United States Patent 6,812,339 (POLYMORPHISMS IN KNOWN GENES ASSOCIATED WITH HUMAN DISEASE, METHODS OF DETECTION AND USES THEREOF) - sequence listing, part 103

SEQ ID NO: 152106 - DNA, 601 bp, Human; identical to SEQ ID NO: 152033

SEQ ID NO: 152107 - DNA, 601 bp, Human; identical to SEQ ID NO: 152034

SEQ ID NO: 152108 - DNA, 601 bp, Human; identical to SEQ ID NO: 152035

SEQ ID NO: 152109 - DNA, 601 bp, Human; identical to SEQ ID NO: 152036

SEQ ID NO: 152110 - DNA, 601 bp, Human; identical to SEQ ID NO: 152037

SEQ ID NO: 152111 - DNA, 601 bp, Human; identical to SEQ ID NO: 152038

SEQ ID NO: 152112 - DNA, 601 bp, Human; identical to SEQ ID NO: 152039

SEQ ID NO: 152113 - DNA, 601 bp, Human; identical to SEQ ID NO: 152040

SEQ ID NO: 152114 - DNA, 601 bp, Human; identical to SEQ ID NO: 152041

SEQ ID NO: 152115 - DNA, 601 bp, Human; identical to SEQ ID NO: 152042

SEQ ID NO: 152116 - DNA, 601 bp, Human; identical to SEQ ID NO: 152043

SEQ ID NO: 152117 - DNA, 601 bp, Human; identical to SEQ ID NO: 38520

SEQ ID NO: 152118 - DNA, 601 bp, Human; identical to SEQ ID NO: 38521

SEQ ID NO: 152119 - DNA, 601 bp, Human; identical to SEQ ID NO: 38522

SEQ ID NO: 152120 - DNA, 601 bp, Human; identical to SEQ ID NO: 38523

SEQ ID NO: 152121 - DNA, 601 bp, Human; identical to SEQ ID NO: 38524

SEQ ID NO: 152122 - DNA, 601 bp, Human; identical to SEQ ID NO: 38525

SEQ ID NO: 152123 - DNA, 601 bp, Human; identical to SEQ ID NO: 152050

SEQ ID NO: 152124 - DNA, 601 bp, Human; identical to SEQ ID NO: 152051

SEQ ID NO: 152125 - DNA, 601 bp, Human; identical to SEQ ID NO: 152052

SEQ ID NO: 152126 - DNA, 601 bp, Human; identical to SEQ ID NO: 152053

SEQ ID NO: 152127 - DNA, 601 bp, Human; identical to SEQ ID NO: 152054

SEQ ID NO: 152128 - DNA, 601 bp, Human; identical to SEQ ID NO: 152055

SEQ ID NO: 152129 - DNA, 601 bp, Human; identical to SEQ ID NO: 152056

SEQ ID NO: 152130 - DNA, 601 bp, Human; identical to SEQ ID NO: 152057

SEQ ID NO: 152131 - DNA, 601 bp, Human; identical to SEQ ID NO: 152058

SEQ ID NO: 152132 - DNA, 601 bp, Human; identical to SEQ ID NO: 152059

SEQ ID NO: 152133 - DNA, 601 bp, Human; identical to SEQ ID NO: 152060

SEQ ID NO: 152134 - DNA, 601 bp, Human; identical to SEQ ID NO: 152061

SEQ ID NO: 152135 - DNA, 601 bp, Human; identical to SEQ ID NO: 152062

SEQ ID NO: 152136 - DNA, 601 bp, Human; identical to SEQ ID NO: 152063

SEQ ID NO: 152137 - DNA, 601 bp, Human; identical to SEQ ID NO: 152064

SEQ ID NO: 152138 - DNA, 601 bp, Human; identical to SEQ ID NO: 152065

SEQ ID NO: 152139 - DNA, 601 bp, Human; identical to SEQ ID NO: 152066

SEQ ID NO: 152140 - DNA, 601 bp, Human; identical to SEQ ID NO: 152067

SEQ ID NO: 152141 - DNA, 601 bp, Human; identical to SEQ ID NO: 152068

SEQ ID NO: 152142 - DNA, 601 bp, Human; identical to SEQ ID NO: 152069

SEQ ID NO: 152143 - DNA, 601 bp, Human; identical to SEQ ID NO: 152070

SEQ ID NO: 152144 - DNA, 601 bp, Human; identical to SEQ ID NO: 152071

SEQ ID NO: 152145 - DNA, 601 bp, Human; identical to SEQ ID NO: 152072

SEQ ID NO: 152146 - DNA, 601 bp, Human; identical to SEQ ID NO: 152073

SEQ ID NO: 152147 - DNA, 601 bp, Human; identical to SEQ ID NO: 152074

SEQ ID NO: 152148 - DNA, 601 bp, Human; identical to SEQ ID NO: 152075

SEQ ID NO: 152149 - DNA, 601 bp, Human; identical to SEQ ID NO: 152076

SEQ ID NO: 152150 - DNA, 601 bp, Human; identical to SEQ ID NO: 152077

SEQ ID NO: 152151 - DNA, 601 bp, Human; identical to SEQ ID NO: 152078

SEQ ID NO: 152152 - DNA, 601 bp, Human; identical to SEQ ID NO: 152079

SEQ ID NO: 152153 - DNA, 601 bp, Human; identical to SEQ ID NO: 152080

SEQ ID NO: 152154 - DNA, 601 bp, Human; identical to SEQ ID NO: 152081

SEQ ID NO: 152155 - DNA, 601 bp, Human; identical to SEQ ID NO: 119373

SEQ ID NO: 152156 - DNA, 601 bp, Human; identical to SEQ ID NO: 152083

SEQ ID NO: 152157 - DNA, 601 bp, Human; identical to SEQ ID NO: 152084

SEQ ID NO: 152158 - DNA, 601 bp, Human; identical to SEQ ID NO: 152085

SEQ ID NO: 152159 - DNA, 601 bp, Human; identical to SEQ ID NO: 152086

SEQ ID NO: 152160 - DNA, 601 bp, Human; identical to SEQ ID NO: 152087

SEQ ID NO: 152161 - DNA, 601 bp, Human; identical to SEQ ID NO: 152088

SEQ ID NO: 152162 - DNA, 601 bp, Human; identical to SEQ ID NO: 152089

SEQ ID NO: 152163 - DNA, 601 bp, Human; identical to SEQ ID NO: 152090

SEQ ID NO: 152164 - DNA, 601 bp, Human; identical to SEQ ID NO: 152091

SEQ ID NO: 152165 - DNA, 601 bp, Human; identical to SEQ ID NO: 152092

SEQ ID NO: 152166 - DNA, 601 bp, Human; identical to SEQ ID NO: 152093

SEQ ID NO: 152167 - DNA, 601 bp, Human; identical to SEQ ID NO: 30766

SEQ ID NO: 152168 - DNA, 601 bp, Human; identical to SEQ ID NO: 30767

SEQ ID NO: 152169 - DNA, 601 bp, Human; identical to SEQ ID NO: 30768

SEQ ID NO: 152170 - DNA, 601 bp, Human; identical to SEQ ID NO: 30769

SEQ ID NO: 152171 - DNA, 601 bp, Human; identical to SEQ ID NO: 30770

SEQ ID NO: 152172 - DNA, 601 bp, Human; identical to SEQ ID NO: 30771

SEQ ID NO: 152173 - DNA, 601 bp, Human; identical to SEQ ID NO: 30772

SEQ ID NO: 152174 - DNA, 601 bp, Human; identical to SEQ ID NO: 30773

SEQ ID NO: 152175 - DNA, 601 bp, Human; identical to SEQ ID NO: 30774

SEQ ID NO: 152176 - DNA, 601 bp, Human; identical to SEQ ID NO: 152030

SEQ ID NO: 152177 - DNA, 601 bp, Human; identical to SEQ ID NO: 152031

SEQ ID NO: 152178 - DNA, 601 bp, Human; identical to SEQ ID NO: 152032

SEQ ID NO: 152179 - DNA, 601 bp, Human; identical to SEQ ID NO: 152033

SEQ ID NO: 152180 - DNA, 601 bp, Human; identical to SEQ ID NO: 152034

SEQ ID NO: 152181 - DNA, 601 bp, Human; identical to SEQ ID NO: 152035

SEQ ID NO: 152182 - DNA, 601 bp, Human; identical to SEQ ID NO: 152036

SEQ ID NO: 152183 - DNA, 601 bp, Human; identical to SEQ ID NO: 152037

SEQ ID NO: 152184 - DNA, 601 bp, Human; identical to SEQ ID NO: 152038

SEQ ID NO: 152185 - DNA, 601 bp, Human; identical to SEQ ID NO: 152039

SEQ ID NO: 152186 - DNA, 601 bp, Human; identical to SEQ ID NO: 152040

SEQ ID NO: 152187 - DNA, 601 bp, Human; identical to SEQ ID NO: 152041

SEQ ID NO: 152188 - DNA, 601 bp, Human; identical to SEQ ID NO: 152042

SEQ ID NO: 152189 - DNA, 601 bp, Human; identical to SEQ ID NO: 152043

SEQ ID NO: 152190 - DNA, 601 bp, Human; identical to SEQ ID NO: 38520

SEQ ID NO: 152191 - DNA, 601 bp, Human; identical to SEQ ID NO: 38521

SEQ ID NO: 152192 - DNA, 601 bp, Human; identical to SEQ ID NO: 38522

SEQ ID NO: 152193 - DNA, 601 bp, Human; identical to SEQ ID NO: 38523

SEQ ID NO: 152194 - DNA, 601 bp, Human; identical to SEQ ID NO: 38524

SEQ ID NO: 152195 - DNA, 601 bp, Human; identical to SEQ ID NO: 38525

SEQ ID NO: 152196 - DNA, 601 bp, Human; identical to SEQ ID NO: 152050

SEQ ID NO: 152197 - DNA, 601 bp, Human; identical to SEQ ID NO: 152051

SEQ ID NO: 152198 - DNA, 601 bp, Human; identical to SEQ ID NO: 152052

SEQ ID NO: 152199 - DNA, 601 bp, Human; identical to SEQ ID NO: 152053

SEQ ID NO: 152200 - DNA, 601 bp, Human; identical to SEQ ID NO: 152054

SEQ ID NO: 152201 - DNA, 601 bp, Human; identical to SEQ ID NO: 152055

SEQ ID NO: 152202 - DNA, 601 bp, Human; identical to SEQ ID NO: 152056

SEQ ID NO: 152203 - DNA, 601 bp, Human; identical to SEQ ID NO: 152057

SEQ ID NO: 152204 - DNA, 601 bp, Human; identical to SEQ ID NO: 152058

SEQ ID NO: 152205 - DNA, 601 bp, Human; identical to SEQ ID NO: 152059

SEQ ID NO: 152206 - DNA, 601 bp, Human; identical to SEQ ID NO: 152060

SEQ ID NO: 152207 - DNA, 601 bp, Human; identical to SEQ ID NO: 152061

SEQ ID NO: 152208 - DNA, 601 bp, Human; identical to SEQ ID NO: 152062

SEQ ID NO: 152209 - DNA, 601 bp, Human; identical to SEQ ID NO: 152063

SEQ ID NO: 152210 - DNA, 601 bp, Human; identical to SEQ ID NO: 152064

SEQ ID NO: 152211 - DNA, 601 bp, Human; identical to SEQ ID NO: 152065

SEQ ID NO: 152212 - DNA, 601 bp, Human; identical to SEQ ID NO: 152066

SEQ ID NO: 152213 - DNA, 601 bp, Human; identical to SEQ ID NO: 152067

SEQ ID NO: 152214 - DNA, 601 bp, Human; identical to SEQ ID NO: 152068

SEQ ID NO: 152215 - DNA, 601 bp, Human; identical to SEQ ID NO: 152069

SEQ ID NO: 152216 - DNA, 601 bp, Human; identical to SEQ ID NO: 152070

SEQ ID NO: 152217 - DNA, 601 bp, Human; identical to SEQ ID NO: 152071

SEQ ID NO: 152218 - DNA, 601 bp, Human; identical to SEQ ID NO: 152072

SEQ ID NO: 152219 - DNA, 601 bp, Human; identical to SEQ ID NO: 152073

SEQ ID NO: 152220 - DNA, 601 bp, Human; identical to SEQ ID NO: 152074

SEQ ID NO: 152221 - DNA, 601 bp, Human; identical to SEQ ID NO: 152075

SEQ ID NO: 152222 - DNA, 601 bp, Human; identical to SEQ ID NO: 152076

SEQ ID NO: 152223 - DNA, 601 bp, Human; identical to SEQ ID NO: 152077

SEQ ID NO: 152224 - DNA, 601 bp, Human; identical to SEQ ID NO: 152078

SEQ ID NO: 152225 - DNA, 601 bp, Human; identical to SEQ ID NO: 152079

SEQ ID NO: 152226 - DNA, 601 bp, Human; identical to SEQ ID NO: 152080

SEQ ID NO: 152227 - DNA, 601 bp, Human; identical to SEQ ID NO: 152081

SEQ ID NO: 152228 - DNA, 601 bp, Human; identical to SEQ ID NO: 119373

SEQ ID NO: 152229 - DNA, 601 bp, Human; identical to SEQ ID NO: 152083

SEQ ID NO: 152230 - DNA, 601 bp, Human; identical to SEQ ID NO: 152084

SEQ ID NO: 152231 - DNA, 601 bp, Human; identical to SEQ ID NO: 152085

SEQ ID NO: 152232 - DNA, 601 bp, Human; identical to SEQ ID NO: 152086

SEQ ID NO: 152233 - DNA, 601 bp, Human; identical to SEQ ID NO: 152087

SEQ ID NO: 152234 - DNA, 601 bp, Human; identical to SEQ ID NO: 152088

SEQ ID NO: 152235 - DNA, 601 bp, Human; identical to SEQ ID NO: 152089

SEQ ID NO: 152236 - DNA, 601 bp, Human; identical to SEQ ID NO: 152090

SEQ ID NO: 152237 - DNA, 601 bp, Human; identical to SEQ ID NO: 152091

SEQ ID NO: 152238 - DNA, 601 bp, Human; identical to SEQ ID NO: 152092

SEQ ID NO: 152239 - DNA, 601 bp, Human; identical to SEQ ID NO: 152093

SEQ ID NO: 152240 - DNA, 601 bp, Human; identical to SEQ ID NO: 30766

SEQ ID NO: 152241 - DNA, 601 bp, Human; identical to SEQ ID NO: 30767

SEQ ID NO: 152242 - DNA, 601 bp, Human; identical to SEQ ID NO: 30768

SEQ ID NO: 152243 - DNA, 601 bp, Human; identical to SEQ ID NO: 30769

SEQ ID NO: 152244 - DNA, 601 bp, Human; identical to SEQ ID NO: 30770

SEQ ID NO: 152245 - DNA, 601 bp, Human; identical to SEQ ID NO: 30771

SEQ ID NO: 152246 - DNA, 601 bp, Human; identical to SEQ ID NO: 30772

SEQ ID NO: 152247 - DNA, 601 bp, Human; identical to SEQ ID NO: 30773

SEQ ID NO: 152248 - DNA, 601 bp, Human; identical to SEQ ID NO: 30774

SEQ ID NO: 152249 - DNA, 601 bp, Human; identical to SEQ ID NO: 152030

SEQ ID NO: 152250 - DNA, 601 bp, Human; identical to SEQ ID NO: 152031

SEQ ID NO: 152251 - DNA, 601 bp, Human; identical to SEQ ID NO: 152032

SEQ ID NO: 152252 - DNA, 601 bp, Human; identical to SEQ ID NO: 152033

SEQ ID NO: 152253 - DNA, 601 bp, Human; identical to SEQ ID NO: 152034

SEQ ID NO: 152254 - DNA, 601 bp, Human; identical to SEQ ID NO: 152035

SEQ ID NO: 152255 - DNA, 601 bp, Human; identical to SEQ ID NO: 152036

SEQ ID NO: 152256 - DNA, 601 bp, Human; identical to SEQ ID NO: 152037

SEQ ID NO: 152257 - DNA, 601 bp, Human; identical to SEQ ID NO: 152038

SEQ ID NO: 152258 - DNA, 601 bp, Human; identical to SEQ ID NO: 152039

SEQ ID NO: 152259 - DNA, 601 bp, Human; identical to SEQ ID NO: 152040

SEQ ID NO: 152260 - DNA, 601 bp, Human; identical to SEQ ID NO: 152041

SEQ ID NO: 152261 - DNA, 601 bp, Human; identical to SEQ ID NO: 152042

SEQ ID NO: 152262 - DNA, 601 bp, Human; identical to SEQ ID NO: 152043

SEQ ID NO: 152263 - DNA, 601 bp, Human; identical to SEQ ID NO: 38520

SEQ ID NO: 152264 - DNA, 601 bp, Human; identical to SEQ ID NO: 38521

SEQ ID NO: 152265 - DNA, 601 bp, Human; identical to SEQ ID NO: 38522

SEQ ID NO: 152266 - DNA, 601 bp, Human; identical to SEQ ID NO: 38523

SEQ ID NO: 152267 - DNA, 601 bp, Human; identical to SEQ ID NO: 38524

SEQ ID NO: 152268 - DNA, 601 bp, Human; identical to SEQ ID NO: 38525

SEQ ID NO: 152269 - DNA, 601 bp, Human; identical to SEQ ID NO: 152050

SEQ ID NO: 152270 - DNA, 601 bp, Human; identical to SEQ ID NO: 152051

SEQ ID NO: 152271 - DNA, 601 bp, Human; identical to SEQ ID NO: 152052

SEQ ID NO: 152272 - DNA, 601 bp, Human; identical to SEQ ID NO: 152053

SEQ ID NO: 152273 - DNA, 601 bp, Human; identical to SEQ ID NO: 152054

SEQ ID NO: 152274 - DNA, 601 bp, Human; identical to SEQ ID NO: 152055

SEQ ID NO: 152275 - DNA, 601 bp, Human; identical to SEQ ID NO: 152056

SEQ ID NO: 152276 - DNA, 601 bp, Human; identical to SEQ ID NO: 152057

SEQ ID NO: 152277 - DNA, 601 bp, Human; identical to SEQ ID NO: 152058

SEQ ID NO: 152278 - DNA, 601 bp, Human; identical to SEQ ID NO: 152059

SEQ ID NO: 152279 - DNA, 601 bp, Human; identical to SEQ ID NO: 152060

SEQ ID NO: 152280 - DNA, 601 bp, Human; identical to SEQ ID NO: 152061

SEQ ID NO: 152281 - DNA, 601 bp, Human; identical to SEQ ID NO: 152062

SEQ ID NO: 152282 - DNA, 601 bp, Human; identical to SEQ ID NO: 152063

SEQ ID NO: 152283 - DNA, 601 bp, Human; identical to SEQ ID NO: 152064

SEQ ID NO: 152284 - DNA, 601 bp, Human; identical to SEQ ID NO: 152065

SEQ ID NO: 152285 - DNA, 601 bp, Human; identical to SEQ ID NO: 152066

SEQ ID NO: 152286 - DNA, 601 bp, Human; identical to SEQ ID NO: 152067

SEQ ID NO: 152287 - DNA, 601 bp, Human; identical to SEQ ID NO: 152068

SEQ ID NO: 152288 - DNA, 601 bp, Human; identical to SEQ ID NO: 152069

SEQ ID NO: 152289 - DNA, 601 bp, Human; identical to SEQ ID NO: 152070

SEQ ID NO: 152290 - DNA, 601 bp, Human; identical to SEQ ID NO: 152071

SEQ ID NO: 152291 - DNA, 601 bp, Human; identical to SEQ ID NO: 152072

SEQ ID NO: 152292 - DNA, 601 bp, Human; identical to SEQ ID NO: 152073

SEQ ID NO: 152293 - DNA, 601 bp, Human; identical to SEQ ID NO: 152074

SEQ ID NO: 152294 - DNA, 601 bp, Human; identical to SEQ ID NO: 152075

SEQ ID NO: 152295 - DNA, 601 bp, Human; identical to SEQ ID NO: 152076

SEQ ID NO: 152296 - DNA, 601 bp, Human; identical to SEQ ID NO: 152077

SEQ ID NO: 152297 - DNA, 601 bp, Human; identical to SEQ ID NO: 152078

SEQ ID NO: 152298 - DNA, 601 bp, Human; identical to SEQ ID NO: 152079

SEQ ID NO: 152299 - DNA, 601 bp, Human; identical to SEQ ID NO: 152080

SEQ ID NO: 152300 - DNA, 601 bp, Human; identical to SEQ ID NO: 152081

SEQ ID NO: 152301 - DNA, 601 bp, Human; identical to SEQ ID NO: 119373

SEQ ID NO: 152302 - DNA, 601 bp, Human; identical to SEQ ID NO: 152083

SEQ ID NO: 152303 - DNA, 601 bp, Human; identical to SEQ ID NO: 152084

SEQ ID NO: 152304 - DNA, 601 bp, Human; identical to SEQ ID NO: 152085

SEQ ID NO: 152305 - DNA, 601 bp, Human; identical to SEQ ID NO: 152086

SEQ ID NO: 152306 - DNA, 601 bp, Human; identical to SEQ ID NO: 152087

SEQ ID NO: 152307 - DNA, 601 bp, Human; identical to SEQ ID NO: 152088

SEQ ID NO: 152308 - DNA, 601 bp, Human; identical to SEQ ID NO: 152089

SEQ ID NO: 152309 - DNA, 601 bp, Human; identical to SEQ ID NO: 152090

SEQ ID NO: 152310 - DNA, 601 bp, Human; identical to SEQ ID NO: 152091

SEQ ID NO: 152311 - DNA, 601 bp, Human; identical to SEQ ID NO: 152092

SEQ ID NO: 152312 - DNA, 601 bp, Human; identical to SEQ ID NO: 152093

SEQ ID NO: 152313 - DNA, 601 bp, Human; identical to SEQ ID NO: 30766

SEQ ID NO: 152314 - DNA, 601 bp, Human; identical to SEQ ID NO: 30767

SEQ ID NO: 152315 - DNA, 601 bp, Human; identical to SEQ ID NO: 30768

SEQ ID NO: 152316 - DNA, 601 bp, Human; identical to SEQ ID NO: 30769

SEQ ID NO: 152317 - DNA, 601 bp, Human; identical to SEQ ID NO: 30770

SEQ ID NO: 152318 - DNA, 601 bp, Human; identical to SEQ ID NO: 30771

SEQ ID NO: 152319 - DNA, 601 bp, Human; identical to SEQ ID NO: 30772

SEQ ID NO: 152320 - DNA, 601 bp, Human; identical to SEQ ID NO: 30773

SEQ ID NO: 152321 - DNA, 601 bp, Human; identical to SEQ ID NO: 30774

SEQ ID NO: 152322 - DNA, 601 bp, Human
aatttctggtttcgagtgaagtcaagatctccgcccctgcgcctgcacacacacctcctgcctaacattctcagctgcaaatgccaaaaaagaaaaaaaaaaaaaacagcaaaagttgggactgccacctatttatttaggtaatctccagccctacacaccccaacccctctctcggactcattgctcattacagtgttggttgtaaccgttcccagcgcctcctgcgggtggacaggtcgcgctagggtctcccttgctgcctcaagaaggcgagctcaggggactctgcgttttaaartgggttccaaagcggcgcgctctgtcggcccagcgggcttgcggcaccagaggtggtctgcagccgcgcaaggattcccacggtcgttctgggctggtgcagaagctggtgctcccgcacccagcggccagcaggctcggcgcagcacatctccccaccccacccccacacacccccgtggggtgcgtcgatcctgtagctcagagggagaagctacttagaacttcgtgaagcacagaggatctggagcgagccccgcagctgggatcagtggtcttaagttgaacccgcttacaggaa

SEQ ID NO: 152323 - DNA, 601 bp, Human
ccggctgccccgccgcccgagcgcgccccacacaaaaggcgccgagagccccgcgccacccaggactccagtcacggcgccgacgctccccggagcgcgggagcccggctcggatccatccgaacttgaaccaccgattcgcgcggcgccttcagctggtcgaacccacggtctctatcctgccgcgactggttatgattcaaagttctttaaaaatgaaaaaccccaaaaaaggaaaaaggaaaaagtatgtgtgagtgtgtgggtgcgtgcgtgttccttaatccgtgtctccccctcytttcttagcggcggcttcgcttgagcttctaataaccgcgctgggcagcgttcctggagcctcctaatagcagatattcatgactattaatattacacgaatacttaataagggaagaatgcctggaaatcgagcgtgaagcggagaggcaactcgcgccggagccggctctcaatgcagtccattgacgggagtctcagtgtagcaaatcggagtggggagagggagcgcgagagacaaaaagcgagcgagagagggagcgggcgagcgcgcggggggccgcggcgcggcgtctggcga

SEQ ID NO: 152324 - DNA, 601 bp, Human
agagaggtgcaccccggggctgtggccccccccccccgccccttccaccccagccccaaagggcagaagaaacgcctgactttaggtttctctattgcaattcccttgcaaaacaagcgaagagagttgattccagagaccgcgaaccctcggcggttcggccgcaggtcccgagggtagggggcacaccgcgctgcacttttcctgcagacagtttaagcatcaaatgttgagaacatctcggggacaagtgaagactcaaggaaatcaagatgaacgtggggagaaacacgccttgggaagccgcggcgaggtaggtctgcgtgctcggagaggtcgagcgggggctggggtagggggtaatgcactcgatttagggatggaaaagagcgagagaaaggcggaaggtggggtgggggatgcaaatggagagggtgtcctgaaggaaagctgggcgtgaaacccgaggtttcgggcagctccacggcaccaggtttccagaatccaattcctaaagaaacagcaacgggggtggggatgggactcaccatggctgaaaaactgtgaactaacatctgcgaagagtctggggtaacgagtc

SEQ ID NO: 152325 - DNA, 601 bp, Human
attgggttgctctgcaccacattaaaatcattttgaaagcttcctaaaatgtgctttcaaaaactgagaagcttggccccaagacatttaaaggagggaaacctaggaatagtacagaagttcataggagataaacgcctgttaaactgtaaagcaccccctacgttcagttattattgcaactcttgtggcaggttggaaggttttgatttcccaactctctaaagaagaaccacaaacaaacacagccccatctctagggtttgaggtattgagttcaactgattcctgtatattttcyctgctgttacaatcacaccaatcccaatggggtctttaaaactgtctttgcaagatatgctgttaggttgttccgagtaaccaaagttatcatcactctcacgtttcttgctctggctctagccccaaagggaaattcgtttcgccaactgtttacgtgccatgtcaccagcctaactggaaatgtcaaaagctgatatcagccctaaaagtttcactgatttcagagacaatggaggcagttctaaacagatgtctaaatagaatcccataatcagaaagtggttaagataaattgttt

SEQ ID NO: 152326 - DNA, 601 bp, Human
ctgcaggcagatttaatcctattttgtccagtttttctcttaaagatcttcctccatttttagacttcgccctgtttcacaaatatatgcgagaaagggatttagaaaacattgggttgctctgcaccacattaaaatcattttgaaagcttcctaaaatgtgctttcaaaaactgagaagcttggccccaagacatttaaaggagggaaacctaggaatagtacagaagttcataggagataaacgcctgttaaactgtaaagcaccccctacgttcagttattattgcaactcttgtgrcaggttggaaggttttgatttcccaactctctaaagaagaaccacaaacaaacacagccccatctctagggtttgaggtattgagttcaactgattcctgtatattttctctgctgttacaatcacaccaatcccaatggggtctttaaaactgtctttgcaagatatgctgttaggttgttccgagtaaccaaagttatcatcactctcacgtttcttgctctggctctagccccaaagggaaattcgtttcgccaactgtttacgtgccatgtcaccagcctaactggaaatgtcaaa

SEQ ID NO: 152327 - DNA, 601 bp, Human
taaactagacctctttctgtgctcgtatatattctttttttttttgagatggagtctccttctgtcacccaggctggagtgcagtggtgcaatctcagctcactgcaacctctgcctcccaggttgaagcgattctcgtgcctcagcctcctgagtagctgggattacatgtgtgcaccaccatgcctggctaatttttgtatttttagtagagacagggtttcaccatgttggccaagctggtctcaaactcctgacctcaacccaaagtgctgggattgcaggcatgagccaccgcacrcagcctgtgtgcacgtgtgtgtgtgtgtgtgtgtgtgtgtgtgtgtgcgtgtgcacgtatatatatatatttttagacggagtctcactgtatcacccaggctggagtgcggtggcgcgatctcagctcactgcaacttccacctcctgggttcaagcaattctcctgcctcggcctcctgagtagctgggattacaggcgcgtgccaccatgcctggctaagttttgtatttttagtagagacagggtttcaccatgttggccaggctggtctcaaactcctaacctcatgatccgccc

SEQ ID NO: 152328 - DNA, 601 bp, Human
acatggagaaaccccgtctctactaaaaatgcaaaattagccaggcgtggtggtacatgcctgtaatcccagctactcgggaggctgaagcagaagaatcgcttgaacccaggaggcagaggttgtggtgagctgagatcgcgccactgcactccagcctggcaacagagcaagaatccatctcaaaacaaaacaaaacaaataccatatttttgaaggataaaacaaataccatatttttgccactcagaaaaaaatgatggacattttgtcatataaaaccagacagtaataaccatcygtgggactgtacccaagacccaacaccccttctgattcgcctaccctcctccccagaacccatggctatcatggattttgggtgtatctttccaggcctttaaaaatatttttgtatatggatgtatttgtatataataaagtatttctttgtgtgaatttacataatcatttaatctacaaatgtgggctatttcagctcattttgtctaataacactcatttcttaggtttctgtcttatagcagtagtaagtatccccaatgcaatcctaatcagcaggactgctagcaggcatttg

SEQ ID NO: 152329 - DNA, 601 bp, Human
ctttccttctgcctcctaatatagagactggaagagtaaatactcactctctcagcctcctttggaagagagaccacgtgacccaatactagccagtaagatgtaaggggatgtccttgaggacttctggggaagaattatcactagctgataaaagatgagaagagtttgctcgtattattctgccctcttccctccttgaacatggacgtaatgcctggaggtgaagtagccataaggtggtcattaggtgacacatttgaggacaaaaacaatgctaaccgctcagcatgaaaatcayagaaaacatctgaatttcttgggtacaatgttgagccattgaaagagctctggaatcatcacactccagacttcttgatacgtgcttctgcttctttagatctttcccttggtttcagatattttctacattctcctggtttctaccctatttctctggtggctcctcagacttttttgtaagatcctattccagggcccatcctttatatgccatggtttctcggtgccctaaatgaggacctcttttcttctccctctaaagagtttcaattgccatctgtagactaaccattccaaa

SEQ ID NO: 152330 - DNA, 601 bp, Human
caccgtcgctaccctcaaaacttctttatacaacctctttcttgttcaacttgtggctattcctacaaccacctgtgtggcgtggtttgcctcctcatccagcttggccccaccatcagcctttcacccactacactctcaagatcacacacacgttctgaacatccccttctcccaccgttccactgctcctgccttgtcatcctccagtctcccctctcctgccttgtcatcctccagtctcccctctccatacagatgggtggaggtggaaagcaaagtcatgaaaatgctcccagcrgctccactttcacattcgtccatgtaatttcaggcggactcttcctgacactgggcaacccctttgtggctttcttaacaactcagtaactcatccttcacaactctccaaagctccatgcctccactgccgtacttcccgctactccttgtcccactgcagtctggcttccactattccactggaacagtgctcaccgtggccgccagttatgtcatattccccaaacccaaggaacaccacagccgatgatattgttgaaatatcacaaggccatttccagcccctttccttctgcct

SEQ ID NO: 152331 - DNA, 601 bp, Human
cggctcttttgtttaaaaggtttttagaatgaaaacaccttccaggtaatcaatttccctttaaggggacatgtttactgcccactctgaaaattaagaataggcagctcttcttcagctactccacaaaatgtattcaatgtagaacgtatttatttatttatttagagacagagtctcactctgttgcctgggctggaatgcagtggtgtgatctcagctcactgcaacctccgcctcctgggttcaagtgattctcctgcttcagcctcctgagttgctgggattacaggcacacacsaccacacccggctaatttttgtatttttagtagagatgggatttcaccttgttggccaggctggtctcaaactcctgacctcaggtgatccaccccacttggcctcccaaagtgctgggattacaggcatcagccaccacacccggcctggaatttatttttaattttaggggaaaagtatcgatggatcttaaagcggtatctaacaagttatacctagaatatttatagcctaaattggaaatgcctaaaattttatatcaccaagcaaaagattgataggatattatgggatgtgaa

SEQ ID NO: 152332 - DNA, 601 bp, Human
ctcaacgtaattctgaacttgtttacttcctacttgttaaattccatatggaacttgttaaattccatatctaataacacatggaacttgttaaattccatagctgaacttctctaattccaatagaaacccccactcccagcccccgacaccggctcttttgtttaaaaggtttttagaatgaaaacaccttccaggtaatcaatttccctttaaggggacatgtttactgcccactctgaaaattaagaataggcagctcttcttcagctactccacaaaatgtattcaatgtagaacktatttatttatttatttagagacagagtctcactctgttgcctgggctggaatgcagtggtgtgatctcagctcactgcaacctccgcctcctgggttcaagtgattctcctgcttcagcctcctgagttgctgggattacaggcacacacgaccacacccggctaatttttgtatttttagtagagatgggatttcaccttgttggccaggctggtctcaaactcctgacctcaggtgatccaccccacttggcctcccaaagtgctgggattacaggcatcagccaccacacccggcc

SEQ ID NO: 152333 - DNA, 601 bp, Human
aggggcagaaatttacttttattttaattgacattaatgttatgatgatttcggcctggaacataagaggcattcaataaatatgttttgagaaagggaaaaatatgattaaagaataattcaagtaacatcctcagaccttgagcgagagtgtgtgtgtgtgtgtgtgtgtgtgtgtgtgtaagaatcaaagagaaatcaacatcattacttcggaaaattatttctaagtatttcagagtttgttgttgaacatttctcactttaaaagcaggcaaaatggatgttaatctcccagacrtgaccagaaccaccaccaaaacattatctccccaagcccagggcggaagaccaaagctctccctttacagattctgcccacacatatttaaaaattgtgaatttccttgggattggtaacacatcaagtcttatcactgacttgtgcattctaatgactgagctttttagatcctttcttgaaagcaacttcattcctttctccattctttcattaaccttcacaagatgcttgggagagcaaccaagataattttctcaataatgcccaaggccagctttattattgagtaataaacta

SEQ ID NO: 152334 - DNA, 601 bp, Human
atcttctcacctcagcctccaagtagctaggactacaggtgtgtgccaccacacctggctaattttttaatttttttgtagagatggagtctcactatgttgcctaggctggtctcaaattcctgggctcaagtgatcctcccacctcagcctcgcaaagtactggattaaaggcaggaactaccacatccatccagatttatatatatttcaaaaatagatgaaaatttaatatttcatgaatttacatgtatttcatttttttcttcaacaagggtatcttgatatttcatgtaagtayatatcatttcaatattttaaaggacaaaatttattagaggctgaaaattaagattacccataatcccaccacctgattaagaaacttttaatttttcagtattctaatccagtcctaatccatctgcatacataacttttatattaggaatgaaagtcacatacacacaatttggtttgttttttcacttacaagcgttttcataacccttataattatcacctttaatggtaataattccatcaatattatatacaataattaccaacctattttcacactaattatttattttaaata

SEQ ID NO: 152335 - DNA, 601 bp, Human
aggaatccattatgaataattaaaatagcagatgtcccttatttccatataattaatacattactgctgtttgccaataaagtgtagtatatcattacaggatttagacttttaaaagaccccaatagtttacatatggtgcaaataaaaagtttttttttaatgttcttaaaacattctaaacataccctttttataagtttaagaagtgttcttaaaatatttatatggaatcctgcatagcatttttggaaggcaaataattcctgtagcagttaagaaaataaaaaaaacaaaatayaaactacaggaggaggatgggtgtgatggctcctgcctgtaatcccagcacttccggaggctgaggttggaggatcacttgagtccaggagttcaagaccagcctgggaaaaatggcgaaacctcatctctacaaaaaagaaaaaaattagctgggtgtggaagcgtgcgcctgtagtcccagctactagggaggctgaggtgggaggatcacctgagcccaggaagtggaggctgcagtgagccatgatggcaccactgcactccagcctgggcatcagagtgagatcctgtctcaaat

SEQ ID NO: 152336 - DNA, 601 bp, Human
tgtgccatgatacccagctaatttttgtatttttggtagagataggttttcaccacgttggccaggctgctcttgaactcctcacctcaagtgatccgcctgccttggcctcccaaagtgctgggattgcaggcgtgagccaccacgcccggccaaacaactattttaaaatatctatttcttgaagtattacatctgagatgcttagcagcaagaattatgtggctttcgtaaaaacgtctaatcatccttataggctggtttcccaaattactatgtagccaactctacagtcaactgytgattattcatgttatttctttcagtcacaatttttaaatcgtaatcgaacttcctccttcaatcccttatgcttcagacgttgctgacagcataaatcaacccaggcaaatgtcaagtgttaccatgctgaccagagtttaaaacaattaaaaatcaggaatccattatgaataattaaaatagcagatgtcccttatttccatataattaatacattactgctgtttgccaataaagtgtagtatatcattacaggatttagacttttaaaagaccccaatagtttacatatggtgca

SEQ ID NO: 152337 - DNA, 601 bp, Human
gatgagatttgtcttaagggaggctttttctaagggcagtctacagcattctggttatatccaaatggcttgggttccaaaggccttgggaggcagggagactgcaggtgatcacttgaagagggttttcatgtagctttggagctgggaagactttcttttatctttttctttttttttttttttttttgttttgagacggagtcttgctctggagtgtagtggcgcaatctgggctcattgcaacctccgcctcctgggttcaagcgattctcctgcctcagcctctggaatagctggkattacaggcgtctgccaccacactcggctaattgtttgtatttttagtagaaactggattttgccatgttggccagggtggtctcaaacttctgaccttgtgatccacctgcttcaccctcccaaagtgctgggattacaggtgtgagccaccacggccagctggggttgggaagcctttttaagcctaaatgtttttaatcacttcaaagccagagtgggctctgtttgtgacatctgtttaacagttttgtaatctgagtttatccagtacttcttactctaaatagtaagtaacatc

SEQ ID NO: 152338 - DNA, 601 bp, Human
agaaagaaaagaaaaagaaaacccagggggaaaagaacaaacattaaagccctcctggcagatgagatttgtcttaagggaggctttttctaagggcagtctacagcattctggttatatccaaatggcttgggttccaaaggccttgggaggcagggagactgcaggtgatcacttgaagagggttttcatgtagctttggagctgggaagactttcttttatctttttctttttttttttttttttttgttttgagacggagtcttgctctggagtgtagtggcgcaatctgggctcaytgcaacctccgcctcctgggttcaagcgattctcctgcctcagcctctggaatagctgggattacaggcgtctgccaccacactcggctaattgtttgtatttttagtagaaactggattttgccatgttggccagggtggtctcaaacttctgaccttgtgatccacctgcttcaccctcccaaagtgctgggattacaggtgtgagccaccacggccagctggggttgggaagcctttttaagcctaaatgtttttaatcacttcaaagccagagtgggctctgtttgtgacatctgt

SEQ ID NO: 152339 - DNA, 601 bp, Human
ccagcctgggcaacagagcaagacactgtctcaaaaaaaaaaaaaaaaaagaaagaaaagaaaaagaaaacccagggggaaaagaacaaacattaaagccctcctggcagatgagatttgtcttaagggaggctttttctaagggcagtctacagcattctggttatatccaaatggcttgggttccaaaggccttgggaggcagggagactgcaggtgatcacttgaagagggttttcatgtagctttggagctgggaagactttcttttatctttttctttttttttttttttttttgktttgagacggagtcttgctctggagtgtagtggcgcaatctgggctcattgcaacctccgcctcctgggttcaagcgattctcctgcctcagcctctggaatagctgggattacaggcgtctgccaccacactcggctaattgtttgtatttttagtagaaactggattttgccatgttggccagggtggtctcaaacttctgaccttgtgatccacctgcttcaccctcccaaagtgctgggattacaggtgtgagccaccacggccagctggggttgggaagcctttttaagcctaaa

SEQ ID NO: 152340 - DNA, 601 bp, Human
agcgtagtggctcgatctcggctcaagcaatcctctcggcccactaagtagctgggaccacaggtgcatgccaccactcccacctaatttttggtatttttgatagagacagggttttgccacgtcacccaggctgagaagagcactttttaatcaggcttgagtcagtgcagctgacttcttgagaaaaatcacttgtttaaaaagtccattcaataaaaatggaactccacacatcagaactaatttcttcatttaaaattattttatctaatgttcagttttcctcaatagctgtgtygttgcaaaatcccaataattataatgtttatattagcaattcaatctataaaataaatggttatgaagctaaaagggaaaccaaagaaaatgaggcagaaagcccagtgggggccaggcgtggtggctcacgcctataatcccagcactttgggaggccgaggtaggtggatcatgaggtcaggagtttgagaccagcctggccaatatgatgaaaccccgtctatactaaaaataccaaaattagccgggcatggtggtgtgcgcctgtagtcccagctactcaggaggctgaggcaga

SEQ ID NO: 152341 - DNA, 601 bp, Human
catacaaagcaagttttctggtttcatgtccctatgaaaaaagccttgatgatatacggagaaaaaaaaatacagtaaatcattacgtttaaacatagctttatttgatttataaacaaaatataaatgaaccccctcttttataattcaaaacatcatcttaggaaaaaagtaaaccatatttattgtctaagaagtaaatggggcgtagggaccctgcttttaaaatgctttggcaagaaagttcacacagtgtatgagataattaaaaataaccacccatttaacatttatttttatytgtgactccagtgggtgttcaggcactgggctaggtattaccacactatgattatctccattcatttgcacaacaacctgaaggaggtactgttatcactattgtgcaatagaggaggaggttgagggccagagtgaagtcacctaattaacgtgtgagaagtgtttttgtttttaagataggtcttgctctgttgtccaggccagagcgtagtggctcgatctcggctcaagcaatcctctcggcccactaagtagctgggaccacaggtgcatgccaccactcccacctaatttttgg

SEQ ID NO: 152342 - DNA, 601 bp, Human
atcagcacccagaaggccccttgtgcactagtccaggcactacacacatccccaccccatagaactgcttgctatcctgactttcatggcacagattagttttctctttttttgtactttgcataaatgaaatcatatggtatgtgctctttttctctttgggctcttgatctcaacattgtctaagattcgtccacattgctgcatgcagtcatagacccttcgttctcattgttgcaaagcattccactgggtgagtatacgatgctactgttcatggacgtttgggtggcgtgcagtwgagaggattcatgtcttctggtgaacacgtgtatgtctttctgttggtgatccataatatttttaacttgtttatctgtctattggctgtcatgtaagcagcataaggcagagatttttcttttctttttttatttcactgctgtgttctctgtgcctaaaatgatgtttggcacatagtaggtgttcaataaatatttgttgaatgaatgaatgagtgaataaatgaaattctttttcctttttttttcagtgatcagaatagcaataaaccaatccttcgctttctttaaagaatata

SEQ ID NO: 152343 - DNA, 601 bp, Human
gcgaaactccatctcaaaaaaaaaagaaagacatgctatcagcacccagaaggccccttgtgcactagtccaggcactacacacatccccaccccatagaactgcttgctatcctgactttcatggcacagattagttttctctttttttgtactttgcataaatgaaatcatatggtatgtgctctttttctctttgggctcttgatctcaacattgtctaagattcgtccacattgctgcatgcagtcatagacccttcgttctcattgttgcaaagcattccactgggtgagtatacsatgctactgttcatggacgtttgggtggcgtgcagtagagaggattcatgtcttctggtgaacacgtgtatgtctttctgttggtgatccataatatttttaacttgtttatctgtctattggctgtcatgtaagcagcataaggcagagatttttcttttctttttttatttcactgctgtgttctctgtgcctaaaatgatgtttggcacatagtaggtgttcaataaatatttgttgaatgaatgaatgagtgaataaatgaaattctttttcctttttttttcagtgatcagaata

SEQ ID NO: 152344 - DNA, 601 bp, Human
tttttataaggacatcagtcttactggattaagaccagccaggctgtggtctgacctcatcttaatctgattacatttgcaaagaccctatttcaaaataaggtcacattcgcaggtaaccagggcggatccctcatgaaaggcttggtgctgttctcacgtagtgaatgagttctttttcaggcaagatgaaattagttcctgagagagtgggttgctccacggcaagcttcctcctcttgtttgttcccttctcgcacgtgcccatttcccctttgaccttcaccccgccatcttttctttttttttttttttgagacggagttttgctcttgttgcccaggctggagtgcaatggcgcgatctcgggtcactgcaacctccacctcccgggttcaagtgattctcctgcctcagcctcccaagttacaagtatgtgccaccatgcctggctaattttttttgtttttgttttttgtttttgagacagagtcttgctctgtcacccaggctggagtgcagtggcgcgatcttcgctcactgcaagctccgcctcccaggttaacgccattctcctgcctcagcctcccaagtagctggg

SEQ ID NO: 152345 - DNA, 601 bp, Human
agtgagaacttactatactttgacgaatatttttacaagctttattgatatataattcacataatatacagttgatccatttaaagtgtacatcacactgctttctcccaaggtgccttcacgtgtcttccctcttccatctctctgtctgccttctttttataaggacatcagtcttactggattaagaccagccaggctgtggtctgacctcatcttaatctgattacatttgcaaagaccctatttcaaaataaggtcacattcgcaggtaaccagggcggatccctcatgaaaggcytggtgctgttctcacgtagtgaatgagttctttttcaggcaagatgaaattagttcctgagagagtgggttgctccacggcaagcttcctcctcttgtttgttcccttctcgcacgtgcccatttcccctttgaccttcaccccgccatcttttctttttttttttttttgagacggagttttgctcttgttgcccaggctggagtgcaatggcgcgatctcgggtcactgcaacctccacctcccgggttcaagtgattctcctgcctcagcctcccaagttacaagtatgtgccacca

SEQ ID NO: 152346 - DNA, 601 bp, Human
aatagatatggaaataagtgccatctgatatattaagaaaaaaagtagaaaaactatgttacaaagcattatattcagcatctattcacaaggaagcacagaaaacaaaagatgaacaggattatatcctgagtagtggagtttttttttatcagtttgaaagtactgatatcctcaactgactcctcttctgtagtcaactatatttattgagtggagttttgctcttgttgcccaggctggagtgcaatggcgcagtcccggctcactgcaacctccgcctcttgggttcaagtgattmtcctgcctcagcctcccgagcagcggggattacaggggcacaccaccatgcccagctaatttttgtatttttagtagagacggggtttccccatgttggccaggctggtctcgaactcctgacctcaggtgatcagcctgccttagcctcccgaagtgctgagattacaggcatgagccactgcacccagcctaacaatatttttaattgagaaaaatactcaatttacaagagcaaagtgagctggtgagtccaacacaaagtctgctaaatggaagacactctcaattctcttttttt

SEQ ID NO: 152347 - DNA, 601 bp, Human
atgtctatgaaatgtccatcaagcctaagacaggaactcaactgaatagatatggaaataagtgccatctgatatattaagaaaaaaagtagaaaaactatgttacaaagcattatattcagcatctattcacaaggaagcacagaaaacaaaagatgaacaggattatatcctgagtagtggagtttttttttatcagtttgaaagtactgatatcctcaactgactcctcttctgtagtcaactatatttattgagtggagttttgctcttgttgcccaggctggagtgcaatggcgcrgtcccggctcactgcaacctccgcctcttgggttcaagtgattctcctgcctcagcctcccgagcagcggggattacaggggcacaccaccatgcccagctaatttttgtatttttagtagagacggggtttccccatgttggccaggctggtctcgaactcctgacctcaggtgatcagcctgccttagcctcccgaagtgctgagattacaggcatgagccactgcacccagcctaacaatatttttaattgagaaaaatactcaatttacaagagcaaagtgagctggtgagtccaa

SEQ ID NO: 152348 - DNA, 601 bp, Human
cacacctggctaatttttttttgtggagacggggtttcactatgttgcccaggctggtcttgaactcctgggctcaagtgatcctcctgcctgggcttcccaaagtgctgggactacaggcatgagccaccatgcccgcctttataaattttacaatattaagctcttgtctggttttagatcctgatggtgatgttgctgtgatgatatctgggttaactctgaacaaataaggaaaagtgctttacaaagaggctgactgcgaacaaagatccttgtcgtgtatattacccattgcatmcaatgttaaaaatgcacatatctgggaaatgacaattacattaaagctttaatatctacatttacttgtgtaatgttaactacaaggcacttactaatttaattaggatgtcattatatacacacttataaagcacatttcagaaagaaaggtgtagatgaaatatagttaattgaaaagcactcagttcaagaagtcaaatatccacaggggagatataaaaaaggaaacaagaaacggttaagaaaaaacaaggttcaagacaccaggggttaacaggtgatgccaatggccagccac

SEQ ID NO: 152349 - DNA, 601 bp, Human
cagactcctgagtagctgggactacaggtgcgcaccatcacacctggctaatttttttttgtggagacggggtttcactatgttgcccaggctggtcttgaactcctgggctcaagtgatcctcctgcctgggcttcccaaagtgctgggactacaggcatgagccaccatgcccgcctttataaattttacaatattaagctcttgtctggttttagatcctgatggtgatgttgctgtgatgatatctgggttaactctgaacaaataaggaaaagtgctttacaaagaggctgactgygaacaaagatccttgtcgtgtatattacccattgcatccaatgttaaaaatgcacatatctgggaaatgacaattacattaaagctttaatatctacatttacttgtgtaatgttaactacaaggcacttactaatttaattaggatgtcattatatacacacttataaagcacatttcagaaagaaaggtgtagatgaaatatagttaattgaaaagcactcagttcaagaagtcaaatatccacaggggagatataaaaaaggaaacaagaaacggttaagaaaaaacaaggttcaag

SEQ ID NO: 152350 - DNA, 601 bp, Human
aatcatggctcactacagcctcaccctcccgggctcaaaagatcctcctacctcagactcctgagtagctgggactacaggtgcgcaccatcacacctggctaatttttttttgtggagacggggtttcactatgttgcccaggctggtcttgaactcctgggctcaagtgatcctcctgcctgggcttcccaaagtgctgggactacaggcatgagccaccatgcccgcctttataaattttacaatattaagctcttgtctggttttagatcctgatggtgatgttgctgtgatgatayctgggttaactctgaacaaataaggaaaagtgctttacaaagaggctgactgcgaacaaagatccttgtcgtgtatattacccattgcatccaatgttaaaaatgcacatatctgggaaatgacaattacattaaagctttaatatctacatttacttgtgtaatgttaactacaaggcacttactaatttaattaggatgtcattatatacacacttataaagcacatttcagaaagaaaggtgtagatgaaatatagttaattgaaaagcactcagttcaagaagtcaaatatccaca

SEQ ID NO: 152351 - DNA, 601 bp, Human
tgtgttttttttgagacaggatctggctctgttatccaggttggagtgcagtggagcaatcatggctcactacagcctcaccctcccgggctcaaaagatcctcctacctcagactcctgagtagctgggactacaggtgcgcaccatcacacctggctaatttttttttgtggagacggggtttcactatgttgcccaggctggtcttgaactcctgggctcaagtgatcctcctgcctgggcttcccaaagtgctgggactacaggcatgagccaccatgcccgcctttataaattttrcaatattaagctcttgtctggttttagatcctgatggtgatgttgctgtgatgatatctgggttaactctgaacaaataaggaaaagtgctttacaaagaggctgactgcgaacaaagatccttgtcgtgtatattacccattgcatccaatgttaaaaatgcacatatctgggaaatgacaattacattaaagctttaatatctacatttacttgtgtaatgttaactacaaggcacttactaatttaattaggatgtcattatatacacacttataaagcacatttcagaaagaaagg

SEQ ID NO: 152352 - DNA, 601 bp, Human
gcttccatgacagattccttcataactagtctgtcgcaggtctgaatttttatcattgcagattgattccttgttgcaacctcagggttcttcatttgaaccacaaaactcagaaaatcattggtgtggctatttctgcatttctcccaatgatattatatgcctagaaattaatttattacatacgctggatgcctaggactttgtgtttaattctcttagtaaaatcctggttgagaatagagctgcctttgtaaatgaaaacatccctgatattacaaaacctaaacatttttaaagrtctaacaggaagactcctcttacctggcttgctgtcggtcgtttctttggatcccaattcaacatttcggtcatgagctgaatagcttcattactggcattgggaataagagtttttaagtttataggaacacactggggaaaacggaagttcatagaggatgccagctggtatccttctggccagtcactctgtttcaggaatatataagtgcaggtggggagggcaaaacaaattgtttttagtaatccatttaaaaaacacagcagtaatataaacatcatttatgtttgaacattt

SEQ ID NO: 152353 - DNA, 601 bp, Human
gtcaattcttatgccagtacttccactgttaccatcatcaatttaaagattactttaatatctgatggggcaagctgtccatccctatcaccgctctctaattccttattcttgttttaacatgtcttgactatcctttcccatttgttcttccagatgacatttagaaaacattttctcaagattaattttaaaaaaagcaaaataaatttttgtaattttcacatggaatttatatttaaatgatgagaatacaataaagtttattattgcctttttattgaagccttgcagacaaaarcactgggtttaaaggccctagacttggaatacatctgtagatatgtcaggtgtagtcacaaaggaacaaagcctgggtgccacaatgctgccctcttgtggcagccagaggctgcacactccagtcccagcaagggatgatactgttgtataaagtgaaccagaatcccacccctaaactgtaaaggcagcataggaaagtctactatgtggaatgattcatgagatgcctttttgcttccatgacagattccttcataactagtctgtcgcaggtctgaatttttatcattgcagattg

SEQ ID NO: 152354 - DNA, 601 bp, Human
aatgtaacccttctgtgagttgtaaagtatggtgagcagtaaggacctcaatttatttttttccctaagagctaatgaattttcccagtatcacccactgagccgtcctcccctctttgtgatgccacgtttgtttaccttgtgctgactcatacgttctgcaacattcagctatttgtcaattcttatgccagtacttccactgttaccatcatcaatttaaagattactttaatatctgatggggcaagctgtccatccctatcaccgctctctaattccttattcttgttttaacatrtcttgactatcctttcccatttgttcttccagatgacatttagaaaacattttctcaagattaattttaaaaaaagcaaaataaatttttgtaattttcacatggaatttatatttaaatgatgagaatacaataaagtttattattgcctttttattgaagccttgcagacaaaagcactgggtttaaaggccctagacttggaatacatctgtagatatgtcaggtgtagtcacaaaggaacaaagcctgggtgccacaatgctgccctcttgtggcagccagaggctgcacactcca

SEQ ID NO: 152355 - DNA, 601 bp, Human
catgcctgtaatctcagctactcgggaggctgagggtgggagaatcacttgaacccaggaggcagaggttgcggtgagccgagatcatgccattgcactccagcctgggcaacaagagtgaaactccatctcaacaacaacaacaaaatgtaacccttctgtgagttgtaaagtatggtgagcagtaaggacctcaatttatttttttccctaagagctaatgaattttcccagtatcacccactgagccgtcctcccctctttgtgatgccacgtttgtttaccttgtgctgactcataygttctgcaacattcagctatttgtcaattcttatgccagtacttccactgttaccatcatcaatttaaagattactttaatatctgatggggcaagctgtccatccctatcaccgctctctaattccttattcttgttttaacatgtcttgactatcctttcccatttgttcttccagatgacatttagaaaacattttctcaagattaattttaaaaaaagcaaaataaatttttgtaattttcacatggaatttatatttaaatgatgagaatacaataaagtttattattgcctttt

SEQ ID NO: 152356 - DNA, 601 bp, Human
tatttacttaagggaagcagtgatcattgtagagaatgagaaacgtatagagttctcaagacaaaaataaaaatttaacacccagagacaaccaagactaacattttttatacttttcggtatttttttctcatcatataaaatatatttttcaaaaacaaaatcatattatttgtataatagtattttagcatgagatttctcccaaattatttaaaaattttattttacaaattcactgttaatgctggcagtatattccaaattaaagatgcacataacctaagtttagaaacattatttatttatttatttatttatttatttatttatttatttatttttgagacagagtctcactctgtcacccaggctggagtgcagtggcacgatcttggctcattgcaacctccgcctcctgggttcaagctatccttctgcctcagcctcccgagtagctgagattacaggtgtgtgtcaccatgcctagctaattttttgtatttttagtagagatggggttctgccacgttggccaggctgatctcaaactcctgacctcaagtgatccgcctgcctcggaaagtgctgggattacagg

SEQ ID NO: 152357 - DNA, 601 bp, Human
ggttggtggggcagttggggactggaaggaaatagatacagtgctgtataagaccgatttccatcctaaaatgccataatgcaaacacatttgggagtgtatacccagtgggacagctaaaatactacagcaactgaagagctcctggagctgaacaaaagatggaagaaaaagttttatactatgcctgacactttaaaaacctattctggccaggtgcggtggctcaggcctgtaatccaagcactttgggaggccaaggagggtggatcacctgaggtcaggagttcaagaccagcckgaccaacatggagaaaccccatctctactaaaaatacaaaattagctgggcatggtggcacatgcctgtaatccgagctactcaggaggctgaggcaggaggattgcttgaacctgggaggtggaggttgtggtgagctgagatcacaccattgcactccagcctgggcaacaagagcaaaactctgtctcaaaataataataataataataataaataaaaacccattctctccatgttccttagcatttaagaacactgtaaaatgaaagtactgttaaaaattcttaagatttagga

SEQ ID NO: 152358 - DNA, 601 bp, Human
tgtggtggaaaatcagtcatcataatctttaatcatgtactgaatgcctttcatgcacaagctactatctatgtaagacactaacagtccccattctcaaggagcgttccatacacgtaagggcataacatatatacacatttaaaagcatgaacaaaaatgggcggtacatgccaaaaatatgataggtgttcagaggagagatctctgtgaactaggttggtgagagacttgaatatttaggatctgagttgactcttcattgacaggaaggatctggaaacctgagacttggctatgtctctttgggcaagtgacttaacttctcaaagccttagtgtcctccttaagtggggacagccttaatgagaaggacactaaggctggcatgtgccagcatcttttactcttccccctccttgaatgcagacacgacatccaaaggaacaccagtcatcctgtggccacaggaatgaaagccacctgctcagggtggtggagcgggaagccagcagcagcctgcctcctctgcaagcttcatgagctccagctacccaccacccgatttcttgttatctgagaacaacaatccctattgttt

SEQ ID NO: 152359 - DNA, 601 bp, Human
tgaaatcttaccgaaatggagaatcttttttccttttttctttaaaaacacccatgcttggcttcttggaatgggaggctccgaaatcatagtcctccaactcttcccagctatctccagacttgaagatagtctgaccccaacgcctcctaccacttttatgactcagtgtgccatttggcttctgtggtggaaaatcagtcatcataatctttaatcatgtactgaatgcctttcatgcacaagctactatctatgtaagacactaacagtccccattctcaaggagcgttccatacaygtaagggcataacatatatacacatttaaaagcatgaacaaaaatgggcggtacatgccaaaaatatgataggtgttcagaggagagatctctgtgaactaggttggtgagagacttgaatatttaggatctgagttgactcttcattgacaggaaggatctggaaacctgagacttggctatgtctctttgggcaagtgacttaacttctcaaagccttagtgtcctccttaagtggggacagccttaatgagaaggacactaaggctggcatgtgccagcatcttttactcttccccc

SEQ ID NO: 152360 - DNA, 601 bp, Human
gtatgtggaaagatttgtgttttgtggaaggcaccaatattaagcaaatttttttctttttttcttttttttgagacagagtctcactttgttacccaggctggaatgcaatggcacaatcttggctcactgcaacattcacctcccaggttcaagaaattctcatgtctcagcttcccgagtagctgggattacaggtgcacaccaccacacccagctaatttttgtatttttagtagagacggggtttcaccatgtcagccaggctagtttcaaactcctggcctcaagtgatcaaccygcctcggcctcccaaagtgctgggattacaggcctgagccactacacctggcctgttaagcaaacttttcttcttttagggtctacatgcatttatatttaatgagtaaaataaagttaatgcatggcaaaaatatttttctgaggaatttgaaatcttaccgaaatggagaatcttttttccttttttctttaaaaacacccatgcttggcttcttggaatgggaggctccgaaatcatagtcctccaactcttcccagctatctccagacttgaagatagtctgaccccaacgcctcc

SEQ ID NO: 152361 - DNA, 601 bp, Human
atgtgaagacctggaaacggattgcataagagttatccaagcaaaaaaagaattatccaagcatatgtactccttagagattcctcgtgctccaaagtgaagacttccatactatgtcatgccaaatagctacttgtataagttttcctgactcataacacacttgttctttctattcttctgtttcaaagaggaaaacaaaaaaaaaagaaagtatctttccaaaatattcaccaaaacttaacccatcctaacttcaaagtcgaataatgtactaaggatgacctcacttataaaaagkaaaggaactgctagagatattaaacttccagaaaaggctcagaaaatgattgaaaaaagtttagaatagcgaggaggcagttagtgaaatcttaacaccatcagaagaagctgttaacttggcacgtggtgctctacttcctgcaacgaggcatgtcaatttcaaatgggaataatgattgtcattcacaagagcatcgtaaaaatggaacaagatcccctctgatacgttttggacatctgtcctctctaaatctcatgttgaaatgtaatccccagttttgaggtggggcctggcggg

SEQ ID NO: 152362 - DNA, 601 bp, Human
accacagatagtatcaaaccctatacagcccatcttttcctatatgtatgtgcatagatacctatgaggaagtttaatttataagttgggcacagcaagagattaacattaataactaatactaaaatagaacaattaaaacaatatattgtaataaaagttatgtgaatgtgctctcaaaaatatcttttttttgttttgagacggagtctcactctcactcaggctggagtgcagtggcacaatctcggctcaccacaacctctgcctcctgggttcaagtttctcctgcctcagcctsctgagtagctgggattacaggcgcccgccaccacacccagctaatttttgtatttttagtaaagacgaggtttcaccatgttggccaggctggtctcaatctcctgaactcaggtgatccacctacctcagcctcccaaagtgctgggattacaggcattgagcctccgcacccagcccaaaatatcttattgcaccgtactgcaggtaaatgaaaccatggaaggtgaaactgcagattcaggggactactgtacccaatttctgtaagacaagaaccaacagaaagccagttttctga

SEQ ID NO: 152363 - DNA, 601 bp, Human
tcctattcaccactccactaattcaccagttcacctcctattcaccactccgctaattcaccagttcacctcctattcaccactccgctaattcaccagttcacctcctattcaccactccgctaattcaccagttcacctcctattcaccactccgctaatgcaccagttcacctcctattcaccactccgctaatgcaccagttcacctcctattcaccactccgctaatgcaccagttcacctcctattcaccactccgctaatgcaccagttcacctcctattcaccactccgctamttcaccagttcacctcctattcaccactccgctaatgcaccagttcacctcctattcaccactccgctaattcaccagttcacctcctgttcaccactccgctaattcaccagttcacctcctgttcaccactccgctaattcaccaattcacctcctattcacaaatccaccaattcaccaattcagctcctattcacaaatccaacaattcaccaattcagctcctattgctaaagaagcagtgtggggtagaagagagaaagacctggatttgaattaatccttacctgatcttggg

SEQ ID NO: 152364 - DNA, 601 bp, Human
ctattcaccactccactaatgcaccagttcacctcctattcaccactccactaattcaccagttcacctcctattcaccactccactaatgcaccagttcacctcctattcaccactccactaatgcaccagttcacctcctattcaccactccactaatgcaccagttcacctcctattcaccactccactaattcaccagttcacctcctattcaccactccgctaattcaccagttcacctcctattcaccactccgctaattcaccagttcacctcctattcaccactccgctaatkcaccagttcacctcctattcaccactccgctaatgcaccagttcacctcctattcaccactccgctaatgcaccagttcacctcctattcaccactccgctaatgcaccagttcacctcctattcaccactccgctaatgcaccagttcacctcctattcaccactccgctacttcaccagttcacctcctattcaccactccgctaatgcaccagttcacctcctattcaccactccgctaattcaccagttcacctcctgttcaccactccgctaattcaccagttcacctcctgttc

SEQ ID NO: 152365 - DNA, 601 bp, Human
cacctcctattcaccactccactaattcaccagttcacctcctattcaccactccactaattcaccagttcacctcctattcaccactccactaattcaccagttcacctcctattcaccactccactaatgcaccagttcacctcctattcaccactccactaattcaccagttcacctcctattcaccactccactaatgcaccagttcacctcctattcaccactccactaatgcaccagttcacctcctattcaccactccactaatgcaccagttcacctcctattcaccactccrctaattcaccagttcacctcctattcaccactccgctaattcaccagttcacctcctattcaccactccgctaattcaccagttcacctcctattcaccactccgctaattcaccagttcacctcctattcaccactccgctaatgcaccagttcacctcctattcaccactccgctaatgcaccagttcacctcctattcaccactccgctaatgcaccagttcacctcctattcaccactccgctaatgcaccagttcacctcctattcaccactccgctacttcaccagttcacctc

SEQ ID NO: 152366 - DNA, 601 bp, Human
cacctcctattcaccactccactaatgcaccagttcacctcctattcaccactccactaattcaccagttcacctcctattcaccactccactaattcaccagttcacctcctattcaccactccactaattcaccagttcacctcctattcaccactccactaatgcaccagttcacctcctattcaccactccactaattcaccagttcacctcctattcaccactccactaatgcaccagttcacctcctattcaccactccactaatgcaccagttcacctcctattcaccactccrctaatgcaccagttcacctcctattcaccactccactaattcaccagttcacctcctattcaccactccgctaattcaccagttcacctcctattcaccactccgctaattcaccagttcacctcctattcaccactccgctaattcaccagttcacctcctattcaccactccgctaatgcaccagttcacctcctattcaccactccgctaatgcaccagttcacctcctattcaccactccgctaatgcaccagttcacctcctattcaccactccgctaatgcaccagttcacctc

SEQ ID NO: 152367 - DNA, 601 bp, Human
cacctcctattcaccactccactaatgcaccagttcacctcctattcaccactccactaatgcaccagttcacctcctattcaccactccactaattcaccagttcacctcctattcaccactccactaattcaccagttcacctcctattcaccactccactaattcaccagttcacctcctattcaccactccactaatgcaccagttcacctcctattcaccactccactaattcaccagttcacctcctattcaccactccactaatgcaccagttcacctcctattcaccactccrctaatgcaccagttcacctcctattcaccactccactaatgcaccagttcacctcctattcaccactccactaattcaccagttcacctcctattcaccactccgctaattcaccagttcacctcctattcaccactccgctaattcaccagttcacctcctattcaccactccgctaattcaccagttcacctcctattcaccactccgctaatgcaccagttcacctcctattcaccactccgctaatgcaccagttcacctcctattcaccactccgctaatgcaccagttcacctc

SEQ ID NO: 152368 - DNA, 601 bp, Human
actaggtatttagtaaacatctactgaatataaatacaagtataaatctaaatataaatatcttgctttttgttcacttttaagaagacaaccaggctgggtgcagtggctcacgcctgtaattctagcactttgagaggcaaaggcaggtggatcacctgagatcaggagtttgagaccagcctggccaacatggtgaaaccctgtctctactaaaaatacaaaaattagctgggcatggtggcggccacctgtaatcccagctacttgggaggctgagacaggaggatcacttgaaccygggaggcagaggttgcagtgagccaagatcgcaccactgcactcagcctgggcgacaagagcaaagctccatctcaatcataataataatttaaaaaataagacaaccattaaataaaaggtatacatgttagtatttggtactctgtattctttatggggaggccctggctgcctgagagaccaagcaggggatggcagggtctgttcaatgcaccagttcacctcctattcaccactccactaatgcaccagttcacctcctattcaccactccactaatgcaccagttcacctccta

SEQ ID NO: 152369 - DNA, 601 bp, Human
cctccacccgcgtagatattgggtcgtgcacagactcatttctgataccagacagtatgtgacaggaacctttataactgagcagcaatttacttgtgtgtaacatgtttctatctgtcctgcaacggctgcagttggattcataacgtgggaaactggtgtgctgagagggaaataacagccatcttcacctgttgactaaaataatttacaatcaatgaggttgtttggggcatggtttggatggcctaaaaaactgaaatggggaaagtgctagaaaagctcccgtatacaatttccsgtcaccctagtgtcaggcacagaaaataggtatttgtggagacatgcctgtgtctcagccagaacagacttgtgcagtggctaagcacctcgctagctgtttagtggtgtttgttagtattaagactgactctctgcctgttggtccctaactcccacagtcctgtttctgtgtacggactgaggactttctgcttcgaggcttagttctgtctcattcccgaggcctgtccctgaggcctgtttgaccaggcagcagtgcgtgaggcggccattgctttgtgttgctgcccatccctct

SEQ ID NO: 152370 - DNA, 601 bp, Human
catcagtcttttggctaagtgacaacttcccctccacccgcgtagatattgggtcgtgcacagactcatttctgataccagacagtatgtgacaggaacctttataactgagcagcaatttacttgtgtgtaacatgtttctatctgtcctgcaacggctgcagttggattcataacgtgggaaactggtgtgctgagagggaaataacagccatcttcacctgttgactaaaataatttacaatcaatgaggttgtttggggcatggtttggatggcctaaaaaactgaaatggggaaaatgctagaaaagctcccgtatacaatttccggtcaccctagtgtcaggcacagaaaataggtatttgtggagacatgcctgtgtctcagccagaacagacttgtgcagtggctaagcacctcgctagctgtttagtggtgtttgttagtattaagactgactctctgcctgttggtccctaactcccacagtcctgtttctgtgtacggactgaggactttctgcttcgaggcttagttctgtctcattcccgaggcctgtccctgaggcctgtttgaccaggcagcagtgcgtgaggcgg

SEQ ID NO: 152371 - DNA, 601 bp, Human
ttgtggttcacgcctgtaatcccaccactttgggaacgaggtgggtggatcacctgaggtcaggagttcaagaccaacctggccaacatggtgaaaccccgtctctactaaaacatacaaaaattagccgggtgtggtggtgagcgcctgtaattccagctacttgggaggctgaggcaggagaatcgcttcaacccaggaggatgaggttgcagtgagccaagatcgtgccactacactccagcctgggcaacgagtgaaactctgtcacacacacacacacacacacacacacacacayagacacacaccaaaactatttaacctatttagatcgccaaatacccagggttataaagtttttgctgttcttgatggcttcatgccaatttcttcaacctctcaaatacaaatacgtgtcttcctccttacaaatcagcacaggactgcagtcctaaagcctcaattcaccccctgtaagtttatatcaacttattcaacacctgtggctaaacctatacacccaccgtgccttctgttttctctcccattcatctctaaaccctctacttgctttcattttttttcttttccccaatta

SEQ ID NO: 152372 - DNA, 601 bp, Human
caaccacttcaaaggttagagcagatcataaacttaaaggaaacttatgtaatacattcaaacaaagactagagacaccttggacaggagaatggaaataaatctaggtgaaaatgtagcagatacttgctttctgatgaaccctaacatgataccaagcccttagcacaaccacctggaatgttgacagtgtactttataggcagaagatattttctacaatataataataacacttgatgttcttgctaagggtcttgtaaaaattgagatggcacaaaaatttttcttcaacaacacracgttttttttgttttgttttgttttgttttgagacagggtctctctctgtcgtccaggctggagtgccatggtgtgatcttggctcactgcagcctccacctcccaggttcaagtgattcttgtgtctcagcctcccgagtagctgggattacaggcacccaccaccatgcttggctaatttttgtatttttagtagagaggggatttcaccatgttggccaggctgtctcaaactcctggcctcaagtgatccgttcaccttggcctcccaaagtgctgagattacaggtgtaagcca

SEQ ID NO: 152373 - DNA, 601 bp, Human
agtgtatgacaccgcagcgacattaaatggataaactgagtttttaaagaatctggaaaacttgtaaaaagcccaaatatattgatgtcacatcagaatatctcactaaactactcacttataatggtaattgtcaaagttttttgatccaatatcacctacattaaaaaacaaactgtacctcttcacacacttttaagttgatatttaaaatttttaatcataagtttaacagttgcaaaggatgttatttctgacatattgtaactataggcatttaaaaaataaaactattagtgatttttttttttttttttttgagacagaatctcgctctgtcgcccaggctggagtgcagtggtgtgatctcggctcactgcaacctccacttcctgggttcaagcgattctcctgtctcagtctcctgagcagctggatttataggcgcatgccaccatgcctggatttttttttgtgtgtgtgtatttttagtagagacagggtttcaccatgttggtcaggcgggtctcgaactccggaccttgtgattcgcccacctcggcctcccaaagtgctgggattacaggagtgggccactgca

SEQ ID NO: 152374 - DNA, 601 bp, Human
aaattaaactacaggccgggcatagtggttcatgcctataatcccagagttttgggaggccaaggtgggaggattgcttgcgcccacgagtcaagatccagcttgggcaacatagcaagaccctgtccctacaaaaaacattttttttaattagctgggcacggtcgtgtgtgcctgtagtcccatctactcagaaggcggaggcaggaggatcacttgagcccaggagttcgaggctgcagtgaaccatgattgcatccctgcactccagcctgggtgacagagcaaggctttttctctrtaaaaaagaattaaaataaataaattaaactacaattaggtatcttattaaagttctaatgattggctttaatgtttatttttggtgcttcactaagaatatctatttcagattcaaatgattcgaagaccattcatggtcaaatctgattggcttaagtacagaatcatcaccctccatttcaagtgtgtacccccacatgtggctgtcacatgccacaccactggggagcaagcttacctcagttaggcataacgctggagggtggagggataaacccttccccctgaatactattgc

SEQ ID NO: 152375 - DNA, 601 bp, Human
ccctagctatcccatatttactggcatggtttgcacagtttttcttaaattttcactgtataactgggagtgaggagggaattctgtgagcatgtggtcctgacaagctactaacttcagcatgggtgaacaaggtattaagtgtggacactctgggtaagacagccgcctggctgccgtgtagtttggtggaggcagggaggccaagagctccccactccatggtttgacaggtcctttcattccactctttttactgggcttaaaattctcaaagtcaaagccactaaaaagctatctracaaagtcagggacaatgtgtctacaagggccagtcagggcaccatgttttccagaaagagccctttagttatagccattggaatagaaacgagcatctgtctgctaaattagtgagctcacccatgtgggccacaggtcaaactggtagcaggggtagaagagacagcgtgggaggggagtagagagcggggagagaggcaataagccccgcttattcagggagggaaaagggaacgtggcattaggctaatgggtgtggctctgagggcaagaagtgagagctttggggagtaacaaa

SEQ ID NO: 152376 - DNA, 601 bp, Human
aggtattgtatctgaggagggatgtctgctttttccatctggggtttaaatatctcttcacactgtgtagtagctgccattcttggattaaactctaagtgttaatactgaaatgaatctgaccattttgtacccctagccctagctatcccatatttactggcatggtttgcacagtttttcttaaattttcactgtataactgggagtgaggagggaattctgtgagcatgtggtcctgacaagctactaacttcagcatgggtgaacaaggtattaagtgtggacactctgggtaagrcagccgcctggctgccgtgtagtttggtggaggcagggaggccaagagctccccactccatggtttgacaggtcctttcattccactctttttactgggcttaaaattctcaaagtcaaagccactaaaaagctatctaacaaagtcagggacaatgtgtctacaagggccagtcagggcaccatgttttccagaaagagccctttagttatagccattggaatagaaacgagcatctgtctgctaaattagtgagctcacccatgtgggccacaggtcaaactggtagcaggggtagaa

SEQ ID NO: 152377 - DNA, 601 bp, Human
aatttccagtagctggccgtgcgcagtggctcctgcctgtaatcctagcactttgggaggctgaagcaagtggatcacctgaggtcaggagttcgagaccagcctggccaacatggtgaaaccctgtctctactaaaaatacaaaaaaagccagctgagcgtggtggcgggtgactgtaatcccagctactcaggaggctgaggcaagagaatcacttgaacccgggaggcagtggttgcagtgagccgagatcataccattgcacaccagcctgggcgacaagagtgaaactccatctcaaaaaaaaaaaaaaagaattttcagtagctgaagagccaatattattcctggtttatagtgctgacactgctgctatttttaatattttacatttagataggcaacgccaggtaagaagaccaagaaaatttattggctcaaattcaatgggcaacacccacagtgttggtgactttgtaatatcacactgtggttacatctaaataatattgacacaatatcactacagaaaaatgtatttggaattgtgaatctataaaactgtggcttcatggaagaacacacatggggtcctataat

SEQ ID NO: 152378 - DNA, 601 bp, Human
tgcttatcaaactcaaaataaagaaattcatcctctcatttgatggggaaaatctgaatttatgtttaaaagattaactcagtactctctgaggctttttaaatgttaaaaccaaaaattctagtgtagtattatgttgacatccattagaatttccagtagctggccgtgcgcagtggctcctgcctgtaatcctagcactttgggaggctgaagcaagtggatcacctgaggtcaggagttcgagaccagcctggccaacatggtgaaaccctgtctctactaaaaatacaaaaaaagycagctgagcgtggtggcgggtgactgtaatcccagctactcaggaggctgaggcaagagaatcacttgaacccgggaggcagtggttgcagtgagccgagatcataccattgcacaccagcctgggcgacaagagtgaaactccatctcaaaaaaaaaaaaaaagaattttcagtagctgaagagccaatattattcctggtttatagtgctgacactgctgctatttttaatattttacatttagataggcaacgccaggtaagaagaccaagaaaatttattggctcaaattcaatgg

SEQ ID NO: 152379 - DNA, 601 bp, Human
ttgcttatcaaactcaaaataaagaaattcatcctctcatttgatggggaaaatctgaatttatgtttaaaagattaactcagtactctctgaggctttttaaatgttaaaaccaaaaattctagtgtagtattatgttgacatccattagaatttccagtagctggccgtgcgcagtggctcctgcctgtaatcctagcactttgggaggctgaagcaagtggatcacctgaggtcaggagttcgagaccagcctggccaacatggtgaaaccctgtctctactaaaaatacaaaaaaarccagctgagcgtggtggcgggtgactgtaatcccagctactcaggaggctgaggcaagagaatcacttgaacccgggaggcagtggttgcagtgagccgagatcataccattgcacaccagcctgggcgacaagagtgaaactccatctcaaaaaaaaaaaaaaagaattttcagtagctgaagagccaatattattcctggtttatagtgctgacactgctgctatttttaatattttacatttagataggcaacgccaggtaagaagaccaagaaaatttattggctcaaattcaatg

SEQ ID NO: 152380 - DNA, 601 bp, Human
tttttgctgtaggattataagtacgtcctgaaaactgcccccgaccagtttttgtgttccaggtatattctgaaagaaatcagatttggaaaacagggttttactcatttgcttatcaaactcaaaataaagaaattcatcctctcatttgatggggaaaatctgaatttatgtttaaaagattaactcagtactctctgaggctttttaaatgttaaaaccaaaaattctagtgtagtattatgttgacatccattagaatttccagtagctggccgtgcgcagtggctcctgcctgtartcctagcactttgggaggctgaagcaagtggatcacctgaggtcaggagttcgagaccagcctggccaacatggtgaaaccctgtctctactaaaaatacaaaaaaagccagctgagcgtggtggcgggtgactgtaatcccagctactcaggaggctgaggcaagagaatcacttgaacccgggaggcagtggttgcagtgagccgagatcataccattgcacaccagcctgggcgacaagagtgaaactccatctcaaaaaaaaaaaaaaagaattttcagtagctgaagagccaata

SEQ ID NO: 152381 - DNA, 601 bp, Human
gcacggttcacaatatttaggttttttgctgtaggattataagtacgtcctgaaaactgcccccgaccagtttttgtgttccaggtatattctgaaagaaatcagatttggaaaacagggttttactcatttgcttatcaaactcaaaataaagaaattcatcctctcatttgatggggaaaatctgaatttatgtttaaaagattaactcagtactctctgaggctttttaaatgttaaaaccaaaaattctagtgtagtattatgttgacatccattagaatttccagtagctggccgkgcgcagtggctcctgcctgtaatcctagcactttgggaggctgaagcaagtggatcacctgaggtcaggagttcgagaccagcctggccaacatggtgaaaccctgtctctactaaaaatacaaaaaaagccagctgagcgtggtggcgggtgactgtaatcccagctactcaggaggctgaggcaagagaatcacttgaacccgggaggcagtggttgcagtgagccgagatcataccattgcacaccagcctgggcgacaagagtgaaactccatctcaaaaaaaaaaaaaaagaatt

SEQ ID NO: 152382 - DNA, 601 bp, Human
acttcatactttggcaaatagtttattcaatactttgtaacatcctacccatatatcaacactgtgggcaatgatgctaagaaaatgcatttcttggaaataagtaaaataggggatgatttttgcccttccaagtacccacttttgcatatttcttccagaactcagtagaaatagacatttgtagacatttcccagggtcaaggaacttgcacgtactctacggagcaatgctgtagggtttcacaccatagactcctaccggtggcctccatacttggccacccagtctgtcctcccrtgcactgagggaatgggctgtgcacggttcacaatatttaggttttttgctgtaggattataagtacgtcctgaaaactgcccccgaccagtttttgtgttccaggtatattctgaaagaaatcagatttggaaaacagggttttactcatttgcttatcaaactcaaaataaagaaattcatcctctcatttgatggggaaaatctgaatttatgtttaaaagattaactcagtactctctgaggctttttaaatgttaaaaccaaaaattctagtgtagtattatgttgacatccatt

SEQ ID NO: 152383 - DNA, 601 bp, Human
gactgcacagctttgagacattaatttaaactgtacaaatacatataaccattaccactaggataaattactctttagattttaacatttttcaacatcttacatctgaacagttgactcttctatacaaaaatatcattattattttataatatgcctttgtataatgcccacaagatgacacttattacaatagcagttgttacaaagtcacaaaatacataaaaatctcagcagttggtaacattattattctttaaaaagaatttacagtactaaggtccagtccagaaagtggcaratttaaacagagtagcccaaagttcgaagtgtctatttaaaataccagtttggaaataaactaaggaaataatatatgtactatgtgatatcactgccccagcagctgaacgcacttgcttcagagcaaatgtgaaggtcagagctgagtcagtggtcagcagcatgagctggcttgggggaaccagctggcacacttcatctttgtgtctggtagggacacagaaacaaaacaatttgaaaagtccaatgaaccagcatcaaacaaacacagtttccagaactttcttaatgatgtcca

SEQ ID NO: 152384 - DNA, 601 bp, Human
gcgtcacccatagcaccctgcttttattgtcagtgttcccttatatgttcacagtcactggaaatgatcaacacaattagatttgcttcttttgccccagaacaaagcgggtttgttgatgtactgaatcggacacattactttctagctgaacactcagcttcatccactccaggacagctgagcgtctgggtgagtaatttttccgaagaaatgtactatagctagattcacctccatagggtaattttcctgggcttttgcagatctgaaacatatggaggatttggctaaaaagcaycccttttcttctaccttctctatgcctctcttctgaaaatgcccagtactcagatctaaaagaaccacccacctgccctatagctgccttccagattctgcctaagaaggcacaaacatctataataaaagagacagtttcatcttttggccctaagcgttgttcccttaaggcaaagaaggacttacccccaccgccttgctgtgggtctgtcactcatgccttccccagccagagtgcagctctcattgcctgccccgcagctccctgtgtgctgggagtcagattacggccacttgt

SEQ ID NO: 152385 - DNA, 601 bp, Human
gaaggaggaggacaaaacagtaggctaaggaagctaggtgggcaggaaacgtccttttcagccccgcaggagacaccagaagaggtgggacccagaaaaggccagccccgctgctcacccccttcacctctcacttctgccatttccggagttctctccctgcttggcctgtcatgcacctgtttacctctccagaggtagttgctctttcagcttcaaatattcatcaaccagagaaatttaaaacagtgcaaaacaccaacacaaaacataaacatgctctttaagaatgtttttagcttttttttttttttaaatccacaaaaatctgatcttcttccaaggcagatggaccagcctcacttggctgtgaaccgtgaagtttgctggcagcatatacatatctctggccttatgagggctcaccctagcgtcacccatagcaccctgcttttattgtcagtgttcccttatatgttcacagtcactggaaatgatcaacacaattagatttgcttcttttgccccagaacaaagcgggtttgttgatgtactgaatcggacacattactttctagctgaacactcagcttcatccact

SEQ ID NO: 152386 - DNA, 601 bp, Human
gtttgtggtcagggttaggggagaaggaggaggacaaaacagtaggctaaggaagctaggtgggcaggaaacgtccttttcagccccgcaggagacaccagaagaggtgggacccagaaaaggccagccccgctgctcacccccttcacctctcacttctgccatttccggagttctctccctgcttggcctgtcatgcacctgtttacctctccagaggtagttgctctttcagcttcaaatattcatcaaccagagaaatttaaaacagtgcaaaacaccaacacaaaacataaacatrctctttaagaatgtttttagcttttttttttttttaaatccacaaaaatctgatcttcttccaaggcagatggaccagcctcacttggctgtgaaccgtgaagtttgctggcagcatatacatatctctggccttatgagggctcaccctagcgtcacccatagcaccctgcttttattgtcagtgttcccttatatgttcacagtcactggaaatgatcaacacaattagatttgcttcttttgccccagaacaaagcgggtttgttgatgtactgaatcggacacattactttctagc

SEQ ID NO: 152387 - DNA, 601 bp, Human
tgccaactgctcattctggcaggaaatggctaggattccccttttggggggggggggcaattaccccagttaccctatcatctaagacttttgcccttgtcctttgcctgtgatagtcatgagagccaagaagtatggagagtatttaccagagaatctaattgcagaggaccacgtaaggggttaggcaagaaagccaagtactttaagagattagtattattgtggctttccctttgacaaattgcggggccctcatttccccatgtcactgaatgttcccgggaacctgctttctgcrtgggtagtgaggaaatgcagtgccaaaaagggtgaggggaatttccagctcagcctagcccttagtttgctatggggctttgctttagaggtggagagagaaaaaccctttcttgcccaggcccgggtggcaggataaaggaagagctggctccacaggggggtggccagccacatcccacgcatcccctgccccagtgaagcgaatctcagaagtatgaaaaaccccaggtgggatgacaacgacatcatactctctagaggaaaagaatgtaaagagacaaaaacgatggttgcaatg

SEQ ID NO: 152388 - DNA, 601 bp, Human
aaagagtttgcaagaagcttggagtcctagtttgaaaatagctaaagatgctaccatggtgactcccaggcctcccaccacactgggaggtgtgaccagatagaggattcctgctccaatgatggcccccaggcactgggctgcgatgtagaagacagacttggcgatgctgatcttcctggtgcacaccatggccacagtcactgcagggttgatgtggccaccgctgatatggccaaagcactgcaccatggttgcaatgctgagtccaaagcaaagggagatgagaaccatgtcgacmggtaaaggcttttctgttccaccccagttgatggtggatcccaggctgaggagaacaaaaataagcatggccagaaattccgctgtgactgctttccagaaagcttgagtccagacccctttgaaagccaccatgatgttctctctggtacacaaaggtccacacttactgaaaagagaaacaaatcagcatcagaagccactacacccaggtttatgaatttaggtgaagggaacaaggcctgccatcttcgggtactgtgggcaggggctgccaggcgtgatttgcacaccaagaaag

SEQ ID NO: 152389 - DNA, 601 bp, Human
acaggagtttgtgctgaatgtccttttctacaaaggaagcaaaatgtgccactgcagcacttaactcgtaaaagaatttcttgagagccttgtgattttataaggcaatgattaaatccattaattaggtttaaattaattaatatatatttcaattaaaatttaagccatgtgtgtttttttttaatcagccctggtgctgagttaacaattgatactcctaatcagctaagaacaaaactaggatcggatgtctatttttttaagcataaccctttatgtagatcattgtacatcttaygaacatgacaagaaaatagtttttttctgctagtgaacaaataactgtaaggaaaatgcattaagctaaatataaagtcaatatagtaattggaatgggagaaggggaggaaaaaaccaacacaattttcgggccacctagattttgttatttttaaggcactcaagagcaaacaatgatttcttacagatatacctaaatactgccagaatcagttttcacactattaagaatcatcaaaaattccctaggagtaaattagctattttagggatgtgcctcatgccaccaaggcattat

SEQ ID NO: 152390 - DNA, 601 bp, Human
cacaactgctgcattacttatttaattttaaaggatttaaattcctttgctgtgagaaacaactgaaacaaaattaattataatattttaaaatggacactgctattctctggaagcactgccactacattaataaatatttatttataatagtttaggtttgagactgaaaagtgagccttttctgtgagtcatttatttttccggtaacagttatggtgataataacataaacctttgcactatttattcgacaccatctgcagttcaaatacttgcaacttacatactattaattgarttcatgcatttgtaaacaaaaaaagggtaaatatctttgctatgggcagcgcttttaagtatttcattctttctcttttttttgcaatttttttccattatagctgggaagactttactttcaattatttaaacaccatattcactacaccatgctgactttaacttgttccacataggcaacctctatatacagtgtattctgctgcaatctgttagatacagtgtctaaaatagtgcttcaaaaaaggaaaagactattattggaggcctagaaccttcagttagagatgttttacat

SEQ ID NO: 152391 - DNA, 601 bp, Human
caaattaatctcagtttgcatcctcattgtaagatttaaataaaattcaaaatttaagctgaggctgaagacataacatttacggggaaactgttgctagtgtggctggaagaatcaagttcctctcttgaacatgaaaaaacccatatgagcctttatcttctctatgcccttttaaaggagaaatgagagccctcctctaaatgtctttgctctttgttagtaaggtctcattagacatgtactattccacaggctacaaatcccacaagggagactagaacagcaaaataattactamcctttccaaaacatctgtgaataagatacccagctgcatgttctcaaaaataaacaaatctcagtgtcaagttgctatttcaaaatgaagtcatatgtactttaaagtaaagaatctttattgctaaaaatctagaaaatgtgtaaaagtataaagaaaactaaaataatatcattacactatacaaaaaacccaattaatattttaatgttattcctaatctttctacctacaaatatactttaaattagttctaaatttcatacaaccattgctatttttagtagaattaagattggt

SEQ ID NO: 152392 - DNA, 601 bp, Human
aaaaagaaaaaaacaaacaaacaaaatgaaaacctctcttttgaaacactgttccaaacactgcagtatactgttttccactgtactacacactcatttgaaaaaaaacatgatggatgctttttgtttaaaacaccctctgcaaattaatctcagtttgcatcctcattgtaagatttaaataaaattcaaaatttaagctgaggctgaagacataacatttacggggaaactgttgctagtgtggctggaagaatcaagttcctctcttgaacatgaaaaaacccatatgagcctttawcttctctatgcccttttaaaggagaaatgagagccctcctctaaatgtctttgctctttgttagtaaggtctcattagacatgtactattccacaggctacaaatcccacaagggagactagaacagcaaaataattactaccctttccaaaacatctgtgaataagatacccagctgcatgttctcaaaaataaacaaatctcagtgtcaagttgctatttcaaaatgaagtcatatgtactttaaagtaaagaatctttattgctaaaaatctagaaaatgtgtaaaagtataaagaa

SEQ ID NO: 152393 - DNA, 601 bp, Human
tctcctctccccggtcaacgtcaatcacatgcaccactccaggttttagaatcaggtcatccgtctctacctgactcctgttgtcctccacctccatgtagcttccttttgtttgctgggcagctttgctgaaggcttctttaaaacgacgtttgaattcaacatctggacagaagacatactcataaaggccaccagcgaggacagctcctatgatgggcccaacccaatatatctaaggaaaagatggaagaggatagagtgtaagtagagaaaagctattccattgagcagctcatgratgtagaatctagctgggttaaattaagagtgtatttgtgtcatgcatcaaaaagaggggaattggagaggaaataagaaaacacaccaaagcctcatcagagatccataaattattaaactgcatttgaacagaaaacaaaaagaactgtttcatctcctatcctcttttcattaattatgttctttccatcttatgataatcgttaatgtaaagatagatcctctttggtggtactacaaattaagcgcactaagaattctttaactaaaataaaaaaaaaatttctggagagtcctt

SEQ ID NO: 152394 - DNA, 601 bp, Human; identical to SEQ ID NO: 152384

SEQ ID NO: 152395 - DNA, 601 bp, Human; identical to SEQ ID NO: 152385

SEQ ID NO: 152396 - DNA, 601 bp, Human; identical to SEQ ID NO: 152386

SEQ ID NO: 152397 - DNA, 601 bp, Human; identical to SEQ ID NO: 152387

SEQ ID NO: 152398 - DNA, 601 bp, Human; identical to SEQ ID NO: 152388

SEQ ID NO: 152399 - DNA, 601 bp, Human; identical to SEQ ID NO: 152389

SEQ ID NO: 152400 - DNA, 601 bp, Human; identical to SEQ ID NO: 152390

SEQ ID NO: 152401 - DNA, 601 bp, Human; identical to SEQ ID NO: 152391

SEQ ID NO: 152402 - DNA, 601 bp, Human; identical to SEQ ID NO: 152392

SEQ ID NO: 152403 - DNA, 601 bp, Human; identical to SEQ ID NO: 152393

SEQ ID NO: 152404 - DNA, 601 bp, Human; identical to SEQ ID NO: 33022

SEQ ID NO: 152405 - DNA, 601 bp, Human; identical to SEQ ID NO: 33023

SEQ ID NO: 152406 - DNA, 601 bp, Human; identical to SEQ ID NO: 33024

SEQ ID NO: 152407 - DNA, 601 bp, Human; identical to SEQ ID NO: 33025

SEQ ID NO: 152408 - DNA, 601 bp, Human; identical to SEQ ID NO: 33026

SEQ ID NO: 152409 - DNA, 601 bp, Human; identical to SEQ ID NO: 33027

SEQ ID NO: 152410 - DNA, 601 bp, Human; identical to SEQ ID NO: 33028

SEQ ID NO: 152411 - DNA, 601 bp, Human; identical to SEQ ID NO: 33029

SEQ ID NO: 152412 - DNA, 601 bp, Human
gttaaaggaccatgagaatacaattagccaaatgcagaatgttaaaaattctacacaatatatgacccagttcctttaacaaataaatgaagatttaaaaagataaaatgatacagattaaaagagactaagacacatatcaaccaatgcactacgtgtaccttgtttggattctgaggcaaacaactgtttaaaaatttagagtttttaatcgctgctcggccttttggctaagatcacgtgtaaaacatttaggtttgttttagataacggataaaaattgaaaataaattgaatattktaagacagaaagaaattatggttaacttagttgggtatgagaatagtcctgtctgacagagatgcatatggaaatacagtatttactggtcaaactgtaagatgtctgggacttgctgtgaaacatttcagattaacaaattacttgtgcaattaaaaattaaaataggtaggtaggtaaacaggtaaacgaatataaccttctcagggacagaatcaattttaggtgaattcaaattaaatataaaagcaaaacaaagcttttagataacatagaatactttcatgttctcagagtaaa

SEQ ID NO: 152413 - DNA, 601 bp, Human
aaaagacaaagattcgatttaaaatggcctcaaaaaatataaagtattaaatatctagcaataagcccaatgagagatgtgcaaaccatctacagggaaaaatcataaaacttcattgacagacattaaagaactaaataaatgaaaatatatgcaatgctcacgatttggaaaactcaattttgtaaagatatcaagtcttcccaaattgatttacagtcaaggtaatctgaatgaaaatccctacaggattacgtatatgtgtatataacctgacatactgatgtttaagtgtatatgraaatgcaaagaaccaacagccaagatattcttggaaaaaaaaaaaaggaataagattaagtataacaagagagtggaattcataaaaacagaccaaggaaacgatataaacagatcagacacagacccacatataaacggacacctgatacaacatagattgcatgacaaaatatcttgtttttccaagaaataataatgggacaaaaaaccatccacatggaaacaaatgaaactgaacctattcctcacattattcacgaaaataaattctacctagctggtagtcaagttgatgaca

SEQ ID NO: 152414 - DNA, 601 bp, Human
aaaaacaaattaattattggccgggcacagtggctcacacctgtaatcccagcactttgattgctagactgagttaaaaaaaaaaaaaaaaatctacatcctactcataatatcgttatctctaacacaagaaaacagaaaggaggataataccatgcaaacaccaaagaaagcttatttagctatgctaatatcagataaagtagactttaaaagcattactaaagataagaagggataattcacaatgatgttgcaggcggcgcgcagcactttgggaggccaaggcagacggatcacraggtcaggagatcgagaccatcctggctgacaaggtgaaaccccttctctgttaaaaatacaaaaaattagccaggcgtagtggcgggcgcctgtagtcccagctactagggaggctgaagtagaagaatggtgtgaacccaagaggaggagcttgcagtgagccgagatcacaccactgcactccagcctgggcaacagagcgagactccgtctcaaaaaaaaaaaaaaaaaaaaaaaaaaccttaaaagagctaaaaggaaaatcagtcagtccacaatttgacttgtacattttaaa

SEQ ID NO: 152415 - DNA, 601 bp, Human
tttaaaattcacgaagtatatttggctaaactggggatatttcaaacgcagtactcacaatgaattaagtaaaaacaagataaggaattccaatcagctttcagccttttaaaatgaagacatgcttttatgtactcaacttagtggatggcatcaccatcagttgagtctccaaacactctcttctacactttatatctactcagtaactgaatcctgttagttctacttcaaatactccagaatctaatgcccctttccattgatatcctccaatgtgtacctatatctttattatcgkcatcatcgccaatattcactgagtacctttacatgttggacaccatgaactgttttacagcattctaataaaatatataataagtattatctttctcatattataaaaatcattcatgttaaacagtatcaaatgaagctgacaccacaggaacaggaatttttttcagaatatttttctgaaattctcaaaatgtcattggataatccatttgaaaggcagataaatttaaggttctttatacttaactgtacattagaattacctaagaagcttttgaaatactgtgacaggtctgcc

SEQ ID NO: 152416 - DNA, 601 bp, Human
tgttcttcacagtaagatatatccaatctctttacctatctggactcaattagtcttctgaattttatatatactgtccagcaaacagtaaacatgattttttttcctaagatatttgaaaaagaaggtaggcaatgatgttggtaaaatgctccgtatagtatcaattcagaaaaatgtgcccccatagacaaattatctatgaaatacaggaatactgcctttgtggaactttccataatccttaacggcagaagtaatcacatcttctgctgtttcaaatgtactctgaatacaaagyatttctaaaacagcaggttatactgtaaaataactattgagttgtctttcaattatagaattttttggtatataaaaagttttgttatacattcttaaaggaatcaattatttttctttatagttttctcttttgctttttattctcaacacagccttcctcacctcaatatcagaaagatactgatgtcttaatttgtactaaaactcacaaaaataaacacttcagagacatttcacccacagtcttgcttcctgtttttaaatatcaaaatgttttaactagacacctttaattgtg

SEQ ID NO: 152417 - DNA, 601 bp, Human
aggctaaagagctcagcagagattccagctgctgctcactgatatggagacaaagactggagtgtaggccccaccaagttagaggagccttcataaataactccaactctctgttgagactacagaagggccagctactccttaagagtaaggtcgaaattgaaatagatcagccctaaaaagtcttataaccaacctttaatagattcaaggtaacctcctagtacttcacataccaaaggaaaacttaattctctttggagcaaagtaacacaaactagagcttctataattgttcaaycacaaggtctaacactcttaaaaattgcaaggctttctaaaaaacaaaaataaatgaccaacacccactttgatagctgcaataacataaaaattaaaagtccagaaaaataacaagtgttgtgaacaatgtatagaaattgcaactctcatatatgctggtggaaatgtaaaagggtacagccactgtggaaaacagtttgacagttcctcaagaacttaaacagttaccatatgatctagcaactccattcctggtacatactaaaaagaattgaaaacacacattcacgcaaaattt

SEQ ID NO: 152418 - DNA, 601 bp, Human; identical to SEQ ID NO: 33030

SEQ ID NO: 152419 - DNA, 601 bp, Human; identical to SEQ ID NO: 33031

SEQ ID NO: 152420 - DNA, 601 bp, Human; identical to SEQ ID NO: 33032

SEQ ID NO: 152421 - DNA, 601 bp, Human; identical to SEQ ID NO: 33033

SEQ ID NO: 152422 - DNA, 601 bp, Human
taaaacaaactattttaaaaagttaaattccagccgggcgtggtggctcatgcctgtctgtaatcccagcactttgggaggccaaggcgggcagatcacaaggtcaggagattgagaccatcctggctaacacggtgaaaccccgtctctaccaaaaatacaaaaaaaattagccgggcatggtggcgggcacctgtagtcccagctacctgggacactgaggcaggagaatggcatgaacccaggaggcagagcttgcagtgaaccgagatcatgccactgcactccagcctcagagtgaggcgacagagtgagactccgtctcaaaaaacaacaacaaataaaggttaaattcctacctcttaaaactaacaaaatgtttttacatgtgaaattcacataaggcaaacagacttaacctataaacaactccttcaataacagacaaaccacagaatatatgacatgaacaggcaattcatagaaaacatgcaaacagcaaataaacatacaaagttatgcaacctgactaataattgaagaaattaagtttacagttttccgctatatatttagcaaataggaagactgtcactgggta

SEQ ID NO: 152423 - DNA, 601 bp, Human
atggtaatatactcatgttaactgaaatcaaatcagtttctttaataaaaatcttctcaggccttttaatagtctaataagcatgctgaaccttccaaagtattttactagtaattagtaaatctattaataccataacttagcaaatgctgggtcaaagttctgatataattgggaaataatcacattttttcatgaatattaccatttcagaatcctatcactaaaacaaactattttaaaaagttaaattccagccgggcgtggtggctcatgcctgtctgtaatcccagcactttgrgaggccaaggcgggcagatcacaaggtcaggagattgagaccatcctggctaacacggtgaaaccccgtctctaccaaaaatacaaaaaaaattagccgggcatggtggcgggcacctgtagtcccagctacctgggacactgaggcaggagaatggcatgaacccaggaggcagagcttgcagtgaaccgagatcatgccactgcactccagcctcagagtgaggcgacagagtgagactccgtctcaaaaaacaacaacaaataaaggttaaattcctacctcttaaaactaacaaaa

SEQ ID NO: 152424 - DNA, 601 bp, Human
ataatacagtcccaataaaaactctgaacactaaggctaagggaaactcccctggtcagcaatataccctgtgtgtattatcacacatctgtgagaggaacacaacacatagtgactgttcaaggagaggacaacacaaactttgcatttgtcctccacatttgatcagtcagcaaatccgctctaccttcaaaatacatggtaaatatcccacaattgactacttctgattacctccatagctatcatactatttaaagccacgatcatctcttaaatacaacaagagcctcttaacagrtctccctatttcacccttgcccaattacagcccattttctatatagctgcccaaaggcattttttgaaaaccatatattcagatcatgttattccagtgctcaaaactttccagcagtatatctccttccacagaataaaatctaaaatccttatggactgaaagactttcaaggcctagccttcaactatctcttggaccttatttcttatgacttcccactttcactcactccgctccagttcgacgggtctccttgctatacttcaaacacaccaagtatgctccagtgcatacttg

SEQ ID NO: 152425 - DNA, 601 bp, Human
cctcaggggacacttacagcaagaggatacctatctagctaatcagtcaacaaataggataaagcagtgaacagaataagacacagttcttcacttcatagaactcagagtctaaagaaaaataattaaacacatattttttaaaattatgtaattataagtagtactgcttaaaggattctaagtataggctactatacttaagtgaatttgcctaataatttaaaatatagtgaagtaagaggtgttttttattttatgttgtatgcttttcatatttttttagattttttttttttttgagacggagtcttgctctgtcacccaggctggagtgcatggtacaatctcggctgactgcaacctccgcctcccaggttcaagcgattctcctgcctcagccacccgagaagctgagactgcagttgcacaccaccacgtccggctaatttttgtatttttagtagagacagggtttcattatgttggccaggttggtctcaaactcctgacctcaggtgatccacccacctcggcatcccaaagtgctgggattacaagcatgagccaccacacctggccaagatttttcaaatttaac

SEQ ID NO: 152426 - DNA, 601 bp, Human
ttattcatactaaccatttcttcaagctggttattctcaactgtgggcagttttgtccctcaggggacacttacagcaagaggatacctatctagctaatcagtcaacaaataggataaagcagtgaacagaataagacacagttcttcacttcatagaactcagagtctaaagaaaaataattaaacacatattttttaaaattatgtaattataagtagtactgcttaaaggattctaagtataggctactatacttaagtgaatttgcctaataatttaaaatatagtgaagtaagasgtgttttttattttatgttgtatgcttttcatatttttttagattttttttttttttgagacggagtcttgctctgtcacccaggctggagtgcatggtacaatctcggctgactgcaacctccgcctcccaggttcaagcgattctcctgcctcagccacccgagaagctgagactgcagttgcacaccaccacgtccggctaatttttgtatttttagtagagacagggtttcattatgttggccaggttggtctcaaactcctgacctcaggtgatccacccacctcggcatcccaa

SEQ ID NO: 152427 - DNA, 601 bp, Human
agacgcactacaaagcgtgataatacatatgcaaagaccctactgatgtcttaattacctagaatatatttttgcaagtgttttgcaagggcatataacaaacacttatcattagcacattatttcttcccattttgagttttatattctaatagatattctatgaaaataacatcctttattttaaacacatgtaaaaacctcccaaattaccatattttatattattggcattcttttctccaatgagatggttaatacttaattttatcttaagtcagtggtcaaaaaaaaaaaaaaagaattttcttttgaagagtaagtcaaggatcaaatttattgagtacttattaggtacaacaccccaggctaggagccatggtaatatagagatgtgatgagcactgtcactgtctatagtgacacacaattaggtagactgaaaaaaataatttttaaatacttaactataaggaaaacattgttttaatctgtcaattctgaataatgtaattttacaaatattctatatatatagaacattcatacatatacacatgtatttcacatcctcagatacaaaccaatacactaaaatttt

SEQ ID NO: 152428 - DNA, 601 bp, Human
gagatactaatgaaactaagagaagcaaactcaaaaggttaccccaaaatatgttctaaaaatttgtactgcagagtgaaatagcattataaaatgcatcttctacaaccattttctgcaaacaatggtatcatacattactacagactttaaggttattcttcatcttttacataaacaattttgatgttaagacgcactacaaagcgtgataatacatatgcaaagaccctactgatgtcttaattacctagaatatatttttgcaagtgttttgcaagggcatataacaaacacttawcattagcacattatttcttcccattttgagttttatattctaatagatattctatgaaaataacatcctttattttaaacacatgtaaaaacctcccaaattaccatattttatattattggcattcttttctccaatgagatggttaatacttaattttatcttaagtcagtggtcaaaaaaaaaaaaaaagaattttcttttgaagagtaagtcaaggatcaaatttattgagtacttattaggtacaacaccccaggctaggagccatggtaatatagagatgtgatgagcactgtc

SEQ ID NO: 152429 - DNA, 601 bp, Human
gccacttgtgctttatcttttgggactgtgagcagttccaatcccaaagagctcaattactacccttcttttactgtcacttctctccctcagaggatcccaacatcattcatgatcaagcctaaaccacagagagaatgcagtcagctaacactactaaagcacaatacatttcataattttcctcgaagccttatccattaaagaaaaaaaaaattatgactatgacttcaattctgattgtttaggaagtatattattttccttcttaggataatgaaattatgctacactggcaatrtatattatctcttgagatactaatgaaactaagagaagcaaactcaaaaggttaccccaaaatatgttctaaaaatttgtactgcagagtgaaatagcattataaaatgcatcttctacaaccattttctgcaaacaatggtatcatacattactacagactttaaggttattcttcatcttttacataaacaattttgatgttaagacgcactacaaagcgtgataatacatatgcaaagaccctactgatgtcttaattacctagaatatatttttgcaagtgttttgcaagggcata

SEQ ID NO: 152430 - DNA, 601 bp, Human
ccttgagtgacatggagaaaatttaagtacaaaaggcaaagtactagacagcctggaaaggtttcacagatgaaactgcccaaatgagccaaaagttcactattaaattacttaacaaacaattaaaaacaaaacaagcccacctcttcaaatatattactgacttacaacagcagcaatgatgtaagcagaaagacttcacatttccaatcagaagaactgttttatctgaaggagtactttatcagagataactgtttttctcctatttgccttccgtgcttctgtttcttttttcctycttttcaattttattctcataaatgtgaatgtaagcctctcaaaaactctgggacctttctttcaacaaggaaatacagtcttagtagagacaaactggctgggtgagagtagaggcgaagagaacttaatactgaaggtaccctacaacactgccagttacatggtttcacagtcatttcctacaaactcctaacaattaccagaggtaaggaccctaattctcaatttttttagccaaggaatctaaaaatcaagattacacagctaatagataaaaactgagaataagacaaacctc

SEQ ID NO: 152431 - DNA, 601 bp, Human
atatgattgccttggttaacttgacccatcattcccataggtggctgctgtccttggtaatgctgtccgcctccctgtggcatattgtattgctgagaaggaggctgctgatgcatcattggacctgaaacaagacacaacattatacacataattttttgtatataactttaacatctcaagagaaataagataatcttttatcatatagtcccaaaaatatataattaaatgcagtaaaaactgatttcaaataataaaaataagtctttgaattaaaattcacatgcctaaaataatstgcaaacaaaagaaaataaccaatccatggtggttaacttgaaatccactggaagatgattcttagtcattttttaaaataaaatgcatataatatatgaacatcctgaatgtgtgtattttccattacacactatctaatatttatctataccatctttcttgagaagatatcatccttatgctacactggaaaatataccaaaagtaaactttacaaaatcacacagcaaaacagtggtcaaactaaggaaaagaaaccaaatctctagatttttactttgttctctttttcaatact

SEQ ID NO: 152432 - DNA, 601 bp, Human; identical to SEQ ID NO: 33034

SEQ ID NO: 152433 - DNA, 601 bp, Human; identical to SEQ ID NO: 33035

SEQ ID NO: 152434 - DNA, 601 bp, Human; identical to SEQ ID NO: 33036

SEQ ID NO: 152435 - DNA, 601 bp, Human
tccagtcttgtctcttcttccccatgcttctgctttactgaactacacacggtttaacactagtccctttgtgaatgctcttctttcatcatccacatctacctggctaatattggctcatccttggtacttcacacttatatataatatttccgaaggaatatttctcaagatctgagttagaagctccttccacataaatcttagctttccttatctaagtacttatcacactgtatcatatcatatgtttacccacctgtatgccatctacacttaagttcataaagactgagtccaygtctatcttatttcccaatatgttcccaatcttagcatggcacttggcatataatggttgctcaataaacatttgcttaatgaatggcttgaagtttaggagatttggaaatatattgacttagaaaggaaaatgatcagtttagtctacaacatgctaaagctgagggaatccaaagacaagagatgttctgtacatttggataaaaaggagctgaaactgggttgagaagtaagagctaagaatactgaaaatagagggcagtatgattcagaggctagaaaaaaaaatacagagtca

SEQ ID NO: 152436 - DNA, 601 bp, Human
gaggtgactaatgtctttaaaacattactctgggtcccatgtgcagagtatcttgtagaggaggcacgataaaatcaagaaaagcaaaaaggaggatatattgcaacagtccagatgagtgctagttgtgacttttgacttgggtgaaaggagactgtgaaaaatggctagatattagatatattttgaaggaagaggtgaaggggtttgctaattggatgtctgctttgcaaagaggggagtcaaagatgactctagatttttaacctgaggaacaggaagaatggaaccactgtttacyggatagcaaggaccgatggggaagtatcctaacaatttccacccttttaatttctccccttttatcttgcatattgctgtaagattcatctgcctaaactacaactataattatgttagtattgggtttcagaatcttcgttagttttccattgcctcaaccatcaagacgtgaacgaactatttttcctaaaataaagagatcaataggtctttgggtgggggctaaagataaggttaaacattaggttaatgtagaaacactactggcactaaaatagctaaaatggtccccccctca

SEQ ID NO: 152437 - DNA, 601 bp, Human
agaaagaaagacagttcttaaatcaatgggactacaacttcaatcttaagaaactggaaaaataagaacaaataaaacccaagtaagcagaaaaaaagaaataataaagttctgggcagaaatcaaagaaacagaaaagcaaatgggcaaaaggcaataaataaaatcgagctgctttttgagaaaaatgaataggtagattaaaactagccagataaatgaggacaaagagagaagacacaaattattaatatcagaaatgagagaggtaatatcactacagattatggagatattgagygatgataaagaaattattcaacaacacagataaaatggacaactccaatgaaaaacacacaaaacatttactcaagaaaaaaatagataacctgaataccccctatatttcataaattaaatttataatttaaaaatttctcacaaaaaaaactacaaacccagatggcttcactggtaactttgcaccaaacattttagaaagaataatgccaattttctgaagggaggaaattcttcccaactcactctatgaaaccagtgctacctcagtaacaaaaccagacaaacatgttacaag

SEQ ID NO: 152438 - DNA, 601 bp, Human
cccctctctttgataaagaacacagaaaagttttggtagaaaaaattataaatttattttgtttctgctgaattaatacctatgatacatctaagcagagctgtcgagtaggcatctaatttccagaagagagattgagactataaatagagatttgggagtcaacagcatggtgaactgagaccttgtgaataaatgagaatgcctagggagagtatattgaatgagaagagttcctaaggtagaaatctgagcaataccaaaatctttacatttctttccttcattctatttacctaaycagtttaaaatcttaacattattccttcacaacattttaggggtttcctcttaactctggtcttgtgatcacgcattcaaatctagaaagtaatggccttatttactcagttgtttatactttattcaccaatatttactgattatgtgctgtgctctactaggtgacagagactcaacagtaataaaaacagacaaagcgatgcttttaaagaggttacattcttggggaagaagaatatgacaataaacagtaacaaaataatctgtcaaatgaagagaaatgttatgttgaaaaatt

SEQ ID NO: 152439 - DNA, 601 bp, Human
gacagaaagggaatatagacaaaagggacatgatgaagcagcacgaagggacatgatgaagcagcacaattctgtgagtgggggtaaacaatgtccagtatacatctgttcaggttaacttttggagaagataagcaacatcttttcctctaaaacagaaggtagaaaaaaagaaagacatactatgaaatatgtattttattacaaatttcttaaatgtgtttaaaacagatgttcataaaagcactaattttcaaaaagcatgactcactggaagcatataattagttaactgtttccyttggctaaacaactctctctccacgtcacaacaatataactcaaaaacattctagacttgaaatacttctctaccataagaaatggtaccctaaaaatctacatttccacagaagtaaatacacatgataatgtgttgaatgtcaccatatatatgatggaataatgaattaaacagaattagggattttatgggccaggcatggtgactcacacctgtaatcccagcactttgggaggccaaggcgggtgattcacttgaggtcaggagttcgagaccagcctgactaacatggtgaaa

SEQ ID NO: 152440 - DNA, 601 bp, Human; identical to SEQ ID NO: 33037

SEQ ID NO: 152441 - DNA, 601 bp, Human
tgcagtgagccaagatcgcgccactgcactctagcctgggcaacagaacaagactccctctcagaaaaaaaaaaaaaaaaagtcttgtttgcttgcaccccctcccctcccacaccctggggttgctacacccggtcttttaatagagtccgttcactttgcctccatcacctaagctccgtctcacatctcaattccttattccccctccctcatcctaaaccatacttagagccttcagtttctccacccctccgattaactccaccccgtgcccgagactccactctcatctattggsaagttccttgactccacctttctgttgttcttcgaccacgcctcacatccactggtcctgcttccttcttggccccctctacattttcaaggccacgcccatctgcctggtcccgcctatgatgactggcttggcctttatcttttcggccccatccggtttcttaagtcttgcctcatcgatttggccacgccccatcccactcagcctccagtctcccgagaccctgagatttctcgggccccgcctccaccgccgaggccccgccccggatcgcgaggccccgccccccacttactc

SEQ ID NO: 152442 - DNA, 601 bp, Human
tctggagacagaggcctggcaggagacattggacactttcatccgtccagcgggatcccgggagagctccagaccagtgcggatggacacaccctcagctgaggcgttgatgtagcccccatcatagctgccaggggggttaatattcactccaggtaggagctcaattgagtcttcagtgcccccatgcatcaccatacctcttaataaggtttcacctctttccacacatcctaccaaaccctcctatcaactcgtatgaaatgcatatgcctgtttctgttacacagatgaagaaackgaaactcaggaaggctaagggggctgcccacagccccacagcacctccagccctcctgacccactctccactcccctgagggtgctgggtccttacaagaaccagtagagcagctgtctccggaagcgcagccccaaggaggcattggtgatttgaagcatcagctcctgctgtggctggaaatcgagctcggaagatgtcagttgcagctctgtgaccttcaccctacaggaggcctcagggtcagatccagggccaagaagagggaacttcccccaacgacaggaaatttgtctgctc

SEQ ID NO: 152443 - DNA, 601 bp, Human
gtgagctggggttggggctggggcttacttgaaggttcccccgaaggccgcgtgcattctggagacagaggcctggcaggagacattggacactttcatccgtccagcgggatcccgggagagctccagaccagtgcggatggacacaccctcagctgaggcgttgatgtagcccccatcatagctgccaggggggttaatattcactccaggtaggagctcaattgagtcttcagtgcccccatgcatcaccatacctcttaataaggtttcacctctttccacacatcctaccaaaccytcctatcaactcgtatgaaatgcatatgcctgtttctgttacacagatgaagaaactgaaactcaggaaggctaagggggctgcccacagccccacagcacctccagccctcctgacccactctccactcccctgagggtgctgggtccttacaagaaccagtagagcagctgtctccggaagcgcagccccaaggaggcattggtgatttgaagcatcagctcctgctgtggctggaaatcgagctcggaagatgtcagttgcagctctgtgaccttcaccctacaggaggcctcaggg

SEQ ID NO: 152444 - DNA, 601 bp, Human
cgccactgcactccaggctgggtgacacagtgagactccctctcaaaaaaaaaattattatttttgttattattatttagagataccaattattgagaatccagtacatggccaaatgtgcatatcagatagtcctcacagttactcttatctaagtggccagcacttaaatatacatttatcatatgccaggtgctgttctaaatttttttttttttttttttttgagatggaatcttgctctgtcaccaggctggagtgcagtggcacgatctcagctcactgcaacctccgcctcccrggttcaagcgattctcctgcctcagcctcccacgtagctgggactacaggcacgtgccaccacgcccagctaatttttgtatttttagtagagatggggtttcaccatgttggccaggatgatctcgatctgttaaccttgtgatccgcccgcccagacctcccaaattgctgggatttcaggcatgagccaccacagccagccttgttctaaatattttttacatataccaacacaaataatcctgacaacgatcttataaaataggatcttataaaatgaggatattgaggcaccaag

SEQ ID NO: 152445 - DNA, 601 bp, Human
tccaacttgggtgacaaagtgagactcttgtctcaaaaaaaaaaataaataaaatgtgtaactcttactctcctccccaatacacaaataaacaaaagtatatgtgaattattattaaagccctcacacttgcaaagcttgggttctcactaatcctcacagcagctctgcgaaggagatggggcaggaaggagcaggaaggagcagaccgcttcacagacaggaacagccatgacaaggcgagggggattggccacagacaagaggccagggccctgtctgcgtggctgccactgggggmcccacctgcacccctccttggtctcactggtgtgcaggtggccctatccctgcccccgccagcactcaccagcaggacaatgctcccaaagtaggtggccctcagcagcatgtccaggtcgtggggcacctgaacaggggaatcaggagtgagggagtgagctctgtcacagaccttctcttgcccatcccacaaacaggccatgacataccttgtcccccaccagcaacagctgcagggcccccgcccggaagtagctctccatggcagagtcgaagaagaactcagagaaggccacat

SEQ ID NO: 152446 - DNA, 601 bp, Human
atttgtaattctgctaggtgcggtggctcacacctgtaatcctagcactttgggaggccaaaaatgggtgatcacttgagcccaggagttcaaggacagcctgagcaacataatgaaactctgtctcaacaaaatataaaaattagcggggtgtggtggcacaagcctgtaattccagctactcaagaggctgaagcaggaggatggcttgagccctgggaggcagaggttgcagtgagcctagattgtgccactgcattccaacttgggtgacaaagtgagactcttgtctcaaaaaaawaaataaataaaatgtgtaactcttactctcctccccaatacacaaataaacaaaagtatatgtgaattattattaaagccctcacacttgcaaagcttgggttctcactaatcctcacagcagctctgcgaaggagatggggcaggaaggagcaggaaggagcagaccgcttcacagacaggaacagccatgacaaggcgagggggattggccacagacaagaggccagggccctgtctgcgtggctgccactgggggccccacctgcacccctccttggtctcactggtgtgcaggtgg

SEQ ID NO: 152447 - DNA, 601 bp, Human
taaaatttgtaattctgctaggtgcggtggctcacacctgtaatcctagcactttgggaggccaaaaatgggtgatcacttgagcccaggagttcaaggacagcctgagcaacataatgaaactctgtctcaacaaaatataaaaattagcggggtgtggtggcacaagcctgtaattccagctactcaagaggctgaagcaggaggatggcttgagccctgggaggcagaggttgcagtgagcctagattgtgccactgcattccaacttgggtgacaaagtgagactcttgtctcaaawaaaaaaataaataaaatgtgtaactcttactctcctccccaatacacaaataaacaaaagtatatgtgaattattattaaagccctcacacttgcaaagcttgggttctcactaatcctcacagcagctctgcgaaggagatggggcaggaaggagcaggaaggagcagaccgcttcacagacaggaacagccatgacaaggcgagggggattggccacagacaagaggccagggccctgtctgcgtggctgccactgggggccccacctgcacccctccttggtctcactggtgtgcag

SEQ ID NO: 152448 - DNA, 601 bp, Human
aaactgctatgccttcttctataggcagtgaaggaatactataagatgcaactgcctaatcttcaccaaacatgattctaaacactgtatatgtgttggttcctttaaacctcataataaccatgtgaggccgatattattactgccaattttgttgttgttattttttacaaatttatttttcaggctgagtcgtcatggcagagaattgcttgaacccgggaggttcaattgcagtgagccaagattgcgccactgcactccagcctgggtgacagagtgagactttgtccccccaccsaaaaaaaaagatctgactaaaaatttatttttcaatagagacagtgtctcactgtgttgcccaggctggtctcaaactcctgggctcaagcaattttcctaccttgacctctcaaagttctcagagtataggcgtgagccatcatgcccagccatatccccatttttgagatggggaaattgaggcacagataggttaagtaacttgtagaggttatgtagttactcagtttcagaactaggcttgaagcccaggcagtctgacaatagagaccctgccctgccataaattggatgatga

SEQ ID NO: 152449 - DNA, 601 bp, Human
cagcctcctgaacagctgagaccacaggttcatgccatcacgcctggcttatttttgtatttgttttttgttttggtttttgcttttgtgttttcgtagagacggggtttggccatgttgcccatgctggtctcaaactcctgggctcaagtgatctgccggcttcagcctcccacagtgttgggattacaggcgtgagccaccgtgcctggccatatcttctttctctaaactgctatgccttcttctataggcagtgaaggaatactataagatgcaactgcctaatcttcaccaaacrtgattctaaacactgtatatgtgttggttcctttaaacctcataataaccatgtgaggccgatattattactgccaattttgttgttgttattttttacaaatttatttttcaggctgagtcgtcatggcagagaattgcttgaacccgggaggttcaattgcagtgagccaagattgcgccactgcactccagcctgggtgacagagtgagactttgtccccccacccaaaaaaaaagatctgactaaaaatttatttttcaatagagacagtgtctcactgtgttgcccaggctggtc

SEQ ID NO: 152450 - DNA, 601 bp, Human
cagcctcaacctcctcagctcaaattatcctgccacatcagcctcctgaacagctgagaccacaggttcatgccatcacgcctggcttatttttgtatttgttttttgttttggtttttgcttttgtgttttcgtagagacggggtttggccatgttgcccatgctggtctcaaactcctgggctcaagtgatctgccggcttcagcctcccacagtgttgggattacaggcgtgagccaccgtgcctggccatatcttctttctctaaactgctatgccttcttctataggcagtgaagraatactataagatgcaactgcctaatcttcaccaaacatgattctaaacactgtatatgtgttggttcctttaaacctcataataaccatgtgaggccgatattattactgccaattttgttgttgttattttttacaaatttatttttcaggctgagtcgtcatggcagagaattgcttgaacccgggaggttcaattgcagtgagccaagattgcgccactgcactccagcctgggtgacagagtgagactttgtccccccacccaaaaaaaaagatctgactaaaaatttatttttc

SEQ ID NO: 152451 - DNA, 601 bp, Human
tgttgcccaggctggagtgcagtggcacaatctcggctcactgcaactctgtctcccaggttcaggcgattctcccgcctcagcctcccaagtagctgagattacaggcacctgccgccatgcccggctaagttttgtatttttaatagaaacggggtttcgccatattggccaggctagtgattcgcccacctcggcctcccaaagtgctgggattacaggcatgagccaccacacccaaaccccttgccatatctttttgctctctctctcctttttttttgagacagggtctctgttrcccaggctggagtgcagtggcatgatcacggctcactgcagcctcaacctcctcagctcaaattatcctgccacatcagcctcctgaacagctgagaccacaggttcatgccatcacgcctggcttatttttgtatttgttttttgttttggtttttgcttttgtgttttcgtagagacggggtttggccatgttgcccatgctggtctcaaactcctgggctcaagtgatctgccggcttcagcctcccacagtgttgggattacaggcgtgagccaccgtgcctggccatatcttctt

SEQ ID NO: 152452 - DNA, 601 bp, Human
cccttctctgcttaaagaatgccctttatgatgcactgattccatcccaggaacccaacagagctcaggacagcccacagggaggtggtggacggactgtaattgatagattgattatggaattaaattgggtacagcttcaaatcccgtcttctctgtggcactgggggttagagggggcactacaggctatgaatgtgggaaaagaggggctgagaggggttggggtcctgaatgacagctgccagcttggggattgagggctcagacagctgctgtggacggtgtgggggcagtggaygccctgacatcagcaggccggttcttctcaatcacctctcgcagccctttggcaaagtggagatcagccccgatggtgaggaatccctgtgttggggagaggggagcctcatttattcattcagttattgaggccagagtttagagatcaagagacagagtgtttgtctttcaggaactcaatctaatggataattccatgtcaaggtgttaaaatgaggctgtaggagtgtagactatgggtgtcaaggagggcttcttggaggaggtgacctctgagctaagacctgaacaattagta

SEQ ID NO: 152453 - DNA, 601 bp, Human
gcacctgtaatcctagctacctgggaggctgaggcaccagaattgcttgaatccaggaggcagaggttgcagtgagccgagattgcgccactacactccagactgggcaacagagactctgtctccaaaaaaaagggaagcctatttaaggtcctgatctaaaactctaggaggggccaggagtggtgctcacaataatcccagtgctttgggaggccaaggtggaaggactgcttgaggccaggagttccaggctgcagtgagctatgatggcgacactgcccccacgcctgggcaacasagcaagaacctgtctctaaaataaataaattttaaaaataaattttaaaaaactctagggaaacagaatagccacattttctctacggcacataattgctattatttatttctctctcttttttgttttgacacagggtcttgctctgttgcccaggctggagtacactggcgtgatcacagctcacagcagcctcaacctcaacaatgaaaagaaaaacaaaatgtttttaagacggtgtttcaccatgttgccccggctggtcttgaactgctgagctcaagagatcctcccgcggag

SEQ ID NO: 152454 - DNA, 601 bp, Human
cagggccagcacggtggctcatgcttgtaatcccagcactttgggaggccaaggtgggaggatctccagcccaggaattcaagaccaccttgggcaacacagcaagaccttgtgtctacaaaaaatttaaaaattagttgggcatggtggcatgcacctgcagtcccagctacgtgggaggctgaggtggaaggatagcttgagcccagggtcaacacttcagtgagccacaatcaaaccactacacttcagcctgggggacagtgcaagaccctgtttcaaaaaaaaaaaaaaaaaaaaagagtcccaagtcaagtgtcctggccacatttgtagatgatattggagagcaacagttattgctcttaaggagcctgcaattcggtagttcaattaggaaatatttgtctttcacaagcatagttggcacagttaatccaattttacagaggaggaaactgaggctccagaggataactggcttacccaagatcactcttgggaacagagaagagtcaagacccacaccaaggtcttttaatgaggcagcaaatgctgttgcagcagtttaaataaagattcagaacttcagagggaaggc

SEQ ID NO: 152455 - DNA, 601 bp, Human
gcttttgtctctagtcttatgtaatctagtatatagcaccctgcaaatttttttaagagctttactcatgtaatttacataccataaaattcacccttttcaagtgaacagttcaatagtttagggcaacaattaggcaactctcccgactattttctctagttttcctcttgtccacctgatacattaattcatcctccatagctcagctcaaaaatggactctccataacattttatctttattcttatctgagcacttcttactgtattaccatttttttatgtatccagccttcccyccatcaactatgaagaagacagtgatagtaattatgaacatttacacagcactttacagtgtatagacggactttttttcttttttttactacttacttattgttttggactagtcaagtgcagtagtgagcaggaggaaagagtagatcaaggagttcgatctgtaactgactttgatcaattgataacacactaccttaggaccagcctagactgatttttttaaatgggttaattcttttgatcttatcctttgttgtgtctagggaagccaattcatgtttatgaaattattttga

SEQ ID NO: 152456 - DNA, 601 bp, Human
gaggctgccgggctggtctgacttctattgacggaaatctctggaagtgttttatagccaacctggcatgaacgtatctacataacaaaggataatttgtgtgtgcaccaggcctgcctgcatgtgggtgtttaagtcatatattttgagtgctaggtgtgctcagctagtccaactcttcgttttacagataacccctttagcttctggttttttatgtgactcacccaaggtcatattactagttagtcttagacatttaggagccacaaaactaaaacaaaactatgaaagtgggtgycagtatacactgtctgcagttttttccctatggaatgttcacagtgtggtgactgaatcaggggtcaggccagcaggctaaacccattcctgatctattacggactactggaagagccacactggggacggaaccaggccttgaatgagactgctctactaaccaagtggaatatctgctgaacacccattcaattaagcttgctaaacaccaataatctagccttgaatttcaaaaaactagggcacagaagtcagaagatggcagttgaagcacccaatgtgccatctactagctatg

SEQ ID NO: 152457 - DNA, 601 bp, Human
taaaatcctagagggcagagcctaggtgtgtaatccttcctttgaaattccctattgtattacatctggtgttcatggatgcagaacttgtcaaaactcacaatgagctgagggagtacaactggattatctaagttcagaaatgagaagtgctgattgttttggcttctacccagaatttagtagttacacagctaaagagtttctatttttaaaggttagatcatatggatatttcacaacatgctctagagtttaattactaagaaaatgactggatagggaagcttctttcaacgayaggaacagttcaggaaaggttaaaaaaaagccccttctaggccaggtgcagtggctcatgcctgtaatcccagcactttgggaggccgaggtgggcggatcacgaggtcaggagatcgagaccatcctgcctaacacagtgaaaccccgtctctactaaaaatacaaaaaattagccgggcatggtggcaggtgcctgtagtcccagctacaggctgagacaggagaatggcgtgaacccgggaggcggaggttgcagtaagctgagatcgcaccgctgcactccagcctgggtaacaga

SEQ ID NO: 152458 - DNA, 601 bp, Human
ctctgcagctgctccacctcaggggcctccacacctccatctctttctcttctgtgtttttaacctcatctctctctcagtcccttcacctgcacctccctagaaacactgctctaattatatccacaaacccctctctcagcttcagtgatctccagcttctctccagcagcactttccactagctgcccaacagcctcagtgcttaagacgaaaccaatctttcctctatttgtatttcctcctctattgccaattcctcttcaacagagtttcaaatgaaaatctcaggcacctttcraacccacctcccatagcgaacctatcgctcactcccagggaggctccctcgtgcagcctcctgccctcactcggacccggcagtgtctctggtgcagatgcctgccgcttgcctcttccggaacaatgctcaaagttttctggtgctcagaaacctccaacccacccttcccactgcctgtgcgacaagcttcagacacctcactctggctctgcccactctcctttctacagtattccaaacctatcactctaactgcctacccttccttccttctctcccacatgaagtaggacctgc

SEQ ID NO: 152459 - DNA, 601 bp, Human
agtgaagtaggtaatggaaattgcttatttacataatttctatttcctgcttatttgttgataagaggaagctatagttccatgtaagaaatactcaatcacagtagagagaaaagcaagatagtgacttagcaattactaaagcactatttttgcacatctgcaccaggaactatataagctctaagtaatgaaagaatatttccatatgtatttaggttaattaatatcaatacatcatgagtaacatgaagaacaaaacaacaaaaccacaaacatcaacaccccaatgtaaagagcragaatgaacttcctgtccttgaggctgaagtagaaagcaaagaatgtgctaactttaaggaaaaacaccgaggcaatctcaaaagaaaattttaaaacctcttatgtaaagatttctcaaaaaccactcacatttcccatgtgagagtcacaaggttgtcagaaaattcagcggaggggaggggtcagtgtgaatcatcaggtcagtgccttgctctgaaggctgctgcccaaaacgcacctgatcctctgcctcacaatggactcagaaagccacagagggcccagcttgccagggccc

SEQ ID NO: 152460 - DNA, 601 bp, Human
ctgggaactgtggttcacacctataatccagcactctgggaggctaaggtgggaggatcatttgagaccaggcctggccaacatagtgagaccctcatctctagaaaaaaataaaaattaggctaggtgcagtggctcatgcctgtaatcccagcctgtaataaccaggctgaggcgggtagatgacttgaggtcaggagtttgagaccagcctggccaacatggtgaaaccccacctctactaaaaatataaaacttagctaggtgtggtggcatgtgcctgcagtcccagctactgggsaggctgaggcaggagaatcgcttgaacccgggaggaggttgcagtaagctgagatcatgccactgtactccagcctcggtgacagagcaagagtctgtctcaaaaaaaaaaaaaaataaagaaaaacataaataaaattagctagacatggtagtgcatgcctgtagtcctagctactcaggaggctaaggtagaacaatcactggagcctaggaagtttaagctgcagtgagctgtgatcacaccacaaaccactgcactctagcctgggcagcagagtgagactctgtctctattata

SEQ ID NO: 152461 - DNA, 601 bp, Human
ctgcagtgatatttgtgcagagaagcattttccctttttaatatttgcttcccaaacatctttatcagtgtgctgaagtctgaaaaatttagaaagataccacaatctgctgttctaaagaccactaccagcttgctcttttgcatatttgagaattgctggctaggcctagagaagaacatctattaccaagccctttttcactgctcagggtcatagccaacagaacagataaaaaactaagtttgacaaaaccagccagctacagcagaacaaaatttttaacagctccccgaggccrgctctactgaggacctgactctatcacaacccttcaccagagggagggacaagaatgatgtgcaaagcaaagcatggggggagaggaaggactgcatgatgagagtctcaggccaggcacctgagcaggacccctaggaacctctcttccccacagtgcacagctcaagtttgaaaggagcctggccgcagtgcagacaccctgcagggtgagaacatcgcagaggaaaccaagcatcaactctgaatgcaactgggaagtgaaccaagtctggtaattattgtttttctctttatttct

SEQ ID NO: 152462 - DNA, 601 bp, Human
gtgggaagttaaagttagggggagttaaagcaagcgctttaaggagatttttatattcgttgcagttcaagtcctaggatacaagcaaagcaacaactcttatttcctggccaatggaactgaaaattgtgattttccagagttgacaggacaactaaaaggaacaatttgctctgctgtcctgatgccagctgtaaaagaggaataattaaaagtttacttaccattggcaaaactctgtccgacgtagtattgtaactctttcacatttgttttcgtctggtttgtaacaggatcaacrtaatcttcagtagctgtaacattcaaaaactgactctgtcgagggctacatgtcagctcacaaaacaggttcagtaggttataaaaacaggatggacatctaaaggaaaagtaaattatattctgcatgatctcacacataatagggccagcaagaacgattttaaatagacaaagaatattttaaacttactgtaaagtgacaaattaccaagagaacatattaaaaaccagcaattctaaacttaaaacttcatgttaaaataaaggcacacctttaaaaaatgccctaattactttc

SEQ ID NO: 152463 - DNA, 601 bp, Human
ggctgtaccgttttgtactcccaccatcaatgaatgagagctcattgccagcatttggtgttgaaagcgtcttgaatttttgccattctaatagatgtgtagtggtatctcgttgttttaatttgtaattctctaatgacataatgttgagcatctcttctcatgtacttatttaccactgtatgccttctttggtgaggtatctgttcaggttgttttgtccatttttcaattgggctgtttgctttcttattgagttttaggagttatttgtatattttgaataacagtccttactaayatgtcttttgcaaatactttctcccagtctgtgtcttgtcttctcgttcttgaggtcttcaatttttcacaatcacaatagtgttacagtgggtgttcttatatgggtctccaggtttatatgcatttagagtttctctaaggcaggcatctataagtgaaatttctgggaggagggttagcttcaacttactacgtactgcaaagttgtttttcaagtagttttgaaacgattgtaccaaattatggttgtaagtggtggagtacattagtattcctattgcttcacattttcacccac

SEQ ID NO: 152464 - DNA, 601 bp, Human
tatccactctggaaaatcctcattatccctttgattattattgtctctccccaactctctggagcttctcatgttatatgtcatttctttaatgatttataggtctttgtatctgtatgctgttttctgagtaattccctcgtatcttccagctcaccatttggttttcaggttttattttatgtttcaagcatacaaaacacatggagaataatacaattctcatttcctcattacccagttaactatcagtcataccatttcacaacatttgcctcaacattaaaaaaataatggactyggccaggtgcagtgactcacacctgtaatcccagcactgtgggaagatctcctgaggccaggagtttgaggccagcctgggcaaaaaagcaagaccctatctctacaaaaaaaaatttgtttttaattagctaggtgtggtagcatatgcctgtggttccaactacccagggggactacttgaacctaggaggttgaggctgcagtgagccatgattgcatcactgtattccagcctgggtgacagcatgagaccttgactctgttttgtagtactgcactattcagaacaactggctat

SEQ ID NO: 152465 - DNA, 601 bp, Human
ccgtccgaagtgctggattataggcatgagccactgtgcccagctgtttttggtttttggatttctttttaataaaggttcctattttccacagccttgtcaacactgcttgttatgtgactttgattctagccatcctggtgggtgtgaagtggtatctcattgtggttttgatttgtatttccctgatgactcatagtattgagcatctctcatgtgcttgttggtcatttgtatatcttccttagagaaatgtctactctattcagatcttttgccattttaaattgggttatttatytatcattgagtagtaagagtttttttttttttttttttttttggagatggagtctctgtccctcaggctggagtccaatggtgtgatctcagctcactgcaacctccacttcccaggctgaagcaattctcctgcctcagcctcctgagtagctgggattacaggcgcacatcaccacacctggctaatttttctattttagtagagacagggtttcaccatgttggccaggctggtctcgaactcctgacctcaggtgatccacccgccttggccccccaaagtgctgggattacaggc

SEQ ID NO: 152466 - DNA, 601 bp, Human
tatataatttaatggagtttagcatattcatagatatatgcaactatcaccatagtcaattttataacattttcatcacctcaaaagaaatcctgtattctagctatgctcaactacctccctacttccctaagccctaagcaaccactgaactgtctctatttatctgactatttcagacagttcacataaatccaatcatataatatgtggtctttcatgaccggcttctttcatttagcataatgttctcaaggttcatgcatattgtggcatgtatcaatacttcatttctttttayggccgaacaacatttcattgcaaggacatatgttttgtttatccatatatcaggtgataaatatctgagttgtttccacagtttggctattatcagtaatgctgctagaagcatttgtgtataagtttttgtgttgacctatactttcgtcttgtgagtggaactgatgggtcatatggtagttctatgtttgtttcaggaactgccaaactgttttccaaagtggggtctcactctgtcacacagattggagtgcagtggtgtgatctcagctcactggcaacctctgcccctcaggct

SEQ ID NO: 152467 - DNA, 601 bp, Human
tgaaatacataaaacaactgaaagaagaaaaagaattggaggttttagtttaattaaattatgttttgctgcttcgtcctatggaattttaagttacctcaataaacttgcgcgtaggggtttgtcactgatagaggaatcctccaagtacaccacataccaaggcaacccttcaatcatgtcccatctccattctcaggagctaatactatagcagagctctagaaaagctgcctcccaccccctttttaactgcttattctttcaattatgacagcaatgcctgaaggcaattcatttsctcctccattcccactcccagcaccccctaaattagccacagcaggataaatgtaccagttacctctcttactgggagaaactatgaactagttacctgaatgtgtttatcttcctattgtagattatgcttcctcaactaagattcattcattcattcatggagagacagggctttgccctcaccaaggttggagtacaatgggatgatcgtaactcactgcagccttgaactcctggacccacgcaatcctcctgcctcagcctcccaagtagctgggactacagatgcatgccacca

SEQ ID NO: 152468 - DNA, 601 bp, Human
ctatgagtgagaacatgcggtgtttggttttttgtccttgcgatattttgctgagaatgatggtttccagtttcatccaagtccctacaaaggacatgaactcatcattttttatggctgcagagtattccatggtgtgtatgtgccacattttcttaatccagtctatcgttgttggacatttaggttggttccaagtctttgctattgtgaatagtgccgctataaacatacgtgtgcatgtgtctttatagcagcatgatttataatcctttgggtatatacccagtaatgggatggmtgggtcaaatggtatttctagttctagatgtactatgagttatgtaagttgtatcatcggggaaactgggttaaggatacacataaattctaccattttgcaactttttggttaagtctacaattatttcaaaataaaaagtaaaaaaagtactgtcctaaattaagatgcaaatatctaaaaggactatagtactccatttaattagatttgaatctgatttcgctcatttgactctgacttttttttttttttttttttttttggtgagacacagtctcgcactgtcgccagggctgt

SEQ ID NO: 152469 - DNA, 601 bp, Human
taatgctatccctcccccaggcccccaccccacaacagtccccggtgtgtgacgttccccttcctgtgtccatgtgttctcattgttcaattcccacctatgagtgagaacatgcggtgtttggttttttgtccttgcgatattttgctgagaatgatggtttccagtttcatccaagtccctacaaaggacatgaactcatcattttttatggctgcagagtattccatggtgtgtatgtgccacattttcttaatccagtctatcgttgttggacatttaggttggttccaagtctttrctattgtgaatagtgccgctataaacatacgtgtgcatgtgtctttatagcagcatgatttataatcctttgggtatatacccagtaatgggatggctgggtcaaatggtatttctagttctagatgtactatgagttatgtaagttgtatcatcggggaaactgggttaaggatacacataaattctaccattttgcaactttttggttaagtctacaattatttcaaaataaaaagtaaaaaaagtactgtcctaaattaagatgcaaatatctaaaaggactatagtactccattta

SEQ ID NO: 152470 - DNA, 601 bp, Human
tgaaacagggaagggcattagagaaaaagctggtgaaatctgattaagatctctggtttagctaataataatgtaataataatggcatggtcgtggttttgatcattgtactatgagttttttttttaattattattatactttaagttttagggtgcatgtgcacaacgtgcaggtttgttacgtatgtgtacgtgtgccatgttgatgtgttgtacccattaactcgtcatttagcattaggtatatctcctaatgctatccctcccccaggcccccaccccacaacagtccccggtgygtgacgttccccttcctgtgtccatgtgttctcattgttcaattcccacctatgagtgagaacatgcggtgtttggttttttgtccttgcgatattttgctgagaatgatggtttccagtttcatccaagtccctacaaaggacatgaactcatcattttttatggctgcagagtattccatggtgtgtatgtgccacattttcttaatccagtctatcgttgttggacatttaggttggttccaagtctttgctattgtgaatagtgccgctataaacatacgtgtgcatgtgtcttta

SEQ ID NO: 152471 - DNA, 601 bp, Human
aaaataccgttttctgaaaaacagaagtgaagaaatagcattagtggacttcatcacagtgaggttgtttttgggacattcctgtaatcccatgaaatgctttcttcctcctcctggcctcctcctccctaattactgccttctttcccctaagtccccttgctctgggtccctctgctcaccagtctcaggagaaaatttaagaagatgttaagagaacaattaataaaggataatttcaccttgtggccctcattttatttaaaacttttaggtcctttaaaaacacactactgggctrggcgcggtggctcacgcctgtaaacccagcactttgggaggccaaggtgggcgggatcacgaggtcaagagatcgagaccaacctggccaacatggtgaaaccctgtctctactaaaaatacaaaaaggttagctgggtgtggtggcacgtgccttgggaggctgaggcaggagaactgcttgaaccagggaggcggtggttgcagtgagctgagatcgcgccactgcattccagcctggtgacagagcaagactccatctcaaaaaaacaaacaaacaaacaaaaacatgctactcttt

SEQ ID NO: 152472 - DNA, 601 bp, Human
tccagctgggcatggaagctcacgcctgtaatcccagcactttgggaggccgaggtgggcggatcgcctgaggtcaggagattgagaccagcctggccaacatggcgaaaccccatctctactgaaaatacaaaaattagctgggcgtggtggcacacacctgtagtcctagctactcaggaggctgaggtatgagaatcgcttgaacttgggagccggaggttacagtgagccaagattgcgccactgcactccagcctgggcgacagagcgagaccctgtctcaaaaaaaaaaaaaaaagatgatgtaaacttcacagggcaaggtcttgttgtttgctcacctctgggttatgctcataaaacaagcttttgcccatgtaccctaagtcagacccaagaatggtgtctaccaatgattgtctcttgccacttaccgtacgcagtacagaaagtgcgtgtggtaatcggcatacacaaagaagtcgtcccctttcttgtggtccagcacggaatggctgttctggaagtaatttaacacactcaaaatggtgcagttcgtgttatacggtgaaagaggggccaagcagatgtcttgaag

SEQ ID NO: 152473 - DNA, 601 bp, Human
accaaaggctcttctatctttaaatcttgtggggggtgtgatacatgacactgtgttagcgacccaggcacgaggtaaagggtgagaggcagctgcactcctcaatcacacaccacgagagcttcctgccagggctctgcacttgctgctggttctgccgggaactctcatccctgtgatgtgcccagctgtcctttcctctccctttgtgcacatctccacgcttaagcaatgcaccccccactctgtccagccttatttttctcctcatagcactaatctctagctggcacgatagcayatgttatgtgttcatcaaccgtctccctccattaagatgtaagcttccagctgggcatggaagctcacgcctgtaatcccagcactttgggaggccgaggtgggcggatcgcctgaggtcaggagattgagaccagcctggccaacatggcgaaaccccatctctactgaaaatacaaaaattagctgggcgtggtggcacacacctgtagtcctagctactcaggaggctgaggtatgagaatcgcttgaacttgggagccggaggttacagtgagccaagattgcgccactgcactcc

SEQ ID NO: 152474 - DNA, 601 bp, Human
gtccctagcattcagggagagtaggcccatccggcatcatgctactcttcccctactgggagaagccttaagattcccctacaggtcaccaaagcaccgcttcctggggtgactattcccaattataaacgcaccctgcccagctagacatgcctcctaagggaagcagctgcagggccctccaatctaaagctgcggagctgcagacctatactgcctcaactcctcagagggaggctgcctcccaaatagctggggcactacaggggactgggctatatatctgagacagaacaaaagrcaccaaaggctcttctatctttaaatcttgtggggggtgtgatacatgacactgtgttagcgacccaggcacgaggtaaagggtgagaggcagctgcactcctcaatcacacaccacgagagcttcctgccagggctctgcacttgctgctggttctgccgggaactctcatccctgtgatgtgcccagctgtcctttcctctccctttgtgcacatctccacgcttaagcaatgcaccccccactctgtccagccttatttttctcctcatagcactaatctctagctggcacgatagc

SEQ ID NO: 152475 - DNA, 601 bp, Human
gagagagcatccagaggctcagacccgtaagaaccccatgaggaaggcgagggcgaggcagaattcagggataaagcctcaagcctgagtaactggtagctgtcactgcctttaaacaaaatggggagaagaagcaggtaagggcatggttctgggcaggccacctgccattactgcaggaccctcaggtgaaaaagtccaggaaaagctggagggagaggaaaggggacagcgctagggcgagactggggttatgaggacgcgcacaagcataactacaaaccaattcaggtccctgccrccaggagcctgccactccctgtaccgcttccacactggtgggaaccacgtccgctttgaggaaacacaaggctcacgcacctctgtcccccatcatttttgttgacttttatcttgtgccacagagagtaaactataaaatttatgtaacattaaatggttgtccaattataaaaattatgtaacattaaatgttttttgtttcttcaaattacccatggctcgtctgcaccgtctaccctgtggagaatgccggtttagggtatggagcataagctattgtgttttcatgagtataact

SEQ ID NO: 152476 - DNA, 601 bp, Human
ataattcaaagaaaagatgtcctgtcctagagcatggggtgcccaccaagggggctcctgaaggagggggccagtctgggaagagtaatggacagacaaatgcaaaataaaaggactcagtgccagttaagtagtttggatttttattctggaggcactggggaacaattagagatttccgggaaagaaatgtcatgagctgttttacaaagatagcttgcgtggcaaagtggaaggtctggaaacggcaaagaaacaggaagcaggtggaacagtaagtggagatgttagcgcaatggcscaggcaagaggcaactggcagtgcagtgcagacagacagttggccagtggagagtgaaccagcattttcggacagaccatcagctacaacttggccaggtgctgagaagcttctgcatatgacccacccgtcagagtggatgggtgacggcatgagggaggtcaggtgacctgcagcgagcagctgagtcccttcatccacagcagaaatctgagagagcatccagaggctcagacccgtaagaaccccatgaggaaggcgagggcgaggcagaattcagggataaagcctcaagcctga

SEQ ID NO: 152477 - DNA, 601 bp, Human
agaatcactgggcaagaggcaggcaaatacagcccagtgccatcaatggcacatggtgcatggcgctacgcaggcacagaggagggagcaaacactaaaaggcaaaattatagccaagaggaagagactgtacagacccagagctccgaggatgagggggatttcaccaaagagggaggacaaaagggtgtctcacacaattacaactgtgggaggaaaaagggagggagagagaacagtgagagggaatgagagcaagatggtggtttggcaagtcctgtatgccgggtatggtggcacrcctaatctcaagtactcaggaagctgaggcagaaggatggctataacccaggagtttgagtccagcctggacaacatagcaagatcccatctctaaaaaaaaaataataataattcaaagaaaagatgtcctgtcctagagcatggggtgcccaccaagggggctcctgaaggagggggccagtctgggaagagtaatggacagacaaatgcaaaataaaaggactcagtgccagttaagtagtttggatttttattctggaggcactggggaacaattagagatttccgggaaagaaat

SEQ ID NO: 152478 - DNA, 601 bp, Human
acctttgggagctcagaatcactgggcaagaggcaggcaaatacagcccagtgccatcaatggcacatggtgcatggcgctacgcaggcacagaggagggagcaaacactaaaaggcaaaattatagccaagaggaagagactgtacagacccagagctccgaggatgagggggatttcaccaaagagggaggacaaaagggtgtctcacacaattacaactgtgggaggaaaaagggagggagagagaacagtgagagggaatgagagcaagatggtggtttggcaagtcctgtatgccrggtatggtggcacgcctaatctcaagtactcaggaagctgaggcagaaggatggctataacccaggagtttgagtccagcctggacaacatagcaagatcccatctctaaaaaaaaaataataataattcaaagaaaagatgtcctgtcctagagcatggggtgcccaccaagggggctcctgaaggagggggccagtctgggaagagtaatggacagacaaatgcaaaataaaaggactcagtgccagttaagtagtttggatttttattctggaggcactggggaacaattagagatt

SEQ ID NO: 152479 - DNA, 601 bp, Human
ccaccaaacgtacccagacaagggtcatggagcaaacttgtatcattcagagaggcaggagccctgccaaaaagtttagaaaacacctcccagttagaagggcctcaagacatcagggacctaaacatttacacagtgaacatttgatgaggctggctgtattctaaggacaacatgggccctgaggtttctcagttgagtaatacagctcagcactcacctttgggagctcagaatcactgggcaagaggcaggcaaatacagcccagtgccatcaatggcacatggtgcatggcgctaygcaggcacagaggagggagcaaacactaaaaggcaaaattatagccaagaggaagagactgtacagacccagagctccgaggatgagggggatttcaccaaagagggaggacaaaagggtgtctcacacaattacaactgtgggaggaaaaagggagggagagagaacagtgagagggaatgagagcaagatggtggtttggcaagtcctgtatgccgggtatggtggcacgcctaatctcaagtactcaggaagctgaggcagaaggatggctataacccaggagtttgagtccagcct

SEQ ID NO: 152480 - DNA, 601 bp, Human
ttgctcaggctggtctcaaactcctagctcaagtgatgtgctcgcctctgcctcccaaattgctgggattacaggcatgaataactctcggcccagttttgtttttttaactgtatgtttgttctccacaaatgaacatgtactcaacttcatcagtctttccttttcgggcttctgagttttgtgtcttgcttagaaatatcttttccacttaaaaattatttttaaaaatgcctcctgaattttcttccagttcttacatttcttttttttttttttttttttttgagatggagtctcrctctgtcgcccaggctggagtgcagtgacttgatcttggctcactgcaagctctgcctcccgggttcacaccactctcctgcctcagcctcccgagtagctgggaccacaggcacctgccaccacacccagctaattttttaaagaatatttttagtagagatagggtttcactgtgttagccaggatggtctcgatctcctgaccttgtgatccacccgcctcggcctccgaaagtgctgggattacaggcgtgagccaccacgcctggcccagttcttacatttcaatcttttatcca

SEQ ID NO: 152481 - DNA, 601 bp, Human
cctggacaacagagcaagactctgtctctgaaaaataaaataaaaaccttttttttttgtatttcttcttttgttatctttcacatgacctcacccacttttctttcaggttgttgatctttttttcacaactttttttttttttttttaagacggagtcttgctcttgtcgcccaggctggagtgcaatggaatgatcttggctcactgcaaactccacctccaggattcaagtgattctcctgcctcagtctcccgagtagctgggactacaggcacacaccaccacgtgtggctaatwttttttgtattttcagtagagacagggtttcacattttggccaggctgagatgagatctttatttattaagaaaatgctgactgccatgcatactaatatttttgtccagtttttttttttttctggcaaggtctcgctctgtcacccaggctggaatgtggtgcaatctcgcttactgcagcctcaacctcctgggctcaagtgatcctcccacctcagcctcccgagtagctgggactacaagcatgcaccaccatgcccagctaatttttgtattttttgcagagacggggtttctc

SEQ ID NO: 152482 - DNA, 601 bp, Human
acatgccacaacatgaatgaaccttgagaatattatgttcaatgatagccagacaaaaaagtccacatattattctatgcacataaaagtccagaataggaaaatctccagagacagtattttagtggttgcctagggctgtggataggaggatgaaaagatggagggtgttagttaaagggtacagagttttattgtggagtaatgaaaatgttcctaaaattgactgtggtgatggctgcacatacacgtgaatatagtaaagctactgaattgtacgcttttttttctttttaaattytcttttttcttttttttagagacatgcaaacattgcctaggctggtcttgaactcccggcctcaagtgagcctctcgtctgggcctcccaaagtgctgggactacaagtgtgaaccaccattcccagcctgaactgtatactttaagtgggtgaactgcatgatacatataccatatctcagtaaaacaattttttaaaagtactggagggcataaagtgcaacctggcctcctaagtcctctcttcccattctctagaggtcacaaacacagttaatttctgaggtcatttgcttgata

SEQ ID NO: 152483 - DNA, 601 bp, Human
cagtggcttatgcctgtaattccagcactttgggaggctgaggctggcagatcacctgaggtcaagagttcgagactagcctggccaacatggtgaaagcccgtctctactaaaaatacaaaaattagccaggcgtggtggcaggtgcctgtaatcccagctacttgggaggctgaggcacgagaatcacttgaacctggaaggcagaggctgcagcgagctgagatcatgccactgcactccagcctggatgacacagcaagactctgtctcaaaaaaaaaaaaaaaaaaaaaaaaaaaggaaatgcattcagtctactaaatcaaaaccacaatgagataccacttcacacccatgaagatagctagaatcacaaagtcagataataaaaagtgctgacgaggatgcgaacgaattggaagtttcatggactgctggtggtgacgtaaagcgctatagccactttggaaaacagtctggcagttcttcaaactattcaaggtggacttaccctatgactcagcaattctactactaggtatgtacccaaaagaaatgaaaactcacatccacaagaacttgtactcaagtgttcatagc

SEQ ID NO: 152484 - DNA, 601 bp, Human
ctcctggcctcaaggcattcctcctgcctccacatccctaagtgctgggatgacaggcaccatgcccagccactgcattagggtcttccacactggagactatcagattacagctaaggttccatacatgctgaattaaagtaagtttagggctgggctcagtggcttatgcctgtaattccagcactttgggaggctgaggctggcagatcacctgaggtcaagagttcgagactagcctggccaacatggtgaaagcccgtctctactaaaaatacaaaaattagccaggcgtggtggmaggtgcctgtaatcccagctacttgggaggctgaggcacgagaatcacttgaacctggaaggcagaggctgcagcgagctgagatcatgccactgcactccagcctggatgacacagcaagactctgtctcaaaaaaaaaaaaaaaaaaaaaaaaaaaggaaatgcattcagtctactaaatcaaaaccacaatgagataccacttcacacccatgaagatagctagaatcacaaagtcagataataaaaagtgctgacgaggatgcgaacgaattggaagtttcatggactgctggtgg

SEQ ID NO: 152485 - DNA, 601 bp, Human
gtctgtcccacttgttactaaaaggtcctcctttttactttacagggctgtattaaacctagagttgaatgtacaattctgtgtttcagagaggacttgtaaacatttctaggtctgctcgggcaacacatgttatgagtttgcattcttaggtgatggactggacaaataagaaaaaactggattatgtgaaataaactttaagataaaccaaaaagttggaatgaagaaaatagatgtaggcaacagaaacgttacatacaattaaaacatgggggaatttatggcagttttaaacatratggaataagaataaagaggcaaaaatatgacgttacactgtgcactgctgttaacctctagaacatacaccaccccccccccggcttaccagaagcctgcgacagcttttgatgtgccccaaggctagggaaatatatagaaacatgatggcatagctaattacaacggtgaagacatcactgtcactttcacgatttagttcatcttcaatacttcgttcagcagtgaaggaaatggtcagattgggattcttgtagtttttcacaaaattaataaacctaaaaggtaagcaaaatgt

SEQ ID NO: 152486 - DNA, 601 bp, Human
taaagaaaagccctcctctgagaagctaaggccagataccaatcctgagaggcaatcgctggagttagaacaggatgagaaaccttatgtggaaaccacactccgaacatgtggaccttgttcagcttgcagccccgagggtggctgtctgagccaggaacaacatgacaatttcagaatgaatgactgaggaaaggaatgatgacacagggagacccagctttgatatacaaataggtataaactgaggcacgatgcaaatgatttttaaatgataatttgaaaatttttcagcaaaacrggaaagatttggtaaaggagaaggtacctgaagcattgcagaactggtcagtgatattgtccactcgacagcaagacgactgtggcttcacccagtcgaaataatcgtcgatccaggacgagggggcgaagcctattcgggtactagagaggacagacagggttactgacctgctccacagggaggaagtctttagtttcagtactttttcttaaaacctaacttccttttctacgttttatactgctaacagtcaaaagaaaaactacatgagcacttaatgaaaaaagccttcaaagt

SEQ ID NO: 152487 - DNA, 601 bp, Human
ttcttatgaaaaacctaagttcagggtttacctaacatacatggggatactcatcttccacctcccaaagcttccaaatcaaggccagagacttccggtcatcatcactatttttgggccatatatctggcttccgtgggtaactggctgcctggctggatgggggagtgagatagcccataaccctatacatggatgggctggcaaggagcatgacgaggctaaaagaatcgcaaccttaatgtgggataatgttactaaagctaagatcacgccccagctgccatcagtacaagtgaayaggccaagttccttcaggcctggattaccagcaggccgtcctctccctcagccccgcttggaatgtgcacaggaatctgcgttcattctcatgcccagggggccaggacacagagagagcatgagatgtgaatgcccacgctaagacagaatcagttgaacactatgaggcattttcttaaaaaggtgttttcggttttcctgcttccaccaaaggaccaggacagggtggggcggagaagagacgttcccatgcaactgtcttagcccagtcctctcctagttttctactgcaaattaa

SEQ ID NO: 152488 - DNA, 601 bp, Human
tctcaggtgatccgcccacctcggcctccaaaagtactgggattacaggtgtgagccacttcgcctggccagatgggcttttctcgattgctctgggttctttggtacatagctgctgtttctccacctggtttcatgtataatcaaaggtacagggtttactcagtcctgttgtgtaataggaagcaggaaagggcaagggccctgggaacaacctcagccctgccacttactggtcatgtaaccccgagcaaaatgaccacctctgagccccagtctcctcttctgtaaatgggtatamcaccacctactcataggctgcgtgatgagaaatggaataatgtcagggagtgcctggcatgacgctggcaccctggaggctccccaggaacggtggctactgccttcagaaaaactgaatctacttcaacttattttacgtaggccaaagcatccagtcagtgagtaaatcaagctgcaagattcatttctacttaacttttaggaggagtcatcccatgatacctcgaataggtctcaaagcacatgcatgatataaatgattcactgatatgactctggtcagatgtatgttcttatg

SEQ ID NO: 152489 - DNA, 601 bp, Human
acctcccgggttcaagcaattctccctgcctcagcctcccgaatagctgggattacaggcacctgccaccacgctcaactaacttttgtatttttttagtagagacagggttttgccatgttggcctggctagtcttgaactcctgaggtgatctcaggtgatccgcccacctcggcctccaaaagtactgggattacaggtgtgagccacttcgcctggccagatgggcttttctcgattgctctgggttctttggtacatagctgctgtttctccacctggtttcatgtataatcaaakgtacagggtttactcagtcctgttgtgtaataggaagcaggaaagggcaagggccctgggaacaacctcagccctgccacttactggtcatgtaaccccgagcaaaatgaccacctctgagccccagtctcctcttctgtaaatgggtataccaccacctactcataggctgcgtgatgagaaatggaataatgtcagggagtgcctggcatgacgctggcaccctggaggctccccaggaacggtggctactgccttcagaaaaactgaatctacttcaacttattttacgtaggccaa

SEQ ID NO: 152490 - DNA, 601 bp, Human
ctataagtcgggctttcttcagagcgtcaataaagtcagcagaggtctgcagcacggtgtggtaggtcatgaagtacgtggctccgaccctggtgccatggccaaggaggatgttaactgcagaactataggcagcatgtcccctgaggaaagaatcctgggtgtcaagagagtccaggtcttgcaaaatatcagcagaatctgagcacttgaggctaagcaaaatcacctgaccctggactcagaggtcagacccagctgtacatttcagggatgaagaaggcccccagataagggaacrccaaaggtttagcttgttctctcccagactggcttctttttttttttattttgagacagagtcttgctctgtagcccaggctggagtgcagtggcgtgatctcggctcactgcaacctccacctcccgggttcaagcaattctccctgcctcagcctcccgaatagctgggattacaggcacctgccaccacgctcaactaacttttgtatttttttagtagagacagggttttgccatgttggcctggctagtcttgaactcctgaggtgatctcaggtgatccgcccacctcggcctc

SEQ ID NO: 152491 - DNA, 601 bp, Human
aggagaaattgctggaacccgttaaggtcaccccacccgcaccgagctggcgcattgtcacaacttcttttcttggacctcagtgctcccctatctgaagcagggctcatatctgagagtacggatacactgttctattttccatgaataccttctcgagtgctctcatctttaatgattaaaagtacctgataaccacataggaggcaaaaggcactggtcggagagctcctggggcggggtgcaattttctaagtaaaaagtgaacatcctgctgtcatcaggctacaggcttgtgcartctctaaagaataacaaattacaggcagactagcccagaactaggccaggaaatcacatttccatggtcagaggcaccatcaggtatactagtatagccgcaaggaatgggacaagagaaaaaattgaacagaaattgcctgtaatgtgcctatgctcccagatgtccaactcaatgctcgctccctctatgccctgtcccaccaccatccagcactcctccagcactcatcctgcctctccatgtgtgccaagagcaagcgccagacttggtatcttactccatctttagggtttacat

SEQ ID NO: 152492 - DNA, 601 bp, Human
tttttggggccctctctacacacagccaaaagcctggttttctgtggcacgtttgtgttgaccaggagaaattgctggaacccgttaaggtcaccccacccgcaccgagctggcgcattgtcacaacttcttttcttggacctcagtgctcccctatctgaagcagggctcatatctgagagtacggatacactgttctattttccatgaataccttctcgagtgctctcatctttaatgattaaaagtacctgataaccacataggaggcaaaaggcactggtcggagagctcctggggyggggtgcaattttctaagtaaaaagtgaacatcctgctgtcatcaggctacaggcttgtgcaatctctaaagaataacaaattacaggcagactagcccagaactaggccaggaaatcacatttccatggtcagaggcaccatcaggtatactagtatagccgcaaggaatgggacaagagaaaaaattgaacagaaattgcctgtaatgtgcctatgctcccagatgtccaactcaatgctcgctccctctatgccctgtcccaccaccatccagcactcctccagcactcatcctgcc

SEQ ID NO: 152493 - DNA, 601 bp, Human
gggtactcacggagctgcccatgtgggcaagtgcctcttccgcgcgctccacgcggctgcctttcatgctcaccgtgaacgctctggttatgtggctgcagaactccacggagatgccacagctctgaaataaagcacttcctttaggatggctctcttcctgttgaagaccctaggcagccaccccgttctgaggatgggtgctaattacccagggcaccctgggtgctagaggaggccaagcatcccattggacttacaaggcctccatcacaccaatcttactgtaccaggaactttytggggccctctctacacacagccaaaagcctggttttctgtggcacgtttgtgttgaccaggagaaattgctggaacccgttaaggtcaccccacccgcaccgagctggcgcattgtcacaacttcttttcttggacctcagtgctcccctatctgaagcagggctcatatctgagagtacggatacactgttctattttccatgaataccttctcgagtgctctcatctttaatgattaaaagtacctgataaccacataggaggcaaaaggcactggtcggagagctcctggggcggg

SEQ ID NO: 152494 - DNA, 601 bp, Human
ctcaggatagaattccctttcagtaatgtccttctattgtgccacccttttaagatgagaactcttacctatgtaactgagtaagacagggagaaatattaatccgtgagtggctcccagtaagaccatggccaaatacatcctgaagtagaatatctggaaaatttgagatttggcaaaagccaacaccacaatccctccaaattttgtaagtgtgattccactgaacacctaaaagaagagatactgtgttagaaaccacttttaccaacctgtaattgaacaaaaacacttccttacraggatttctcccaggttcaagtgattctcctgccccagcctcctgagtagctgggattaaacaggtgcacgccaccatgcctggctaatttttgtgtttttagtagagatggggtttcaccatgttggccatggtctcgaacccctggccgcaagtggtccgccagccttggcctcccaaagtgctggggttataggcatgagccaccgtggccagcccttatggggatttcttaatattcaaggttcaaagcaatgggaactgaacccaggtagcatcatctactacctaacactattt

SEQ ID NO: 152495 - DNA, 601 bp, Human
tgccagatggactccttcatctcagtggcagggaggagctgccctgcctgctgacactcagatccattcaaggactggctccaggcctttgtgaagcagacagatcaggcctccagaaaaaacatcgacaacttcctaataaagtagtctgcaccatcatgaatcccctggatgggttttttcttttagaagaaatttttttactcagtatcatttatcattatcaaatgaccattagtatgagttcaaatacttgaaaagaatgcctcaggatagaattccctttcagtaatgtccttcyattgtgccacccttttaagatgagaactcttacctatgtaactgagtaagacagggagaaatattaatccgtgagtggctcccagtaagaccatggccaaatacatcctgaagtagaatatctggaaaatttgagatttggcaaaagccaacaccacaatccctccaaattttgtaagtgtgattccactgaacacctaaaagaagagatactgtgttagaaaccacttttaccaacctgtaattgaacaaaaacacttccttacaaggatttctcccaggttcaagtgattctcctgcc

SEQ ID NO: 152496 - DNA, 601 bp, Human; identical to SEQ ID NO: 32237

SEQ ID NO: 152497 - DNA, 601 bp, Human; identical to SEQ ID NO: 32238

SEQ ID NO: 152498 - DNA, 601 bp, Human; identical to SEQ ID NO: 32239

SEQ ID NO: 152499 - DNA, 601 bp, Human; identical to SEQ ID NO: 32240

SEQ ID NO: 152500 - DNA, 601 bp, Human
aatttatacgtgtgtttgtatgtgtgtgtattaggtccaggatcatagtatatttttctctgatttcccccctccgcccccccctcccaacacacacacatcgtgttgattctcagtaggcatctcttgactatcatcagtgagggaaagggacttaaaagatgaacaataacaggacaaagccaggcttcttaagaagagtagctgtgccaactctgaacgccttctacttttagaatattggtttagaggccaggcacggtggctcatgcctgtaatcccagtactttgggaggtcgargcaggcggatcacttgaggtcaggagttcgagatcagcctggccaatatggtgaaaccctaactctactaaaaatacaaaaattagccgagtgtagtggtgggcgcctgtaatcccagctactctggagactgaggcaggagactcacttgaactcgggaggcggaggttgtagtgagccgagataccaccactgcactccagcctgggcgacagagtgagagaatatcggttttgagagctgaagttacgctgatgcatggagctgacgtgttgattgttttaacttgtatagaactgt

SEQ ID NO: 152501 - DNA, 601 bp, Human; identical to SEQ ID NO: 123921

SEQ ID NO: 152502 - DNA, 601 bp, Human; identical to SEQ ID NO: 123920

SEQ ID NO: 152503 - DNA, 601 bp, Human; identical to SEQ ID NO: 123919

SEQ ID NO: 152504 - DNA, 601 bp, Human; identical to SEQ ID NO: 123918

SEQ ID NO: 152505 - DNA, 601 bp, Human; identical to SEQ ID NO: 123917

SEQ ID NO: 152506 - DNA, 601 bp, Human; identical to SEQ ID NO: 123916

SEQ ID NO: 152507 - DNA, 601 bp, Human; identical to SEQ ID NO: 123915

SEQ ID NO: 152508 - DNA, 601 bp, Human; identical to SEQ ID NO: 123914

SEQ ID NO: 152509 - DNA, 601 bp, Human; identical to SEQ ID NO: 123913

SEQ ID NO: 152510 - DNA, 601 bp, Human; identical to SEQ ID NO: 123912

SEQ ID NO: 152511 - DNA, 601 bp, Human; identical to SEQ ID NO: 32241

SEQ ID NO: 152512 - DNA, 601 bp, Human; identical to SEQ ID NO: 27382

SEQ ID NO: 152513 - DNA, 601 bp, Human; identical to SEQ ID NO: 27383

SEQ ID NO: 152514 - DNA, 601 bp, Human; identical to SEQ ID NO: 27384

SEQ ID NO: 152515 - DNA, 601 bp, Human; identical to SEQ ID NO: 27385

SEQ ID NO: 152516 - DNA, 601 bp, Human; identical to SEQ ID NO: 27386

SEQ ID NO: 152517 - DNA, 601 bp, Human; identical to SEQ ID NO: 27387

SEQ ID NO: 152518 - DNA, 601 bp, Human; identical to SEQ ID NO: 27388

SEQ ID NO: 152519 - DNA, 601 bp, Human; identical to SEQ ID NO: 33142

SEQ ID NO: 152520 - DNA, 601 bp, Human; identical to SEQ ID NO: 33143

SEQ ID NO: 152521 - DNA, 601 bp, Human; identical to SEQ ID NO: 33144

SEQ ID NO: 152522 - DNA, 601 bp, Human; identical to SEQ ID NO: 33145

SEQ ID NO: 152523 - DNA, 601 bp, Human; identical to SEQ ID NO: 33146

SEQ ID NO: 152524 - DNA, 601 bp, Human; identical to SEQ ID NO: 33147

SEQ ID NO: 152525 - DNA, 601 bp, Human; identical to SEQ ID NO: 33148

SEQ ID NO: 152526 - DNA, 601 bp, Human; identical to SEQ ID NO: 33149

SEQ ID NO: 152527 - DNA, 601 bp, Human; identical to SEQ ID NO: 33150

SEQ ID NO: 152528 - DNA, 601 bp, Human; identical to SEQ ID NO: 33151

SEQ ID NO: 152529 - DNA, 601 bp, Human
attcaattcacgctttctttgtatacctgtatttatgtgcccactctttctcctgatattgtttatatgcaccttctttctttcttgtttgattgatcgtgctcgatcttgacagagttgatcagtcttaccgaggctaacatttagtttagttggtcccttgtgctgtaactgtgatttctatttctgctcctttgttgttgttacttctttctgctttttttttctcattctcttatttttactctaaattaggttagacagcacattaattttaactttcatcttaaaatactgggcyaggcacagtggctcatgcctgtaatcctagcactttggaaggccgaggcaggcagatcacttaaggtcaggagtttgagaccagcctggccaacacagtgaaactgtctctactaaaaaacacaaaattagccaggcctggtggcacgtgcctgtactcccagctactcgaggggctgaggcaggagaattgcttgaactcgagaggcagaggctgcagtgagctgagatcacacccctgcactccagcctaggcaacagagcaagactccatctaaaaaataataaataaaatataata

SEQ ID NO: 152530 - DNA, 601 bp, Human
tttaatgggataagaaaaaatgttagcaaatatttacataatagttaccataaaatttaacttaaatctatacttattcggattattattatagaactaagtttttatctaaatctgctattactaagaaagatgacaagcactttctggtaagtttaaaggtttctttttaatgatttgaaggtctatcatcttataattctaagactatcaaaatgtttcttaataattctttgacttgtctgcacatttctagaggggttatctacgaagcaattcgtatcatctatagtggtgatgsttttaaaatatgtccacaattcactgatacttcctccatcaaactaataagagtattaagtaccctctccttgaacatgcatggccttagtgagttacttctcaaacggaatgttgtggaagttgtatgtgacttctaaggctaggtcacaaaaggcaatgaagcttctgccttgctctctaagaatgctcactcttgaaactcagttgccttgtgataaagtccaggtctcatagagatgccttgtgtaggtgttcctggtgacagcccagttgaggtcacagtcaacaagagtaaaga

SEQ ID NO: 152531 - DNA, 601 bp, Human
caagatttttgtcagtccaaaaaaaaaaaaaagtttcatctgttaaggaattcacaatgtaataggacagaaaggtgaatgcgggaaattggtgagaaagagatgaataggggcaagaaatgaagcatacaagaaatagaccaaagtaatctaatgcaaccctctataattcattcacaaatattctctagaagatctgacagtgagaagatccaccctctgcgtgaatacctccaataacaagtgtactagttcagagggttcgtttgtaggtttaaaacagctcttaagagctaatgcyaacctgatattcaccagtgctattattcgctcatgaaccctagttctatattttgggcttaacacaggataaagaactcttttttccatgtaaaagttcaggtatctaaagtcagctatcatgctgctctgtttaggttttctctttccctgtctaatcaatgctagcttcttctctaagagttctagttcttcttccttggaaccactccagtgcatcaatagcccgcaggaataaattattaacatcataaatagctttgatttggctttgattaaaattaaagattttttttttttt

SEQ ID NO: 152532 - DNA, 601 bp, Human
atacctggatacagcaatgctaacccaatattacaggcttctttttcaaggacattaccacctttactcacatgccttccacatgtgggcccaaccccaagtgctttatagatttaattattcagggacagagaaagagaaacttaatgatatctttaatactctctttactaccctatgacaaaactatgtacaagatttttgtcagtccaaaaaaaaaaaaaagtttcatctgttaaggaattcacaatgtaataggacagaaaggtgaatgcgggaaattggtgagaaagagatgaayaggggcaagaaatgaagcatacaagaaatagaccaaagtaatctaatgcaaccctctataattcattcacaaatattctctagaagatctgacagtgagaagatccaccctctgcgtgaatacctccaataacaagtgtactagttcagagggttcgtttgtaggtttaaaacagctcttaagagctaatgctaacctgatattcaccagtgctattattcgctcatgaaccctagttctatattttgggcttaacacaggataaagaactcttttttccatgtaaaagttcaggtatct

SEQ ID NO: 152533 - DNA, 601 bp, Human
tagtacaggtacctggaattttgcgacgcagatgaaaaacatgggtgaggggagtttgagggatctaaagatgtggattctgatctctcttttggctctaccaacctacatgattccagacgtagtcatgatttcccagaaaagggtgactactacttgagaaacactatcagcatcccagtcgccgacagtcctatgataaggggcactcaggggtctgttttcttgtctgtcaaaatcagtggctcgaatggaccagtccttcttgattattttcactgacaaaccctccttaataccytaagagggtattaaagtacaaaattccttggtaattcctattttaccttaaacatttaaaggaatttcagaattctacttgatcatgtatctgtattttaatctagaaacaaccacaccctcaccccaatcccgagtacagctgactgtcctggactccagcactcccccactgcacgcttccacagctccctccacccagcgtaagtgctctagggcagaccagcccacccaaggtgctgtggcttttaagaggggcctcttagggcaagattctgatcagctccgctggtggagggca

SEQ ID NO: 152534 - DNA, 601 bp, Human
ctgactttcttaagcgtaaactaattcggcagaaaggaaaagcgcagaaaccttcaggacttcttagtacaggtacctggaattttgcgacgcagatgaaaaacatgggtgaggggagtttgagggatctaaagatgtggattctgatctctcttttggctctaccaacctacatgattccagacgtagtcatgatttcccagaaaagggtgactactacttgagaaacactatcagcatcccagtcgccgacagtcctatgataaggggcactcaggggtctgttttcttgtctgtcaawatcagtggctcgaatggaccagtccttcttgattattttcactgacaaaccctccttaataccctaagagggtattaaagtacaaaattccttggtaattcctattttaccttaaacatttaaaggaatttcagaattctacttgatcatgtatctgtattttaatctagaaacaaccacaccctcaccccaatcccgagtacagctgactgtcctggactccagcactcccccactgcacgcttccacagctccctccacccagcgtaagtgctctagggcagaccagcccacccaagg

SEQ ID NO: 152535 - DNA, 601 bp, Human
tgtttatatgatgaattccagaagattttcacatattcaaattcctacacctgctagaattttgttagaatgacaaatcactatcaacccattctgaaccataagcaggaaatgaaatgacgttaactgactttcttaagcgtaaactaattcggcagaaaggaaaagcgcagaaaccttcaggacttcttagtacaggtacctggaattttgcgacgcagatgaaaaacatgggtgaggggagtttgagggatctaaagatgtggattctgatctctcttttggctctaccaacctacaygattccagacgtagtcatgatttcccagaaaagggtgactactacttgagaaacactatcagcatcccagtcgccgacagtcctatgataaggggcactcaggggtctgttttcttgtctgtcaaaatcagtggctcgaatggaccagtccttcttgattattttcactgacaaaccctccttaataccctaagagggtattaaagtacaaaattccttggtaattcctattttaccttaaacatttaaaggaatttcagaattctacttgatcatgtatctgtattttaatctagaaac

SEQ ID NO: 152536 - DNA, 601 bp, Human
agcataactaagtaaagtatatgagtaataaatgctaagaaaaaagagtaacgggactcacagcgctggggagaggggcaggttgcaattctaaacagggtggtcaggatgggccttgtggctgaccacccaggtgggtcacatgtaagcacagatgtggaaggggtcagtctcacggatattttagttaacagtgttccaagcacagagaacggcgaatgacttaaggtggtacatacctaacatgtctgagggacatgaagaatgtggctggagccacggggacaaagcggagaggagmagtctgcagtttaggttcggagagtcaagaaatcctgtactgattcatttctcctaaatttgactgtcagggaaaaaggactgctacttccattttctcagcgggcctacctagtagagtgtcataacaatttaagtcagcaagtattcaaacattgtttatatgatgaattccagaagattttcacatattcaaattcctacacctgctagaattttgttagaatgacaaatcactatcaacccattctgaaccataagcaggaaatgaaatgacgttaactgactttcttaagcgtaa

SEQ ID NO: 152537 - DNA, 601 bp, Human
aattgaaggtggagggacttaggggaaaagatttaactttcatcacatccaaaggcccatgagacaccatgcaaacaatgcggaccaaatatctatattggtgatatagcaataagcataactaagtaaagtatatgagtaataaatgctaagaaaaaagagtaacgggactcacagcgctggggagaggggcaggttgcaattctaaacagggtggtcaggatgggccttgtggctgaccacccaggtgggtcacatgtaagcacagatgtggaaggggtcagtctcacggatattttasttaacagtgttccaagcacagagaacggcgaatgacttaaggtggtacatacctaacatgtctgagggacatgaagaatgtggctggagccacggggacaaagcggagaggagcagtctgcagtttaggttcggagagtcaagaaatcctgtactgattcatttctcctaaatttgactgtcagggaaaaaggactgctacttccattttctcagcgggcctacctagtagagtgtcataacaatttaagtcagcaagtattcaaacattgtttatatgatgaattccagaagattttca

SEQ ID NO: 152538 - DNA, 601 bp, Human
caggagtgagccacggcgctcagcagtattgcaccattttctttgaaactcagactctccgcttctaggagagttagagcctaaacaaattgaaggtggagggacttaggggaaaagatttaactttcatcacatccaaaggcccatgagacaccatgcaaacaatgcggaccaaatatctatattggtgatatagcaataagcataactaagtaaagtatatgagtaataaatgctaagaaaaaagagtaacgggactcacagcgctggggagaggggcaggttgcaattctaaacaggktggtcaggatgggccttgtggctgaccacccaggtgggtcacatgtaagcacagatgtggaaggggtcagtctcacggatattttagttaacagtgttccaagcacagagaacggcgaatgacttaaggtggtacatacctaacatgtctgagggacatgaagaatgtggctggagccacggggacaaagcggagaggagcagtctgcagtttaggttcggagagtcaagaaatcctgtactgattcatttctcctaaatttgactgtcagggaaaaaggactgctacttccattttctc

SEQ ID NO: 152539 - DNA, 601 bp, Human
ccaaacaatagtttactgtccttgaaatcatcagcgtctttcaacccatcatgatttcaagatcctaaacttgacaggacaatgtcactaattaaattctgattccacaaatctcctaattgaaaaagtcctctttaatctgtccccaagagtctgcaatgaaaagaatacctgagaaatgtctttacaaaataggtaaaattcattagtttggaaaacagacatttttcctctttggtagcttgtataaaataagacatactaatcttcactttaaaataatcagtaagtatctcaccattttttttttttttgagatggagtttcgctcttgttgcccaggctggagtgcaatggtgcgatctcagttcaccacaacctccacctcctgggttcaagcaattctcctgcctcagcctcctgagtagctgggattacaggcatgtgccaccacgcccagctaattttgtatttttagcagagacggggtttctccatgttggtcaggctggtcttgaactctcgacctcaggtgatccacctgcctcggcctcccaaagtgttgggattacaggagtgagccacggcgctcagcagtatt

SEQ ID NO: 152540 - DNA, 601 bp, Human
cgatgcagtccatgacatatcttctctaactagacgctctgatggaatgcctccatgatgaactggtctgttccctgcattgaatactttcagcaatcatacacaatttttagtcaacaaacatattttaacctatagggatctaaaggtaagacattatttgtttgaagcttttaaaaaggaaaaaagaaattatattaagccgtgactctgagtactgatactttattgcataaaatattgtgggaaggagcttgagtagttgctacctgaataggcctagtgagatcagcaggaaggrgaaattccagcagagggcacatcataaagaggaatgaaagggaatggtgtagcggcaggactggcagattcagaaaggctggcgagctggctagagagggctccccagacacattaagggcggaccctgaagggcacgtgggccgtgctacaggcacaggctctggacagggccccagtgaagttctttaaaggactggtataaacacatttgattttcatgaaaataactctcagcagcatagaagatggactgaaccaagaagaaggcaacttcatacaccaatacactgaaagcgta

SEQ ID NO: 152541 - DNA, 601 bp, Human
aacctctactagcactagtagcagaactatcaagaacatacacttttttttctacaggcatcatctgccttaattcttgtcactgagtaaatgaagaaatgcaatacccaaacagaactgtggtttataacttggattaaaattaagccaatttctgacaaggagtcccttcacctcctaccctcaaacagcatgttttctgagaaacagctccacctctcaagaaatgactagtgctagctgtggctgtgctgacaatacagattagtttcctctttcaatactgtcatcataagctttaaaaaaaaaaaaacaacccacagctttcaccaaatatatcattattgtaaagacatctccttttggaaagttttccaggtcaaacagaaaggagaatttgtattcattgtaactggttacaattcatcctgaacaggttaaatcacagcaaagatcaagcatccttaacttacaagtcaggcaagaagatgaccaattctaatagtacagcgtgaaccagtgacttttcccctttagattttcccattctcaactaagggtaatcagtacgttttcaaacagtgatgtccaagaactcaaa

SEQ ID NO: 152542 - DNA, 601 bp, Human
atcacatatatctttatgtctgactgtatttctctaagtagactttcttggtcggtcagagtatttgaacactgagtattatacactttgaaatctctccttttctgacaggtgaaaggcccattccctggttactgaatggagcatttcttcatgtgcaaagtgtccacctttgattctttgaactaggagtttatgtcctttgccagttttttccatgggctgttttttttctttttgacttgcaggagctgtactacctcaagtaaaaaatgcattttagtttcctgtgaattgacgyagtataatagctcatagttacattaatctgcatatctttttacttatcaaatatttttctctttcaaataagtcattctgatttaagttatgttttcaaaaatctcaaatattatggtatatcttttgaatatttaaaaatctttagggggaaagacagccctgttgataatcaagtctttattacttgatgaataaagagtagctgtggatacacaaaaatctctcctactatctcagaatggaaggaagaatcatgcttgcacacaggtgtggctgatgcgctcagaggcaactgggc

SEQ ID NO: 152543 - DNA, 601 bp, Human
aatttgcctgtaagtggactagtacagttcaaccctggatggttcaagggtcaactataggtatttcaaacagaaaataaaatttttaactctaaatagtagtttaaaatacaaatgcacataaaaaaaacttccaatattacagaaaggaataaaatggaaaattaaagtctctattcccaagctccacaaattattactaatggtatatgtatgattaacttatttaaccagtcccttacagattgcttgagtctgatgcgttaaaataagactgcaatgaacatgatcacatatgtctttttttttttttttttttttggacagttttgctctttcgctcaggctggagtgcagtggcactatcttgcctcactgccacctccacctcccgggttcaagcgattctcctgcctcagactcctgggtagctgggattataggtacccgccaccatgcccagctaatttttgtatttttagtagagatggggtttcaccgtgttggccaggctggtctcaaactcctgatctcaggtgatccatctgcctcagcctcccaaagtgctgggattacaggtgtgagcctccgcgcctggccg

SEQ ID NO: 152544 - DNA, 601 bp, Human
actacaacctaatatttgagagtggcgttttcctcactcaacttatttttctattacttgatctacttctaaaacaaaacacagtctaaaggtaaaaacagcaatgaggaaatccccagtaaaatgaatacctttttctttaattaggaaaaaaaaaatggatgtagcaatttgccagtgaggttactccttagtgtatacacacaatcacaacccatgccattccactggtgattctaaagactaaataataaacaggaacacagctggagtcttgctctgttgcccaggctggagtgcmatggcacgacctcggctcactgcaacctctgcctcctggattcaagcaattctccctccctcagcctcctgagtagttgggattacaggcgtgcaccaccatgccaggctgatttttgtatttttagtagagacggggttttaccatgttggccaggctggtctcaaactcctgacctcaggtgatctgcctgcctcagcctccccaagtgctgggattacaggcgttgagccactacgcccagccataggtttttaaatcagaggaacagagattcacatctcagctcttccatttacc

SEQ ID NO: 152545 - DNA, 601 bp, Human
gtgttaggaagtggaccctgtgaagagagaggagagagagcagatgagggaagcagacagaaagagcaaggctccaggaaggccttgttaagtctgctcctgggatgttacaagacagacagcggacgggcttataagaagtaaaccaagacttccaatctacctgatttcaaaaacaggtctgtgttagttaggatttttggttgtaaatgatcaaaactgacttttattttctcaggcaaaaaaggaattgtgtaagatatcaagtggctttcagagttgaggactagagagacaaacytgggtaggaaccaagggttaagacacaagcaaggtcctgccccaaagaaagtcaacctgggatgctgctcttgataccgtcactactatctccttgcttttgctggcactgccatatgaaggtggctatagtattcatgtacaatctataggcaaatcagagacaaaatcacgagtaggagtatctgactgatcatgttctagctgcaaagaaggtagaccaaggaaatttctgtcctcttcatcttctacagccaagaggatgtgcctcccacacatcatagaaaatccatgagaaaaa

SEQ ID NO: 152546 - DNA, 601 bp, Human
tcctaggttcaagcggttctcctgcctcagcctcccaagtagctaggattacacctggctaattttgtatttttagtagagacggggtttcaccatgttggccaggctggtctcaaactcctgacctcaagtgatctgcctgcctcggcctcccaaagtgctgggattacaggtttgaggcaccgtgcctggcctaatccttaatttttaaatgatattgaagatcaggaaaaacccctgtaaatgactatgctgatactgctggaaattctggcatgtcattgccacatctaattagaartggattaggaaattttcatcatcattaaaaaccagcaattatgaaatgtagaataaagtaagaaatctgaagtagaacagtacaagatcttaaagctggaagaggacttattgacaataggtcaataaggattcctagggattccaaagatctatatgtcactgctagtccatatttattccattgtatttctatcttggagatgaaaggtctgcaattgttataaaaatacttaagaaaggaaaaggatacatgagtttttccggacagaaacactttgaccgctagcctttagcaatt

SEQ ID NO: 152547 - DNA, 601 bp, Human
ttaagaagctgaacactgaccaataatggctattaatgaaataaaaagaacaataatcagacattatgggtctcttgatgaataacacattacccaccacctctgaagtaatcttccccaaaataattaaacctgactcttgttaaccatctaggttcaaccaccataaacatgatttctaaattctggtggcagtgttatcttattaatacagtaattatactccaaaatgagagaaataaaatttgcaaatcatgtagtctacaatggtgctcaaactgacaatgtcataatccttgatttttttttttttcttttttgagatggagtctcactctaccgcccaggctgcagtgcagtgggttttgagatggagtctcattctatcatccaggttgaggtgcagtggcacaatctcggctcactgcaacctccacctcctaggttcaagcggttctcctgcctcagcctcccaagtagctaggattacacctggctaattttgtatttttagtagagacggggtttcaccatgttggccaggctggtctcaaactcctgacctcaagtgatctgcctgcctcggcctcccaaagtgctg

SEQ ID NO: 152548 - DNA, 601 bp, Human
ttttttttttttaagagacagtgtcttgctctgtagtagcccaggctggagtgcactggggtgaacttggctcacttcagcctcaatcttctgggctcaagcaatcccccaaccccagctgggactccaggtgcgtgccaccacacctggctactttttgtattttttgtagaggcagggtctcactttgttgtcgaggctggttttgaattcctgggctcaagtgaccctcctgcctcagcctcccaaagtgctgggattataggtgtaagccctccaacctggccagaaaaaaaaaaawtttttttaagtaaaatagaaataaagagataaacaggattaaagagaacgtgacaaataaaaaaggtaggcaaagaaaatccaacatacgtataataggaagacccaaagaagaacattaaagcaagcaagggagcagaacaaatactaaggactgtaattcaacaaatatttctttaacaaaaagtatttaaaaaattttaaaaagtacttgaagtcaaactctcaagaacacatcatgtacctgtaaaaactgacccagaatggccaattactaagacatatttttggtaaaactaat

SEQ ID NO: 152549 - DNA, 601 bp, Human
ctagtttattctattacaacacaaagagggcaaaagaggtaaatggcgaaagggggagaaatgcctcaatcatcaccctggcaacagcaggttcataacccactatgtgtatgtacctcaaccaaggcccaaggaacagttcatatgtttctggggaagaaaaatgcaagtaaggcctggcatggtggctcatgactgtaatctcaacactttgggaggccaaggtgggaggatcgcttgagctcaggagtttgagaccagcctggataacaaggcaagaccccatctctattaaaaaaawataagaaaattaggtatggtggctcatgcctgtaatcccagatactcaggaggctgaagtgggaggatttcttgaggccaggagttggaggcctcattgagagctgtgattatgccactgtactccagcctgggtggcaaagcaagactgtctcaaaaaaccaatcaaccaaccaaccaaccaaccaaacaaacacccaagtaaatgttcttgagaccacatgccacatttatacatgtgtgtgtatgtatgtatgtatgtgtgcgtgttacatatatatataaaacaccattttttttc

SEQ ID NO: 152550 - DNA, 601 bp, Human
ggtgactcaagagactgtataataagcttagtacggatgtcacgggaagctggacagaaggaaaaccagaacctaggcctcacgcacagagcatgcacctgtgcttactcaatgcagcaaaaaacacaagtgtttcaagggatccaccataaaagggactgccacacatctaaaaagcatgtatatatctcccttctctttaaggtttttttgtattgttagtgatcacttaatttacttaatggttaactaaaacagtatttcacttatagactacatacattcctaaagtcatatgagrctaaacattctcctattttcaagctatcacagtttctattagcatctcagaattactctcatttcattattttctagtttattctattacaacacaaagagggcaaaagaggtaaatggcgaaagggggagaaatgcctcaatcatcaccctggcaacagcaggttcataacccactatgtgtatgtacctcaaccaaggcccaaggaacagttcatatgtttctggggaagaaaaatgcaagtaaggcctggcatggtggctcatgactgtaatctcaacactttgggaggccaaggtg

SEQ ID NO: 152551 - DNA, 601 bp, Human
tactttatccttctaaagaataaagaatccctagttctaattaaaaattataaagtagaacacaaacaaattcttgctattatattgtggtatgttctaaacccaggccaataaaaaatccagtgatcatgtcattataccacacagttgctagcaactaaaacagagtggctggccaactcacatgatggcctcaactccagaaagatgcttcagaatcaataatctctctttacaacaattagcatcttttcaaaaggacttatccccatgtcaaaagttaggagatggccgggcgtgktggctcacacctgtaatcccagcactttgggaggctgaggcgggcagatcacctgaagtcaggagttcaagatcagtctggccaacacagcgaaaccccatctctactaaaaatacaaaaaattagccaggcgtggtggtgcacacctgtattcccagctactcgggaggctaggacaggagaatcacttgaatccaggaggtggaggctgcaatgagccaagatcatgccactgcactccagcctgggcaacagaatgagactttgtcttaaaaaataggggaccaggagaactaatga

SEQ ID NO: 152552 - DNA, 601 bp, Human
ggttctttctttcttgctagtatccttttcaactactcccggttcctgttgtcccttccaattcattactgttacaaaaaggaaactgatcaactaaaaaggtaattgtggctcccgcaccatcatgatattaactcacttgatccttagagcaatcctatgaagtaggtacgttatcaccctcattttatagatgataaaacaggtactgtttatcatctatagtaaagtaatgtgacccaagtcactcagcaagaatggcagagtcaggatttaaacttgggctatctgattctagagkttatctacttaggcaaatgtaattctgcctctcatactgaaatgctactttatccttctaaagaataaagaatccctagttctaattaaaaattataaagtagaacacaaacaaattcttgctattatattgtggtatgttctaaacccaggccaataaaaaatccagtgatcatgtcattataccacacagttgctagcaactaaaacagagtggctggccaactcacatgatggcctcaactccagaaagatgcttcagaatcaataatctctctttacaacaattagcatcttttca

SEQ ID NO: 152553 - DNA, 601 bp, Human
gtggaagcacccttttcttctccttggtcaccgagtcacactacttctcctctggtccccagctgctgccctccacccttctcgctgcttcacccccctccctacacacacgcgggttgcacccacaattataggctgtccctgtctgcagccgttccacacatgcctgccaagttttctgtgtaaaactctgcattatgtatactacattctgcacaaaatgtcagtggcttgctgttctaaggcaaaatcccatttacatttttaaaagagaattctaaatttaaagtctttgaacagyaatgtcaaacttgcatatatgaagccaggaaaataacctgtgagttgagcaagtgtaacaacaggaattgttaggccacagcaatttaagcatatgccctgttcacagccttcaaatgcaagttaataatcatcataaatatataataagattatacattttccaattatcataaaaaatctatacagctctatgaccccaggcccaattactttcacactttaggtatatatggaaggtaccaagattttgtttctaaaagactttcactaagccccagttctgtcatctgtaaatagg

SEQ ID NO: 152554 - DNA, 601 bp, Human
acatctggggcaggggagaggtgacagaaccgatctatgtttctgttatgggcagtggttacatgactgaatgcactgtcaaaagtcacaacacgactgtacaccaaaaggaatcaatcttattgtaggttaaaaaaaaaaggtaaattaaatttattgcattaaaaaagagaattcaaaacattctaaaataagaagggtaaactctagtctccttttacaaagcagcaggtgggcagttaatacggcaacactgacacaggaatgagctagagaggtgggttcttgacagcggggggtkggggggatacagttaactcaaagtcaagttttcctttaaatgaggttaagattccagtggatgttaataacccactttgtttcttacttgctgcggccaccagcaggaccagactcagtctgtgtgggccttcatgtggtctgctttgagcaggggcctgcagtgctctgtgggctacggcccagtacccctacggggtcctgcgcacaattacttcatcaagtcctggctcaaacatatggttaccccacaatcttgggcaacagcttgctttctctttgcttgtatgattttggctca

SEQ ID NO: 152555 - DNA, 601 bp, Human
aaaatgatcatggtttctacgctttaagacatttatttttaaattaattatggtaagtgaacaaagccagactaaaggctatatactatactattccatttttatgacattctggaaaaggcagaaaaacagaaacagaaaccagattactggtttctggctgggggtagaggacaggactgactgtacacaagcaacacaagaacatctggggcaggggagaggtgacagaaccgatctatgtttctgttatgggcagtggttacatgactgaatgcactgtcaaaagtcacaacacgaytgtacaccaaaaggaatcaatcttattgtaggttaaaaaaaaaaggtaaattaaatttattgcattaaaaaagagaattcaaaacattctaaaataagaagggtaaactctagtctccttttacaaagcagcaggtgggcagttaatacggcaacactgacacaggaatgagctagagaggtgggttcttgacagcggggggtgggggggatacagttaactcaaagtcaagttttcctttaaatgaggttaagattccagtggatgttaataacccactttgtttcttacttgctgcgg

SEQ ID NO: 152556 - DNA, 601 bp, Human
gaggtcaggagttcgagaccagcctggccaacatggtgaaaccccgtttctactaaaaatacaaaaaattagccaggcgtggtggcgcgtgcctgtaatctcagctacttgggaggctgaggcaggagaattgcttgaacctgggaggtggaggttgcagtgagcagagatcgtgccattgcacgccagcttgggcaacaagagtgaaactccatcttcaaaaaaaaaaattttttttctaccagtataattttacattctttaacattttcctttttatgaatttcaaagtttatttttwaaatataatctcccgttcacatgattatcttttagattctgctacacaggcataggggagcaactcaagaattaatctaaagaaacgatctttatatttttaattggaattgctcctctaaattgttgcctttccccatggcaataatttccaatcctaaagctgtttatatgcttttgctgatgtgctaaagtggtttaccaacatgctaaatgtttcctgtctcttaagcctgcctggtattcactatcgcttcctggatattcctgatgatctgtatttctaactcattatgaaaat

SEQ ID NO: 152557 - DNA, 601 bp, Human
acaaactagggaagattttctttagtggaaatttgtgatgtattaataatagctaacgcatacaacacttactattttggaggcctgttctaagcactttacttattaactcaatccacacaataatcctattaaagcccattttcctgatgaggaaactgaaacaaagggtaagatagtttgcccaaggtcacacagctggaacatggcagaaccaggatttgaagcaacctggggcagcctttgggttctcagctactaatctgttaccatacatgttaccaatattttctttaattcrtgtatcatgaatgggctatttttttctattttaaaaaatttctgccgggtgcaatggctcatgcctgtaatcccagcactttgggaggccgaggtgggcagatcacttgaggtcaggagttcgagaccagcctggccaacatggtgaaaccccgtttctactaaaaatacaaaaaattagccaggcgtggtggcgcgtgcctgtaatctcagctacttgggaggctgaggcaggagaattgcttgaacctgggaggtggaggttgcagtgagcagagatcgtgccattgcacgccagctt

SEQ ID NO: 152558 - DNA, 601 bp, Human
aaggatttataaccagttctggctagtataaggactatttttttttttaaaagtcatggcaggagtcaacctttctgctcattccccttccgcctccttcatgtctgcactacagacacgatgtctggatatacagcacccatctaacaatggtggaaaagaggccaggcatgatggctcatgcctgtaatcccaacactttgggaggccaaatcacttgaggccaggagctagagaccagcctggccaacatcgcgaaatgccatctctactaaaaatacaaaaattagctgggtgtggyggcgcatgtctgtaatcccagctacattggaggctgaggctggagaatcgcctgaacccaggaggcggcggttgcagtgaggtcagatagtgccactatactccagcctgggcgacagagcgagactccatctcaaaaataaataaataaataaataaataaataaataaataaataaataaataaaaatgtggtgggtcacacctgtaatcccagcactttgggaggccaaggtgggcagattatgaggtcaagagattgagaccttcctggacaacatggtaaaaccccgtctctact

SEQ ID NO: 152559 - DNA, 601 bp, Human
aaaggaaggatttataaccagttctggctagtataaggactatttttttttttaaaagtcatggcaggagtcaacctttctgctcattccccttccgcctccttcatgtctgcactacagacacgatgtctggatatacagcacccatctaacaatggtggaaaagaggccaggcatgatggctcatgcctgtaatcccaacactttgggaggccaaatcacttgaggccaggagctagagaccagcctggccaacatcgcgaaatgccatctctactaaaaatacaaaaattagctgggygtggcggcgcatgtctgtaatcccagctacattggaggctgaggctggagaatcgcctgaacccaggaggcggcggttgcagtgaggtcagatagtgccactatactccagcctgggcgacagagcgagactccatctcaaaaataaataaataaataaataaataaataaataaataaataaataaataaaaatgtggtgggtcacacctgtaatcccagcactttgggaggccaaggtgggcagattatgaggtcaagagattgagaccttcctggacaacatggtaaaaccccgtct

SEQ ID NO: 152560 - DNA, 601 bp, Human
ttctggccagtcattggttaaaggaaggatttataaccagttctggctagtataaggactatttttttttttaaaagtcatggcaggagtcaacctttctgctcattccccttccgcctccttcatgtctgcactacagacacgatgtctggatatacagcacccatctaacaatggtggaaaagaggccaggcatgatggctcatgcctgtaatcccaacactttgggaggccaaatcacttgaggccaggagctagagaccagcctggccaacatcgcgaaatgccatctctactaaawatacaaaaattagctgggtgtggcggcgcatgtctgtaatcccagctacattggaggctgaggctggagaatcgcctgaacccaggaggcggcggttgcagtgaggtcagatagtgccactatactccagcctgggcgacagagcgagactccatctcaaaaataaataaataaataaataaataaataaataaataaataaataaataaaaatgtggtgggtcacacctgtaatcccagcactttgggaggccaaggtgggcagattatgaggtcaagagattgagaccttcctggaca

SEQ ID NO: 152561 - DNA, 601 bp, Human
ctatgtgtatttaacaaatagatatgatttaaaacctgtatgaagtttacctgtatactagaatctccctttatacattttgctccttctattatagccatgtatgagaatctcagttgatctggggtctgaataagacccattcggtattttctcatgttcagtaacacttgttttatgttaatatcatctcctttttccatctgcaagaaaggcaaaaaatgagacaagtcttgttattggaacccaggaaacagaatcaatgcaagatcattgctaagatttttgctatgcattttcycctctgaaagaacaacgataatttaaccctccagctataactgttatgtacacaacaactatcccagcctactcatccctccccacatctcaacccctcaagtagttggaggactttgattctttagctgattcacaactgattccaaaccaatcatagtaatctcattccttctggccagtcattggttaaaggaaggatttataaccagttctggctagtataaggactatttttttttttaaaagtcatggcaggagtcaacctttctgctcattccccttccgcctccttcatgtc

SEQ ID NO: 152562 - DNA, 601 bp, Human
tgtgaaggcatggggaaatctgattgaactacttttctttttgaactccagatttaagttggtgaaagctcactgtgattagaaagggaaattttcctaatcttaaacatctgaaataacttttacttcacctaaatcactgatcactgccaaagtgaccctggcaaatccagtgttcccaaagtctggcgtctgaagcaggacatgttctaatgggctgagtttcccaaacattgcgtattttggctctgagtgccctaatgtttctgtgcattaagaatattttaatgctatttaaagrtttggaaaaaatctttttaaataaacctttattctgacaccaatggtccgatctaatttacattcttatattggctagtaatcagagaaatgaaagtgctagtaaatatgttcacacatgagaaacataatgaaaagacagtcgatcttcttatattatgcatcaacttacagtatctgcttatgtccaatactatgtgattaaaccagacaaaaaatggagtctgtggttgtttctattttacattttaacttagtacataacacaagtttctgatcagtctttgaacttaggttctac

SEQ ID NO: 152563 - DNA, 601 bp, Human
gaccatttctgcagaaattaaccccttggaatgggcagcatgcttttctgatcctgagtacctgaaggataaagatgtttccaatatcctatctggaataggggcagaaaatgccttagaattgagagcctgaggacaatatcacaccagataaattaacagaaaaaaaatccttgctagccacaaactgcactgtcaaagactccacaaaaaagtgtgtccagaaaaactcatctctgtgataaaaaaagatccaccctcagataaagtatgtattctaaaactaaagacacaaaacttaaaaaaaaaaaaagcagtggtaggaaagacacaatccaaaggacaatacatttccctcccagttacccgtctcatcacagccaggaagcaggcagggaaggcggcatgcaggctgtgaaggcatggggaaatctgattgaactacttttctttttgaactccagatttaagttggtgaaagctcactgtgattagaaagggaaattttcctaatcttaaacatctgaaataacttttacttcacctaaatcactgatcactgccaaagtgaccctggcaaatccagtgttcccaaagtctg

SEQ ID NO: 152564 - DNA, 601 bp, Human
cccatgagtcactgccactaggagccatgccccccacacaatgcctagaaccctagctctacccatttctctcactgaagaaagctttaagcaatgcaattaaacttcaaatcctctgtaatttgttaaaagtttatcatttacatttaatactttattagtaatatcaaattaccagctagagatcttacaacattagttctgaattgccaaactagatatttactctggggggttaactgtcatcatcaatactgggaatatgctaataaatatgtggtaataccagcaaccagcttamgtatttatgcctgaccttgtgctgaaaggcaattgcaaatagcctatatgtctataggaatgtcaaagtcattggaagttttctgtaaatgaatacatgctttaagattataattacacatatttacagacttaagatacaatcactttgggctgggtgcggtggctcacgcctgtaatctcagcactttgggacgccgaggtgggcgatcacttgaggtcaggagttcgagaccagcctggtcaacactgtgaaaccccatctctactaaaaatgcaaaattagccaggagtggtggca

SEQ ID NO: 152565 - DNA, 601 bp, Human
gggatgagttctggtgttttactgcacagaatgactatggttaataatatttaatatttcagacagggtgtggtggctcatgcctgcaattctagcagtttgggaggctagggcgggcagatcgcttgagcccaggagtttgagatcagcctgggcaacatggtgagacccagtctctacaaaaatttaaaaattagccatatgtggtggcacgcgcctgcagtcccaattacttaagagactagggcaggaggatcacttgagcccaggaggcggaggctacagtgagcgagccatgatsgtgccactgtacaccagcatgaacaagagaatgagaccctatctcgaaaaaaatttatatacatacacattttatatacacataaaatcctctcttctggctatttcgaaatacttatatatacttatatatatttcaagtactatgaaatatattagcacataataatatataattaaatagagatttcaaaatagctggaagagaggattttgaacgttttcaccacaaagaaaagataaatgtatgaggtgatagacgtgctagtctaatttggtcattacataaatgtatcaaaat

SEQ ID NO: 152566 - DNA, 601 bp, Human
gcatggaaataaatctacgtatttacagccaatttatttttgacaaagatgccaagaatatacactggtgaaggacagtctctttgataaatggtgttgggaacactggatatctagatgcccaagaatgaaactagacccctatctctcaccatattaaaaaatcaactcaaaatggactaaagacttaaatatgagaccccaaacaaatatacatactagaagaaaagatagggaaacacttcaggacattggtctgggcaagggaagggtcttttgtataagacctcaaaagcaaaamcagacaaatgggattacatcaaactaaaaagcttctgtatagcaaaggaagcaatcgatagactgaagagacaatctacagaatggaagaaaatatctgcaaactatacatttgacagggattaatatccagaatatataagaaactcaaacaaaattcaatagcagaaaacacaagtaatccaattaaaaataggtaaaagacctgaatagccatttcttaaaagacatacaaagagccaacagatacatgagaaaatggtcaatatcactaatcatcagaataatgcaaatcaatacc

SEQ ID NO: 152567 - DNA, 601 bp, Human
aagttgaaagcttttcctcttaagatctggaacaagacaaagatgcctcctttcttttttttttttttttttgagatggagtcttgctctgtcaccaggctggagtgcagtggcatgatctgcaacctctgcctcccaggttcaagcgattctcctgcctcagcctcccgagtagctgggactacaggcgcgtgccagcatacccagctaatttttgtatttttagtagaggcagagtttcaccatgttggccagggtggtctcaatctcttgacctcatgatctgcccatctcagccccscaaagtgctgggattacaggcatgagccaccgcaccgggctaggatgcccactttcaacacttttattcagcataatactgtaagtcctagccagagcaattagctaagagaaagggtattcaaattggaaaggaggaagtcaaattgtctctgtttgcagaagacataatcttatgtatagaaaaccctatagactctaccaaaaaactgttataactaataaaaaaaatcagtaaagttgcaggatacaaaatcaacaaataaaaatcagtagaattttatacatcactaacaaacta

SEQ ID NO: 152568 - DNA, 601 bp, Human
aaaaagaaacgaaagatcaacaaaaccaaggatcatttttttgaaaaggcaaacaaaatcaacaaacctatagcagactaagaaaaaaaaaagactcaaatcagagatgaaaaaggagatattacaactaataccataaacaaagtattgtaagagactattataaacaactgtatgccaacaaattgaaaagcctagaggaaatggctaaattcttagacacacacgaactatcaaaacggaaccatgaagacatagaaaacctgaactgaccaataaagagtgagattaaatcagtaayaaaaagtctcccatcaaagaaaagcccggacttgatggcttcatggctgaattctaacaaacatttaaataatactaattcctttcacactattcaaaaaactgaagagggaaatcttccaaaatcattctgtaaggccagcattaccctgataccaaaaccagacaaggacacaacaaaaaagaaaactacaggccaatatccttgatgaatatggatgcaaaaatcctgaatgaaataatagcaaattgaattcaacagtatattaaaaacatcatttaccatgaccaagtgggattc

SEQ ID NO: 152569 - DNA, 601 bp, Human
cctttttctttctccagtaatgcaattaagcttacatgtttaaatgttttattaaaggcatattatcagttacattataattatagtacaaatggcaggtattcatactacttattttctgtaccataccatatattttagcacccaattatattaacttttacactcaatcattattgttttaaaggatttttgaactggtttctaagtattggctgaaagctccttaagaacacctttgtcatcatatactaaataccctcaggtaagaaataaaggttatattaatttggctgggcayggtggctcacgcctgtaatcccagcactttgggaggctgaggcgggtggatgacctgaggtcaggagttcaagaccagccttgttaacatggtgaaaccctctctctactaaaaatacaaaaattagctggacatggtggtgggcgcctgtaatcccagctacatgggagggctgaggcaggagaattgcttgaacccaggaggtggagcagctaaggttgtgccaccgcactctagcctgggtgacagagaaaaaaaaaggttatattaattcaataaaaaaaagggcctatattattt

SEQ ID NO: 152570 - DNA, 601 bp, Human
attccaatctaacaaatataaccacaagataaaattccccatgataagaagtatatttggcaaaaagagaagaagaaaagttattcagagatgcaggagagaggaaagaaaaacctcattcactttgctatgtgacttataccaggttatcagcttcctaatctgtgagagacagtcttagaaatgtaattgtaatttaaaattctgaatagatgccacattcatatggatttttaaaaaacgcctttttctttctccagtaatgcaattaagcttacatgtttaaatgttttattaaagrcatattatcagttacattataattatagtacaaatggcaggtattcatactacttattttctgtaccataccatatattttagcacccaattatattaacttttacactcaatcattattgttttaaaggatttttgaactggtttctaagtattggctgaaagctccttaagaacacctttgtcatcatatactaaataccctcaggtaagaaataaaggttatattaatttggctgggcacggtggctcacgcctgtaatcccagcactttgggaggctgaggcgggtggatgacctg

SEQ ID NO: 152571 - DNA, 601 bp, Human
tcaaaaattgggaataacattactaaatcataataaactcttccactataatatataataatacatgtattatatattggaatatgttagcatttataaaatttcaggtgtttaatttttatattaggaaaatacagcagtaaagctataatgtatggcagacttcgactattttcattccaatctaacaaatataaccacaagataaaattccccatgataagaagtatatttggcaaaaagagaagaagaaaagttattcagagatgcaggagagaggaaagaaaaacctcattcactytgctatgtgacttataccaggttatcagcttcctaatctgtgagagacagtcttagaaatgtaattgtaatttaaaattctgaatagatgccacattcatatggatttttaaaaaacgcctttttctttctccagtaatgcaattaagcttacatgtttaaatgttttattaaaggcatattatcagttacattataattatagtacaaatggcaggtattcatactacttattttctgtaccataccatatattttagcacccaattatattaacttttacactcaatcattattgttt

SEQ ID NO: 152572 - DNA, 601 bp, Human
ccaggtattaagcctagtacccattagttatttttcctgattgtccccctcctcccaccctccatcctccgacaggcccccagtgttgttcccctctatgtgtccatgtgttctcatcatttagctctcaattgttagtaagaacatggggtatttggttttctgttcctccattagttttgctaaggataatggcctccagctccatccaagcccctacaaaggacatgatctcattctttattatggatgcatagtattccatgctgtatatgtacattttctttatgcagtctatcaytgataggcatttagattgattccatgtcttttctatggtgaatagtgctgcaatcaacatacgcgtgtgtttacatctttacagtacaatgatttatattcttttgggtgtatacccagtaatgggattgctgggttgaatggtatttctgtttttaggtctttgaggaatcaccacactgtcttccacaatagttgaactaatttatactcccaccaacagtgtttaagcattcctttttctccacaacctcgccagcatctgttaaattcatgttattatttgtgatatgctgataat

SEQ ID NO: 152573 - DNA, 601 bp, Human
aatgggacctgcccaggttttcccgtatatttatgcaatttaggatattaaccaatgggaatgcctcctgtggacccttgcccagggaagatcatgtggcgtgatcatagctccctgtagcctcaacctcttgggctcaagcaatcctcccacctcagcctcccttaagactacaggcaggtcccaccacatttggcggatttttgtattttttgtagagacagggtttgccatgttgcgcaggctggtcttgaactgctaggctcaagtgatccacccgcctcagcctccccgagtgttrggattacaggcatgagccactctgcctgctccagacttttcgtatgtccaagttgtttctcactctcagtgatctgggtttctgggttgaactgtaattgagaatactgcctttcaaattcagactgcaacctacagtaagaaatagcatcacaacagagtaacctcacacacacacttacataggtacacaatgtatatgtaaatatatggaatttatacatcacacatacatatataaaaacaggttaaaattcaagttcaggggtacgtccatgtgcaggcttgttacataagcttg

SEQ ID NO: 152574 - DNA, 601 bp, Human
ctttaaatgctacataggagtttaaaaggttttgtactatatttgggggaactggttatgctttctggttgggctgacaacacactatttttctcatttaaaagaatggaacagaggtttttgctttccaaaagtgcactatataattcaggaatggactagagacaaataccaaggcatgcctgtatctaatttaagaacacaattccagagaatgacaagactactctcgatttgtgataaaatcttttcttccttagtggggcctaaagaaattatgtctgtgtaatgacttgccaartgggacctgcccaggttttcccgtatatttatgcaatttaggatattaaccaatgggaatgcctcctgtggacccttgcccagggaagatcatgtggcgtgatcatagctccctgtagcctcaacctcttgggctcaagcaatcctcccacctcagcctcccttaagactacaggcaggtcccaccacatttggcggatttttgtattttttgtagagacagggtttgccatgttgcgcaggctggtcttgaactgctaggctcaagtgatccacccgcctcagcctccccgagtgttgg

SEQ ID NO: 152575 - DNA, 601 bp, Human
gctaacttgggtacttgttttatcttcatcacatattctgcaacttgaggacagactgggttttgctatctttgttcatcttatggtgctttctcatgtctttttcactttttgttatcatatatacaggtatccctggctgtctgaactccatctgaatatctgctataatgacttgcaaaaattcttactcagaattcactctctgaattgaaaattcactatcacaaatatgcatgtacctgttagtgaaaacatttgtgttcaagtgtaggcaaaatatgtataaaaacagagaggrggttagcctcccatgggccctttattagcttttgccaggagcctgggggtatcgttaacaaggttccaatttagatataatctttaacgtattatttcattttttattttcattgcggtatagaaggcaattataatttgtatctagtattttgtcatttaccatacaagcccaataatgagtcccttaagtgttatatgattacataattagtgctttaaatgctacataggagtttaaaaggttttgtactatatttgggggaactggttatgctttctggttgggctgacaacacac

SEQ ID NO: 152576 - DNA, 601 bp, Human
gggaaaacagggtaaaataaataaaaacaatgatcatcttagaatatatgcagttgcatgcaaatctcacactaatctaagataccatagcatagtcaggtcccacacctgagctcaaaacagtctctttccagtgagaccaatatactcactgtgctcatatatatgtttagcagtaccaaacctttgtttgttcaacttaaaaacattctccttattcacattctacctatccgaaatccagtctctttataggagccttcccaactattcacaagaattgccagccattttgaaggcrgaagggaaaatggtcaaaataaccaggacatagcattagacacttaatatttctgtggattccctaacagagtatatattctttaatggcaatctctgttttttgtaccctatgacaatacccagcactaacactccacttaccagaccttaaaaaaaaaacaaaacaaatctaacaccaaagtgtcccttaccttctcgagctaaatcacccacattaatgtatttcagtcctgattttgacgcaagttctttgcctagtgtggtttttccaacccctggtgtacctgtaagacaagcc

SEQ ID NO: 152577 - DNA, 601 bp, Human
aaaccaaaagcgaacccagccaagggggtgaaagccgagggcgcggccggggtggaaggtgaggcagtgacctgtgcggagcgcgccctgcaaacttccctgctgcgggtgaaagaagctgcctgggaaagtcctccccaccatcactcccctaaagtggggttttctccgcccgaagaagccttaaagcagccagaaacaaagaagcagtcaatccgtgcggcccggggactgcagacaggggacccggcgaggacgcagggagccgctggcgaaccgcccctgggaattcagataaacrtagggtcgcttcctttcgggggcccactccgcattccagaattccttcttctaaaagaagagccggttctaagggcgttttcagcagccattagcatctggtgtacccccccgtgtcattggcaaagctggtctcatgaaaaccatttcctaaaaaagggcagcgaaagggtcgcattcttgtgcgaactgatctgtcaatatgggggtacaagaactgtagaaagaggaaatgatttcggtgaggactgaattgtgccagcgtctctaggcttcctctaggctcttgtggaacctccgg

SEQ ID NO: 152578 - DNA, 601 bp, Human
tgaaagaagctgcctgggaaagtcctccccaccatcactcccctaaagtggggttttctccgcccgaagaagccttaaagcagccagaaacaaagaagcagtcaatccgtgcggcccggggactgcagacaggggacccggcgaggacgcagggagccgctggcgaaccgcccctgggaattcagataaacgtagggtcgcttcctttcgggggcccactccgcattccagaattccttcttctaaaagaagagccggttctaagggcgttttcagcagccattagcatctggtgtacccscccgtgtcattggcaaagctggtctcatgaaaaccatttcctaaaaaagggcagcgaaagggtcgcattcttgtgcgaactgatctgtcaatatgggggtacaagaactgtagaaagaggaaatgatttcggtgaggactgaattgtgccagcgtctctaggcttcctctaggctcttgtggaacctccggcaggctcccatcatcggctcccatcaccggcctcttccaaaaccatcccttacgctaactcgattgtccggttggcttagaattccagaggatctgggaaggccctgcc

SEQ ID NO: 152579 - DNA, 601 bp, Human
aagaagcagtcaatccgtgcggcccggggactgcagacaggggacccggcgaggacgcagggagccgctggcgaaccgcccctgggaattcagataaacgtagggtcgcttcctttcgggggcccactccgcattccagaattccttcttctaaaagaagagccggttctaagggcgttttcagcagccattagcatctggtgtacccccccgtgtcattggcaaagctggtctcatgaaaaccatttcctaaaaaagggcagcgaaagggtcgcattcttgtgcgaactgatctgtcaakatgggggtacaagaactgtagaaagaggaaatgatttcggtgaggactgaattgtgccagcgtctctaggcttcctctaggctcttgtggaacctccggcaggctcccatcatcggctcccatcaccggcctcttccaaaaccatcccttacgctaactcgattgtccggttggcttagaattccagaggatctgggaaggccctgccctccctgctagcccctggcacagatccgcacagatccccacctcccccgacttgctcagccacagccaggatctagtctggtctttctctgt

SEQ ID NO: 152580 - DNA, 601 bp, Human
ttcagataaacgtagggtcgcttcctttcgggggcccactccgcattccagaattccttcttctaaaagaagagccggttctaagggcgttttcagcagccattagcatctggtgtacccccccgtgtcattggcaaagctggtctcatgaaaaccatttcctaaaaaagggcagcgaaagggtcgcattcttgtgcgaactgatctgtcaatatgggggtacaagaactgtagaaagaggaaatgatttcggtgaggactgaattgtgccagcgtctctaggcttcctctaggctcttgyggaacctccggcaggctcccatcatcggctcccatcaccggcctcttccaaaaccatcccttacgctaactcgattgtccggttggcttagaattccagaggatctgggaaggccctgccctccctgctagcccctggcacagatccgcacagatccccacctcccccgacttgctcagccacagccaggatctagtctggtctttctctgttgacctttttgtgtggcaggagtgggttttcctgttccccaggccctctaatatttccagacataaattccaggaatcccatgcttcc

SEQ ID NO: 152581 - DNA, 601 bp, Human
acgtagggtcgcttcctttcgggggcccactccgcattccagaattccttcttctaaaagaagagccggttctaagggcgttttcagcagccattagcatctggtgtacccccccgtgtcattggcaaagctggtctcatgaaaaccatttcctaaaaaagggcagcgaaagggtcgcattcttgtgcgaactgatctgtcaatatgggggtacaagaactgtagaaagaggaaatgatttcggtgaggactgaattgtgccagcgtctctaggcttcctctaggctcttgtggaacctcmggcaggctcccatcatcggctcccatcaccggcctcttccaaaaccatcccttacgctaactcgattgtccggttggcttagaattccagaggatctgggaaggccctgccctccctgctagcccctggcacagatccgcacagatccccacctcccccgacttgctcagccacagccaggatctagtctggtctttctctgttgacctttttgtgtggcaggagtgggttttcctgttccccaggccctctaatatttccagacataaattccaggaatcccatgcttccctcttgagg

SEQ ID NO: 152582 - DNA, 601 bp, Human
ggcataataacatgttccccctttaggcagaggactacaccagatgatctcttaagatacatgttaccatttcctgctaatctatgagttcagggtgccaattagcaaacctgggagaggaggaagctggaggaaatctctttacttcttttatctccaagaaagatacacactctttgagtggcttcctgcagacagtgccttacctttgccagttctgtgtgtaggaatttgaacttggagttggaagaaccatgccaaagcagagaaagaagaggtttctgggcagacggaggctttkaaacatcaatcgtggccggtcgcgttggctcacacctgtcatcccagcactttgggaggctgaggcggggggatcatttgaggtcaggagttcaagaccagcctggccaacatggtcaaaccccgtctctattaaaaatacaaaaaaaagttagctgggcggtagcggcgcatgcttgtaatcccagctactcgggaggctgaggcaggagaatcgcttgagcctgggaggtggaggttgcagtgagccgaaatcacgccactgcactccagtccgggcgacagagtgagactctatctc

SEQ ID NO: 152583 - DNA, 601 bp, Human
tctgtgtgtaggaatttgaacttggagttggaagaaccatgccaaagcagagaaagaagaggtttctgggcagacggaggctttgaaacatcaatcgtggccggtcgcgttggctcacacctgtcatcccagcactttgggaggctgaggcggggggatcatttgaggtcaggagttcaagaccagcctggccaacatggtcaaaccccgtctctattaaaaatacaaaaaaaagttagctgggcggtagcggcgcatgcttgtaatcccagctactcgggaggctgaggcaggagaatckcttgagcctgggaggtggaggttgcagtgagccgaaatcacgccactgcactccagtccgggcgacagagtgagactctatctcaaagaaaagaaaacaaaagaaaagaaacatcagtcatatcacaccacatttgtggcttcctttttttttttttgagggtggctgtaagtttcagttttattgaaatcagaggacattttatttgaaagaccaaatgaccttgttgtccacactgagtaagatttgccacatcccctcgtttggctggctctttcctgggtgagatgtgtgcagcag

SEQ ID NO: 152584 - DNA, 601 bp, Human
ggtttctgggcagacggaggctttgaaacatcaatcgtggccggtcgcgttggctcacacctgtcatcccagcactttgggaggctgaggcggggggatcatttgaggtcaggagttcaagaccagcctggccaacatggtcaaaccccgtctctattaaaaatacaaaaaaaagttagctgggcggtagcggcgcatgcttgtaatcccagctactcgggaggctgaggcaggagaatcgcttgagcctgggaggtggaggttgcagtgagccgaaatcacgccactgcactccagtccrggcgacagagtgagactctatctcaaagaaaagaaaacaaaagaaaagaaacatcagtcatatcacaccacatttgtggcttcctttttttttttttgagggtggctgtaagtttcagttttattgaaatcagaggacattttatttgaaagaccaaatgaccttgttgtccacactgagtaagatttgccacatcccctcgtttggctggctctttcctgggtgagatgtgtgcagcaggctgtgtttctagctgctcatccaattaggctgattctctgggtgggataacattgaggg

SEQ ID NO: 152585 - DNA, 601 bp, Human
cacctgtcatcccagcactttgggaggctgaggcggggggatcatttgaggtcaggagttcaagaccagcctggccaacatggtcaaaccccgtctctattaaaaatacaaaaaaaagttagctgggcggtagcggcgcatgcttgtaatcccagctactcgggaggctgaggcaggagaatcgcttgagcctgggaggtggaggttgcagtgagccgaaatcacgccactgcactccagtccgggcgacagagtgagactctatctcaaagaaaagaaaacaaaagaaaagaaacatcartcatatcacaccacatttgtggcttcctttttttttttttgagggtggctgtaagtttcagttttattgaaatcagaggacattttatttgaaagaccaaatgaccttgttgtccacactgagtaagatttgccacatcccctcgtttggctggctctttcctgggtgagatgtgtgcagcaggctgtgtttctagctgctcatccaattaggctgattctctgggtgggataacattgagggagatcaaaaccatttgactgtcttcggtttactctcttctctctctctctctctcct

SEQ ID NO: 152586 - DNA, 601 bp, Human
cccagcactttgggaggctgaggcggggggatcatttgaggtcaggagttcaagaccagcctggccaacatggtcaaaccccgtctctattaaaaatacaaaaaaaagttagctgggcggtagcggcgcatgcttgtaatcccagctactcgggaggctgaggcaggagaatcgcttgagcctgggaggtggaggttgcagtgagccgaaatcacgccactgcactccagtccgggcgacagagtgagactctatctcaaagaaaagaaaacaaaagaaaagaaacatcagtcatatcacrccacatttgtggcttcctttttttttttttgagggtggctgtaagtttcagttttattgaaatcagaggacattttatttgaaagaccaaatgaccttgttgtccacactgagtaagatttgccacatcccctcgtttggctggctctttcctgggtgagatgtgtgcagcaggctgtgtttctagctgctcatccaattaggctgattctctgggtgggataacattgagggagatcaaaaccatttgactgtcttcggtttactctcttctctctctctctctctcctcttttttgtt

SEQ ID NO: 152587 - DNA, 601 bp, Human
taatgggtacttcacctatgtccagggccttcgcatggaaggcctcttgtctccccagggacactaggacgcaagagtagaacagatttatactcacagtaaggcagatcatcagaactgtgcaacctcacatgagttgctatgagcactgtatgacagagtatccaataaggtgataagaatttgttagtgttattgtggaaggaagtaatgcataggatagtgggttgggctaggtaatgatcacatttgctttccaagtctgagattctagtaacttactattttttctcccgagacyggcatttcttggggaagggggatggtggggagggttgagtggctagccacagcatttatttcttggcacaactgattcctctactaaattgaaccatttgtggaaagtatgttcagcattggtgactctgggtacgttctatgttacacgagaataaatatgatatagtgggctatcttcccagcagtgcctggcatatggtaacactgtgtcttatgcacccatcccaggctgatggaatccatcagggtccctttgttcctcctttgttcagggtcagcattgctgctttcatcctcc

SEQ ID NO: 152588 - DNA, 601 bp, Human
ttcttataaggacgccaaccccattcatgaaggctctaccctcacaacctaagcacctcccaaaggcccacctcctaatatcctcacattggaggttaggcttcaaaatgggaattttgttggagggacacaaatattaattccatagtaccttgtcaatagtgttcaggcatgtggcctctacttttgccctggcccaatgacactgttttagtgagtgtgatatatcctttaggtctgctctaaggccacagccatgagaaaataggaaactttacattttaagatgctaggacagtgrtccccaacctttttggcactagggatcagttttgtggaagacgatttttccacagatgggagcaggaggcgggggatggttttaggatgaaactgttccacgtcagatcatcaggcattagttagattctcatgaggagcatgcaacttagatccctcacatgcgcagttcacaacagggtttgcactcctgtgagaatctaatgtcaccattgatttgacaggaggcagagctcagctggtaatgctcactcactgttcacctcctgctgtgcaacctggttcctaacaagccatgggt

SEQ ID NO: 152589 - DNA, 601 bp, Human
ggcaggaggtgttgcatgtatagtgggatatggtgggagtcaaatacagcgggggctgtgaagtggggagttgggaaggtttcttggagtaggaaggatttgaacagtgcctaaagggacagggaaggaaaggtgggtgtgcactccaggccctggcagggggcttggatctcactgtattttctggcacagtccctcccctcccagcctgcccactcttccattgacaccccctactccctgtctctctagcactgggtcttttatttttaattccctttgcccccttttttttttttttgaaaaatttaaaacttacacagcagttgaaaggactatgaatgtcccctagattcagcaggagtaacattttgtcacttgtcctttgtctctctctctctctttttttttttttttttttgacatggagtctcgctctgtcaaccagcctggggtgcagtggcacaatctcggctcactgcaacctccacctcctgggttcaagcgattctcttgcctcagtctcctgagtagctgaaatcacaagtgtgcaacaccatgcccagctaatttttgtattttttttagtagagatggcgtt

SEQ ID NO: 152590 - DNA, 601 bp, Human
ccgcggggcacagcagggtgctgccagggatgccgtcaagcctggccaggctcaccttttttttttttagatggagtcttgctctgtcacccaggctggagtgcagtggcacaatctcggctcactgcaacttccgcctcctgggttcaagcaattctcctgcctcagcctcccaagtagttggaattacacgcatgcaccaccatgcccggctaatttttctatttttagtagagatggggtttcgccatgttggccaggctggtctcgaactcctgacttcaagtgatccacccgcctygacctcccaaagtgctaggattacaggcgtgagccaccacacccagcctgaaatctttagttatcaaagttgtattacatgggtgctatgcggtagtttctgtccttgaggtttacagtctaacaatgtccttggcctgctagggcgtacatgggaaaagttaggtaacagtaccagacatcccagtgggatatcgccagatgcttagttgccagatgttcagaaggtgagggctggtggagtttggggtgaccagggagagcgtgtggtgtctgctaatgaaccagaagaagggctgat

SEQ ID NO: 152591 - DNA, 601 bp, Human
gacagagcgagactccgtctcaaaaaaaaaaaaaaaaaaaaaaaaaacattattattgaaatgatacttcacataatgtactgatttacacatgttgctactgttaatgagaattgcatgactggacacttcatttgcatcagcgctttgcttctgacttgttaatcttaactgttgtgtcacaaataaccagatgtgcacattcttatttgtgcttatgaacaaagtagttacactctacttgtgccttctttatatgcccttggcttcttccttattaaaaatatccatgggtgaaagraaaacagtaattgtagactcacagtcactataataatttgtaattgcttctgctgtgaatctcggcaacatcaggaatgattgagaaggattggtacatagccctggaatgcacgcctttcttttaaggaagcgcttcagaatgcctttgattaagaaggatgtcattatgcagatgagcttgtaattgttctagtgtttgaaaaaggtaatagccccataatcctaagcacgtagacttgtactgagtataactcatgtgccagggactgtgctcagtgtttgctacctattgccgcat

SEQ ID NO: 152592 - DNA, 601 bp, Human
aaaaaaaaaaaaaaaaaaaaaacattattattgaaatgatacttcacataatgtactgatttacacatgttgctactgttaatgagaattgcatgactggacacttcatttgcatcagcgctttgcttctgacttgttaatcttaactgttgtgtcacaaataaccagatgtgcacattcttatttgtgcttatgaacaaagtagttacactctacttgtgccttctttatatgcccttggcttcttccttattaaaaatatccatgggtgaaaggaaaacagtaattgtagactcacagkcactataataatttgtaattgcttctgctgtgaatctcggcaacatcaggaatgattgagaaggattggtacatagccctggaatgcacgcctttcttttaaggaagcgcttcagaatgcctttgattaagaaggatgtcattatgcagatgagcttgtaattgttctagtgtttgaaaaaggtaatagccccataatcctaagcacgtagacttgtactgagtataactcatgtgccagggactgtgctcagtgtttgctacctattgccgcataacaaactaccctgacctcagtggc

SEQ ID NO: 152593 - DNA, 601 bp, Human
caggtaactgtttgtcatttctgggaatgtatgagatgtgcagaggcaaagtccagtatcagagatggtctcaccttgatggcagtaaaaggctcaaatgcgtttataataataccaacagcagcagcgacaacaatatatttgtttagcactttacagtttacagtgaactgtcctcatgttatttcatttagtcctcaaataactctatgtggttggctttttgtcttcgatctgcaggtgtgaaggacagaggcttagccatgtgaaatgtttttgctcaatgtcataaaggccatgygggaagtggaccctaagccaggcagtgtgactgctccagggttcccagctccacagtgcaggaggcaaccatttccagttcttttcttcctttactttctcataggatactttttaagcactataaattgggttcaggaaatgtcagtttgtgaaatgtgatcaatccagaaggccaacctgctggactgcaggggactgttagagatcagaggttcccaggtctgctattacagctgttgggtcactgtgcaagcactgctgtcagggtggcacagtggagggcagatgagccctggca

SEQ ID NO: 152594 - DNA, 601 bp, Human
agtagattgtttccacaagaggagctctggctgagctgttttctttatatactttgctacggggtctggcaagtaaaaggtgctgagtaatagctttcaattcactaaatgaatactgtagaacatcattattttcattcattcgactaaatttataacatactctaaattttttattgaagtataacatacaaagtgcactaatcttcagtttaatgcacgatggactttcacaaatggaacagacctatgtaaacacctgggtcaagaaataatgttaccagctgtccagaagcccacyctgttcccccttccaagcattaccttaaaaaaaaagtaactagttgtcttgacttctaacactgtaacatttatttttgcttgtttttaagttgtagcagatgcttactgtaggatctttgttttttttaggtacttatactaagatggcattaatagacgttcttaggaccaaagggctggggcagaatgtgctgccattgggccacaagtgtgcagagacatggatgctggcctggggagatgggctgggtaggctgtggccctttggcttcttccagctgtagccatgtgggcccgt

SEQ ID NO: 152595 - DNA, 601 bp, Human
atataacctaattttttgtttgtttgtttgtttgttttgagacaggggctcattccatcacctaggcaggagtgcagtggtacaatcttggctcactacaacctctgcctcccaggttctagcgattctcatgcctcagcctaccgagtagctgggattacaggtgtttgccaccacacctggctaatttttgtatttttagtagagatggggtttcaccatgttggccaggctggtctcgaactcctggcctcacgtgatgcacccctccttggcttcgctaagtgctgggattacaggygtgagccaccccacccaaccatgaatataataaaattttttatttttgctaatattatagcttaaaaatgataatctattttaatttgcatttctttataatgacaatggatattttaaaaatttgtttattgactgactatatttttctgttacctgccccttcacatcgtttacccattttcaactgggttgtttttgttactgatttgtgagtaatctttgtatattaagaagctaaactctttgttatttgtattgcatatgtttttcctcagtttgttgtttcatgtttcactgt

SEQ ID NO: 152596 - DNA, 601 bp, Human
tgaatttgagaaaaatcagagccagtagtgtccgaattatgaatttacccctggttgtttttttactcttctcttgatgtacttctcacacactgcattctgttgcataaaaagaataacatggtgttgaatgacagatctaaagatggacatttgtctatgtggtaaatacgtggtagattctgggtgatttttcatatgcttcatataaaaaatgatcgtacataaaataacttttttggaaggaacataatctgagccattcagatacaacgaaatccagctcctctctatagcatcrctgtgggtgtagctaaaatatgagattttaagtttaaaaacaacttctgcatgttatttggaaatattttttactaatttcttacgcagcccaaaacttaatgggcaaatttaaaatacgcatttagtgtcttagtattttacaaagtccttcgagcctcaccttatcttttttttttttttttgacacagagtcttgctctgttgcccgggctggagtgcagtggcatgatcttggctcactgcagcctctgcctctcgggctcagacaattctcccgtctcagcctcccaaatagctg

SEQ ID NO: 152597 - DNA, 601 bp, Human
tacgtggtagattctgggtgatttttcatatgcttcatataaaaaatgatcgtacataaaataacttttttggaaggaacataatctgagccattcagatacaacgaaatccagctcctctctatagcatcgctgtgggtgtagctaaaatatgagattttaagtttaaaaacaacttctgcatgttatttggaaatattttttactaatttcttacgcagcccaaaacttaatgggcaaatttaaaatacgcatttagtgtcttagtattttacaaagtccttcgagcctcaccttatcttttttttttttttttgacacagagtcttgctctgttgcccgggctggagtgcagtggcatgatcttggctcactgcagcctctgcctctcgggctcagacaattctcccgtctcagcctcccaaatagctggaattacaggcatgtgccaccatgcccagctaatttttgtattttttttagtagagacagggtctcaccgtgttagccaggctggtcttgtaccccgacctcatgtgttcccccatgttggcctcccaaagtgctgggattataggcatgagccaccacacccggtcct

SEQ ID NO: 152598 - DNA, 601 bp, Human
tgatcgtacataaaataacttttttggaaggaacataatctgagccattcagatacaacgaaatccagctcctctctatagcatcgctgtgggtgtagctaaaatatgagattttaagtttaaaaacaacttctgcatgttatttggaaatattttttactaatttcttacgcagcccaaaacttaatgggcaaatttaaaatacgcatttagtgtcttagtattttacaaagtccttcgagcctcaccttatcttttttttttttttttgacacagagtcttgctctgttgcccgggctrgagtgcagtggcatgatcttggctcactgcagcctctgcctctcgggctcagacaattctcccgtctcagcctcccaaatagctggaattacaggcatgtgccaccatgcccagctaatttttgtattttttttagtagagacagggtctcaccgtgttagccaggctggtcttgtaccccgacctcatgtgttcccccatgttggcctcccaaagtgctgggattataggcatgagccaccacacccggtcctcactgtatttttgaaaacatggttacagaattagttgcatgtggag

SEQ ID NO: 152599 - DNA, 601 bp, Human
ccagctcctctctatagcatcgctgtgggtgtagctaaaatatgagattttaagtttaaaaacaacttctgcatgttatttggaaatattttttactaatttcttacgcagcccaaaacttaatgggcaaatttaaaatacgcatttagtgtcttagtattttacaaagtccttcgagcctcaccttatcttttttttttttttttgacacagagtcttgctctgttgcccgggctggagtgcagtggcatgatcttggctcactgcagcctctgcctctcgggctcagacaattctcccrtctcagcctcccaaatagctggaattacaggcatgtgccaccatgcccagctaatttttgtattttttttagtagagacagggtctcaccgtgttagccaggctggtcttgtaccccgacctcatgtgttcccccatgttggcctcccaaagtgctgggattataggcatgagccaccacacccggtcctcactgtatttttgaaaacatggttacagaattagttgcatgtggagaagctgaaatgctatatgtaaatcctctttcctgattaccagcattctcctaatgcaaagtgtg

SEQ ID NO: 152600 - DNA, 601 bp, Human
cccaaagtgctgggattataggcatgagccaccacacccggtcctcactgtatttttgaaaacatggttacagaattagttgcatgtggagaagctgaaatgctatatgtaaatcctctttcctgattaccagcattctcctaatgcaaagtgtgtgaagtgacagcagagaagatatcaaagggtttggtgcttgggacattctgtattgtcaatgtgagatgcccagtgagatggaagttctgcacagggtggctgggcggcaggcattcatttccgtaagcctctctctttcctcctrtatggtatgtgatgagtttgggggaaagcatctgcatttaagctctgttctggtggagagagggaagaggtctcagtgtttatcgtctcccatgagttgagtgtgcaggatctgtagccaacaactcttgagttttgagagttccatgtgagcctcactacatgctaagtcagaaccacagggtgagtgaatgctctttctctgctccatctggcttctgtcttcttaacagcatatctgctgtttcacatagctgcatatcaagccagttttttgtttttgagatgggggttctcactg

SEQ ID NO: 152601 - DNA, 601 bp, Human
cttctgtcttcttaacagcatatctgctgtttcacatagctgcatatcaagccagttttttgtttttgagatgggggttctcactgtgttgatcaggctggtctcgaactcctggactcaagtgatcgtcccgccttagcttcccgagtagttgggactacagatatgtgcccagctacaagctggctcttttatttttggggcagtttaaccacttggcattgtcaggtcttccctaagcttcccttggtcttttcttccattttgctgtttttttggacattaaataatttattacctstaccaggtgcttggacagaataaagtaaaagagagaatcgttatgttagaaaattaacttgtgcaaggtgacataaaattctctctgctgttgattcatccatgctggctttgccagtggtcatgagggtaaccagtgattcaactgtatgggagggaatctgccctttctgagtggatctcacaaggtgattcctgtgtgatgatgtaaagatgagaacctttctgggaatttgctttttttttttttttttttgaggcagagtctagctctatcaccctggctggagtgcagtggtgt

SEQ ID NO: 152602 - DNA, 601 bp, Human
gcagggcagggctgtagccaggtgagcagagggcagaatcctcccctggaatacattagaccctgtggtgacattagttcatgctcagtgctctgttcacaatctctggtcctcacaacggccctgttagcgggttaggtgtgggcatgcagtgaggtgggtcctggaacttgtacccaggcttgtctgacaccagagcccatgctctccaccacagccgtgtctccaacctctccctagtgcttggtgctactgcaaggacttctttttccttctccccttaactgtcatgataaagtgmcagcatctcagacaaatttaaaaattccctgaaggaatcagctggttggcgctgaactttgcagggtgccgtgaacaccctgggctggagtctgaatgcattgctttcctcatgcaacagtattgactgagccactgtaaacacacaagagttttgctgggtgctgagtgtattgtgagttttcatcgtctgtgctaatgctcatcttactgagcataataacctggagcatgacctatattgaattcacttggtggttgctgcaggatgcttaaaggaatgaaacttgagggtaggtta

SEQ ID NO: 152603 - DNA, 601 bp, Human
gagttttgctgggtgctgagtgtattgtgagttttcatcgtctgtgctaatgctcatcttactgagcataataacctggagcatgacctatattgaattcacttggtggttgctgcaggatgcttaaaggaatgaaacttgagggtaggttaagggaagcaatggtgatgagctgagctttcaccaggtggcacctggctctggatgctgatgtgtttggatcagtggtagaaaacaagcaaatagaatggcgagttagacagtttccactgcgcacagcacttgggtgttttccatgctrtaaatctttattttttccactttggtttgagtgggatcacttccattggagctaatccagaaattgctaattcagtgggaattgtgagtctataagttaggaataaattgagcttaacatgcaatatattggaaatgatcctagatcctggatccttcctcttcccaaacagtgagctgtgagggagtcactcctcccaccaggttagaaccatccgacgtgtgcagatgtggcatatatggtgtatgttctgagggacaaaatgacgacccctgactgcagtgtggctccagcattgct

SEQ ID NO: 152604 - DNA, 601 bp, Human
tgcttaaaggaatgaaacttgagggtaggttaagggaagcaatggtgatgagctgagctttcaccaggtggcacctggctctggatgctgatgtgtttggatcagtggtagaaaacaagcaaatagaatggcgagttagacagtttccactgcgcacagcacttgggtgttttccatgctataaatctttattttttccactttggtttgagtgggatcacttccattggagctaatccagaaattgctaattcagtgggaattgtgagtctataagttaggaataaattgagcttaacaygcaatatattggaaatgatcctagatcctggatccttcctcttcccaaacagtgagctgtgagggagtcactcctcccaccaggttagaaccatccgacgtgtgcagatgtggcatatatggtgtatgttctgagggacaaaatgacgacccctgactgcagtgtggctccagcattgcttgcttccaggctgaccagggacaggtgtcctggaagatggctcttcctgttcccagagctgtcccacccttcagtgtccacaggcattctggaagcccaggttctccttcattctgctta

SEQ ID NO: 152605 - DNA, 601 bp, Human
atagaatggcgagttagacagtttccactgcgcacagcacttgggtgttttccatgctataaatctttattttttccactttggtttgagtgggatcacttccattggagctaatccagaaattgctaattcagtgggaattgtgagtctataagttaggaataaattgagcttaacatgcaatatattggaaatgatcctagatcctggatccttcctcttcccaaacagtgagctgtgagggagtcactcctcccaccaggttagaaccatccgacgtgtgcagatgtggcatatatgrtgtatgttctgagggacaaaatgacgacccctgactgcagtgtggctccagcattgcttgcttccaggctgaccagggacaggtgtcctggaagatggctcttcctgttcccagagctgtcccacccttcagtgtccacaggcattctggaagcccaggttctccttcattctgcttaatagctcggcctagaattctcattcgtattctgtgcctggagacccaatccaaactccaagcctcattccattttcctgggctctggttccctccaggattcggtccacaggtgggtgtgga

SEQ ID NO: 152606 - DNA, 601 bp, Human
gtcaaattcctcccaactgaaaagaggggagtatctattaatacaaatgtaaagaggggagaaaatgtgttctgttacatgggagaggcatgccctgtagtcaggagcctgtgtccagttatgtgagatggaagctggggggcagggtggcggggaggagggagggagggagggagggaggaaaggctaaactaaggtcatgcactcaggtcctcaggtacataagagctagtatctatcgcactctatatactgacactggacgaactccttccctgcactgtcacagccctgtgaggtrttgctcttcctgtcactattgtgcaattgagatggaagcctggagaagttaaatacttgctcagggccccgcagccagtaagtggcaggacctgtgcttacctcctggcctatggactccagcgattgtgttgtgaagccaccacacccgctgcctttcctgaacacggacaggaagtgttacatacctaacgaggagaacatgggcaaaaccttgcgagtttaagttgtgagtgagctaagggtgagccgagaggatgactgtagccaagcctggcagcctggggagcctatctgcagg

SEQ ID NO: 152607 - DNA, 601 bp, Human
aggaaaggctaaactaaggtcatgcactcaggtcctcaggtacataagagctagtatctatcgcactctatatactgacactggacgaactccttccctgcactgtcacagccctgtgaggtgttgctcttcctgtcactattgtgcaattgagatggaagcctggagaagttaaatacttgctcagggccccgcagccagtaagtggcaggacctgtgcttacctcctggcctatggactccagcgattgtgttgtgaagccaccacacccgctgcctttcctgaacacggacaggaagygttacatacctaacgaggagaacatgggcaaaaccttgcgagtttaagttgtgagtgagctaagggtgagccgagaggatgactgtagccaagcctggcagcctggggagcctatctgcaggtgtggaggggtgaattgttagtgaaggtgaggaacagcagaaaggagaggcaggcagggtgcagaaaggatcccggatacgatgaacaaagcggggcccgaggagccacccctgcgggggagcagtggggtggggaaggactcgagtctctggcgcctcagcactgtgtgccaggtga

SEQ ID NO: 152608 - DNA, 601 bp, Human
gtgaggtgttgctcttcctgtcactattgtgcaattgagatggaagcctggagaagttaaatacttgctcagggccccgcagccagtaagtggcaggacctgtgcttacctcctggcctatggactccagcgattgtgttgtgaagccaccacacccgctgcctttcctgaacacggacaggaagtgttacatacctaacgaggagaacatgggcaaaaccttgcgagtttaagttgtgagtgagctaagggtgagccgagaggatgactgtagccaagcctggcagcctggggagcctawctgcaggtgtggaggggtgaattgttagtgaaggtgaggaacagcagaaaggagaggcaggcagggtgcagaaaggatcccggatacgatgaacaaagcggggcccgaggagccacccctgcgggggagcagtggggtggggaaggactcgagtctctggcgcctcagcactgtgtgccaggtgagagacaagttgtgtgtggttttattctctccatatccatttctttttgtttggttttgtttttaaaaagtatttagcatttaatgaacctccttccctgcggctgcaagccacca

SEQ ID NO: 152609 - DNA, 601 bp, Human
aacatgggcaaaaccttgcgagtttaagttgtgagtgagctaagggtgagccgagaggatgactgtagccaagcctggcagcctggggagcctatctgcaggtgtggaggggtgaattgttagtgaaggtgaggaacagcagaaaggagaggcaggcagggtgcagaaaggatcccggatacgatgaacaaagcggggcccgaggagccacccctgcgggggagcagtggggtggggaaggactcgagtctctggcgcctcagcactgtgtgccaggtgagagacaagttgtgtgtggttytattctctccatatccatttctttttgtttggttttgtttttaaaaagtatttagcatttaatgaacctccttccctgcggctgcaagccaccagcacacaggccccccagcattcttaatcttctcagctcatcagaattgggccttcatgatgacagactgctttgggagctttccctttcccagaactttatagtagcccagttgcaccacagcagtgatgggaggagcctcttggtggtggcggtggttttttgttgtcgttgttgttgttgttttgtttttttttgagatggagt

SEQ ID NO: 152610 - DNA, 601 bp, Human
gcaaaaccttgcgagtttaagttgtgagtgagctaagggtgagccgagaggatgactgtagccaagcctggcagcctggggagcctatctgcaggtgtggaggggtgaattgttagtgaaggtgaggaacagcagaaaggagaggcaggcagggtgcagaaaggatcccggatacgatgaacaaagcggggcccgaggagccacccctgcgggggagcagtggggtggggaaggactcgagtctctggcgcctcagcactgtgtgccaggtgagagacaagttgtgtgtggttttattctytccatatccatttctttttgtttggttttgtttttaaaaagtatttagcatttaatgaacctccttccctgcggctgcaagccaccagcacacaggccccccagcattcttaatcttctcagctcatcagaattgggccttcatgatgacagactgctttgggagctttccctttcccagaactttatagtagcccagttgcaccacagcagtgatgggaggagcctcttggtggtggcggtggttttttgttgtcgttgttgttgttgttttgtttttttttgagatggagtctcgctc

SEQ ID NO: 152611 - DNA, 601 bp, Human
tgagtgagctaagggtgagccgagaggatgactgtagccaagcctggcagcctggggagcctatctgcaggtgtggaggggtgaattgttagtgaaggtgaggaacagcagaaaggagaggcaggcagggtgcagaaaggatcccggatacgatgaacaaagcggggcccgaggagccacccctgcgggggagcagtggggtggggaaggactcgagtctctggcgcctcagcactgtgtgccaggtgagagacaagttgtgtgtggttttattctctccatatccatttctttttgtttkgttttgtttttaaaaagtatttagcatttaatgaacctccttccctgcggctgcaagccaccagcacacaggccccccagcattcttaatcttctcagctcatcagaattgggccttcatgatgacagactgctttgggagctttccctttcccagaactttatagtagcccagttgcaccacagcagtgatgggaggagcctcttggtggtggcggtggttttttgttgtcgttgttgttgttgttttgtttttttttgagatggagtctcgctctgtcgcccaggctggagtgcagtg

SEQ ID NO: 152612 - DNA, 601 bp, Human
ctcagcactgtgtgccaggtgagagacaagttgtgtgtggttttattctctccatatccatttctttttgtttggttttgtttttaaaaagtatttagcatttaatgaacctccttccctgcggctgcaagccaccagcacacaggccccccagcattcttaatcttctcagctcatcagaattgggccttcatgatgacagactgctttgggagctttccctttcccagaactttatagtagcccagttgcaccacagcagtgatgggaggagcctcttggtggtggcggtggttttttrttgtcgttgttgttgttgttttgtttttttttgagatggagtctcgctctgtcgcccaggctggagtgcagtggtgcaatctcggctcactgcaacctctgcctcccgggttcaagtgattctcctgcctcagcctctcaagtagctgggattataggcgcctgccaccatgcctgcctaagttttgtatttttagtagagacgtggtttcaccatgttggccaggctggtctcgaactcctgacctcaagtgatccgcctgccctggcctcccaaagtgtagggattataggtgtgagc

SEQ ID NO: 152613 - DNA, 601 bp, Human
tctctccatatccatttctttttgtttggttttgtttttaaaaagtatttagcatttaatgaacctccttccctgcggctgcaagccaccagcacacaggccccccagcattcttaatcttctcagctcatcagaattgggccttcatgatgacagactgctttgggagctttccctttcccagaactttatagtagcccagttgcaccacagcagtgatgggaggagcctcttggtggtggcggtggttttttgttgtcgttgttgttgttgttttgtttttttttgagatggagtctcrctctgtcgcccaggctggagtgcagtggtgcaatctcggctcactgcaacctctgcctcccgggttcaagtgattctcctgcctcagcctctcaagtagctgggattataggcgcctgccaccatgcctgcctaagttttgtatttttagtagagacgtggtttcaccatgttggccaggctggtctcgaactcctgacctcaagtgatccgcctgccctggcctcccaaagtgtagggattataggtgtgagccaccatgcccggccctcagtcttgtttttagcagcatttgcctgtg

SEQ ID NO: 152614 - DNA, 601 bp, Human
taggtgtgagccaccatgcccggccctcagtcttgtttttagcagcatttgcctgtgtctgctcacggatcatagtccacagtttgtcaaagttgacagttgggctgaagctctgtttcctctttaagtggtaatgcctcacaccagctttcccacataacctgggtgacatttgtcaaagttgatcctgtggtggtgcacaccacctgcattaccacagcctccacggtgcttccgcactcggtgatgtggccatggccgtggctcgtgtggccctgaagtttccggctcttcctcagtstggatggcatgtcagacaaaagaggaaggtttctacaaagtctcttaaggtattgagcacctatttctccttttaaaaacgggcaagctgagcacagttgtgcatgcccataatcccagctacttgggaggctgaggtgggaggatcgcttgagcccaggagtttgagatcagcttgggcaaaggggaatttttctttcattatcattttgatgtagaaaatcagtaacatcttctttgccaatatgaaaacatgtttttctttaagcagagtcttgctgtcagccagattggagtgcca

SEQ ID NO: 152615 - DNA, 601 bp, Human
tctttaagcagagtcttgctgtcagccagattggagtgccatggtgagataatagcttaccgcagtcttgaactcctgagtacaagggatcctcctgcctcatcctcctgagtaggtgggactacagacatgcaccaccaagcctggctaatttttaaaatttttgcagcgatggggtctcactaggttgccccggctggtctggaactcctgggctcacacaaccctcctgcctgagcctcctgagtagctgggatcacaggtgcacaccaccatgcctggctaatttttcattaaaaawtttttttagagggtctttctaggttgcccagactggtattgaactacttgcctcaagtgatcctctcccctcagcttctcaaagtgatgggattacagatgtgaaccaccatgcctagcctgaaaacatttccttttgattctagcatttagatcctaaacctaaaactgttgccctagaattgcgctgcccacttttgctgctgatcttattccctgtccagacctttgaggaccagagttggttgggcctccctcccagatgatgctcagggtgctggatgctggagtgcagggactt

SEQ ID NO: 152616 - DNA, 601 bp, Human
gattggcaaagctgagatttcccagtgtatgtgaatttggtttggttcatttgtaaaccccttgacaactctgtacatcagaataatggcattcctcttgggagtattttgtaattatttgctcagtgtgtaatatcccattaaatatccaaagtcaattcagcaaatgtttattaataataagatttgccgaaagcaagagaagtcttaagtgggttatgcctacagtttctagaaagccttcagattgtggtggtaaaaaaacttggctttgtaaattttgtgtaatttgtattagaaratgctaatttattttaaaagcacagtactcttttgtggtaaatttccaagtttgcccctgtcatttgaaaagcttttggtgtgagtgttttcagatgttattgggtggtaggggcaaggactcgttatttttgttttcaaatatgtattatctctttcaaatagctattaaaatttattatgtatttgcacttataaatgttttatgtaccaatttaaaaaatggatcaatagatttctgtgtctagcagagaatcgattaatgagttttgaatagtgtgccaaggtgactcagctttat

SEQ ID NO: 152617 - DNA, 601 bp, Human
gcaggtgacacgtgcacacacacacacacccccacacccacacactgtttccttatgtaacatacatgatgtaaatatgtaatataaatgtatagttatgtagaatataaatatatttacattgtagtagaggctgagtcggtggtataatagagcatctgcaattcaatatttagagtataaagctgtttttcctttgtgaaaccatttgttttccatacactgcttggtgttgggcggggaaataatgcagttacttatctgctacactaacgagcagatgactgtcctcctctcctgmggctcttctgcagaaatgagtcgccacagtgaattgcttgtgtttattattctggtcatgggttagcaccaggtgtcacagtgaatcaatcttggattggtaaaaggttgtcacgacggcagaaaattgcaggctagagcaaattgtcctatgcccattacagaatctcaagtaatgatggttggttatgcatggaggggctgaaatagtccatagcataaggaaaccaagcaggggtctctaaataggtcagagggttctaacagataccccacccccttctgcttttaaaagctcttg

SEQ ID NO: 152618 - DNA, 601 bp, Human
taactgtggggtgggtggtgggatattgtgaaatgtgtatttggtcttcatccctgtttcctaaaacccttagaatctctggagcgaagagtattttttgcctgctcatgatggactgatagctggcagcccccaggtagctttaggatggggctggtcacaggaaagaccaaggcaagatgggagggttgggacttttagccccaccaccaacctccagggaagggacctccagggaagggaaggggcggaaggttgagttgatcaccagtggccattggtttaatcaggcatgcctacrtcatgaagtttccataaaaacccaaaagggtgagtttggagagcttctggatagctgaacatgtggaggctcctggagggcggcgcaggggcacactggggagggcatggaagtcccacaccccttcccacatgccttgccctacaagtctcttcatctgcatcctgtgtaacatcctttataataaactggtgaatgtcagtaagtgtttcccggggttctgtgagccactctagcaaattaatcaaacctgaggaagtggtcatgggaaccctgatttgcagcccatcaatcagaagc

SEQ ID NO: 152619 - DNA, 601 bp, Human
tctggatgattcttagcctatggagagtaaagcacaggtttttaagtttcttagatacactgtattgatgaggatacagactaagctgctgaaacaggagatcccagattatagtgacttcagctttttcagtcctcctggtggctggttcagggcttgtttggtggcttgtggggtcatcacattgtatactctcctgtcctgtgtgccagcacctggtcacatggccacccctgactgcaaggaagatgggaaaatgtcatcgttagctgggtaaccaggggcccagctaaaactcagsgttctttttctaatagttgaaagggagagtgagtatcacagagccccagcagtttctctcctaagcatcttttattttccaatgaggacactgccaggccagttgtgtcttccttggctagagctttgatctgcaaacttggagctgattctgacctcagaccctggggtgacgagaggagctctatgattctagttagaccagcctaatggatgaatcctgactccctcacttgctgtttgtgtggccttcagttcggctgttgagcctctctgacattccgattcactggtaatgata

SEQ ID NO: 152620 - DNA, 601 bp, Human
acaagttaatttgctcagagcctgatttaatttgcattattgcatcaggatgacacctctttacagtaaagttatttatacttctccaaatgcaaaatttaaaattattttggctggacgtggtggctctcgcctgtaatcccagcactttgggaggccgaggaaggtggatcacttgaggtcaggagttcgagaccagcctggcaacatggtgaaaccctgtctctactaaaaatgcaaaaattagctgggcgtggtggcgcacacctgtaatcccagctactcaggaggctgaggcagragaattgcttgaatctgggaggtggaggttgcagtgagccaagattgcaccactgcactccagcctgggcaacagagtaagactctgtctcaaaaaaaaaaattcttttggtgggttaatgttacccagaagcagatcatactgtgctcacacatcttctgtccacatcataccaatgctagaataaagggggtaaacagaaaaacaggttttcttgggaaatgacatatggaagttgctgcacaggggtctctaatggcagaggtgcctccagggggctttgatatgtcagcagtagca

SEQ ID NO: 152621 - DNA, 601 bp, Human
tatggaagttgctgcacaggggtctctaatggcagaggtgcctccagggggctttgatatgtcagcagtagcagcgcacactgcaatgccttccttgcttgtagtaagtggcctctgggttcttaaaacaagaccctattgtgtaagatgctggacttgggaaaacccctggcaggggctgcattgaggctggtgactcctgttggggcattgtgtgctgcatagtgtaataggcagccactctaggcccagcatggtggctcacgcctgtaatcccagcactttggaaggccgaggtggrcggatcacttgaggtcaggagttcgagaccagcccggccaacatggtgaaactccgtctccactaaaagcacaaaaattagccaggtgtggtggcgggcacctataatcccagctactagggaggctgaggcaggagaattgcttgaacctggtggggcagaggttgcagtgagccgagataacgctactgcactccagcctgggcaacagagtaaaactccgtctcaaaaaaaaaaaaaaaaaaaaaaaaaaaggcagctgctctgggcacccctggattgtggcaaacttcagaattg

SEQ ID NO: 152622 - DNA, 601 bp, Human
gtggatggatcacaagggctggagttgcagagtcagagctgatggagctttcctgccagccacgcaccatctgtccagtgggaagtcctttctgtgctgggaggaaggggccagcaggaccacttgtcctgcgccagtgccagcctctctcagcctgtgtgcagcacgtacatgtccatggcagccctcggctggatctcagggctgtgggcaggggtggaggccactgctaggctgtcctgctgctccagcagccccctcaggggccgttgacttttcacaggaacccaggcctgccatygagggtggagatttcatttggaaatgctcgcctcacttcccatgcggttcctctgtctgctttatgagcgggacatacccctcatccactgcctcatccaggtttcctggtgtggcagggtccccagggacccagagggagccaggaaatgtgagtcagtggcttcccaaagtggctgcctggcctgtggtgtcatagggctgctgctgtctgccctttgtcctgtctcacgctgtccccagccctcccagcactggccgttgagaagacagagttgagttgactgtcactgttgtcttg

SEQ ID NO: 152623 - DNA, 601 bp, Human
gcagacgccttctccggacagtttggcttgacctgtgcagagtgctttttccccagcgaaatggaacaggaaagctcacggcagcaagtggcagaggggtggagccacaacttggctctttttccttcttcttttccttcttcttctttttaaaaaaaatccagtccactaaagcacgaatgtttttcaaagtcgcaaatgaaatacagtaggattttaaaaaaccaaagctgtctttcaacatgttgatgttctcggactgtagcaaacatggtttggacttgtccatttagaaagcagkgtaaacaggctctgaaatgccattgtaccaagggaaatgaggacatgcggcaaagctttaagaattcagcccctagacctgcttttgactgaaatagttttgcttgaaataatttattttccttgaattttttgatttttatttcttcagttctgtctggtcaccttccctgtataggcatgaccagcacctgaggaagaatgattaacacatgtacaaataacttaaatgtactcgaaagctataaaacaatatgtgtgttactgaaaataaacagatagtgtaatacctggattataa

SEQ ID NO: 152624 - DNA, 601 bp, Human
gactcccgggtgcggtctgtgcctgttgggaagatgggcagctgactcacttcactgtcatcccctcacccatcttctgtggtcccaggctccacttacctcctctatatgaccctgtaggcgcagtgggtgctttaatcatggggcacagtgggtgcattaatctttcctcattttagtttgcatttttatttagcggtggagttgcctccatgaatttctgttctcatccacacctttagtttttctctttttattttccatgtcatagtaggaggaaatttggaattagcagaaaacrttactgaatatttccagtggaaaactatgcattgtgtagagcatacccttccaaggtatctgattgtagcctttgatccatttcatacctccgtaagttgtaggtaattggtagcaatgcaaaataactattgcctgtagacatgcaaaaatgtctgttagcatggctaaaatgaccccctccaagccgtaggaaaagcagagttcgtatttgtaaattcatttcaacattcctttactccatatatacttatgcttctctgacttctccttttaactggttgtaacatcttattaattc

SEQ ID NO: 152625 - DNA, 601 bp, Human
ggtgcggtctgtgcctgttgggaagatgggcagctgactcacttcactgtcatcccctcacccatcttctgtggtcccaggctccacttacctcctctatatgaccctgtaggcgcagtgggtgctttaatcatggggcacagtgggtgcattaatctttcctcattttagtttgcatttttatttagcggtggagttgcctccatgaatttctgttctcatccacacctttagtttttctctttttattttccatgtcatagtaggaggaaatttggaattagcagaaaacattactgartatttccagtggaaaactatgcattgtgtagagcatacccttccaaggtatctgattgtagcctttgatccatttcatacctccgtaagttgtaggtaattggtagcaatgcaaaataactattgcctgtagacatgcaaaaatgtctgttagcatggctaaaatgaccccctccaagccgtaggaaaagcagagttcgtatttgtaaattcatttcaacattcctttactccatatatacttatgcttctctgacttctccttttaactggttgtaacatcttattaattccctaatta

SEQ ID NO: 152626 - DNA, 601 bp, Human
gagttgcctccatgaatttctgttctcatccacacctttagtttttctctttttattttccatgtcatagtaggaggaaatttggaattagcagaaaacattactgaatatttccagtggaaaactatgcattgtgtagagcatacccttccaaggtatctgattgtagcctttgatccatttcatacctccgtaagttgtaggtaattggtagcaatgcaaaataactattgcctgtagacatgcaaaaatgtctgttagcatggctaaaatgaccccctccaagccgtaggaaaagcaragttcgtatttgtaaattcatttcaacattcctttactccatatatacttatgcttctctgacttctccttttaactggttgtaacatcttattaattccctaattaatggtgaagtcaataaaatctttgacatgttcattttgtatctgtatgagagttgattttacctttgattattatttttaacgtaatattttatggtccctattaaaaataacaaaggtaccgtgcttcctggttaaccagtgacaagaatgggccctaacaagaggaacttggatgcaaaaagcagaatgaa

SEQ ID NO: 152627 - DNA, 601 bp, Human
actattgcctgtagacatgcaaaaatgtctgttagcatggctaaaatgaccccctccaagccgtaggaaaagcagagttcgtatttgtaaattcatttcaacattcctttactccatatatacttatgcttctctgacttctccttttaactggttgtaacatcttattaattccctaattaatggtgaagtcaataaaatctttgacatgttcattttgtatctgtatgagagttgattttacctttgattattatttttaacgtaatattttatggtccctattaaaaataacaaaggyaccgtgcttcctggttaaccagtgacaagaatgggccctaacaagaggaacttggatgcaaaaagcagaatgaattaatcctgagggcttaagacattggaagtttttctcttaatattgtaaaaatgtgtagactcataaacaaccaatagtcaaagaagaaattacaatggaaattggaaattaccttgagatgaatgaagacaaaagcacaacattccaaaacttcagagcagtgctcagagggaaacttatagccataaacacctacattaaaaaaagagaaagacttcaaatcaa

SEQ ID NO: 152628 - DNA, 601 bp, Human
aaaataacaaaggtaccgtgcttcctggttaaccagtgacaagaatgggccctaacaagaggaacttggatgcaaaaagcagaatgaattaatcctgagggcttaagacattggaagtttttctcttaatattgtaaaaatgtgtagactcataaacaaccaatagtcaaagaagaaattacaatggaaattggaaattaccttgagatgaatgaagacaaaagcacaacattccaaaacttcagagcagtgctcagagggaaacttatagccataaacacctacattaaaaaaagagaamgacttcaaatcaataacccaattttacaacatagggaactagaagaagaagagcaaaataaactcaaagttacaaattgtaggaaatacagagtgaagagaaatgaaatagagaatagaaaaataatagggaaaatcagtgaaaccaaaagttggttctttgaagatcaacaaaatcaacataccttaagctacgttactaagaaaaaaagagaaaagaagtaaatcactaaaattaaaaacaaaatgggacattactactggccttacagaaatgaaaaagattataagagaatactat

SEQ ID NO: 152629 - DNA, 601 bp, Human
aaaaagagaaaagaagtaaatcactaaaattaaaaacaaaatgggacattactactggccttacagaaatgaaaaagattataagagaatactatgatcacttgtaagccaacaggttagataacctagaagaattagacaaattcctagacacacaaaactaccaaactgtctcaagaagaaacagaaagtctgaatagacttaaaacaagtaaggagaatcagtaatcaaaaacctcccaaaagaaaggctcaggaccagatcgctctactggtaaattctaccaaacatttaaagaarcataacatcagttgctcttaatctcttccaaatatagaagaggagggaatacacctaatttattttatgaggccagcattatactgatgaagcctgacaaagatattacaagaacactatagaccaatatcccttacaatatagaagcaaaaatcctgaatgaaatactggcaaactgaacccagaagtatattaaaaggattatacaccatgaccagatggggtttatcccaggagtgcaagggtggtttgacatactaaaacggatcgatgtaatacaccatattaatagaaagaggg

SEQ ID NO: 152630 - DNA, 601 bp, Human
ctggccttacagaaatgaaaaagattataagagaatactatgatcacttgtaagccaacaggttagataacctagaagaattagacaaattcctagacacacaaaactaccaaactgtctcaagaagaaacagaaagtctgaatagacttaaaacaagtaaggagaatcagtaatcaaaaacctcccaaaagaaaggctcaggaccagatcgctctactggtaaattctaccaaacatttaaagaagcataacatcagttgctcttaatctcttccaaatatagaagaggagggaatacayctaatttattttatgaggccagcattatactgatgaagcctgacaaagatattacaagaacactatagaccaatatcccttacaatatagaagcaaaaatcctgaatgaaatactggcaaactgaacccagaagtatattaaaaggattatacaccatgaccagatggggtttatcccaggagtgcaagggtggtttgacatactaaaacggatcgatgtaatacaccatattaatagaaagagggaaaaacaccacctgatcctttcaattgatgctgaaaaagtattgacacattcca

SEQ ID NO: 152631 - DNA, 601 bp, Human
tctgaatagacttaaaacaagtaaggagaatcagtaatcaaaaacctcccaaaagaaaggctcaggaccagatcgctctactggtaaattctaccaaacatttaaagaagcataacatcagttgctcttaatctcttccaaatatagaagaggagggaatacacctaatttattttatgaggccagcattatactgatgaagcctgacaaagatattacaagaacactatagaccaatatcccttacaatatagaagcaaaaatcctgaatgaaatactggcaaactgaacccagaagtayattaaaaggattatacaccatgaccagatggggtttatcccaggagtgcaagggtggtttgacatactaaaacggatcgatgtaatacaccatattaatagaaagagggaaaaacaccacctgatcctttcaattgatgctgaaaaagtattgacacattccaacactctttcatgatgaaaccactcaggaaactagagatagaggggaacatgttaaaggacatttgtgaaaaacccacagctagcatcctgttcaatggcaaaagacttgaaagcgtttcctcaaagatcaggaaca

SEQ ID NO: 152632 - DNA, 601 bp, Human
aagggtggtttgacatactaaaacggatcgatgtaatacaccatattaatagaaagagggaaaaacaccacctgatcctttcaattgatgctgaaaaagtattgacacattccaacactctttcatgatgaaaccactcaggaaactagagatagaggggaacatgttaaaggacatttgtgaaaaacccacagctagcatcctgttcaatggcaaaagacttgaaagcgtttcctcaaagatcaggaacaagacaaggatgcccactttcaccgtggctgttcaacataggaagtcttasccagagcaattacgcatgtaaaagaagtaaacggcatctgaatagagaagaaagaagtaaaactatctctgttgcaggtgatatggtcctagatatagaaaatttcaaagaattcacaaaaaacaactactggaactaatacattcagtgaagtcacaggatacaagttaaacatgcaaaaataagttgtgtgtttttacaccagcagtgaacaatttgaaattaccaaaatgattccatttataatagcatttagaagaataacatttaaccaaatacatttaaccaaagaggtgaaaa

SEQ ID NO: 152633 - DNA, 601 bp, Human
atactaaaacggatcgatgtaatacaccatattaatagaaagagggaaaaacaccacctgatcctttcaattgatgctgaaaaagtattgacacattccaacactctttcatgatgaaaccactcaggaaactagagatagaggggaacatgttaaaggacatttgtgaaaaacccacagctagcatcctgttcaatggcaaaagacttgaaagcgtttcctcaaagatcaggaacaagacaaggatgcccactttcaccgtggctgttcaacataggaagtcttacccagagcaattackcatgtaaaagaagtaaacggcatctgaatagagaagaaagaagtaaaactatctctgttgcaggtgatatggtcctagatatagaaaatttcaaagaattcacaaaaaacaactactggaactaatacattcagtgaagtcacaggatacaagttaaacatgcaaaaataagttgtgtgtttttacaccagcagtgaacaatttgaaattaccaaaatgattccatttataatagcatttagaagaataacatttaaccaaatacatttaaccaaagaggtgaaaaacatatacaatgaa

SEQ ID NO: 152634 - DNA, 601 bp, Human
ctaaaacggatcgatgtaatacaccatattaatagaaagagggaaaaacaccacctgatcctttcaattgatgctgaaaaagtattgacacattccaacactctttcatgatgaaaccactcaggaaactagagatagaggggaacatgttaaaggacatttgtgaaaaacccacagctagcatcctgttcaatggcaaaagacttgaaagcgtttcctcaaagatcaggaacaagacaaggatgcccactttcaccgtggctgttcaacataggaagtcttacccagagcaattacgcawgtaaaagaagtaaacggcatctgaatagagaagaaagaagtaaaactatctctgttgcaggtgatatggtcctagatatagaaaatttcaaagaattcacaaaaaacaactactggaactaatacattcagtgaagtcacaggatacaagttaaacatgcaaaaataagttgtgtgtttttacaccagcagtgaacaatttgaaattaccaaaatgattccatttataatagcatttagaagaataacatttaaccaaatacatttaaccaaagaggtgaaaaacatatacaatgaaaac

SEQ ID NO: 152635 - DNA, 601 bp, Human
agtattgacacattccaacactctttcatgatgaaaccactcaggaaactagagatagaggggaacatgttaaaggacatttgtgaaaaacccacagctagcatcctgttcaatggcaaaagacttgaaagcgtttcctcaaagatcaggaacaagacaaggatgcccactttcaccgtggctgttcaacataggaagtcttacccagagcaattacgcatgtaaaagaagtaaacggcatctgaatagagaagaaagaagtaaaactatctctgttgcaggtgatatggtcctagatatrgaaaatttcaaagaattcacaaaaaacaactactggaactaatacattcagtgaagtcacaggatacaagttaaacatgcaaaaataagttgtgtgtttttacaccagcagtgaacaatttgaaattaccaaaatgattccatttataatagcatttagaagaataacatttaaccaaatacatttaaccaaagaggtgaaaaacatatacaatgaaaactaaagaacatttcacattgctgaaagaaatcaaagaagacataagtaaattgaaataaatccctattcatggattggaag

SEQ ID NO: 152636 - DNA, 601 bp, Human
tggtacaatgtggatgaaccttgaaaacattatactaaatgagagaaaccagacacgaaaggtcacatattgtgtgattccattcatagggcttgtgcagagtaagtcagtacatggagattaagtagatatgtgattgccaggggtggagaaggggcaatggggaataactgcttaatgaatatggagtgatttgggggtgaagaaagtgttttggagttagataagggtggcggttgccaccattgtggatgtactaaatgccactgagttgttcactttaaaatggtgaattttatgytatgtgaatttcagcacatacaaaaattgatatggtttatatgtgagtaattagttcctagtaggaagagggtttagatcaacagtattaaatattctccccctgaaaacacatggcacatataacacctacggtcaacggcatccacacaggaaacacagtcccaggaactcccaggattatgcacaatttcgatgagtttcctgaataccacctcatcattaactctgattaattacaagttactggtggcgtatctcgcagaagcaaggtgaggtgattaggtgatggtcattctaa

SEQ ID NO: 152637 - DNA, 601 bp, Human
tgccactgagttgttcactttaaaatggtgaattttatgctatgtgaatttcagcacatacaaaaattgatatggtttatatgtgagtaattagttcctagtaggaagagggtttagatcaacagtattaaatattctccccctgaaaacacatggcacatataacacctacggtcaacggcatccacacaggaaacacagtcccaggaactcccaggattatgcacaatttcgatgagtttcctgaataccacctcatcattaactctgattaattacaagttactggtggcgtatctcrcagaagcaaggtgaggtgattaggtgatggtcattctaacttttgataattttgagggacagcagtgtagggagaaaatactagtgtaaaacattatatttgtctgggtgcagtggctcaagcctgtaatctcagcaccttgggaggccgaagcaggaggatcgcttgagcacaggagttggagaccagcctggacaacacagtgagaccctatctctaccccctacccccaaataataataattagccaggcatggtggcatggaccggtagtcccagctactcaggaggctgaggtgg

SEQ ID NO: 152638 - DNA, 601 bp, Human
tgattaattacaagttactggtggcgtatctcgcagaagcaaggtgaggtgattaggtgatggtcattctaacttttgataattttgagggacagcagtgtagggagaaaatactagtgtaaaacattatatttgtctgggtgcagtggctcaagcctgtaatctcagcaccttgggaggccgaagcaggaggatcgcttgagcacaggagttggagaccagcctggacaacacagtgagaccctatctctaccccctacccccaaataataataattagccaggcatggtggcatggacyggtagtcccagctactcaggaggctgaggtgggaggatcgcttgagcccagaaggttgaggctacagtaagccatgattgcaccactgcactccagcctaggtggcagagcaagaccctgtctcaaaaacaaaaaagctacatttatatagattagcctaaagaacgtaaaatttgtatcctaattcctctacttagatcacatctgttgatatttaaaaatataaggggaccagatgcggtggctcatgcctgtaatcccagcactttgggaagtcgaggcgggcggatcacgagctca

SEQ ID NO: 152639 - DNA, 601 bp, Human
gggaacagagggaacagagggagcggagggaacggaagtgcagggacacccaggaagagatttaagttctgtgtgtctgattccagagcccaggctctcaccaacacaaaattctactcctctacacagttagtttgtgggagagctgggatttattgtaatttatagtttacatagcttctatgttttgctgttttctggtccagttccctaaggtgtgtgtgccctacgtttcacatttcggtctcccaggggctctaccttactgggttttcttgattttgtcttccttaaattagamaagaaaaggaagaaccaagaagactgaaacagttatgattgaggtttgcagaattgttcccatgaatggctactagctcttgatatattagtccagagcacagaaaatctatacttttaatagcttggactgcacacaacagtaagtctttatagacggttctgtcctgtaggggagaaaagtcctcgttgttcctctgggatgcaacatgagagagcagcacactgaggctttatgggttgccctgccacaagtgaacaggtcccagcatgaaagcagggacaagaaaattgagctcgt

SEQ ID NO: 152640 - DNA, 601 bp, Human
ttcggtctcccaggggctctaccttactgggttttcttgattttgtcttccttaaattagaaaagaaaaggaagaaccaagaagactgaaacagttatgattgaggtttgcagaattgttcccatgaatggctactagctcttgatatattagtccagagcacagaaaatctatacttttaatagcttggactgcacacaacagtaagtctttatagacggttctgtcctgtaggggagaaaagtcctcgttgttcctctgggatgcaacatgagagagcagcacactgaggctttatggrttgccctgccacaagtgaacaggtcccagcatgaaagcagggacaagaaaattgagctcgtgacctccgtccagtgggccctttgattcattctttctttttgtctcactgtgtcatcatatctccctgaactcagctccagattgaaacgtagctgtaaccgcagctaaccaacaggcttcccttgaacaggccgaaaggtacagggtgagtctattttgtgactctgtggaggcgtgggcagcgagatggttgtctaccgggatctgtgttctggcttttgtgaagagggaagaaatg

SEQ ID NO: 152641 - DNA, 601 bp, Human
tttgtgaagaggcaggagtaggtacagtatggaggtctacagcttgggtttctgaggcacagaccaggttttcccaactgttttcccagcctgttttcccaactgtaaggcgtcacactagtaagtctgtcatagaattagattgaagattaaatgaggtgatgcaaatgaaaagagtctagcatacaggaaagcttaacagaatgttaactatcatcaccatcattactaataacatgattagtggtcttaataattcatagatattcatgatgtggaacttggaatctcattagctccrttttgtcttgatgtctgtgactgccttctcttgacttttcccttagtcaccattttttactgcattttcaacccaactggccacatgtgcctgctttgtagtccaggttcccatcagtgcccttggccttaccctctgtgagcaggagcttcgtactctctagcaaggtttcagattagttttctgtgctggaggagttggaggcatttttggtaagctaaggctgtacttgaggactaatgtcacgctgtcaattttagctcattgctgtgatatccagcatagcagtaaggagctgat

SEQ ID NO: 152642 - DNA, 601 bp, Human
ccagcatagcagtaaggagctgatctgcagtcacttgccctcctctttgagcttcagctcttcttgggctggggaacagttgaggacactgtccaggaaccagagactgaatttccatggcctcatggcagcagtacatggatttaggttgttaccaggaggtttgtccacatgtgaggctgtctctgttttcattgtcagtcccagccgtcacaccccctctctcctttgaatgaatgaaagatgctagcgtgcctcatctctgacctcaggaggcctggacaatggaagaggaagtggrggcttttgctgccctctgctcagaggctgcaatgtggcgtggattcttctggcagctgtggtttaggctgccttgtgtttcctggtaaaatttcttaaactaagagtaatattttagcatttttctccaaagagcatagattgaagatgagggcttagtaatttcccttgagttggaaattcattgatgacttttatttatattttgtaatgtctgttaaatacttgcagaagtgctggatgattggagaagctttaaaccatgagaaggtcatgtgagcatggtagttgtggggatgca

SEQ ID NO: 152643 - DNA, 601 bp, Human
ctctcaaggaagctctgagaagccagaggtgcccagcagggaagccggcctgcagtggggacatggagcaggtgcctgcgggcagccactgctctgcgtagctcctgcctctacaccctacattgggaggaccgctgttgggagaagagtcagacacagaagagaggagtggggacaagtggggctctgctgggaaccttgtcatctctgtgtgctaaagaccttcagagagtaatgcccagtctttacttcctgcagattccttttttggtcaactctagtccagaactctatggagaakgggcttctgggaagtgagtggtgttcctagctttagccacgttgaacctaggatgatccaggacaccgcatgctgggtctgtgtaacagtgtctctgtgggctgtgtggacatgtgtgtgcacatgtatgcatgtgcatgtatgtgtgtgttcatgtgtgtgcttcagatcccctttggggaatgtgcaggaatgtcagaagtagggagatagagccactgggttagggcagagggcgagaggccctctttgaggccacctgtggagggctaagatgactccatcctggatgctaatcca

SEQ ID NO: 152644 - DNA, 601 bp, Human
ctatctccccatgaggacaaaagcaagggtgactacaaaaatgaccaccgctgccgaggcctttgctctgaaagtgcagcacagtggctgggaccgcaagacagtgtaactgacgacgtctgcagaattcaaccagcgtgctctgttgggtgggacaggaagtagggcagtagaagattagacagaattgataatctttgagatcaagcagtgtgcggctttgagatggagaagcagtagtagctttgtccttcccagggtttggacccagggctgccttgggaatagacgttcagacatsaggaaggtggcctgaaacatggcggctcggctatgtagagcggagggcacttagaggacatttatctatacagcgggtctttttgtttttgtttttgttttgagacaaggtcttgctctgtcactaaggcttgagtgtagtgcagcctcaacctcctgggctcaagcaatccttctgtctcagcctcccatgtaccttggacaccaggcacatgccaccatgcctggctaattttttgatttttcataaagacagtgtctcgctatgttgtccaggctgttctcaaactcctggcttcaa

SEQ ID NO: 152645 - DNA, 601 bp, Human
catggcggctcggctatgtagagcggagggcacttagaggacatttatctatacagcgggtctttttgtttttgtttttgttttgagacaaggtcttgctctgtcactaaggcttgagtgtagtgcagcctcaacctcctgggctcaagcaatccttctgtctcagcctcccatgtaccttggacaccaggcacatgccaccatgcctggctaattttttgatttttcataaagacagtgtctcgctatgttgtccaggctgttctcaaactcctggcttcaagtaaacctcccacctcarcctcccgaagtgttgggattataagcgtgagccacagcacctgtcctatctagtagatcttaaaactatttaggtcatagattgctttgcgaatctcatgagggaccctctcaccaaaaaaaaaaattacctgctcacaaaggtttccatatgatttagggggatattggatgcctgaggtctgtgatctgtttctaagcctcatcccagaggtgtggtgatgaggaccaacaaggtatatgcttgccggaggtcaagacagagagacaggaggggtgaaaagggcaaggctatcccgag

SEQ ID NO: 152646 - DNA, 601 bp, Human
cacctcaacctcccgaagtgttgggattataagcgtgagccacagcacctgtcctatctagtagatcttaaaactatttaggtcatagattgctttgcgaatctcatgagggaccctctcaccaaaaaaaaaaattacctgctcacaaaggtttccatatgatttagggggatattggatgcctgaggtctgtgatctgtttctaagcctcatcccagaggtgtggtgatgaggaccaacaaggtatatgcttgccggaggtcaagacagagagacaggaggggtgaaaagggcaaggctmtcccgagacctgtttccatacatggtcgggcctctcaacttgaatggaaagtttaattttgcctctctatggtggtagaaatagtgtcagtgacatcaagtttttataaggggaaagcaccacagaggatcttggggtgctgggggctctgacagatgatgcatgagttatcaggattgtgtccacttcagaggggacaacatggtgagaaaagggggcaccagactaaggtggtccccgtgagcacgttctcgggaagtgtgagggtgggtaaatggtccctgtttcttgccttgcgtt

SEQ ID NO: 152647 - DNA, 601 bp, Human
atgatgcatgagttatcaggattgtgtccacttcagaggggacaacatggtgagaaaagggggcaccagactaaggtggtccccgtgagcacgttctcgggaagtgtgagggtgggtaaatggtccctgtttcttgccttgcgttgaaggctttgctattccacatttccatttttttgaaaaagattattttaattttatttttttaacctgggttaaagatatgcatcttccacattttctctggtgctttagaattcgtttaatgaaatgagcttttctttcttttcttttttttttktttttgtttttgtttttgagataaggtctcactctgtcacccaggctggagtgtaatggcacaatcacagctcactgcagcctcgacctcccagcctcaagcgatcctcctacccaagcctcccaagtagctgggactacaggtgtgcaccaccatgcccagctaattttttattttttgtagagacaaggtcttgccatgtagtgcaggctggtcttgaacttctgagctcaagcagtcctcccacgtaagcctcccaaagtgctgggattacagacctgaagccaccatgctgggcca

SEQ ID NO: 152648 - DNA, 601 bp, Human
gtgtgagggtgggtaaatggtccctgtttcttgccttgcgttgaaggctttgctattccacatttccatttttttgaaaaagattattttaattttatttttttaacctgggttaaagatatgcatcttccacattttctctggtgctttagaattcgtttaatgaaatgagcttttctttcttttcttttttttttgtttttgtttttgtttttgagataaggtctcactctgtcacccaggctggagtgtaatggcacaatcacagctcactgcagcctcgacctcccagcctcaagcratcctcctacccaagcctcccaagtagctgggactacaggtgtgcaccaccatgcccagctaattttttattttttgtagagacaaggtcttgccatgtagtgcaggctggtcttgaacttctgagctcaagcagtcctcccacgtaagcctcccaaagtgctgggattacagacctgaagccaccatgctgggccatcagctgttcttcagaacaattttttttcactctttttaaagaaattcttttttcatttagtcttccctgcatttcaaatagaatgatcttatgagaagggtc

SEQ ID NO: 152649 - DNA, 601 bp, Human
caaagtgctgggattacagacctgaagccaccatgctgggccatcagctgttcttcagaacaattttttttcactctttttaaagaaattcttttttcatttagtcttccctgcatttcaaatagaatgatcttatgagaagggtcagtaggattatttaaagccgagagatgaggcagtgagctccgggaggtgttcatgcttcccttctccctctgtctgtcgggtcccaggactaaggatcctggctgtgggcaatctgcagggtggaagaacaatcctgtttcccctaacatgtctygtcacagttcccaaggcccccgctaaggacgcgtggaatggggaggtgagatgggaggaactgaaacagccccatcctggtgttaggttccctgttgagtcacagtgtgtggaaaggatatcaaatgaaggagagattttctactgagatgaaaaggcacttaataaaatgacataacgcttcacagggagctgttttaatggctactcaaagcaactctgaaatgtctataatgagatcctaaaagcaagttctgaaatccccaattctcttctttctgatcttggatgctgtgatatc

SEQ ID NO: 152650 - DNA, 601 bp, Human
ctctgtctgtcgggtcccaggactaaggatcctggctgtgggcaatctgcagggtggaagaacaatcctgtttcccctaacatgtctcgtcacagttcccaaggcccccgctaaggacgcgtggaatggggaggtgagatgggaggaactgaaacagccccatcctggtgttaggttccctgttgagtcacagtgtgtggaaaggatatcaaatgaaggagagattttctactgagatgaaaaggcacttaataaaatgacataacgcttcacagggagctgttttaatggctactcaaarcaactctgaaatgtctataatgagatcctaaaagcaagttctgaaatccccaattctcttctttctgatcttggatgctgtgatatcttccctagagatttactcttagatggaatgactgcatttcatggtagctctgtagccatgctaacttcatttgctgatggcagctttatcgctattgtttaaatcactctaaataggttttgtcagttaaagcaatgtaatatctttcctttcttacagcccagagagtagactcctgtaggaatattggaatattcagaatcactactcgca

SEQ ID NO: 152651 - DNA, 601 bp, Human
agatcctaaaagcaagttctgaaatccccaattctcttctttctgatcttggatgctgtgatatcttccctagagatttactcttagatggaatgactgcatttcatggtagctctgtagccatgctaacttcatttgctgatggcagctttatcgctattgtttaaatcactctaaataggttttgtcagttaaagcaatgtaatatctttcctttcttacagcccagagagtagactcctgtaggaatattggaatattcagaatcactactcgcagagcagaacctcataatcctatmaaactttgctctcatcaacccctcacactgctgacctaccttaaaccttaatgtcctgatttgcaaaatgaggataaccctacttcattagggttgttgaaagattaaacctgtaacaagcctggagagtcagtgcttactaaatgccctccattatgtctgtattagttgcccattgctgttgtccccaaacctaacagcttaaaacaacatgcactgattatgtcacgggttttgtgggtcaggaattgggcatggcttagtaggtcctcgggctgggggatctcttacaacactaca

SEQ ID NO: 152652 - DNA, 601 bp, Human
aacgattctcgtgcctcagcctcccaagtagctgggattacaggtgcacaccaccatgcctggctaatttttaatatttttagtagagatggggtttcaccatgttggccagggttgtctcaaactcctgagctcaggtgatccacctgcctcggcctcccaaagtgctaggattacacgtatgagccaccatgcccggccaccagtaccttttataacctcccccttggaagtgacatctgccacttttgctgcattccatttcttaggagcaagtcattgggtccagtccatatgggastgaatactgggaggcggggattattgggagccattttagaagctgcctactgcaattgtcatgattcttcatccttttttgctagacatgcaactcaggaacagtaaagattgtcttgtaaaaaattgcagaatgtagcaataaaaaatccaaagtttggagcgtggtgccttgcttggtaagccaggttattccatatgatctgcgaatgctccctccaggaggtgggtgcctgtatcactcatcagtgacccatcttgcccagtgaggagctcacacatgtgttgcttgtgaagaaag

SEQ ID NO: 152653 - DNA, 601 bp, Human
attctctatttctgcttagctgcacagagtttgtacatcgggacaaactgctctctggaaatgccaagaagctgtggggctattataagaaaaacggaactgaaggagttatggaacttgctcttcttccccatttaaaagtcgtcttccttctttaactgatctgaagagtaggggaggaggagagagtggtggtgcgggcttccttaagagctgggctagaggagacatggagcctctggcactttggttttttgctcctgataacgtcagtggccctggctttcctagaactcagcarcaggagtttcctttgccaccagcagggtaggggagctgccaccattgaggccagaatgctcagtggctgaaagattgctgaacttgggaatccaccagataggccagctctgcgagaatgagagaaaaataaatttaacaatagcagaaagggacagtgtttttaaatattacaaatattttcttattaggaacagtttctttagggtggatgatgtcccggcaccgagaccatctgttctttttaaaccttcatctcagagtctgaaaagatctggaaagtgtcctggccgtaacatgt

SEQ ID NO: 152654 - DNA, 601 bp, Human
tcgggacaaactgctctctggaaatgccaagaagctgtggggctattataagaaaaacggaactgaaggagttatggaacttgctcttcttccccatttaaaagtcgtcttccttctttaactgatctgaagagtaggggaggaggagagagtggtggtgcgggcttccttaagagctgggctagaggagacatggagcctctggcactttggttttttgctcctgataacgtcagtggccctggctttcctagaactcagcaacaggagtttcctttgccaccagcagggtaggggagcygccaccattgaggccagaatgctcagtggctgaaagattgctgaacttgggaatccaccagataggccagctctgcgagaatgagagaaaaataaatttaacaatagcagaaagggacagtgtttttaaatattacaaatattttcttattaggaacagtttctttagggtggatgatgtcccggcaccgagaccatctgttctttttaaaccttcatctcagagtctgaaaagatctggaaagtgtcctggccgtaacatgtgtccttggacgagttgctttaatttcttcctttaaac

SEQ ID NO: 152655 - DNA, 601 bp, Human
gaacttgctcttcttccccatttaaaagtcgtcttccttctttaactgatctgaagagtaggggaggaggagagagtggtggtgcgggcttccttaagagctgggctagaggagacatggagcctctggcactttggttttttgctcctgataacgtcagtggccctggctttcctagaactcagcaacaggagtttcctttgccaccagcagggtaggggagctgccaccattgaggccagaatgctcagtggctgaaagattgctgaacttgggaatccaccagataggccagctctgygagaatgagagaaaaataaatttaacaatagcagaaagggacagtgtttttaaatattacaaatattttcttattaggaacagtttctttagggtggatgatgtcccggcaccgagaccatctgttctttttaaaccttcatctcagagtctgaaaagatctggaaagtgtcctggccgtaacatgtgtccttggacgagttgctttaatttcttcctttaaacttacgctaaggcctaatcaaacatgatcagagagatgaggagacagggcaactcaaatgaaaacctttcaacagac

SEQ ID NO: 152656 - DNA, 601 bp, Human
agtgctgtagctcagcagcaagcttaggaaataatcattctttatttacagcatcagttcaatggaaaaacgcatattttagtttcacatgcgtagccaacaaatgctcacttggaactcagccatcagcaatccagttgatggagtggggattgcctgtacaattagttcggtcactgtcaccctaacctcctgcctttgattcctttgtaaagtttaagtctcatttgtaagtgtcctcactgcaggaatcaggacataatctttttatcccctgtccttgcatactgctgactgcacrtacggtgaatcagtggatgaattcgtgcatgcatttgtgcgtgcctcctggagagatggtttggctggtgaacagtgcactggatatggggaatgggaaatctgagtcttgactctgcccttactagttacaggcccactgggagaatccatgttttccttatgcgggaattgaggatgaagccatctctcctccccttgacaaagggctgctgtgaggaccaagtgagataagtgtgtgaacatgggtacacgggctcccatttgcaccatcgaatcatcttgtttttgtggcttccat

SEQ ID NO: 152657 - DNA, 601 bp, Human
cctaacctcctgcctttgattcctttgtaaagtttaagtctcatttgtaagtgtcctcactgcaggaatcaggacataatctttttatcccctgtccttgcatactgctgactgcacgtacggtgaatcagtggatgaattcgtgcatgcatttgtgcgtgcctcctggagagatggtttggctggtgaacagtgcactggatatggggaatgggaaatctgagtcttgactctgcccttactagttacaggcccactgggagaatccatgttttccttatgcgggaattgaggatgaagycatctctcctccccttgacaaagggctgctgtgaggaccaagtgagataagtgtgtgaacatgggtacacgggctcccatttgcaccatcgaatcatcttgtttttgtggcttccatgcccttcctttccgcttattttttcgtattctctggtaggatgttttacatctctcctggccatttttttgtatcttaaatgtggcaccttattctctgtatgtgggcttctgattctttcatggagggaactgtggacatttccaagctatgctcattaatgtccacggggcattaatctaa

SEQ ID NO: 152658 - DNA, 601 bp, Human
gtggatgaattcgtgcatgcatttgtgcgtgcctcctggagagatggtttggctggtgaacagtgcactggatatggggaatgggaaatctgagtcttgactctgcccttactagttacaggcccactgggagaatccatgttttccttatgcgggaattgaggatgaagccatctctcctccccttgacaaagggctgctgtgaggaccaagtgagataagtgtgtgaacatgggtacacgggctcccatttgcaccatcgaatcatcttgtttttgtggcttccatgcccttcctttcygcttattttttcgtattctctggtaggatgttttacatctctcctggccatttttttgtatcttaaatgtggcaccttattctctgtatgtgggcttctgattctttcatggagggaactgtggacatttccaagctatgctcattaatgtccacggggcattaatctaaatgcttgagttcacttatgccatgtattagtttaaatttacttctgtaaggaatattttccctcatgaggtagatagataaaatgaagtctagtgactcagacccagtgcagaacccacctttttctttc

SEQ ID NO: 152659 - DNA, 601 bp, Human
acctttttctcttcagtgcataattgtccctctggtgaaaagtgcttgaggtacagaggaattatttcataccaccaacatagtatttagggcccagagcaaacaggcccagtaagtctgtaatctgataagccctggaatgggatccaggtgcaaagtacttccgatctctttgacacaaagggaggcctagacacagactcaagtgaggaaggaactggagctctcccgggagttcactggtagtttgaggagtgatgttcgttgttttaacctccagtctttggtccagccaactgayagaatacttcactttggggacccgagactcttgttgggtatataggattggggttttctgttgattgctttgtaacaaacctagtgtagggggccgggtgtagggggtgggggagagtgggtgggaggagtatattctcttccccttaggcaaagcttcaaaaaagtgctttgtgggttaatatggaatttgtgccatatttctgtggggtttctttgaaatcgaaaagggaaggtgcagtgcttcctggattgagcttcctgagcccgtttgtcttctgctctgagttgaccctggttt

SEQ ID NO: 152660 - DNA, 601 bp, Human
gttttctgttgattgctttgtaacaaacctagtgtagggggccgggtgtagggggtgggggagagtgggtgggaggagtatattctcttccccttaggcaaagcttcaaaaaagtgctttgtgggttaatatggaatttgtgccatatttctgtggggtttctttgaaatcgaaaagggaaggtgcagtgcttcctggattgagcttcctgagcccgtttgtcttctgctctgagttgaccctggttttggggctgtagaaaggggaggagtagccatccagtaaccctggcctggattgytaaggccagggcccgggagctgggctctcactctttccagacagggctgaggcaccctcctgctccaagatgtggaggcgccttcctgcgtgacctcatctctgcatctgcgagctccatctgcccccggagtgggtgagccaggcaagcgtggcactgccctcattactatgcactgccttcgcttgcaggcatctccacacaaggacctgcctggcaggcggggtgggctgaggcgggcgggtggggtgtgtatgctggtgtcccaggtgcctgatgggacctttacttcttttggtc

SEQ ID NO: 152661 - DNA, 601 bp, Human
gctttgtaacaaacctagtgtagggggccgggtgtagggggtgggggagagtgggtgggaggagtatattctcttccccttaggcaaagcttcaaaaaagtgctttgtgggttaatatggaatttgtgccatatttctgtggggtttctttgaaatcgaaaagggaaggtgcagtgcttcctggattgagcttcctgagcccgtttgtcttctgctctgagttgaccctggttttggggctgtagaaaggggaggagtagccatccagtaaccctggcctggattgctaaggccagggccygggagctgggctctcactctttccagacagggctgaggcaccctcctgctccaagatgtggaggcgccttcctgcgtgacctcatctctgcatctgcgagctccatctgcccccggagtgggtgagccaggcaagcgtggcactgccctcattactatgcactgccttcgcttgcaggcatctccacacaaggacctgcctggcaggcggggtgggctgaggcgggcgggtggggtgtgtatgctggtgtcccaggtgcctgatgggacctttacttcttttggtcacctttggagtcag

SEQ ID NO: 152662 - DNA, 601 bp, Human
gagatgctggaattatcagtgatccccaatgggatgtcatgcacagagtcagttttgtagtgtacattataggcaaatcatattctctctctttctgaacattctgagaagaatgcactcaaggtttgaaagactatcatgtatgccataatttttgtgcttagttttttttcttatttaactacattctgaggaatggaatccctgagttgatgggtcttgttagtgttatttcctgtccataagaatcatgttgatttataatgttatcagcaatgtatatcccttaccagtttactcraacacctcaccacctgaagatttctgaaagtctgcggagcagtgcttagtgagtttgtagtaaaggagtcagtaggagtatggtggatgtcgtgaagagagaccagagaggacagccttttcttctcagtgcccactttgatcgagtcacaattattccctgcagggctgggtcgaaaagattttaaggcccttttcacgttcaataagataatgtgtcttgaattgattactgatgtctgccatgagagcaggattaagtagtcgcgatctatttgcctgggaggtatcattctttttt

SEQ ID NO: 152663 - DNA, 601 bp, Human
gtgtgtgatgctcccctccatgtgtccatgtgttctcattgttcaactcccatttatgagtgagaacatacagtgtttggttttctgttcctgtgttagtttgctgagaatgatggtttccagcttcatccgtgtccctgcaaaggacatgaactcatccttttttatggcttcatagtattccatggtgtacatgtgccacattttctttatcaagtctatcattgatgggcaagtctttgctattgtgaacagtgctgcaataaacatacgtgtgcatgtgtctttatagtagaatgayttataatcctttgtgtatataaccagtcatgggattgctggatcaaatggtatttctggctctagatccttgaggaattgccacactgtcttccacaatgtttgaacttacactcccaccaacagtgtaaaagcattcctatttctccacatcctcttcagcatctgttgtttcctgactttttaatgatcaccattctaactggtgtgagatggcatttcattgtggttttgatttgcatttctctaatgaccagtgacaatgaacttttttccatatgttttttggccacaaaaatgt

SEQ ID NO: 152664 - DNA, 601 bp, Human
cccctccatgtgtccatgtgttctcattgttcaactcccatttatgagtgagaacatacagtgtttggttttctgttcctgtgttagtttgctgagaatgatggtttccagcttcatccgtgtccctgcaaaggacatgaactcatccttttttatggcttcatagtattccatggtgtacatgtgccacattttctttatcaagtctatcattgatgggcaagtctttgctattgtgaacagtgctgcaataaacatacgtgtgcatgtgtctttatagtagaatgatttataatccttygtgtatataaccagtcatgggattgctggatcaaatggtatttctggctctagatccttgaggaattgccacactgtcttccacaatgtttgaacttacactcccaccaacagtgtaaaagcattcctatttctccacatcctcttcagcatctgttgtttcctgactttttaatgatcaccattctaactggtgtgagatggcatttcattgtggttttgatttgcatttctctaatgaccagtgacaatgaacttttttccatatgttttttggccacaaaaatgtctttttttgaga

SEQ ID NO: 152665 - DNA, 601 bp, Human
agaacatacagtgtttggttttctgttcctgtgttagtttgctgagaatgatggtttccagcttcatccgtgtccctgcaaaggacatgaactcatccttttttatggcttcatagtattccatggtgtacatgtgccacattttctttatcaagtctatcattgatgggcaagtctttgctattgtgaacagtgctgcaataaacatacgtgtgcatgtgtctttatagtagaatgatttataatcctttgtgtatataaccagtcatgggattgctggatcaaatggtatttctggctstagatccttgaggaattgccacactgtcttccacaatgtttgaacttacactcccaccaacagtgtaaaagcattcctatttctccacatcctcttcagcatctgttgtttcctgactttttaatgatcaccattctaactggtgtgagatggcatttcattgtggttttgatttgcatttctctaatgaccagtgacaatgaacttttttccatatgttttttggccacaaaaatgtctttttttgagaagtgtctgttcatatcctttgcccactttttgatggggtttttttttctt

SEQ ID NO: 152666 - DNA, 601 bp, Human
ttccagcttcatccgtgtccctgcaaaggacatgaactcatccttttttatggcttcatagtattccatggtgtacatgtgccacattttctttatcaagtctatcattgatgggcaagtctttgctattgtgaacagtgctgcaataaacatacgtgtgcatgtgtctttatagtagaatgatttataatcctttgtgtatataaccagtcatgggattgctggatcaaatggtatttctggctctagatccttgaggaattgccacactgtcttccacaatgtttgaacttacactccyaccaacagtgtaaaagcattcctatttctccacatcctcttcagcatctgttgtttcctgactttttaatgatcaccattctaactggtgtgagatggcatttcattgtggttttgatttgcatttctctaatgaccagtgacaatgaacttttttccatatgttttttggccacaaaaatgtctttttttgagaagtgtctgttcatatcctttgcccactttttgatggggtttttttttcttgtacgtttgtttaagttctttgtagattctggatattagccctttgtcagatgga

SEQ ID NO: 152667 - DNA, 601 bp, Human
tcaatacctagtttattgagagtttttagcatgaagtcgtgttgaattttatcaaaggccttttctgcatctattgagataatcatgtcatgtagtttttgtgattggttttgtttatgtgatggattacgattattgatttgcatatgttgaaccagccttgcgtcccggggataaagccaacttgattgtggtggataagctttttgacatgctgctggattcagtttgccagtattttattgaggatttttgcgttggtgttcatcagggatatgggcctgaaattttctttttttgytgtgtctctgccaggttttggtatcaggatgatgctggcctcataaaatgagttagggaggagtccctcttttctattgtttggaatagtttcaaaaggaatgttagcagctcctccttgtagtgggaggtatcattcttaatctggagggataggaagcttgaaggccgttgcaggagtccaggaatgaatcaagtgttagtgcttggttttcacagattggtggtgcctagcgttttgtgtggcagcagccaaaactttgtggttcctgatttcataattatagatttacatgtgatt

SEQ ID NO: 152668 - DNA, 601 bp, Human
ctttttgacatgctgctggattcagtttgccagtattttattgaggatttttgcgttggtgttcatcagggatatgggcctgaaattttctttttttgttgtgtctctgccaggttttggtatcaggatgatgctggcctcataaaatgagttagggaggagtccctcttttctattgtttggaatagtttcaaaaggaatgttagcagctcctccttgtagtgggaggtatcattcttaatctggagggataggaagcttgaaggccgttgcaggagtccaggaatgaatcaagtgttartgcttggttttcacagattggtggtgcctagcgttttgtgtggcagcagccaaaactttgtggttcctgatttcataattatagatttacatgtgattaataagtgtgacaattcaaacagcaggggttgtcatttcagaataagtggttgttctcagagaggaatctcatatgagggatccatttcccaggaagtagatggaaccaattgctgggcatgagtacgtctctgatatcgactatacaaatgattatacaatgaaacactatctggcccacaggtagggttttactgtactt

SEQ ID NO: 152669 - DNA, 601 bp, Human
tttttgagaaatttaggccagtgtggtgactcaagcctataaccccagcactttgggaggctgaggccggaggatcatttgagcctgggagtttgcgttagcctgccccacatagcaagaccttgtctctgcaaaaaaacccctaacatttaaaaatagcagggtgtggcggtgcacacctgtagtctcggctactggagaggctgaagcgagaggatcacttgagctcaggagttcgaggctgcagtgagctatgattgcaccactgcattccagcctgggtgacagagcaagaccctcyctcttaaaaaaataaaggaaaaatgtacacttagcagggaagttgatttaacctagtgagagccttaagaggttttgactaggactcaaaagagtttggttctgactctaccaaccagctatgtgaccttgaggaagtcacactgtttcctctttaccaaaacgaggggactggacaagacggcctgtggtattctcagaatcttacgaaatggaataatatatacatagatgggtttccgtcagtgtggccctaaagacaggcctctctgatcctgtctctctcttccaaggctccttc

SEQ ID NO: 152670 - DNA, 601 bp, Human
tcacttgagctcaggagttcgaggctgcagtgagctatgattgcaccactgcattccagcctgggtgacagagcaagaccctctctcttaaaaaaataaaggaaaaatgtacacttagcagggaagttgatttaacctagtgagagccttaagaggttttgactaggactcaaaagagtttggttctgactctaccaaccagctatgtgaccttgaggaagtcacactgtttcctctttaccaaaacgaggggactggacaagacggcctgtggtattctcagaatcttacgaaatggaawaatatatacatagatgggtttccgtcagtgtggccctaaagacaggcctctctgatcctgtctctctcttccaaggctccttcttcacccagtaggcttcattctcttttctgagtcctacctctgtgtcttcacatgcgacagccactattaccctggcactttccttgtgtgtgtgtcacagccctagcgagtttcctgcggggaagggcattcccagcgcggagtgactccttagcctggctcctggcctgtcctcagcaaaccgcgggtagggtgtgcccctggtggccagccgag

SEQ ID NO: 152671 - DNA, 601 bp, Human
ctgcagtgagctatgattgcaccactgcattccagcctgggtgacagagcaagaccctctctcttaaaaaaataaaggaaaaatgtacacttagcagggaagttgatttaacctagtgagagccttaagaggttttgactaggactcaaaagagtttggttctgactctaccaaccagctatgtgaccttgaggaagtcacactgtttcctctttaccaaaacgaggggactggacaagacggcctgtggtattctcagaatcttacgaaatggaataatatatacatagatgggtttccrtcagtgtggccctaaagacaggcctctctgatcctgtctctctcttccaaggctccttcttcacccagtaggcttcattctcttttctgagtcctacctctgtgtcttcacatgcgacagccactattaccctggcactttccttgtgtgtgtgtcacagccctagcgagtttcctgcggggaagggcattcccagcgcggagtgactccttagcctggctcctggcctgtcctcagcaaaccgcgggtagggtgtgcccctggtggccagccgaggaacagcagtcgcccctggaggtc

SEQ ID NO: 152672 - DNA, 601 bp, Human
aaagagacagtgactttgttgtttgaaaaatcagtgcttatatctaaatttgagcagacttgctgctgtaactcttcagacaagttggcgttgacgcttgagccctttgtagaggatgatgagtaaagctgaacattgagcattgtcaagtgacttcttcccttttccgccttcaagggcgttttggggctggccttgcaggattgatttgttggctgctttgagacttgtgtccattgttttgagcacatcccttgggagagtaaatgatagattccaaaggggtgcttttcagaccagygcccccaccgagaagatgcaccctcagccctgtgccccaggggcacgtgagggaactgagcaagcacctgcagcctaaggaggaaggccccggggcacacagaaaccaggcgaggtttgtcactgggtgatagggtaagcctgggtatcaaggaatgaaaaaaaggagcaaatcgaggagttgtctcctgagctcagaggggccacaggtggggcagccccatcaccactgtgtgctggtcctcctgccgtgtgcctggccctgcttaagaactcctggaggccagggagggtggaatgg

SEQ ID NO: 152673 - DNA, 601 bp, Human
aagggcgttttggggctggccttgcaggattgatttgttggctgctttgagacttgtgtccattgttttgagcacatcccttgggagagtaaatgatagattccaaaggggtgcttttcagaccagcgcccccaccgagaagatgcaccctcagccctgtgccccaggggcacgtgagggaactgagcaagcacctgcagcctaaggaggaaggccccggggcacacagaaaccaggcgaggtttgtcactgggtgatagggtaagcctgggtatcaaggaatgaaaaaaaggagcaaatygaggagttgtctcctgagctcagaggggccacaggtggggcagccccatcaccactgtgtgctggtcctcctgccgtgtgcctggccctgcttaagaactcctggaggccagggagggtggaatggtatctccccgccaatggggtctagcctgctgttggcatgggaaagggagggtttggggaatgcctgttgggcgagtgaagaatgagtgaatgaacgattgaatggaatagccctgagaaggagaattcctaaactgtgatggagaaaggtagaaatgagcgtggtcggtgttgg

SEQ ID NO: 152674 - DNA, 601 bp, Human
tggccctgcttaagaactcctggaggccagggagggtggaatggtatctccccgccaatggggtctagcctgctgttggcatgggaaagggagggtttggggaatgcctgttgggcgagtgaagaatgagtgaatgaacgattgaatggaatagccctgagaaggagaattcctaaactgtgatggagaaaggtagaaatgagcgtggtcggtgttggggagaggtccccaccctgcctccttggcagtttgtaggaatcagctggcctcatgaaagtgtgctgcctgctgtaaggggcawtttcctaatcttcaagggcagggcagggcaggctgtcacagttcctcagtgtccagtttcttgggggctacgtgggctacagtctggcaaggatttgctcctccacagggggtcttaagaacaactgagatgaaaagagttgtggtttgggggactgcgagggaacatgagccagaatccatacttgaggtgcagctcagaaatagcagcggcatcaattggcatctcaggagctgatgttttgattctgccgtcacctctttgaactctgtgcatcgatttgcacgatgcagataaaca

SEQ ID NO: 152675 - DNA, 601 bp, Human
tctggagaggggttttctgatgagtattaaaagccaagtcccctgttgccccaggtttgctggaattgtcccccaaacacagggctgagaaggagtaaaaataattcagattgccaactggtatttcaaatcccacttcatatttcagtgtctgaagaaaaccacatttctctgaatttcaacatttcatccttgatcttttggctttcaaatttatacctttaatgtaagagaactgaatcagctattttttcattctctcgataaatcacttgttcccgttttgtgtatagttttcagracgcctccacgatccttccagtaggaacatgttggcaacggcgatcggtgttgataaagccttgggtcctgtgtcctctgcccttcctgcctgtctcagaacagcagccattaacaattgagggcagatgcttttttctactttcttctacttttggggcaacttcctgactttattttctaactcctccatgaaattttaatttctgccatcatatttttaatatatatattttttgagacagaatctcactctgtcacccaggctgagtgcagtggcacaatcatagctcactgcacc

SEQ ID NO: 152676 - DNA, 601 bp, Human
ccaaacaatgtggtatgttcacgtacttcttctctagagccctcccaagatttcagaatttctgaaaatacatccatagtgaacatgttcatttttggttaaatattgtatacatgtcagacatgtttctgaaactgatttttaccatacttcttttctttctgtgaaagcaatacaattttattatagaaaatattggtgagaaatagaagaaaatatccccccactccctctcccagtctcatcaaccagaaatagccagtcgtgtcctctggtaatctgtgaggtcagttaacctcayaacctgtgagttgccgcccttcatcttcacggttgtatcctcattctttcctaggacactggggttgggaaatcaagcatcgtgtgtcgatttgtccaggatcactttgaccacaacatcagccctactattgggtaagttcctgtatgtcgttctccttcgcgttgcttcctttcacggcatcagaatggccactctgtctgtgcctgagccttcaggcagggccacagttttcatcccagccagtgagaatcaatcccagctgtagaccgacagaaattcagggacttctgagtatgt

SEQ ID NO: 152677 - DNA, 601 bp, Human
cttttctttctgtgaaagcaatacaattttattatagaaaatattggtgagaaatagaagaaaatatccccccactccctctcccagtctcatcaaccagaaatagccagtcgtgtcctctggtaatctgtgaggtcagttaacctcacaacctgtgagttgccgcccttcatcttcacggttgtatcctcattctttcctaggacactggggttgggaaatcaagcatcgtgtgtcgatttgtccaggatcactttgaccacaacatcagccctactattgggtaagttcctgtatgtcrttctccttcgcgttgcttcctttcacggcatcagaatggccactctgtctgtgcctgagccttcaggcagggccacagttttcatcccagccagtgagaatcaatcccagctgtagaccgacagaaattcagggacttctgagtatgtgtccaggcttactgtccctgtcggtcatttttttttttcctagtcaaccttcctcatgctacctcctaaggtcatttccttgatctctgagagcattattctgcaaatcttggcgttatttccagttggaagacgatatgcagagcaaaccc

SEQ ID NO: 152678 - DNA, 601 bp, Human
tttcctaggacactggggttgggaaatcaagcatcgtgtgtcgatttgtccaggatcactttgaccacaacatcagccctactattgggtaagttcctgtatgtcgttctccttcgcgttgcttcctttcacggcatcagaatggccactctgtctgtgcctgagccttcaggcagggccacagttttcatcccagccagtgagaatcaatcccagctgtagaccgacagaaattcagggacttctgagtatgtgtccaggcttactgtccctgtcggtcatttttttttttcctagtcarccttcctcatgctacctcctaaggtcatttccttgatctctgagagcattattctgcaaatcttggcgttatttccagttggaagacgatatgcagagcaaacccctgatagttctgctttaagttgcctgctaataaaccctgaaaatgccatccacccgtacctcagcactgtctgcaaagtctgtggagcagattgactttccttttctggaattatctttttttttacttcttgagactgagtgttgctctgtcacgttgcccaggctggagtgcagtggggtgatcttggctcac

SEQ ID NO: 152679 - DNA, 601 bp, Human
gtttcaccatgttggtcaggctggtcttgaacttctgactgaaagcagtccacctgcctcagcttcccaaagtgttgagattacaggcatgggtcactgcgcccagccccttttctggaattatctaatgccagcatttccactgtcatgtgtggggaggggtggaagtgcattgttaaattctcctgagcttgggatgcaaaattgttttcctgttcatctcccctttccagtgggctccttggccgcgtgtgctttggctctgctgttcgggaagtgcctgctttttcattcttagaaygtggcctctgcttatttttcaccctgaagatatcaagtctttgtaggcaatgtatgtctttgtctgtatgttttgggaaacctgtaggattgttgagaatgggagagtgtatcagaagtggagaaaaatcatggcagggaataaatagatgctcaagagtacttggctgataggccagtagttggaactgtgtagctgagaaaacccacattctgtagattaaaaatgacttaaagaaacatactcatgaaaatatcaagaattaggaaaggtctgagattttaccctaattgcagcctg

SEQ ID NO: 152680 - DNA, 601 bp, Human
tgttcatctcccctttccagtgggctccttggccgcgtgtgctttggctctgctgttcgggaagtgcctgctttttcattcttagaacgtggcctctgcttatttttcaccctgaagatatcaagtctttgtaggcaatgtatgtctttgtctgtatgttttgggaaacctgtaggattgttgagaatgggagagtgtatcagaagtggagaaaaatcatggcagggaataaatagatgctcaagagtacttggctgataggccagtagttggaactgtgtagctgagaaaacccacattytgtagattaaaaatgacttaaagaaacatactcatgaaaatatcaagaattaggaaaggtctgagattttaccctaattgcagcctgcaacttgttaacaagttagcagttgtgacttgttagcctgactcagtttcagggatgctggcagaagacagaagacccccgagtcacagacagaggcaatagcaatagccagagtattcacaaaatagggtgacattagagtcagacacctcacatgcagggggctgtgttacgggagcggaaccccaagctgagggaacgcaagtcttctac

SEQ ID NO: 152681 - DNA, 601 bp, Human
gggctgtgttacgggagcggaaccccaagctgagggaacgcaagtcttctacatggggcagtgagcacatctgtcctcagctacagagagagactctcccctccaaggatgcttgctgtgcaggttgagcatccctaatccaaaaacctgaaatccagaatgctcccaaatctgaaacttttgagtgccaacatgacgctcaaaggtaatactcaaaatgctcattgggatatttcagattttggaatttcagctttgggatgctcaactgggtaagtataatgcaattattgcaaaattwaaaaaaatatatatccaccggaagcggtggttcacgcctgtaattctagctctttgggaggcctaggtgggcagatcacatgaggtcaggagttcaagaccagcctggccaacacggtgaaaccccgtctctactaaaaatacaaaaattaaccagatgtggtggcacgcgcctatagtcccagctacttggaaggctgaggcaagagaaggtggtggttgcagtgagctgagattgtatcactgtactccagcctgggcaacagagcgagacttcatctcaaataagtaaatagataaa

SEQ ID NO: 152682 - DNA, 601 bp, Human
acatgacgctcaaaggtaatactcaaaatgctcattgggatatttcagattttggaatttcagctttgggatgctcaactgggtaagtataatgcaattattgcaaaattaaaaaaaatatatatccaccggaagcggtggttcacgcctgtaattctagctctttgggaggcctaggtgggcagatcacatgaggtcaggagttcaagaccagcctggccaacacggtgaaaccccgtctctactaaaaatacaaaaattaaccagatgtggtggcacgcgcctatagtcccagctactyggaaggctgaggcaagagaaggtggtggttgcagtgagctgagattgtatcactgtactccagcctgggcaacagagcgagacttcatctcaaataagtaaatagataaataaataaatccaaaattcaaaatacttctggtaccaaacattttggataagggatactcaacatgtacaagcatccttgaaaacacaatccggaaaaaagtgtttacttgcaagatgtgcacgttgtgagagaccataaagaattgtctcccaacataggcgcgcttgtatgataggtatactttttatg

SEQ ID NO: 152683 - DNA, 601 bp, Human
atttcagctttgggatgctcaactgggtaagtataatgcaattattgcaaaattaaaaaaaatatatatccaccggaagcggtggttcacgcctgtaattctagctctttgggaggcctaggtgggcagatcacatgaggtcaggagttcaagaccagcctggccaacacggtgaaaccccgtctctactaaaaatacaaaaattaaccagatgtggtggcacgcgcctatagtcccagctacttggaaggctgaggcaagagaaggtggtggttgcagtgagctgagattgtatcactgyactccagcctgggcaacagagcgagacttcatctcaaataagtaaatagataaataaataaatccaaaattcaaaatacttctggtaccaaacattttggataagggatactcaacatgtacaagcatccttgaaaacacaatccggaaaaaagtgtttacttgcaagatgtgcacgttgtgagagaccataaagaattgtctcccaacataggcgcgcttgtatgataggtatactttttatggaagaaattggtttcactctgctctgaatgtacttttttctctctctctcttattt

SEQ ID NO: 152684 - DNA, 601 bp, Human
ccaatagagaatcaggagactggcacgtaataaacttgcattcctggtttctcttgaaaaatcagtgggtttggagccctggtgcccattcccatgtggtgggagccagccggtgccactccgcatgggtggccaggcctcccggcttcatgccattcccgctaggtattgttactattatgttcatcagtataaacgttcacacctagcctgcttcactcatttatatgtcctgcctggtccctagacatttcagttcctggccctggcactgccttcttggcggtaaccctgctggccrcccccaggcccagggcggttaggggacttgcctaggtgcacacagcccgtgagcagcccactcatggctcacaccagtgagtccactctcaaagcccacccttgttcttcccactggaatcacacgaccattggtacaatgccatgggctgtaaaatgccattgcttcagcattaaaagagttaattcttatggcctctctgactcacactgaaaaaccttggctctgctattcaagcagattgcattaacatcttgagtgtgtgtgtatgtgtgtgtctccctttttatttcaactttt

SEQ ID NO: 152685 - DNA, 601 bp, Human
tcagtataaacgttcacacctagcctgcttcactcatttatatgtcctgcctggtccctagacatttcagttcctggccctggcactgccttcttggcggtaaccctgctggccacccccaggcccagggcggttaggggacttgcctaggtgcacacagcccgtgagcagcccactcatggctcacaccagtgagtccactctcaaagcccacccttgttcttcccactggaatcacacgaccattggtacaatgccatgggctgtaaaatgccattgcttcagcattaaaagagttaaytcttatggcctctctgactcacactgaaaaaccttggctctgctattcaagcagattgcattaacatcttgagtgtgtgtgtatgtgtgtgtctccctttttatttcaacttttgtaaggaaattgtgtaacttctctgccagattttggtttccacagataatgaagtcagtttatcagggccagtgcgcctcctccaccagtttggagggtaatctacacagaagaaaagatgcctgaggttcttatttgtttatttgtttgagacaggatcttgctctgtcacccaggctggagtgc

SEQ ID NO: 152686 - DNA, 601 bp, Human
tcccactggaatcacacgaccattggtacaatgccatgggctgtaaaatgccattgcttcagcattaaaagagttaattcttatggcctctctgactcacactgaaaaaccttggctctgctattcaagcagattgcattaacatcttgagtgtgtgtgtatgtgtgtgtctccctttttatttcaacttttgtaaggaaattgtgtaacttctctgccagattttggtttccacagataatgaagtcagtttatcagggccagtgcgcctcctccaccagtttggagggtaatctacacrgaagaaaagatgcctgaggttcttatttgtttatttgtttgagacaggatcttgctctgtcacccaggctggagtgcagtggcgcaatcatggctcactgcagcctccacctcccaggctcaagtgatcctcccaccttagcctcctgaatagctgggaccacaggtgtgagccaccacacctggctgtttttaaatttttgtttttaattaaatctttttatttttgtggagatgaggtctcactgtgttgttgcctaggctggatgaggttcttaagatcaaaagctagcaaagactt

SEQ ID NO: 152687 - DNA, 601 bp, Human
cttaaaaaccaacaacaaatctcagtcaacaaaaaaaagcaatgattgtcgtggtcctcatttcaaatactgagagtctttctcctagtggcgagagatcaggaacacagagggatatgtgtgtgtgtgaggtgtgccttcctactattactaaagttgctcctcacagctcactgtgaaccaaggggaatttcgcaggtatccatttccctatatgtccctacaaacaccttctattcaatgcagagtaggtattggccccatttcacagaacaggaaaccaaagggctttacgggctgkttcattgagtctggcagtgagggcctctgcttcctcttcctggttaggccactgcactcttctttcaccaggaaccaggcagtcttctgggattttggttccccccccttacctgcactgtggaggggttggactggatattttatattttttccaagattttaaaggcatgaactttgttttctaaccctgaggagaactttttaagggtagtagggttgctgtattatttatcgcagcacctagaatatactgaagaataaatgaaaatctgactaacatcaaaagtgaaaacaaaaa

SEQ ID NO: 152688 - DNA, 601 bp, Human
tcctgggctcaagggatcctcctgcatcagcttcctgagtagctgggactacatgcaaaagccactgtgcctggctgatttttttttttttcttttgtagagccaggggtcttgctatgttgccaaggctggtcttgaactcctggcctcaagtgatcctgccaccttggcctcccaaagtgctgggattacaggtgtcagccaccatgctcggctctactttttaaaaattaagtctaaggatatagttgtacagggacacaaagatgtaattataaggatattcactgaatcattgtcrtaatagtgaacaatagataaccaaaatgtccatcgttagggtattgaataattccataacatgatgtatgatcttcagtcattttagatgatattgatgtatattcatagaaatggaaagattttaggtgatttttttttttttttgagacagagtcttgctctgtcacccaggctggagtatagtggtgtgatctcagctcacagcaacctctgactcctaggctcaagtgattctcctgcctcagtccccgacgtagctgggattacaggcacacaccaccacacctggctaattttt

SEQ ID NO: 152689 - DNA, 601 bp, Human
tagtggtgtgatctcagctcacagcaacctctgactcctaggctcaagtgattctcctgcctcagtccccgacgtagctgggattacaggcacacaccaccacacctggctaatttttgtatttatagtagagacgtggttttgccatgttggccaggctggtttcgaactcctgacctcaagtgatccgcccccatcaacctcccaaagtgctgggattacaggtgtgagccactgcgcccagccaattttagatgatattgatctatattcatagaaaaggaaagatttccaggatatrtaaagttgaggaaaagcaaaatttagatagagtatgatcaattttcagagcaaaagttatgttaaaatagagcgtcctgcaaactcggaagcagatcacaaggggtggtcacactgcagtgtgattgacataaagaccgatgttacttgggaagaagcctggaagaggaggaagaggaaagaaaaagagtcgagaacagctcttactcagggatgctggactttcagggatgtggctataaaattctttgaggatgagtgggaatgcttggaccctgcacagcatcctctatacagggac

SEQ ID NO: 152690 - DNA, 601 bp, Human
atctcagctcacagcaacctctgactcctaggctcaagtgattctcctgcctcagtccccgacgtagctgggattacaggcacacaccaccacacctggctaatttttgtatttatagtagagacgtggttttgccatgttggccaggctggtttcgaactcctgacctcaagtgatccgcccccatcaacctcccaaagtgctgggattacaggtgtgagccactgcgcccagccaattttagatgatattgatctatattcatagaaaaggaaagatttccaggatatataaagttgargaaaagcaaaatttagatagagtatgatcaattttcagagcaaaagttatgttaaaatagagcgtcctgcaaactcggaagcagatcacaaggggtggtcacactgcagtgtgattgacataaagaccgatgttacttgggaagaagcctggaagaggaggaagaggaaagaaaaagagtcgagaacagctcttactcagggatgctggactttcagggatgtggctataaaattctttgaggatgagtgggaatgcttggaccctgcacagcatcctctatacagggacctgatgttgg

SEQ ID NO: 152691 - DNA, 601 bp, Human
agaatcgcttgaacccagttgcagtgagctgagatcatgcgactgcactctagcgtgggcgacagagtcagactctgaaagaaagaaagagagaaagagaaagagagtaacagagaagagaaagaaaagagaatgcctatgtaatgaagcctctgtcaaaaaaaggaaaggaaagaaagaaagaaagaaggaaagaaaagaaaaggaaagaaagaaaagagaatgcctatgtaatgaagcctccataaaaacttaaaagaaaagtgttcagggcacttctggagagctgagtttcctggaragtggcgcccagggagggcatggcagctctgtgcccctgtctgcttaccttgccctaagcgtctcttcatctgtatgctttgcagtatcctttatgagaaactggtcactataagtaagtgtttccttggtttctgtaagccgctgtagcaaattaatcaaactcaaagaggggttggtgggaaccccaacctgaagcctgtcgatcagaagttctagaggcccggacttgggactggtgtctgtggaggagcactcttgggtactgagccctcaacctgtgggatctgacagtatctcc

SEQ ID NO: 152692 - DNA, 601 bp, Human
ttctaagcccaaatccatatttctaacaagtatgggacttacttaatctattcttccttacacaagaacagaaagcacacattagggaaaaaccttacaaatgaaatgagtgtggcaaaacctttaatcatgactcactctatgctgtatattagataatccatcccagagagaaatgacataaatgtgatttatgtagcagggttattagtcaaaaataaaaccttgcacatcattggagagagtttatactggagagaaactctacaaatgtaatgaatgtgacaaggttttcggtcayaattcacaacttgcaagacattggagaattcacactggagaagacccttacaagtgtaatgagtgtggcaaagccttcagtgtgcagtcagcacttaccatcaggtggtccatactggagagaagccttccaaatgaaatgagtgtggcaaggtcttcatgcacaattcacttctcccacaacatccaataattcgttcttgggagaatccttacaaatgcaatgattatggcaaacccttcatcgtgagttcaagcattaattgacatcagagagtccatactaaagaaaaatcataga

SEQ ID NO: 152693 - DNA, 601 bp, Human
ccaaataaaatgatttaaattgggcaaggaatctgagtagacatctctaaaaagaagacatacagatggccaacaagtttgtggaaaaatgctcaacatcactatcatcagggaaatgcaaattaaaaaccacaggaagatatcatctctctccagttagaatggctatcatcaaaaatacaaaaaataacaagtgctggcaagggtgaagagaaaagggaattcttgtattctgttggtaaattaagcactgtgtacattagtacagacattatggaagacagtatggaggtttctcaamaaagctaaaaatagaactgccatacaatccagcagttctactactgggtatttatgcaaaggagagtgaatcactatatcaaagggatacctgcactcacagatttattgctgcactatccacaacagccaagctatgaaatcaacccaagtgtccatcatccatcaacaaatgaatggaggctggcgtggtggctcacacctgtaatcccagcactttgggaggccaaggagggtggatcacctgaggtcaggagtttgagaccagcctggccaacatggtgaaaccccatctctacta

SEQ ID NO: 152694 - DNA, 601 bp, Human
tatatcaaagggatacctgcactcacagatttattgctgcactatccacaacagccaagctatgaaatcaacccaagtgtccatcatccatcaacaaatgaatggaggctggcgtggtggctcacacctgtaatcccagcactttgggaggccaaggagggtggatcacctgaggtcaggagtttgagaccagcctggccaacatggtgaaaccccatctctactaaagtaaattacaaaaattagctgggcatggtggcacatgcctgtaatcccagctacttgggaggctggggcaggrgaatcgcatgaacctgggatatagaggttgcagtgagctgagactgtgccactgcactccagcctggttggcagagtaagaccccatctcaaaaaaacaaaacaaagcaaaaatgaattaatggataaagaaaatgtggtatatatacacactggaatactattcagccataaaaaagaatgaaatcctgtcattcatggcaacatggatgaacctggaggacatttcgttaagtgaaataatccagacacagaaggataaatactacatgttctcactcatatgcaagagctgaaaaaa

SEQ ID NO: 152695 - DNA, 601 bp, Human
gtaagacaactttttctttatgccattgtaagaccaaaaacattacatgccaacataccagctgctattttcactcttaattattgtaataagtttttaaaatccaaggttgtattctttcctgagatctgggggtattttaataattgaagctaactggttttagaaacacagtccttttttttttttttttttttttttttgagacggagtcttgctctgtcactcaggctagagtgcagtggtgcgattttggctcactgcagcctctgcctcccgggttcaagtgattctcctgcckcagcctcccaagtagctgggactacaggcacccgccaccatgcccggctaatttttgttttatttttattttattttattatcatatacatattttttgagatgaagtctcatactgtcacctgggctggagtaccatggtgccatcttggctcactgcaacctctgcctcctggtttcaagcaattctcctgccttagcctcccaagtagctgggaccgcaggtgcctgccaccacgccgccaccaggcctggctaattttttgtatttttagtagagacagggtttcaccatattggc

SEQ ID NO: 152696 - DNA, 601 bp, Human
gggggtattttaataattgaagctaactggttttagaaacacagtccttttttttttttttttttttttttttgagacggagtcttgctctgtcactcaggctagagtgcagtggtgcgattttggctcactgcagcctctgcctcccgggttcaagtgattctcctgccgcagcctcccaagtagctgggactacaggcacccgccaccatgcccggctaatttttgttttatttttattttattttattatcatatacatattttttgagatgaagtctcatactgtcacctgggctgkagtaccatggtgccatcttggctcactgcaacctctgcctcctggtttcaagcaattctcctgccttagcctcccaagtagctgggaccgcaggtgcctgccaccacgccgccaccaggcctggctaattttttgtatttttagtagagacagggtttcaccatattggccaggctggtcttgaactcctgaccttgtaatctgctcaccttggcctcccaaagtgccgggattacggcatgaaccaccgcgcctggccagaaacagtcttttgaatgcctcctttgttttgttttgttt

SEQ ID NO: 152697 - DNA, 601 bp, Human
ggggtattttaataattgaagctaactggttttagaaacacagtccttttttttttttttttttttttttttgagacggagtcttgctctgtcactcaggctagagtgcagtggtgcgattttggctcactgcagcctctgcctcccgggttcaagtgattctcctgccgcagcctcccaagtagctgggactacaggcacccgccaccatgcccggctaatttttgttttatttttattttattttattatcatatacatattttttgagatgaagtctcatactgtcacctgggctggmgtaccatggtgccatcttggctcactgcaacctctgcctcctggtttcaagcaattctcctgccttagcctcccaagtagctgggaccgcaggtgcctgccaccacgccgccaccaggcctggctaattttttgtatttttagtagagacagggtttcaccatattggccaggctggtcttgaactcctgaccttgtaatctgctcaccttggcctcccaaagtgccgggattacggcatgaaccaccgcgcctggccagaaacagtcttttgaatgcctcctttgttttgttttgtttt

SEQ ID NO: 152698 - DNA, 601 bp, Human
cagtgaaaataagatcagtttctgaaggtttgtttgcattagacaagactcttggttgcaggtgacagaaacctagcttgaaatgatgtaagcaaaaagaaaatgtactcattagctatgtgaaaagtctaagtgggtacctagggtgaggcggggctgagttcaggtccccaaatgtgttgtgagaggagcccatctctcttatttctgtttctttccatttagtgcagttgtggttgcactctcgatttggttcatttttaggcagactcaccctccctccttacctcaagggtggtarccatggccccaaaagcatctctacacctaccttcagcctttttagcaactactgggtgagcatgcacctcttctgcaagtgggaacatacatcttagtgcctctgagttctcactggcctgccttaggccccatgcccactcctgaacttcaggtggtaccttgttcttgggggtttggtgcccctactggtgggatctggcagtacactgacccctagaggcaagggccggtgtcagccccacctgaaccatgttggttcaggaagtcaggtaggcttagcgccccaaggaaaatctga

SEQ ID NO: 152699 - DNA, 601 bp, Human
agtgaaaataagatcagtttctgaaggtttgtttgcattagacaagactcttggttgcaggtgacagaaacctagcttgaaatgatgtaagcaaaaagaaaatgtactcattagctatgtgaaaagtctaagtgggtacctagggtgaggcggggctgagttcaggtccccaaatgtgttgtgagaggagcccatctctcttatttctgtttctttccatttagtgcagttgtggttgcactctcgatttggttcatttttaggcagactcaccctccctccttacctcaagggtggtaascatggccccaaaagcatctctacacctaccttcagcctttttagcaactactgggtgagcatgcacctcttctgcaagtgggaacatacatcttagtgcctctgagttctcactggcctgccttaggccccatgcccactcctgaacttcaggtggtaccttgttcttgggggtttggtgcccctactggtgggatctggcagtacactgacccctagaggcaagggccggtgtcagccccacctgaaccatgttggttcaggaagtcaggtaggcttagcgccccaaggaaaatctgag

SEQ ID NO: 152700 - DNA, 601 bp, Human
gtgaaaataagatcagtttctgaaggtttgtttgcattagacaagactcttggttgcaggtgacagaaacctagcttgaaatgatgtaagcaaaaagaaaatgtactcattagctatgtgaaaagtctaagtgggtacctagggtgaggcggggctgagttcaggtccccaaatgtgttgtgagaggagcccatctctcttatttctgtttctttccatttagtgcagttgtggttgcactctcgatttggttcatttttaggcagactcaccctccctccttacctcaagggtggtaacsatggccccaaaagcatctctacacctaccttcagcctttttagcaactactgggtgagcatgcacctcttctgcaagtgggaacatacatcttagtgcctctgagttctcactggcctgccttaggccccatgcccactcctgaacttcaggtggtaccttgttcttgggggtttggtgcccctactggtgggatctggcagtacactgacccctagaggcaagggccggtgtcagccccacctgaaccatgttggttcaggaagtcaggtaggcttagcgccccaaggaaaatctgagg

SEQ ID NO: 152701 - DNA, 601 bp, Human
tcctgcgtatcaacccagaggaagtcattacacagaaaagatacttgcacacgcatgtttattgcagcacaatttgcagttgtaaaaatatggaaccagcccaaatgcccatgaatcaatgagtggataaagaaaatgtggtatatatatacaccatacaatactactgaatactactcagccataaaaaggaactaaataatgacattccagcaaactggatgcaattggagaccattattctaaatgaagtaacatactaaacatcgtatgttatcattcataagtgggagctaagctrtgaggacacagtggcataagaatgatacaatggacttcggtgacttgcaggaaagggtgggagtgggggtgagcaataaaaactacacactgggtacagtgtacactgcttgggtgatgggtgcaccaaaatctcagaaatgaccactagagaatttactcttgtaagcaaacaccacccattccccaaaaacctactgaaatttaaaaaataataataaaataaagctaaaagaagcatgctaaaatatagctaaaatatgcacctaatcttaatctaaaattgtagatgtggaattgc

SEQ ID NO: 152702 - DNA, 601 bp, Human
tatattaaatatttaaataaaacacattttcttaaaaatacattttaaacagttttaagaaataaattaggatgaatattctggcctacaaatgctaacctcattagaaagtcttctatttttctgctaaattgagaacacagacttctgtgcacgggaagcagctgcctggggcacctctttaactccatcagctgtgcctgcctagtcctcaaatgaggtgacccattcaaggaaaaatgtctacttagagacctcacttcttgatatacgtgtgtgttacttgtagttgatctgctgrttttttgtttgtattgttatgtaaacttaaacagagagagtttcttgattctctttttacctctggctatgaaatagttgcttttgcagctgcctttaatgaacacaataagtcaattttgcgaatcgctggcttaatgtcagcgatgcttctgcttctcctgctggcggacgttccctgatgacttgctgtgttccatgtactgttctgagtgcctgtgtgtactgatgcattcagccctcctcgcaaaagcactttgaggttgaaactgtcgttattcccatttgcaggtgaggtcac

SEQ ID NO: 152703 - DNA, 601 bp, Human
tgatatacgtgtgtgttacttgtagttgatctgctggttttttgtttgtattgttatgtaaacttaaacagagagagtttcttgattctctttttacctctggctatgaaatagttgcttttgcagctgcctttaatgaacacaataagtcaattttgcgaatcgctggcttaatgtcagcgatgcttctgcttctcctgctggcggacgttccctgatgacttgctgtgttccatgtactgttctgagtgcctgtgtgtactgatgcattcagccctcctcgcaaaagcactttgaggtwgaaactgtcgttattcccatttgcaggtgaggtcactgagacagagacattaagtaacttgcacaatgtcgcagagctaataaggtgtaaagctgaaaattgaatccagcagtctgggtcctgagctttgtagttttattttgattgaaaaatcacacaaaaaaccatacggttgaaagtaaaactatccaaactcccactacccagatatttccactatggatattagatgatcgttcttcagatatctctacgtgattgataattttatatcaatgggattgtgattctttataacct

SEQ ID NO: 152704 - DNA, 601 bp, Human
ttttattacccctctttatcatcatagaaatgttattgttcttttagttttcataattttaaacaaacaatcactttgggtttatgatttgacaatataaagacagatttctttttttctttcttattttattttattttatctttttaagacaaggtcacactctgtcagccaggctggagtgcagtgatgcaatcatagctcactgcaacctcaaactcccaggcctggtcaatcctcctgctccagcctcctgagtagctgagactaccagtgtatgccaccatgcgcagctaatttaaaaaaaaaaaaaaaaattgggccagacacagttgctcacgcctgtaatcccagcactttgggaggccgaggcgggcagatcacgaggtcaggagtacgagaccagcctggccaacatggtgaaaccccgtttctactaaaaatagaaaaagtagctgggcgtggtggcacttgtagtcccagttacttgggaggctgaagtgagagaatcgcttgaacccagaaggcgaatgttgcagtgagctgagattgcaccactgtaccccaatctgggtgaaagagcaagactccacctcaaaaa

SEQ ID NO: 152705 - DNA, 601 bp, Human
caatctgggtgaaagagcaagactccacctcaaaaaaaaaatttgttagagatgaggtcttgctatgttgtgcaggctgggcttgaactcctggcctcaagcaatccatttcacttggcttcccaaagtgttgggattataggcgtgagccaccaagcctggccaaagacatggatttctgtgtccttaaaggaagaaagctccgctcagtgctttgcttgtgttcatgattcaatatttatttatttgtggaatgattgcaccaagttctgcctaacatacacagcattctggttaatgycctacttactgcccagtaataattctatcttatatttgtggtacaaatttgtactcttggaaaattattttttcttctcctgagcacaggaatctcaaaggatcctcctcctctttatataagagagtattcattctatttatttttatttatttattttagagacagggtctcactctgtcacccaggctggagtgccatggcatgatcatagctcattgtagtctcaaattcctgggctcaagcgattctcccgcctcagcctccagagtagctgggactacaggtgcgccaccgtgc

SEQ ID NO: 152706 - DNA, 601 bp, Human
aatgggttattgtgctggtttctgcttcacaccaagctgtgaacagtacagagtagcaggtcagcaggcacctttgcaaggatgtacacaggagccatgcctagagcggtccatagccgacagaaggtaatttacctgcccagctccctgcgggagcctagagtcaacacatagagtggcttttagcgagaggagctgaaaagcaacattgtcataaataaggcatgcgttcatgaagaggtgaagagctggggataatactttcatctgccagcggcccctcctgggttctcttgctctrtataccatggaggaccaacttcttccaacctgaaactttcttcagccatctcccttccatttttttccaccgtgctatacttttacacagttcatgacgttccaacacaaatttcccattaaaaaacctgaagctgtagagctaatgtttgactttccatggctctgaagatatatttattccttcctcttggctcagacggcccctccccatgttggaaaatggtttctaaaaagagcccagtgaagcggcagtggtggaattctctgtactttttccttggcagggagttctttccct

SEQ ID NO: 152707 - DNA, 601 bp, Human
cccccagccctgggatactttctgtctctagatttgcctaatctggacatttcacacaaatggaatcatacaacctgtggttctttgtgactggatcctttcacttaggataagattatcaaggttcaccttgtggtgtgggtcataaaagtatttcctttttatggcagaataatattccattgtctggatagaccacattttgtttagccactcatcagttgatggatatccactttcccccaactttttggctattatgaatagctgtgaacattcatgtacaattctttgtgtagattttttttttttttttgagatggagtcttctctgtcgcctaggctggagtacagtggcatgatcttggctcactgcatcctctgcctcctgctttcaagcgattctcctgcctcaacctccccagtagctgggattacagccagctgccaccatgcccggctgattttttgtatttttagtagagacagggttttaccatgttggccagatgtctcaaactcctgacctcaggtgatccaccggcctcggcctcccaaagtgttgggattacaggtgtaagccaccgtgcccggccagatg

SEQ ID NO: 152708 - DNA, 601 bp, Human
tgcatgcagtcaggagatctggccaccccaggctgttcagccataccgcttgttcacctccttcagattaattttgcaagtgactgccagtctgcatggtttgaaagattaggtgtttggagatcatgtgcccagagggctgggatgcactggcacaaagctgtgcggaatcgctgggtctgaatgggtccttgagaaagcaaaggaactggaggcagcagatagctgaggtcaaattcaggctttacagacatccaaagaaactcttttgctgtctttcctgctttcttcagggccccarcatctatggtcaaaaaagtggttcactattcataggccattagtaaagtcagaggaaattttgacctttggaagttcttgaagaatggagcctcttacaagctcagaatgagcagctcctttctttctcctgcaggcattggaaatacagtcccagctggcaacaccagccagcagcacagcccggaatcctgctcctgacctgcaccatccccaccagcccacgatagaacgtttttgtaggcattcctcctcatgggagaggatagagtacatgcgagtttttgctctcctcccaccc

SEQ ID NO: 152709 - DNA, 601 bp, Human
gttcagagacaaggtctcactatactgtccaggctgggatgactgtgctttctaccaatgcaaactgagatcccggcaagggaaatattcccttcctccatgcccctagtaactctcttgaaagagaaaactgagtgatgattgtgtggggaggaggcaggcctggagcttgaagatagggtttatgctgttgaagtgagataaacagctgtggtgagggccatgcctgctgagctcctttaaggagaagccccaggaatccttcattaagcactttacagctgaagagtttcattgatayttgaaaattggtgctggaaactacaaaagcaaagtgtgagcagaggtattggagaggggcatgaggggaccctgacggcagctgtgcaggtggagcagggactgcctcggtccacagacgtggcccccagaactgtcgtgccatttgcgggggttgtgtcctgtaagaaaataggaatctaggtgcagaacagccctcctgggtgtcagaatgccagcgacaggagagaaggaggaaggacatgttcatatacgaagatacctttcgggagttcttagggaaacactgtaaacagctctg

SEQ ID NO: 152710 - DNA, 601 bp, Human
cttctgccctgctcttgcccctcgggggttcttttgtcactggagaccctgctgttgccctttgctctccagtgcgtgtccccttcttccatatgccccctccttggtggggacaggctgctctgggaggtacagtgactgcgctagatgaacaccttcccaggtcaggcaatgacattttgctgatgtgtgttttagtctgggatgccctgagtagcttctaattatgaggcactgtctgtgcctcttgggtggaggccaagtttccattctgccaactctcagaggacgtggggccaaracacagagccgctgagacaggagtttcagggggtctggaggtggatttgccgagaatctaagaagcacttcaactagttttgtttcctctcctcccttccactccctttcccttctgtcctcttcttttcttttatggagctaatttcctacgtctggctaaaatacagtagaaaagccctataaagcctatgagtgtcactcttgaataggaaattagcaaatagactttgtttggtaacagaagaacctgttcctgaggcgctgacagcctgtcctaacagaggcagctgggctgcag

SEQ ID NO: 152711 - DNA, 601 bp, Human
aagggaccaggtcccacccaagatgccacagaatggagcttggcttttatactaagtttgaaggattctgaacagggaagtgaaacaattggatttatataggaagaaatcaatcactctgatgttcagttaacataagatgatgtcaagtatttgcttcaaaagactccagggggtaggaatggagcgggaggtgagacgaggtagaaaggaagccagtggtccatgtgttagtggtgatcttgaagtcaggggatgagaagatggaagtccattattctagtctctcttcttgtggatrtgcttgaaaatttccacagtgaaagttaaaaataaatacattctgtggtcagtgtaaataaatatcataatccagcacttcaaaacaggatctctctggtggctgtgtggccagtttggagctcactggatatctgaaggctcttgtggaaactttggacgtccagtcaaggcaagacgaactttgctcggacaggagggaggtgcggctgcgtgagagctggggctgggtctgaaggccgtgctggctagcctgggttggcacacagcaaagtgcagagtctagggctctaggcacatg

SEQ ID NO: 152712 - DNA, 601 bp, Human
cttggcttttatactaagtttgaaggattctgaacagggaagtgaaacaattggatttatataggaagaaatcaatcactctgatgttcagttaacataagatgatgtcaagtatttgcttcaaaagactccagggggtaggaatggagcgggaggtgagacgaggtagaaaggaagccagtggtccatgtgttagtggtgatcttgaagtcaggggatgagaagatggaagtccattattctagtctctcttcttgtggatatgcttgaaaatttccacagtgaaagttaaaaataaatrcattctgtggtcagtgtaaataaatatcataatccagcacttcaaaacaggatctctctggtggctgtgtggccagtttggagctcactggatatctgaaggctcttgtggaaactttggacgtccagtcaaggcaagacgaactttgctcggacaggagggaggtgcggctgcgtgagagctggggctgggtctgaaggccgtgctggctagcctgggttggcacacagcaaagtgcagagtctagggctctaggcacatgggggtaaatgacaccgtatgtttttgagtgcatctggt

SEQ ID NO: 152713 - DNA, 601 bp, Human
gttttgagactatttctcatctaacagtatgtcaaagatctcttttcctataaataaaaatcatcattttaatggctatagaatatcattacatacatatatgtattaatctgtgcacaaaataacatagactgggtggcttaaacaacacacgttgatttcttaccatttgggagctgggaagtccaagatcaaggtgctggcagattcagtgcctgtgagggccccctttctggtatgcagatactcgccttcttgctgtatctcacataggggcagggcagggagagaagggagatckggtctccttctctccttataagggactaatcccatctgtgacctcatctaaccctaattacctcctaagggccccacctcctaataccaccacgttgggagttagggtttcaatacatggattttaggggagacacaaacattcagttcataacattataccatgagtcaattcccatttactcccataaacagcgcagggatgtgtcttcctgcgtgtgatggtcactccagtatatattcctctaagtggaattgctgggtcaaatgggacacacatttcaacttttgattatattac

SEQ ID NO: 152714 - DNA, 601 bp, Human
actatttctcatctaacagtatgtcaaagatctcttttcctataaataaaaatcatcattttaatggctatagaatatcattacatacatatatgtattaatctgtgcacaaaataacatagactgggtggcttaaacaacacacgttgatttcttaccatttgggagctgggaagtccaagatcaaggtgctggcagattcagtgcctgtgagggccccctttctggtatgcagatactcgccttcttgctgtatctcacataggggcagggcagggagagaagggagatctggtctccytctctccttataagggactaatcccatctgtgacctcatctaaccctaattacctcctaagggccccacctcctaataccaccacgttgggagttagggtttcaatacatggattttaggggagacacaaacattcagttcataacattataccatgagtcaattcccatttactcccataaacagcgcagggatgtgtcttcctgcgtgtgatggtcactccagtatatattcctctaagtggaattgctgggtcaaatgggacacacatttcaacttttgattatattaccaacagtt

SEQ ID NO: 152715 - DNA, 601 bp, Human
ggccccacctcctaataccaccacgttgggagttagggtttcaatacatggattttaggggagacacaaacattcagttcataacattataccatgagtcaattcccatttactcccataaacagcgcagggatgtgtcttcctgcgtgtgatggtcactccagtatatattcctctaagtggaattgctgggtcaaatgggacacacatttcaacttttgattatattaccaacagttgctttgaaagaagatattcagcacattccatgtagagtatgtgtgcctcccttcccaaaccyacaccaacactgaacagcacaaatctttttacaatttaataatttataagtgtctccttatttttattggtgttcttccgattctaattgaacatgttttaaaatatttgttggcaatgtatatgtcttctgtgatttacctttatatatatctttgtccatttttctattaagccatctttttcttattgactttcaaaacccctccaggatactattttttttttttttttttttttttgagataaagtctcactctgtcttccaggcaggagtgcagttttgcaatcttagctcact

SEQ ID NO: 152716 - DNA, 601 bp, Human
gaatttagatgtcatttatggtggttctctcacttagagagactggagcagagacgtcactgcttgcatcttgccagtagcgtgccactatatattgagtttatttcatgtatatgtaacaaagcatcccatatttatctgctaaattaaacaataatgaccattcattcttaaaattgactgtagaggcaaagtcatgcctgctagtactattctgcagaatgtcagcttttaaagaaaaggaaaatcatttttaatttctgcatgctttataattacagaatacttatttttgttactrtttcaatcatactacatacttaaaatgccaagcataacattcgtgtgtatgtaagtaaatctttgtgtgtgtatatataagtatatttttagttatcacgttgaaggtcttagacttccatcaacaaataaccgcagtagtttgatgacattttttcccactcctgcaaactgaattatttacttttttttctctggagtgttgactcagcacataagactgttagtttaatgacccatcactgttactttccacgagttcctgaccacttctacctaaatgtggtgtgttgcccttggc

SEQ ID NO: 152717 - DNA, 601 bp, Human
ttctaatgatttgtgtacactgttggtttaggattcattttataccttgaagaaatgggtcaaggagctgaaagaacatggtccagaaaacattgtaatggccatcgctggaaacaagtgcgacctctcagatattaggtaagatgcattgaaatctcttttgtgtagatactgtcctccatccctgagtgtcatccgtgtagatactgtcctccatccctgagtgtcatccgtgtagatgctgtcctccatccctgagtgtcatccgtgtagatgctgtcctccatccctgagtgtcatscgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctcca

SEQ ID NO: 152718 - DNA, 601 bp, Human
acatggtccagaaaacattgtaatggccatcgctggaaacaagtgcgacctctcagatattaggtaagatgcattgaaatctcttttgtgtagatactgtcctccatccctgagtgtcatccgtgtagatactgtcctccatccctgagtgtcatccgtgtagatgctgtcctccatccctgagtgtcatccgtgtagatgctgtcctccatccctgagtgtcatgcgtgtagatgctgtcctccatccctgagtgtcatccgtgtagatgctgtcctccatccctgagtgtcatccgtgkagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccct

SEQ ID NO: 152719 - DNA, 601 bp, Human
gaaacaagtgcgacctctcagatattaggtaagatgcattgaaatctcttttgtgtagatactgtcctccatccctgagtgtcatccgtgtagatactgtcctccatccctgagtgtcatccgtgtagatgctgtcctccatccctgagtgtcatccgtgtagatgctgtcctccatccctgagtgtcatgcgtgtagatgctgtcctccatccctgagtgtcatccgtgtagatgctgtcctccatccctgagtgtcatccgtgtagatgctgtcctccatccctgagtgtcatccgtgkagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccctgagtgtacaaaggtatcatgcc

SEQ ID NO: 152720 - DNA, 601 bp, Human
aagatgcattgaaatctcttttgtgtagatactgtcctccatccctgagtgtcatccgtgtagatactgtcctccatccctgagtgtcatccgtgtagatgctgtcctccatccctgagtgtcatccgtgtagatgctgtcctccatccctgagtgtcatgcgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatscgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccgtgtagatgctgtcctccatccctgagtgtcatccctgagtgtacaaaggtatcatgcctttgttatgtctgccctcagtgtagtaact

SEQ ID NO: 152721 - DNA, 601 bp, Human
tccctgagtgtacaaaggtatcatgcctttgttatgtctgccctcagtgtagtaacttaattaatggcctttcacttttggtagtcaatgtggcattgattcaaccagagaagaaataagggaaaatgatagggaaatacagatctgatgtaccatacaatgataaatgttcaaattataactcctgtacataacacagttacatccctgactctacatatctttgggctagatggttttgttatttctgttgttactttttccattattattttcattatgactactagcacaattttastaacactttcctatggtaatgaccattagaattcttaatatttttcatagcatacctgtttgttttggttctagattttatcttaaggatatagtcaagtacataatctcactatttagttctaaaatcagaatacgacacattgtatgtgagtaccttgactttccccagtggtattgggttattgaacttcttatatcttgaaggaggttgtgaggatccagtacacatgaattagagatttgatgatagctttacctagcctggtaagctagctgttttgctaaataaatacattat

SEQ ID NO: 152722 - DNA, 601 bp, Human
ctactagcacaattttactaacactttcctatggtaatgaccattagaattcttaatatttttcatagcatacctgtttgttttggttctagattttatcttaaggatatagtcaagtacataatctcactatttagttctaaaatcagaatacgacacattgtatgtgagtaccttgactttccccagtggtattgggttattgaacttcttatatcttgaaggaggttgtgaggatccagtacacatgaattagagatttgatgatagctttacctagcctggtaagctagctgttttrctaaataaatacattatttaaaaaaggaaatagcgaatttgtggtatctccattcccttggttaatttaattctcaggaattctagtcgttgattttcataaagacaactacatcatgcttctggttttgctaatcaaagtgtgattaaaccaaagaggaataaataatggatggaagtggatcttgcaaaagctcttaacatagcatttaacgaactgttctgtttctttaggatttcaaaagtttgcatcaacttgcatctggttggtttataataacagccataaacaccacttttc

SEQ ID NO: 152723 - DNA, 601 bp, Human
aggagaaaggggaatttattggaagatactggtaatccacatggtaaaaacagaactgccctcagctctggcatttgacatgttccagagttagtctctggagagatactggcctggcattctcttcgtttccagtctaaaatgccagggaggaattccccaggttaagaacaggcgtgtgtggccaagaggggattggtagtacgagatgatatttcccaacattactattagaatgggaaggcaggtggtcttgaagagggacagttcctagaaaagtgtagcctggccagataaaacrtatctgtgacatatagatgtggctaccagcacccaaagatgtgctgtgtttcggggtggaatttgccttttatgcacaggtacagcattcttcttgatgggtgttctgatttgtgctcagctgattcttatatgtgcaattttcatagtgccccagctaacataatctattcatctcacttccaaccgtgaatttactcacagcctctctatccccagtgggagaaaatgcagggccatccagctgctacctctagtggtagtgtcatggggccactgtcccatgcatccagcctccctg

SEQ ID NO: 152724 - DNA, 601 bp, Human
atttttatggctgaataatatttcattgtatggatataccacatttttatttattcattcacacattaacatttgaattatttctacttttttgctattatgaaaaatgttcctatgaacaatcatgtacaaattttgtgtggatgtatgttttcatctctctaggatatgtacttaggagtggaatttctgtgtcacatgataactctttgtaataattttgggaactcacagactgttttccaaagtaactgcaagatatccacatcctcaccaacatttattgcctgtctttttgatyataggcatcctagtgggtgtgagattgtgtcactgtggttttcctaatgactaatgatgttaataaatgtcttttcatatgtttattggccatgtgtgtatcttctttggagaaatgtctcttcaaatcccttgcctaatttttagttggattgtctttttattatcgagttgtaagagttctttatgtattctgaataaaagtctcttatcaaacatataattcgcaaatatttcctctcatcctgtggattatcttttcacaatttttactgtgtgcaaaagtttatgtccagcttat

SEQ ID NO: 152725 - DNA, 601 bp, Human
attcagtctagtcgatagtttgtcagttttgttgaccttttcaaagaaccagtgtttttggtttatttcttttcattgtttttctctttcatttatttatcctctaattgttatttccttcctcctgtttactttggatttactttgttcctctttttctggttcgctaaggagaaaggttagcatatttattcgagatctctttaaatgtaggcatttatagttataaattttcctgtaagcactgctctagctgcatctcataggttttgatatgttgtttttaactaatctcaaaatrttttctaattcgtgttctaacccattgtttatttaatagcatatgcaattcccaaattttgacttttgatcatttctaatttaattccattgtaatctgaaacatactttgtatgattttaattattttacatttattgaggcttgttttatggcttagtatatggtctgtcctggggaatgttctaagtgagcccgatgacactaagtttttaagacctatttttacacttgctattctcccttagagagaaagtctaaggttgagggccctctgcagacaagtgtgtctaactagagt

SEQ ID NO: 152726 - DNA, 601 bp, Human
tcctctaattgttatttccttcctcctgtttactttggatttactttgttcctctttttctggttcgctaaggagaaaggttagcatatttattcgagatctctttaaatgtaggcatttatagttataaattttcctgtaagcactgctctagctgcatctcataggttttgatatgttgtttttaactaatctcaaaatattttctaattcgtgttctaacccattgtttatttaatagcatatgcaattcccaaattttgacttttgatcatttctaatttaattccattgtaatctraaacatactttgtatgattttaattattttacatttattgaggcttgttttatggcttagtatatggtctgtcctggggaatgttctaagtgagcccgatgacactaagtttttaagacctatttttacacttgctattctcccttagagagaaagtctaaggttgagggccctctgcagacaagtgtgtctaactagagtttaattatattttgtctttatcatatttattttttaggattacattctttttatgatagttgacactagtgttgcatttatgacagtgatatcatattt

SEQ ID NO: 152727 - DNA, 601 bp, Human
atagtaaagatgttcattctcttcaaattgagttataggtttaaatgaaatttttgtcaaatcttagcaaggttttttgtaaacataaataagcctattctaaaatttatatggaaaatcacagacactgaatagctaaaacgatattgacaaagaagaatataatggaaagaatcactctgttctatatgaaggcttaccatatagctacagtaatcgagacagtatggtattggcagtgagacggatgcatagatcaatggaacagaatagagaacccagaaataaatctacacaaatrtgctcaattgattttttgacaaagatgcaaaggtagttcaacagaagaagcaattcaaccaatgaccttttcaacaaatagagtaatcggacatcaataggcaaaacaaaaacaaacctcaaccttatataaaattagtctaaaatgaatcacaggctttaatgtaaaatgttaacccataaaacttttagaaaaacttctaaaagaaaataaatttaaagatctggggttaggcaaagagttcttagacttatcattaaaagcacgattcatataaggaaatactgataaattagacac

SEQ ID NO: 152728 - DNA, 601 bp, Human
agcaattcaaccaatgaccttttcaacaaatagagtaatcggacatcaataggcaaaacaaaaacaaacctcaaccttatataaaattagtctaaaatgaatcacaggctttaatgtaaaatgttaacccataaaacttttagaaaaacttctaaaagaaaataaatttaaagatctggggttaggcaaagagttcttagacttatcattaaaagcacgattcatataaggaaatactgataaattagacacccttaaaatttaaaaacttaaaaatatttgctctgtgaaatattgaggygtgaagaggatgaaagacaagctacagactaggaggaaatatttgcaaactatatatctataagggactagtatgtagactatataaagaactcacaaaatttacatgaaaaaatttgaaaatggcaaaagacataaacagacatttcacctgagagaataggaagatggtgaggaaggatataaggcgacgttcaatatcatcatcaaacctatcagaatggctaaaataaaaatcagcgacaacacctaatgctggtgaggatatggaaaaactgagtcatccatacgttgccggtgt

SEQ ID NO: 152729 - DNA, 601 bp, Human
tggtaaaattgtatacagcttaactcacatacataagtgcatacaagtaaaactggagaaatctgaataagatagaatgcatcaatgacaatgtcctctttgtgatattataccatagtttttcaagatgtgaccatttagggaaactgggcgaagtgtatgagaaatcgcttggtactgtttcttacaactgcatgtaaacgaatctacggttatctcagtaaaaaatctgattaacaaaaagttgatttagataaaaataataaatattggaacagtcaggtgagggtatgtgtgatayatatgcattatatatattatatacacatggcaaaaattacaaagggggatgtatttgacaaaaattttgtaaacacactgggccaaatgattaaattaaccatctccagcacacctaaggtacaaaagataaacagggtaactgtattaaaaattcccatttaggaaagagggaaggggaagcctgctgcctgggtctctgcccagaatgtctgtctcctgtgagacaggaatagtcggtaagtgatagggcctgggaacctagtgggcaccggcttgttgacacgtttctatggtgggg

SEQ ID NO: 152730 - DNA, 601 bp, Human
cttacaactgcatgtaaacgaatctacggttatctcagtaaaaaatctgattaacaaaaagttgatttagataaaaataataaatattggaacagtcaggtgagggtatgtgtgatacatatgcattatatatattatatacacatggcaaaaattacaaagggggatgtatttgacaaaaattttgtaaacacactgggccaaatgattaaattaaccatctccagcacacctaaggtacaaaagataaacagggtaactgtattaaaaattcccatttaggaaagagggaaggggaagmctgctgcctgggtctctgcccagaatgtctgtctcctgtgagacaggaatagtcggtaagtgatagggcctgggaacctagtgggcaccggcttgttgacacgtttctatggtgggggaatcggttcttggtcagcaatctggctgctccagattctgcctgctgatataacttttctggggagttagccaaacctctaaaccccagaccttattcagagcttgaccttcttttactctaatcccaaagtactttgctctcctgtaattcccagaaaactgtatttgatttttaactgag

SEQ ID NO: 152731 - DNA, 601 bp, Human
ggggctaattcaaggtctgtgctattctaggacagcagattggcctagggtctaaatagaaaagaaagctttgtctcagaaagtctggagagccctacaggacgctgcatgtccttttcctgggtctggtgggaaaaacagggcagttgagtcttgcaaagaaaaaaagagaaataggttgtaaccttgcctcagtggttttaaaagtttcatgaattcaagaaaccatagtgcacttgttaaaaattccagttctaggaaccaggtccagagattttgattcaataggaagaggcaggcragggtatgtgcattttaaaaagtgatccttttacaagtggtccaagggtcattctcggaaaagcattgctttcgtcagtaggagtttatggtagagaagaatgaggaagtcccagaatctatcctggcatctgtacaggtctctaactgcaggctgcactgtctgggcttctctcttgcccttcaggcttcctggagaatgaaaacaatgactcatcatctttcaggattcaaaagtgtcacccattatcctaagcaaattaatccaggaacagaaaatcaaatactgcatgttcttact

SEQ ID NO: 152732 - DNA, 601 bp, Human
aggctgcactgtctgggcttctctcttgcccttcaggcttcctggagaatgaaaacaatgactcatcatctttcaggattcaaaagtgtcacccattatcctaagcaaattaatccaggaacagaaaatcaaatactgcatgttcttacttataaggggaagtaagcattgggcactcacggacataaagatggaaacagacactgggagcttcagaggcaggaaggagtgggggacagttgcaaaacttcctcttgtgctcagtacgtgggtgacagaatcaattgtaccccaaacctcwgtgtcaccccgcatacccatgtaacaaacctgcacacgtacccctctgaatctaaaataaaagttgaaattattggctggtcagggtggctcacacctgtaatcccaacatgttgggaggctgaggtgggcagcttacctgaggttgggagttcaagaccagcctggccaacatgatgaaaccccctctctactaaaaatacaaaaattagccaggtgtggtggcacacgcctgtaatcccagctacttgggaggctgacacatgagaattgcttgaacccaggaggcagaggttgcagt

SEQ ID NO: 152733 - DNA, 601 bp, Human
tacgtgggtgacagaatcaattgtaccccaaacctctgtgtcaccccgcatacccatgtaacaaacctgcacacgtacccctctgaatctaaaataaaagttgaaattattggctggtcagggtggctcacacctgtaatcccaacatgttgggaggctgaggtgggcagcttacctgaggttgggagttcaagaccagcctggccaacatgatgaaaccccctctctactaaaaatacaaaaattagccaggtgtggtggcacacgcctgtaatcccagctacttgggaggctgacacaygagaattgcttgaacccaggaggcagaggttgcagtgagctgagatcgcaccactgcattccagcctgggtgacagagcgagacattgtctcaaaatacaaacaaacaaacaaacaaaaaagttgaaattatttaaaaaaacacacacacaaaacacaaaagtgacaccattggcccttcatctttaatctcttccaaagcatttccagggcctctctgccccctttcacaccccacattcataatcaccaggagaagagatgtgattgggttcaaattaatatgaggctaccctattta

SEQ ID NO: 152734 - DNA, 601 bp, Human
gttcaaattaatatgaggctaccctatttagcttggatctttttctaggttcctgatcttggtgaaagattttcctattttgaacaaccctaaacaaattcttcctctgctcaaattattgtgaaactgaagtaatgtatgatccctcttctggatggttcgactcccttatatccagcctgtgcttggttgcctttggcttgggtaaggggttaagggtacctggctttgggacctctgtgagaggacctgcaggtatttcaggaaccatttgctttagggccatgtggccaggatcctccgcgaaggagggaaggtcagaggaagaagagcatatcctatcccaccctggcccttaagcaagaatcactccctcacacttcctctgacaagcatgggcagccttgacctatagctgccataataagtcattccttgggagaaattactccaaccccatacattccgcatagcaggttctagttctacatttcttctgcttgatcttgttttcctgattttgaattcttggctctacacaaatcccctttgactcttcccaatttgaaactctttcaggctttcctggtcatttttggac

SEQ ID NO: 152735 - DNA, 601 bp, Human
atattgccaaggctggtctcaaacttctggcctcaagggatcctcccaccttgacctcctaaagccctgggattataggaatgaaacaccgcacccagttctttttttcattttttaagagacagggtcttgccatgttgcccaggctggagtgcagtggctattcgcaggcctaatcccaccactgatcagcactgaagtttccaccttctctatttcctacctgggccagttcacccctccttaggcaacctgattgtccgtcaccccttggaggtcactatattgccatgcaacttaktgcagacacctgattgacatagtgcactacaacccagaactctggggctaagtgattctcctgcctcagcctcctgagtagctaggactgcgggtgcatgccaccatgccaggctgtgttgttttttcatcatcagaagtccttaatttttgtgtaacatgatttatcaatttttttctttatggtttattttggggggaagagcctaattttaagaaatcttattttaaaaatatttccatacctccaagatcaggaagttattcccctaatattaacttactcccccaatattaacta

SEQ ID NO: 152736 - DNA, 601 bp, Human
tccatacctccaagatcaggaagttattcccctaatattaacttactcccccaatattaactatctttcataagctttacagttttggttttcctatctgtcttcaaatcacttgaaatggattttgatatgtatgctgcttaatttttcccatgtagacacccagttgtctcagcattattggatgtgaagtccactgttttcctactgacctgcagtattagctgtcatacgttgcgtgtcatgtgcacagtgtttcttgggccgtctcttctgttccatcggctgacttagccatccytaaatcaacactgcactaacttaattacgatacctttatcgtgagtcttgataaacagtctggacttatgctctgggatctttaatcaatacttgtgggccccagaaaagatttcatgagcacatagaagtgtgggtgtggacatgttatggtctggtggagactgggcttatgttgtactttgggttatgatgcagaactatgttatctatttcgttgctcaaacggttccaactttggccactggggtttctttctgttggctcccctgtccctttgacatatgcctatcattttggt

SEQ ID NO: 152737 - DNA, 601 bp, Human
ggtcgatcctaggtcctgtagctaagacggtgtagggtccagcttctgacctaagtggtctatcccagagcctgtgttcttgaccgtcatggtatcttgcatccactaagaagtacaaacaggacccacagtacaaacaggaactcccaaactgccccgagagaaaacggcagctggtatgatccgctcagaggatttggagccgacaactctttccagtggttctttctctggcctcttcaggactaggctgaatttctgtcagcagaaggggattaagaggcaaaggaatggccaagtmccctagagaacctgttttctgcccagtccctgttggattccaaattctgatatgttttccatgagaaacaacccatttaaatctgtggcgagaacctgacactgctcgtttgaacctgacaccaggaatttagccccaggtgaatagcagttaaggacatgtgttattaagtaggtgaggccccttgggagcagaaattctttgctggtacacggttgtcaagtgctttagctgtaagtgcttagatcattgcaatgtgttattgtctcagatatttgctgtgaagggagtagctattct

SEQ ID NO: 152738 - DNA, 601 bp, Human
acaagcacccctattgggtagcacaggcctgttggaaatgctggagcccgcaagaatgttgtttcctgatcccctcccctgctgagaagcctctgagtgccagggaccagctcagggctcacctcgctggaatacaggctggttaacatcagagcctgggactcagaggaggctccctttcatgtttttaccctcaaagcctccctcccagcccacttggaaggctgggtgagcctcttgtcccggatcttttccagttgactctcagcactcaccacacttcccactaagtccatagatycctccactacccactcctcctttctgctgaaggcaacttggggtgatttttgtcatctagtcattcagcagatgcttactgattgcctcctgagagccaggtaatgtgaggatccctggacatgaaaacaaaagccacggttctggtccgaagacatccacagcctgtttgaacagagagacagcttcacaaggagatggtatgacgataggagtatgacaggaagaggggaagagcatctagcctggtggaggggttgccagactgagctctctaggaggccgtgtgagatgttgccac

SEQ ID NO: 152739 - DNA, 601 bp, Human
ctggaaggagggtaaagcaggctttatcacagagcattgaggtttgcaagaagagtggcagatttgtaggtgagaggtggttggtcgggctttgacaagttgcatttgtgaagtccatttgccctgagcagcagctagctagctcaagggggagatgtgtccagacgtggaagagaaagggtggagtctgtggcccccgagcctgtaaccacacagcatgaacggcaggtccctaagatgctctgcaggacagtgtccaccgtgggaggcagtcacctatccttcatcctgactcagtgcyttcattcccatcacctgagcctgattggtctcttttgtggtcccgcagccgttcctgcggtctccagctttcccacttctcccgccctccccatcccgcagcggctcaggagggactccagctgggttctgaattccaccctccatcctcaccactcagcctgactggagctggccaccgctgctgctttgggatgggggtgtgcttcagacagtcagagaagaaaccctgagtaatgctgacattgatgggccacgcagactatgatcagctccgggaatgtctgtgaaggagcagcca

SEQ ID NO: 152740 - DNA, 601 bp, Human
ctcccgccctccccatcccgcagcggctcaggagggactccagctgggttctgaattccaccctccatcctcaccactcagcctgactggagctggccaccgctgctgctttgggatgggggtgtgcttcagacagtcagagaagaaaccctgagtaatgctgacattgatgggccacgcagactatgatcagctccgggaatgtctgtgaaggagcagccaggggacagggctggcctggggggatctgcatccacacttcctgcagtcgtagtaattctcagtgatttctgcatatagrttggtctagaaagtctaaaaatagtctttaccgtcaaaactaactctctgcatgtttataccttggcttgggtgaactcgtttcagtttacctgtttcaacgcctagcacaatgcccagcatatagtaaaccctatacacttgttgaaaaaaaataaacaaaagtcacgggatgccgtaccctcccataatcgtaatgacgggaggcctgtggtggcagcctttctgcatcatgggtctgtgcagtggcctctcctgaagtgcagctggagttctcaaatgttcccagttttacatgttt

SEQ ID NO: 152741 - DNA, 601 bp, Human
tggcctctcctgaagtgcagctggagttctcaaatgttcccagttttacatgtttgcaagacattctgggaagtgaattctcaccttcgcaaaactctcctcacagattgtagtcacaccatttgttccgacagcaatttatctgacactaactggatgtcctactattcagttcaattcagacactgactacctggagttagtgtagaccctgcaagttaagagtgcaatactgcgagactgcctcccatttcagactagagctgcaagtttccggtatccccaagttatctgcatttcygcccaacagactacaaatttggggtctcctatgacctctcctcaaattcagtaattcactagaatggactcacagaactcaggaaagcactgtactgtcaaaggaaggaattatgattactgtcaaaggaaggaattacaacaaatttatttttaaatattctttagagacagtatctcactctgttacccaagcgagagtgcagtggtacaatcatagctcactgcagccccaaactcaccaggctcaagcgatcttcccatctcagtagctcctgagtagctgagtccacaagcacac

SEQ ID NO: 152742 - DNA, 601 bp, Human
gataaagacttcaggaagaggctgggcgcagtggtgcaagcctgtaatcccagcactttgggaggctgaggcaggcggattacttgaggccaagagttcaagaccagactgggcaacgtggcgaaaccccgtctttaccaaaaaatacaaaaattagccaggtgtggtggtgcgcacctgtaatcccacctactcaggaggctgaggcacaagaattgcttgaacccgggaggcggaggttgcagtgagccgagatcatgccactgcactccagcctgggcgacagagcaagacactgtcaaaaaaaaaaaaaaaaaaaaacttcaggaggaagtaaaaaacaaggtatcatgccaaactgcacagagaaaagcacttttctgtaatctttcaaatataaaattctgttgccagaaaaactccagcataatccctgtgacaggcctgggtcttgtctgttacaaacaagagagtgaatgtcggggtgtacttttccctgcagtttggaagcacaggtgcccactgacttggctccagggacatatttcttttggctgagaggctggggccatcgcctttaacatggtagaccctagtcagg

SEQ ID NO: 152743 - DNA, 601 bp, Human
gaaaccccgtctttaccaaaaaatacaaaaattagccaggtgtggtggtgcgcacctgtaatcccacctactcaggaggctgaggcacaagaattgcttgaacccgggaggcggaggttgcagtgagccgagatcatgccactgcactccagcctgggcgacagagcaagacactgtcaaaaaaaaaaaaaaaaaaaaacttcaggaggaagtaaaaaacaaggtatcatgccaaactgcacagagaaaagcacttttctgtaatctttcaaatataaaattctgttgccagaaaaactcmagcataatccctgtgacaggcctgggtcttgtctgttacaaacaagagagtgaatgtcggggtgtacttttccctgcagtttggaagcacaggtgcccactgacttggctccagggacatatttcttttggctgagaggctggggccatcgcctttaacatggtagaccctagtcaggcgcttttccagctaggactgaagggtcttccccgcatatggtttgagtcccataggaatttgaatgccaaagtagaatttccttggtaactttaaacctcttgaagccatttacaggctctg

SEQ ID NO: 152744 - DNA, 601 bp, Human
tcatggccacacttaaggtgaccacctctgggcatcttcctggggtctattgaacagaacacatcacttcctgcccctctgctcctgaagcactttatgtcgcagtgttgtggattagagtgcccctggatgagccctgtttgtctgtgttctaaagcacaggtgccagaaggcagaacctgtgttttctctggcccctgggagagggactggcatgcagcagctgctggagaataggaactgcatcttttttatctttggatccaccacagcattttcacattgaaaagaggtcagtagrtttttttagggtggtatggccgtagaccccatccaagtactagccaggcctgaccctgcctagcttccaagatcagatgaaatcaggtgcgttcaggtgagttttgttttgttttgttttgttttgtttgagacggagtcttgctctgtcacccaggctggagtgcagtggtgtaatctcggctcactgcaagctctgcttcctgggttcacgccattctcctgcctcagcctcccgaggagatttttttaattgttcatttaaatagagttcatgccctaaaacctttgcgagaacatc

SEQ ID NO: 152745 - DNA, 601 bp, Human
catttaaatagagttcatgccctaaaacctttgcgagaacatccttttacagatgaaagtccagatatgccatcctgtattgtagccatggtcggtataaccatgctcgtttccaaactgtcacagcacattgcatattttctctgatttgtgaaagataatatgtaaaaagtttcacaaaagcatgtgtgcacaaacatactaacagaggtttggtgttttttaatattgagtcatgtaatggggaaaaaagttgaaatcagctgtagctctgaaagctgaaatgtgtactgccatattygtcatggttttccctgctgttctggaattcttctgtgggagcaggaacactattttatatatgcatatcttctcttcatgaatgccagagactgggttttaaactttaaaaagtctcactcatactaggtgtccattcttgctgagtgattgaattattattctacaagaagataaaggagctgttgccgcacaagctgtctggtcttttgggtgatttgtattttacaaacaaacattcatttcctgtctacatttgacctcttttccagggaggttcccctgaaggatgctaaggaat

SEQ ID NO: 152746 - DNA, 601 bp, Human
ctacatttgacctcttttccagggaggttcccctgaaggatgctaaggaatacgctgaatccataggtgccatcgtggttgagacaagtgcaaaaaatgctattaatatcgaagagctctttcaaggaatcagtaagtacctgaaattgggttttcagcccaacttgcatttttatgcttctgggagtcaaaggataacattttagaactctgaagtgaacttttcctctgtgtgaatttatcggatgccatggatacaaaatctacagctatgcagttgttaatacccacttctattatmctctcgattctagatttccatgattctgtactggaacctgttcactctgagttctgtaaattaaaatgaagtaatcctgttgcaaaaataaaatttattttaattgaaaattatgcattctgtagcattttatgttaggaggagagagaaaatagacaaggtatagaactcaaggtcacccattagatgggatgactctaggtaaactgagggaaccttccagtaactttttttgcctgatcatctcctacaaaaagtaatgtctccatcctgtttgacctgaaattgggaattggatac

SEQ ID NO: 152747 - DNA, 601 bp, Human
gtttgatctctttcctgcctgagatcgtttttggcagagctctcaaagtcagagaagccgtggcttcccagaacagttttgatttctgtttaactggtttgagtgcattactttagactccaagaacccacaggagggaatcttttgtttatgttggcttgatggagaattcattggagatggggaattctgacctgtcttacctacactatgcagagatatgcaaaagaaatgtgcaaaagaatggcttggagcctcccctccccagctgctggccctttccttcactggggtcttcacycccttcccttctttccaccttccctttctttcctcctttgatttcttactctcaacagaatggtttcaggctccttgccctgaatggctgaactctagcaggctggggctggaatttcatgtgggaaaccccatgtccccacattcctctcccttctccatcatggtcagtgggtgcagatgctctctggtgttgtgtcactctgggtgacatctaagtttgggctcgaactcattacattagcctcacatttcctcagattaaactcattctcttctggtggcgttaggctcttctgct

SEQ ID NO: 152748 - DNA, 601 bp, Human
ttgatctctttcctgcctgagatcgtttttggcagagctctcaaagtcagagaagccgtggcttcccagaacagttttgatttctgtttaactggtttgagtgcattactttagactccaagaacccacaggagggaatcttttgtttatgttggcttgatggagaattcattggagatggggaattctgacctgtcttacctacactatgcagagatatgcaaaagaaatgtgcaaaagaatggcttggagcctcccctccccagctgctggccctttccttcactggggtcttcacccycttcccttctttccaccttccctttctttcctcctttgatttcttactctcaacagaatggtttcaggctccttgccctgaatggctgaactctagcaggctggggctggaatttcatgtgggaaaccccatgtccccacattcctctcccttctccatcatggtcagtgggtgcagatgctctctggtgttgtgtcactctgggtgacatctaagtttgggctcgaactcattacattagcctcacatttcctcagattaaactcattctcttctggtggcgttaggctcttctgctat

SEQ ID NO: 152749 - DNA, 601 bp, Human
aaacattttgtttttacaggtggttttaatgaatgaagctagatagctcctgaggacgattgccttagcaccttccatccttacagccccgcgtcttccgcagagccccctcctcctccttagctccctggccttggaagacccccagcacagatatcagtggtcagccaggggagcctggtgccttgtatgacctgaacttgagcttgagatctctgcaccagctgggaagctttctgaagtttatgaaagtcattgttaaaatttaaaaatatcaaataaggacctgaaagagaagaakcctgagtaggaagtactgtactaatatcttttttctttttttttctgagacagagtctttgttgctcaggctggagtgcagtagtgcaatcatagctcgctgcagcctccacctcctgggctcaagcaatcctccgacctcagccacctgggtagctgggactataggtgtgcaccaccacactcagctaaatttttggatttttagtagaatcaaggtctcgccatgttgcctaggctggtctcaatctcctgagctcaagcaatcttcccccatcggcctcccaaagtgccaggatta

SEQ ID NO: 152750 - DNA, 601 bp, Human
aaaaaatgcaataaaaagttaaggagctgtgaaaataaaagccctttaaaaaggtgtgtttaaacaaaatgaattcacattgactcggatgaagagatgaatgtttctcttttacagtcccatagtgttcataaaccagaaatgggacaactgtgttttctgaacattggcaaatacagtgtctaactggagactgcttacaaaaatatgttatctttttaaagactgaagctaccctgtaaaggatttaggtgctgctctgtttggggtggtctgtgcagtttgtcctcctcatataatrtattgtcgtctgattggtattcctccaggcacccttttctaaatcacatttttagacctactttgtctgcctgcatgtggctaattctcttccatgcatttctacccagggtttgtttatttttttttccttgggttcttacacccaaggaagaaaagtaaaaacttgaggttacttttggtttgttctgccattttgacacttaaacatattttatctttaattgattctccaagcgtttaggtatgtgcctgttcttctagggagattgcaagttctttgggagcttgtcttttgtat

SEQ ID NO: 152751 - DNA, 601 bp, Human
gaagcccctcaagcttttaaagcaggagtgcagagtgtccaatttacatttacaaaaaaagatcacacttaaaaggaggaaagtctccgcatgtctcaatcagttggcatgcgattgtaataatccaggagagaagtggcttggacgagggtggaggaagtggagctggatttcagaaatcttccagaagaaccaataacactggaaggagatggggaatgaggaagacagcgttaccaagagtcatccccaagttctgtttgccggaatgaggaggattggcataggaacaagtgatctrggctggatttggttatgagcctagcatataggattctggattgtggtgaacccaagttttggtttgtagattattattatttttttatttttagagatgaggtctcgctgtattgtccaggctggtcttgaactcctgggctcaagtggtcctcccgccttggcttcccaaagtgctgggattacaggtatgtgccaccatggccagctggtttgtggattttaattacttaactcgaatatctctttaaaagtattttaacttttcctgagggcaaagagaggtggagctgcaggctca

SEQ ID NO: 152752 - DNA, 601 bp, Human
gattattattatttttttatttttagagatgaggtctcgctgtattgtccaggctggtcttgaactcctgggctcaagtggtcctcccgccttggcttcccaaagtgctgggattacaggtatgtgccaccatggccagctggtttgtggattttaattacttaactcgaatatctctttaaaagtattttaacttttcctgagggcaaagagaggtggagctgcaggctcagcagaaaaatgtctggattggggtggaacccagcaaaatagctatgcattttgctccagttaatttaartgttgactgtggcagagaaagcaggactttctcctgaaaattacacttggagacactagagacattagaccaggttttatatttgttgttagtttgagagcaaggtgagaaacatttgttttattaaggtgaatatatgggcatggcggtgtgcacctgtagtcccagctactctggagactgaggcaggaggatcacttgggcccaggagtttgaggctgcagtgagctatgactgtgccaccgccctgcagcctgggcaacagaacgagatcctatctctaaaataaataaataaata

SEQ ID NO: 152753 - DNA, 601 bp, Human
gattttataatagtcagcaagctgtcaggtgaaggtaagtttagcagttaaggaacaaggaaaggacaaagacaaagtttgtccactttctcaccccaaaaaaagttaatttaccaaatgcaatccacttaagaaagtggacagactttcttacaccaagaaagttaatttagtgaatgtaaaataatgtcatttcggcatatgggcaagttgggtctcaaaaggcatgtcttttattccagcaattctaaagaagaaattcttcaggtgtgcaaacataataacaaggtttaatatgtayggagctctgattctgtgcttttgttgcaattgctgaaatatatacttagctcattaatgcacccttgatcctgtgaagtaggctctgttatcatccctgttttacagatgaggaaattgaggcctggagaggcttgtaactttccccagggcacacagctaataagtgagagacaggcaggcaggctccggggcacatgctcttagcttgtctatatcatgtcccattgcacagcgtggtttattgtaacattattcatgatagcagaaaacaggaaattactgaactgtccaaaagtta

SEQ ID NO: 152754 - DNA, 601 bp, Human
ttcaggtgtgcaaacataataacaaggtttaatatgtatggagctctgattctgtgcttttgttgcaattgctgaaatatatacttagctcattaatgcacccttgatcctgtgaagtaggctctgttatcatccctgttttacagatgaggaaattgaggcctggagaggcttgtaactttccccagggcacacagctaataagtgagagacaggcaggcaggctccggggcacatgctcttagcttgtctatatcatgtcccattgcacagcgtggtttattgtaacattattcatgayagcagaaaacaggaaattactgaactgtccaaaagttaggaaatagtttttaagaaatcatggtacacccatataaacaagtgattcaaaaggatgacataaatctttgtttactgacataaaaagatcaatcattgaatgtgaaatggaagttacagagcagttcatataatatccttatttcacaatatatctcatatttcataatatttcataatctatttcaatatcatatttcatatatttcataatatatttcaatatcatatttcataatatatttcaatatcatatttcata

SEQ ID NO: 152755 - DNA, 601 bp, Human
tacatgacactctggagaagacaaaattgtggagtcagtgaaaagatcagtggttgctgtgggttgtcggggaagggatgaattggtgggtcacaggatttttagggcagtgaaactgttctgtctgatactataaaggaggatacatgttattacatgtttatcaaaacccataaaatatacagtgccaaaacggaaccctcctgtgaactatagactgactatccttaatagtaatgtcttcagcaaatgttggttcatcagttgttacaaatgttccactaaactaagatgttaaaartgggagaaattgaagatgaggagaggaaggtatatgccaattctctatttttcactcaatttttttccataaaccaaaaactgctcaaaaaataaataaataaagtttatcaattaaaaaaagaaagagaaaggtgcctttgagtggtagggaagcctaatgattttttttaaggttttctttttttcttttcttttcttttctttttttttttttttaactttaaattccaggatacatatgcagaacatgcgggtttgttacacaggtatacatatgccatagtggtttgctgcacgt

SEQ ID NO: 152756 - DNA, 601 bp, Human
tgtgaactatagactgactatccttaatagtaatgtcttcagcaaatgttggttcatcagttgttacaaatgttccactaaactaagatgttaaaaatgggagaaattgaagatgaggagaggaaggtatatgccaattctctatttttcactcaatttttttccataaaccaaaaactgctcaaaaaataaataaataaagtttatcaattaaaaaaagaaagagaaaggtgcctttgagtggtagggaagcctaatgattttttttaaggttttctttttttcttttcttttcttttctttttttttttttttaactttaaattccaggatacatatgcagaacatgcgggtttgttacacaggtatacatatgccatagtggtttgctgcacgtatcaacacgtcatctaggttttaagccctgcatgcattaggtatttgtcctaatgctctcgctcccccacccccaacccctcaacaggtcctggtgtgtgatgttcccctccctgtgtccatgtgttctcattgttcaactcccacttatgagtgagaacacgtggtgtttggttttctgttcctgtgttagtttgctgagaac

SEQ ID NO: 152757 - DNA, 601 bp, Human
aaggtcattatcaagagtgaatactgccaagtcctagcaaacttggtcaagttactcatctagatgattcagaaaatcaaatcaagaaatggatgttacacagcaactgccagcattgctaacaccaaacaaaagataaccaagccaagtaaatactggaactggaatgaaaggagagaagaattacatacagtggaatggttagcgggagaatcagcgcttgcgcaggaaatggctggtccacggggaaagggaacagccccagctaagcttgctgttttatttttgttgtgtgtaaatrcatgacagcccagttccgagccaggataaaacttacaggctaggaatttgttttcacatactgtgttcctgtggaatcatttctaaaacctgcgtttcctctagactgtcaactttcaggaaaactgaacttaaaaaaaaaaaagtcttttaaacttctcctagacagcatcttacaaaatccaaaccctattaaaataaacactctggcctcaaatttatgctcaaggacaacttgttctggaggctgactacttagagcacattttgtaagagtggaaacctacagactatgctcaga

SEQ ID NO: 152758 - DNA, 601 bp, Human
tgtaaatgcatgacagcccagttccgagccaggataaaacttacaggctaggaatttgttttcacatactgtgttcctgtggaatcatttctaaaacctgcgtttcctctagactgtcaactttcaggaaaactgaacttaaaaaaaaaaaagtcttttaaacttctcctagacagcatcttacaaaatccaaaccctattaaaataaacactctggcctcaaatttatgctcaaggacaacttgttctggaggctgactacttagagcacattttgtaagagtggaaacctacagactakgctcagagccttttcagatgtttttgtatatatttttgtcctgctctatgcctgtgtaaataatactgattcaacagagttccaaggtgatcaccttggtacagaaagccatggccattttccaaaaccatgcctttgtgtaagtgccttgaaccttccggtaaattctgaataccttaggccctaagatcggggtttgcgttcggggtttgctttcttgttttgcgttctggtttcctggtgcaggctcccttctccttttaaaggtgccggcctcattgttatgatctggcttttctc

SEQ ID NO: 152759 - DNA, 601 bp, Human
aacactctggcctcaaatttatgctcaaggacaacttgttctggaggctgactacttagagcacattttgtaagagtggaaacctacagactatgctcagagccttttcagatgtttttgtatatatttttgtcctgctctatgcctgtgtaaataatactgattcaacagagttccaaggtgatcaccttggtacagaaagccatggccattttccaaaaccatgcctttgtgtaagtgccttgaaccttccggtaaattctgaataccttaggccctaagatcggggtttgcgttcggsgtttgctttcttgttttgcgttctggtttcctggtgcaggctcccttctccttttaaaggtgccggcctcattgttatgatctggcttttctctttctctgcgtggaagcatttccttctccctgtgtttaaggttggcatgtgtgtgacttatcccaggctgagagttttgtagatgagatgggtcccggtccactaactgaaccctgagaattgaccgtgaccatgaatcacacagcatttctccccgccatgcaaaacccatgagccgtgcccagaagccctcaactgctggggact

SEQ ID NO: 152760 - DNA, 601 bp, Human
gataaatttaaaagaatagcatgtccagaaaaggaaaattcatacttatggtctcctttcctcctggattgggactgaagtttttggagatgtcctgcaaaagctctgtagatctctgttggctacacaaaatggcaaaagccacagctgcagaaattgttgcaaacttttcatttgcttcatcatcaaatgaagatctctactattacttttgagtttggagttaaatgctggtgaccttcatctttatgctgaagctttggtgactgtctataccatctgatctacacaatgtattatyacctttgaaatcaactctttttgtcccttgtggaaatgcacctctgctggggtgttttggtgctctatattgtcattaggtaacacccacttgcattaaaagactttgtcagggcccagcgcatagtcagtattccgtgctatcagtgtgtgttcagattctcctcttactggttttcttagactgtactgttttctaagcaaatgcccatgtgtgatttttaagatgtgctggggaaaaataaatcaataccacaaccaaaaaaaaaaaagactttgtctttagaaccaatttcccttc

SEQ ID NO: 152761 - DNA, 601 bp, Human
gtttttggagatgtcctgcaaaagctctgtagatctctgttggctacacaaaatggcaaaagccacagctgcagaaattgttgcaaacttttcatttgcttcatcatcaaatgaagatctctactattacttttgagtttggagttaaatgctggtgaccttcatctttatgctgaagctttggtgactgtctataccatctgatctacacaatgtattattacctttgaaatcaactctttttgtcccttgtggaaatgcacctctgctggggtgttttggtgctctatattgtcattargtaacacccacttgcattaaaagactttgtcagggcccagcgcatagtcagtattccgtgctatcagtgtgtgttcagattctcctcttactggttttcttagactgtactgttttctaagcaaatgcccatgtgtgatttttaagatgtgctggggaaaaataaatcaataccacaaccaaaaaaaaaaaagactttgtctttagaaccaatttcccttccacttctaattactggttccttagcaaatgaatacactaactagccaataatatagatagatagatagatagatagata

SEQ ID NO: 152762 - DNA, 601 bp, Human
actttgtcagggcccagcgcatagtcagtattccgtgctatcagtgtgtgttcagattctcctcttactggttttcttagactgtactgttttctaagcaaatgcccatgtgtgatttttaagatgtgctggggaaaaataaatcaataccacaaccaaaaaaaaaaaagactttgtctttagaaccaatttcccttccacttctaattactggttccttagcaaatgaatacactaactagccaataatatagatagatagatagatagatagatagatagatagatagatagatagatagatagatagatagatagatagatagatagatagatagatagatagatatagatattcattttagcctaggcctggtggctcatacctgtaatctcagcactttaggagaccaaggtgagaggatcacttgaggccaggagtttgagaccagcctgggcaacatagcaagaccctatctctacaaaaaaaaaaaaaaatttatcggggcatggtggcgcacacctatagtcccagctactcagaaggttgaggtgggaggatccctttagccccggaattcgaggttgcagtaagccatga

SEQ ID NO: 152763 - DNA, 601 bp, Human
tgtcagggcccagcgcatagtcagtattccgtgctatcagtgtgtgttcagattctcctcttactggttttcttagactgtactgttttctaagcaaatgcccatgtgtgatttttaagatgtgctggggaaaaataaatcaataccacaaccaaaaaaaaaaaagactttgtctttagaaccaatttcccttccacttctaattactggttccttagcaaatgaatacactaactagccaataatatagatagatagatagatagatagatagatagatagatagatagatagatagatagatagatagatagatagatagatagatagatagatagatagatatagatattcattttagcctaggcctggtggctcatacctgtaatctcagcactttaggagaccaaggtgagaggatcacttgaggccaggagtttgagaccagcctgggcaacatagcaagaccctatctctacaaaaaaaaaaaaaaatttatcggggcatggtggcgcacacctatagtcccagctactcagaaggttgaggtgggaggatccctttagccccggaattcgaggttgcagtaagccatgatcaa

SEQ ID NO: 152764 - DNA, 601 bp, Human; identical to SEQ ID NO: 26866

SEQ ID NO: 152765 - DNA, 601 bp, Human; identical to SEQ ID NO: 26867

SEQ ID NO: 152766 - DNA, 601 bp, Human; identical to SEQ ID NO: 26868

SEQ ID NO: 152767 - DNA, 601 bp, Human; identical to SEQ ID NO: 26869

SEQ ID NO: 152768 - DNA, 601 bp, Human; identical to SEQ ID NO: 26870

SEQ ID NO: 152769 - DNA, 601 bp, Human; identical to SEQ ID NO: 26871

SEQ ID NO: 152770 - DNA, 601 bp, Human; identical to SEQ ID NO: 26872

SEQ ID NO: 152771 - DNA, 601 bp, Human
ttagcacgtgtagactcttgtaaccactacaatcaagttacagaactacactaccaaggttcatctttttaaaatctttgatgttacctttttcggaacagtgaccatgagaggactttcctcccaaaattttgagaactactgaaccagaatatagtctgacactaataggtagaaatttaaccaaaggagattatgaagctctgcacttcagttaacaaatcacttctcagcttccagttccatctcagaaggaaggaaagggattaaaatccagagaccagaaatgggagcaaagtayaaggtggtgtaatcattacagaggtttcctgatgtttccaagtcagtcgtgtgttgagctgctaaactctaaagtaattttaggtggaagtgttggaaacatgctgctgaggtgatagaaaggaatccatggtcctctgttagttggaaagtatatggaatactatattctacataagatacaacactctctgtgagacaaggataaagtagattttgtcagtgaaattgtgacaagaatcgctgatgggtttagagcctaagtttgcgaggagcactggaagaaattaagattgttgag

SEQ ID NO: 152772 - DNA, 601 bp, Human
tacagattattcaggacagggagttgaccaactgcaaagagtgattgacaccatcaaaaccaaccctgacgacagaagaatcatcatgtgcgcttggaatccaagaggttgaaagaaccccgtcgtcttcatttatactaaccatactcttagagggaagcaatctggttttgtgcagaggcacctgagggaggcaggaccctgggaacttcccccagccacatggttgattgtgtgacgttgggcaagtcacattttgctgcactttcaccttcagatcatgaggttgggcccagaggattttttttttttttttttttttttgagacagagttttgctctgttgcccaggctggaatgcaacggcgtgatcttggctcactgtaacctctgcctcctgggttcgagtgattctcctgcctcagcctcccaagtagctgggattacaggcatgtgccaccatgcccggctaattttgtatttttagtagagacggggtttcaccatgttggtcaggctggtcttgaactcctgacctcagatgatctgcctgcctcagcctcccaaccagatgatcttaatttgtgtatttatactcatt

SEQ ID NO: 152773 - DNA, 601 bp, Human
ggttttgtgcagaggcacctgagggaggcaggaccctgggaacttcccccagccacatggttgattgtgtgacgttgggcaagtcacattttgctgcactttcaccttcagatcatgaggttgggcccagaggattttttttttttttttttttttttgagacagagttttgctctgttgcccaggctggaatgcaacggcgtgatcttggctcactgtaacctctgcctcctgggttcgagtgattctcctgcctcagcctcccaagtagctgggattacaggcatgtgccaccatgccyggctaattttgtatttttagtagagacggggtttcaccatgttggtcaggctggtcttgaactcctgacctcagatgatctgcctgcctcagcctcccaaccagatgatcttaatttgtgtatttatactcattcttacaccaaaaagggttttaaattgcctagaaactacatgtaagatgttaacattttaaatggaagcagatgaagttccagctcgctgccacctcactaacatttttaacaattatattgtaaaattcaactctaccagggtgtagagccaggtgtggtggctca

SEQ ID NO: 152774 - DNA, 601 bp, Human
tttttttgagacagagttttgctctgttgcccaggctggaatgcaacggcgtgatcttggctcactgtaacctctgcctcctgggttcgagtgattctcctgcctcagcctcccaagtagctgggattacaggcatgtgccaccatgcccggctaattttgtatttttagtagagacggggtttcaccatgttggtcaggctggtcttgaactcctgacctcagatgatctgcctgcctcagcctcccaaccagatgatcttaatttgtgtatttatactcattcttacaccaaaaagggytttaaattgcctagaaactacatgtaagatgttaacattttaaatggaagcagatgaagttccagctcgctgccacctcactaacatttttaacaattatattgtaaaattcaactctaccagggtgtagagccaggtgtggtggctcacacctgtaattccaacaactccagaggccaaggcgagaggatcatttgaacccaggaatttgaggctgtagtgagtcatgatcacgccattgcactccagcctgggcaacagagtgagaccctgaatatttaaaaacaacaacaacaacaa

SEQ ID NO: 152775 - DNA, 601 bp, Human
ccttctcttgataaaaggttgactgtggaacaggcatctgctcaatgctgtgtccaagataaagatgactgctccaaatgtggggcttcagtttagggagaagtggtgggcaggtgggcaggacaaggcaggcatctgcctcagcaaccatgggcacttaacatgtcaggtgctgtgaggtactaagcaccagtaccagagagggaagagccacattcaagccaggggattgtccaaaagggggcattttaactcattttaacttgaaggagaattgaagtgcaaatgtttttccttttcttttttttttgagatggagtctttctctgtcggccaggctggagtgtgccgtggtgcgatctcagctcactgcaacctccacctcccgggttcaagcaattcttctgcctcagcctcccaggtagctgggattacaggcacatgccaccacacccagctaatttttgtattattagtagagatggggtttcatcatgttggccaggctagtctcaaactcctgacttcaagtgatccacctgcctcagcctccgaaaattctggaattacaggcataagccaccaccctggccataaatat

SEQ ID NO: 152776 - DNA, 601 bp, Human
gcccgctctagaaaggccgcctcgggagtaccacccactcctgacggggcggggagttctctccgaccccacccgttccaaggacgcagccctgtgattggccatgacgcgtgccagagctgcccagtcgcggaagagcagctgttttggcgtctgtttgctgcggtaggaacatggcggatcggctcacgcagcttcaggacgctgtgaattcggtgaggaatttcattcgattagcctctgtctttctctttcttgaggtaaagcaagggaggaaaggggcccaagaggcaaaacttgraagtggggagcggactgagagacagggcttcggcataaagcgctctctcgggaggcgccaccgcgaactcggaggtttgaggccggctgccgggcggtgcttgaaggtgcgggagggagcagactctttcgcttgaggagaccgggaagatcgttcttgtccgggtgaggccgccaggacttgtgggctgcgcggtcctgtcgtgttccctgaggacagttttattttcttgtcagtggtgcttacgggttctctttcttttgggggttgggaggagaagcaggagcttttttctttcct

SEQ ID NO: 152777 - DNA, 601 bp, Human
ctacagaaggtaaacaggttttcttagcttctcttagtttgactctcacattttttgtaatcctttaaaattagatttcttgagaaattcagcttattttatttctaaaattattgttgtttgagaatattacaagttttgtttgttgtaaaaaatttacagtcaattcacctaacatctcataattctggttcatgtcagataatagattgttactcctttagaggagaatttgtattaatttagctgagtgagggaccttaacaaggaaggcatcccatttataaatttctttattcargtgaccactatattgtcataataaatgaaattacatacattatgcttaattcccaatttgagctaaatgtgtaacaggattggtgtatattttaatcattagaatcttctttttttttttgagacggagtctcgctctgtcacctaggctggagtgcagtgatgcaatcttggctcactgcaactttcgcctcccgggttcaaggaattctcctgcctcagcctcctgagtagctgggattacaggctcatgccaccacgtctggctaatttttgtatttttagtagagatggggtttca

SEQ ID NO: 152778 - DNA, 601 bp, Human
tttggagacagactaaggaagagaaaccaacactctctcaggaccaagctggattcttctgaaagtcgcagtgaggtagtaacaaggaaacaaagttgccacaaatcacgggaagcttcctgcaaagttatgatacagttgttgcaagaaaaatgcagcttaaagccaggaatggtggctcacacctataatcccaacactatgggaggccaaggcggcagatcacctgaggtcaggagttcgagaccagcctggacaacatggtgaaaccccatctctgctaaaaatacaaaaattagcygggcatggtggtgaatgcctgtaatcccagctacttgggaggctgaggcaggagaactgcttgaaccccggaggtggaggttgaagtgagccaagatagtgccactatccagcctgggcgacagagcaagactccctctcaaaaaaagaaaaaatgaaaaatgcagctttagcaagaatggaagtcactgaggttggactgcagaaaagactacctaacattggaacaattatgaactctccttggagaagctcttactgggttgaaatggctcatgttcggccaggcatggtggctcag

SEQ ID NO: 152779 - DNA, 601 bp, Human
gagcaggcctgagaggctcagtggcttggagactggtatggccatgttgccataggagtatgggggatctgggacatgggatgtggatgctgggagctcataaggtggtggaggaagtgggaagccagaatctgggtggattgagcaggggcagtaagttgtgggtggtggaggtccaaggtatggagctggggcttggggctcaaatgatggctcacttggagcattcagaccctgcaaggaaagacacaaagagatttggagacagactaaggaagagaaaccaacactctctcaggamcaagctggattcttctgaaagtcgcagtgaggtagtaacaaggaaacaaagttgccacaaatcacgggaagcttcctgcaaagttatgatacagttgttgcaagaaaaatgcagcttaaagccaggaatggtggctcacacctataatcccaacactatgggaggccaaggcggcagatcacctgaggtcaggagttcgagaccagcctggacaacatggtgaaaccccatctctgctaaaaatacaaaaattagccgggcatggtggtgaatgcctgtaatcccagctacttgggaggc

SEQ ID NO: 152780 - DNA, 601 bp, Human
ccatcggcagcctgttgcagcgcgtactcttcaggagagtagctgttgcctgattcatcccgaaggtgctggaaaatgtcacggtacagctctgtcagctgttggcgcatgacctccagggtccggtctgcctccccgcgggccctgagaagccgctcccgttcattggtcagccgctccagctcccgctccagctgcacaatggtttccagcttcctcttgcggcagttctgggctgccaccttgtttttgccccgtcgtcggatgtcccggactagcgctagctggctctctgtcagcgggtaccttgccaatagctcattaaagtcatctaccggcaagttgacaatcttgtccgtaggaaaaggaatcttcatggccaaggcccgacgttcatcccgactccctgcctccccccgtgcagtgggcttagcccgcacagggcctgaggagggctctaaggccaagggggtctcagcagctggcaaggtatagttggagtgggccaaggagttgggcatgagtgagtaggggtactccactgggtacatctctacatattcgctgcgccgccgaccagcctctgtcccctccagctcaa

SEQ ID NO: 152781 - DNA, 601 bp, Human
gagcgcaacggaggtcgaaggcgttcagactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgaccgtaaggatctcctggcgggcagtaggacaggtgtccagaaccccggcggacatatgtccgcgaggggctgcagtctccccgttccatccagtcaccccggcgtcagctccccttccggccagtcacccccccsgcctggctccctactccggccggtcacccccggcctggctgccccctccggtcggtcaccaccatccgggtccccatctggcccgtcacccctgcccgggtcctcctccggccggtcacccccgccccggtcctcctccggccggtcacccccgccccggtcctcctccggccggtcaccccccgcaggttcccctccggccggtcatccccccgcaggttcccctccggcccgggtcctcctgcggccggtcaccctcggatgcttagagaagtgaagaaacttggggcttggttgttg

SEQ ID NO: 152782 - DNA, 601 bp, Human
tggctgccccctccggtcggtcaccaccatccgggtccccatctggcccgtcacccctgcccgggtcctcctccggccggtcacccccgccccggtcctcctccggccggtcacccccgccccggtcctcctccggccggtcaccccccgcaggttcccctccggccggtcatccccccgcaggttcccctccggcccgggtcctcctgcggccggtcaccctcggatgcttagagaagtgaagaaacttggggcttggttgttgttgggttggttggtttttaatcataacagtaggtcwtaaaagcagtgagaatataagaagctggctgggtgctgatggtgacaactgcacaagaactccaggtcatacaagatttgctcacacacaaagatttggtatcttaacacctctggctataagacacttttagtgttgaaactcatgcaggaaaaataattattattgccagtgggaaactctaccagagctgacaaacttgagtgtctttaggctctgaacagtaatttgaatgtagcgaggagtggtggagacccggccagtttgtgacttctctgccaagaatgtttataaacactt

SEQ ID NO: 152783 - DNA, 601 bp, Human
acccctgcccgggtcctcctccggccggtcacccccgccccggtcctcctccggccggtcacccccgccccggtcctcctccggccggtcaccccccgcaggttcccctccggccggtcatccccccgcaggttcccctccggcccgggtcctcctgcggccggtcaccctcggatgcttagagaagtgaagaaacttggggcttggttgttgttgggttggttggtttttaatcataacagtaggtcataaaagcagtgagaatataagaagctggctgggtgctgatggtgacaactgmacaagaactccaggtcatacaagatttgctcacacacaaagatttggtatcttaacacctctggctataagacacttttagtgttgaaactcatgcaggaaaaataattattattgccagtgggaaactctaccagagctgacaaacttgagtgtctttaggctctgaacagtaatttgaatgtagcgaggagtggtggagacccggccagtttgtgacttctctgccaagaatgtttataaacacttttttcttctgaaatatttttaaatttattttaaataaatggcagttttcttt

SEQ ID NO: 152784 - DNA, 601 bp, Human
gaagaaacttggggcttggttgttgttgggttggttggtttttaatcataacagtaggtcataaaagcagtgagaatataagaagctggctgggtgctgatggtgacaactgcacaagaactccaggtcatacaagatttgctcacacacaaagatttggtatcttaacacctctggctataagacacttttagtgttgaaactcatgcaggaaaaataattattattgccagtgggaaactctaccagagctgacaaacttgagtgtctttaggctctgaacagtaatttgaatgtagcraggagtggtggagacccggccagtttgtgacttctctgccaagaatgtttataaacacttttttcttctgaaatatttttaaatttattttaaataaatggcagttttctttacaacagaataagtcccttagatatcagatctataaagtacagtaaggcatagaatactgttttcttctgaatgtcctaaaactcattcaagaggtgctgccctggcctagcgcttagaatttgataacccagattaccctggttgataccgaagcagataaggaattatttagaggtgggttttgtt

SEQ ID NO: 152785 - DNA, 601 bp, Human
gatggagtctctttctgttgcccaggctggagtacagtggtgcgatctcaactcaccgcaacctctgccccacgggttcaagcaattcttgtgcctcagcctcccaagtagctgggattacagcacatgccaccatgcccagctaatttttatatttttagtagagacggggtttcaccatgttggacaagctggacttgaactcctgacctcaagtgatccacctgccttggcctccccaaagtctgggattacaggcatgagccactgcgcctggctggatcatatttatttttgtaamcccagcactgctacctagtaaacacccaataaacattcttttggaaatgatctttgagccatggtctacagtaacagcaacccttgtacaaaattgtgtgaataaatggcctgaccccagtcagagaaccatgaattgtttatccctaactctgttcctgagggtaatacccaacataggtttctgctctgagtttctcaaggcagcctaatcgttaatcctcagaactcttcatttctgactttcccattttaatgagagtactgatcacagaaagcagtgccctctccaggctcgcat

SEQ ID NO: 152786 - DNA, 601 bp, Human
ctctttctgttgcccaggctggagtacagtggtgcgatctcaactcaccgcaacctctgccccacgggttcaagcaattcttgtgcctcagcctcccaagtagctgggattacagcacatgccaccatgcccagctaatttttatatttttagtagagacggggtttcaccatgttggacaagctggacttgaactcctgacctcaagtgatccacctgccttggcctccccaaagtctgggattacaggcatgagccactgcgcctggctggatcatatttatttttgtaaccccagcastgctacctagtaaacacccaataaacattcttttggaaatgatctttgagccatggtctacagtaacagcaacccttgtacaaaattgtgtgaataaatggcctgaccccagtcagagaaccatgaattgtttatccctaactctgttcctgagggtaatacccaacataggtttctgctctgagtttctcaaggcagcctaatcgttaatcctcagaactcttcatttctgactttcccattttaatgagagtactgatcacagaaagcagtgccctctccaggctcgcatagccagcc

SEQ ID NO: 152787 - DNA, 601 bp, Human
gagacggggtttcaccatgttggacaagctggacttgaactcctgacctcaagtgatccacctgccttggcctccccaaagtctgggattacaggcatgagccactgcgcctggctggatcatatttatttttgtaaccccagcactgctacctagtaaacacccaataaacattcttttggaaatgatctttgagccatggtctacagtaacagcaacccttgtacaaaattgtgtgaataaatggcctgaccccagtcagagaaccatgaattgtttatccctaactctgttcctgagrgtaatacccaacataggtttctgctctgagtttctcaaggcagcctaatcgttaatcctcagaactcttcatttctgactttcccattttaatgagagtactgatcacagaaagcagtgccctctccaggctcgcatagccagccattactgatgcccagatttgccccaaggaacagactctggcacctgcccttgtgttcttctgtgaggactgcatcgcttgtaggcactgaagtaaattattgccaagtgtggcgccatagtcttcccatagtgctcttttttctttttttcttct

SEQ ID NO: 152788 - DNA, 601 bp, Human
aaagcagtgccctctccaggctcgcatagccagccattactgatgcccagatttgccccaaggaacagactctggcacctgcccttgtgttcttctgtgaggactgcatcgcttgtaggcactgaagtaaattattgccaagtgtggcgccatagtcttcccatagtgctcttttttctttttttcttcttttgaaacagagtcttgctctgtcacccaggctagagtgcaatggcacaatctcagctcactgcaacctctgcctcctgggttcaagcgattctcctgtctcaccctcccaaagtagctgggattacaggcatgcgccaccacacccagctaatttttgtatttttagtagaggcggggtttttccatgttggtcaggctggtcttgagctcctgacctcaggtgatctgcccgcctcggcctcctgaagtgctgggattataggcgtgaaccatcacgcccagcccatagtgctcttcagtgtcagttataatgaccaaagttctagcactgtggcctcaacctctaggtctacaactgcattttactaagtgctaggataagagatgtctggaagtcccctatcctgtt

SEQ ID NO: 152789 - DNA, 601 bp, Human
cagactctggcacctgcccttgtgttcttctgtgaggactgcatcgcttgtaggcactgaagtaaattattgccaagtgtggcgccatagtcttcccatagtgctcttttttctttttttcttcttttgaaacagagtcttgctctgtcacccaggctagagtgcaatggcacaatctcagctcactgcaacctctgcctcctgggttcaagcgattctcctgtctcaccctcccaaagtagctgggattacaggcatgcgccaccacacccagctaatttttgtatttttagtagaggcrgggtttttccatgttggtcaggctggtcttgagctcctgacctcaggtgatctgcccgcctcggcctcctgaagtgctgggattataggcgtgaaccatcacgcccagcccatagtgctcttcagtgtcagttataatgaccaaagttctagcactgtggcctcaacctctaggtctacaactgcattttactaagtgctaggataagagatgtctggaagtcccctatcctgttctaggttgatctggatgtgtgctagaactgtcctttctccatatgacaagtggaataacgacaga

SEQ ID NO: 152790 - DNA, 601 bp, Human
tttttgtatttttagtagaggcggggtttttccatgttggtcaggctggtcttgagctcctgacctcaggtgatctgcccgcctcggcctcctgaagtgctgggattataggcgtgaaccatcacgcccagcccatagtgctcttcagtgtcagttataatgaccaaagttctagcactgtggcctcaacctctaggtctacaactgcattttactaagtgctaggataagagatgtctggaagtcccctatcctgttctaggttgatctggatgtgtgctagaactgtcctttctccatrtgacaagtggaataacgacagaagctgccattctctagctgttaaaggctataccgtgtatgggaaatactacagtagatccactttcacaacttcgtggtgcttcttgttggcaacaccttgttggcaacactgaccctgtcctagaacagtatatgcaatcctgcccacagcttccatgggacttaatgaagagcagaaagaatttcaaaaagtggcctttgactttgctgcccgagagatggctccaaatatggcagagtgggaccagaaggtaggcgtttttcttgtgcttagacg

SEQ ID NO: 152791 - DNA, 601 bp, Human
ggattacagatgtgagccaccgcacccggcccctctcacccttttcctcaatccaaagatggaactgccagtgatttgaggaagtaatagaaactactaatagaaagcacatataactctgatttttagaggctcgtgtaacctaactagaagtagtacaaacgtgctggtgagaagtacctcagcctggttatctctgggtagtccttattccaggaatatgttttaatccaccgtttgcctttaaagagtcttcccaattgtgactctccccttcccactcttctgctttactccactkccctgccctttgttctctttccccttctcccccatttttttttcttttccatctttatttctgtcattgtcttttcttcttggtgtacctatcagcatgtgtgcctggatgattgatagcttcggaaatgaggaacagaggcacaaattttgcccaccgctctgtaccatggagaagtttgcttcctactgcctcactgaaccaggtgaatttgccacactgcactgagatatagcagggagagatgcttcctgctcagatggcattaccgagcactccttccagcctcttgacatgtcg

SEQ ID NO: 152792 - DNA, 601 bp, Human
ccctgtgctgcagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccgtaagtgattcctctggctctcctgggatggacagggaacagctgctaggcccaggggtcttgagagacatgagtcagatttggaacccagccctcctggaatcccacaaggatcaccttaagcttaaggatataaatgaactcatgagcggcctatgtgggagctctcatcgctggcttttaggcctgctgcatgccattatacacttcattatgtcactgttgtttggttgtgttctaggcgagaaaccacctttggaaggttcacagcagccccaatttagcactctgccatgtttacattgtcaggctgcattgccactagggggaaccatagctttttatcatcccagccagggtggctgtgggcagcttctgcctggcaggtaataagggagaggggcagagggctttgagtcgcctgtctggggggaa

SEQ ID NO: 152793 - DNA, 601 bp, Human
atacagaatgtggaggccctctttgagcttggctgtttgtggttctttcatgggtttatggcgggctgccagatcgtgggctggggtaggaagggaagctgcttgctccacagtcttcccagagtccaagacgtctagtccctgtctccctgcagatctgcaaccaggccttgcagatgcacgggggctacggctacctgaaggattacgctgttcagcagtacgtgcgggactccagggtccaccagattctagaaggtaaaaattgccagaggttattctcttcccttcagaacggggrcgggatcgctgctttccccactctctgtccccatgcctcctgggcctcagggtgcagtcaagccctgtctgtctcgaggcttcctcctccctcccgttccgcagagctgttctggcaggggcctggagtccagagccgcagcttcgtccctttcggggggcctcagatcgctctgctgctgcccttttcctctggagatctgcgagaagggtgaactgagataatggatgagaaagcatgttgaaaaccacagccggggcttttctctaaggttatcgagtacgtggttctcagggatcc

SEQ ID NO: 152794 - DNA, 601 bp, Human
ggcaggtatccgggatggtccctctccctaacccgggcaaggagcatcggtgaccgctgcaagccctcggcagcatcccagcttggcagcccctccccctggcctccccaacccggcgccctggggaggatggggcacttacaggcggcggctgagaccctccaccgagcgcccgcaggagggcaccgcgtagctcagcaggaacaccgcgacgctccactgctgaaccagtctccgctgcatcgtctccgctcgcgctcgggacctgcaacagaagggaatgggacccgagtgtcagtcwggactctccatctccccgcactactccgctccccctttttagcccgctctcaaaaagcctcttcaacatcaagggcatctcccaagttgaaaagaaaaaaaatttctctggagcctctcagcacttacttatttagcaaccggctactccaactgtgctttctccaaaccacacagccagaaagagcaaaaagggaaaaaagaaacaaatcagaggcgcttcctctgaaataatagcgaaaataaaatggttttatatatgcatcaatgataagtagtgtgtttacacgtctcccatagc

SEQ ID NO: 152795 - DNA, 601 bp, Human
attatataatacgcttttattatgtaatgtgttcctattttatatgcttaaaattatgtcattcataataaaattagatgtacggcttttgctttttcacacgcaaaccgccacccacattcagtatgtatacaagcgcgcaggccatacgtccccaggaccgctcagcttcctccgagtttcagaagcttcccgggtcctgacagtaaccaccaccccccaactttttttcttttccactagaggcagaggatctttccctagaagagattctgtgaaacgctccctcttatggaaacasacataaagtctctctcttgcctgtctcccgttgaagatcaaccagttctcctgccaggtttgaggacccgggctcaggccccggcaggtatccgggatggtccctctccctaacccgggcaaggagcatcggtgaccgctgcaagccctcggcagcatcccagcttggcagcccctccccctggcctccccaacccggcgccctggggaggatggggcacttacaggcggcggctgagaccctccaccgagcgcccgcaggagggcaccgcgtagctcagcaggaacaccgcgacgctcc

SEQ ID NO: 152796 - DNA, 601 bp, Human
aaaaggttccacacctaaaattcattttggaatcaagcgctctagcgttcctgaactgtatcaatactaacattggagtcgtgccactgcaaagttgttgctactttattatataatacgcttttattatgtaatgtgttcctattttatatgcttaaaattatgtcattcataataaaattagatgtacggcttttgctttttcacacgcaaaccgccacccacattcagtatgtatacaagcgcgcaggccatacgtccccaggaccgctcagcttcctccgagtttcagaagcttccygggtcctgacagtaaccaccaccccccaactttttttcttttccactagaggcagaggatctttccctagaagagattctgtgaaacgctccctcttatggaaacacacataaagtctctctcttgcctgtctcccgttgaagatcaaccagttctcctgccaggtttgaggacccgggctcaggccccggcaggtatccgggatggtccctctccctaacccgggcaaggagcatcggtgaccgctgcaagccctcggcagcatcccagcttggcagcccctccccctggcctccccaa

SEQ ID NO: 152797 - DNA, 601 bp, Human
aatggcatcagtataaactaggtatacagaggtagtgagtaataaattcaaattaaggacgttttcaatttagataactctgaaatatttaagttgtaaatatggcctcaataatagtcttttactcaatttgtctgtaaacattacatagcactatggttcacatgacacttacatacctaagctccaaaatggaaaaacaggtaggttatgtatcatgttctcctttgattattgtaaaaaaaaattgcaaaattttggggaaatgcttatcatagataaccctaaattcagcccaaayatagttcttctcctttaaaaaaaaaatcactccaagggagtttttagggaagaagcttagatttctaaggaactatcaaggaacagagggcataaaaacagtgatggaaattccctttccagcacaggaagaagcagtatgcttgtactgatgctaggcttctaaggacggactctgtgtttgagaagaaaagttctgtggtacatgcaagagacagggttagggtgttagagttaagatgactcaccagaaggtccttccaacccaaatgactcagtagaaagttatgcttttcattaa

SEQ ID NO: 152798 - DNA, 601 bp, Human
ctaaattggaaatgctgttagacactttacttagtatttcaaaaacttctgcaattaaagtattgtgaagaatgaatctctcactaggcagttgcattagaggatcaggaatataatggcatcagtataaactaggtatacagaggtagtgagtaataaattcaaattaaggacgttttcaatttagataactctgaaatatttaagttgtaaatatggcctcaataatagtcttttactcaatttgtctgtaaacattacatagcactatggttcacatgacacttacatacctaagctmcaaaatggaaaaacaggtaggttatgtatcatgttctcctttgattattgtaaaaaaaaattgcaaaattttggggaaatgcttatcatagataaccctaaattcagcccaaacatagttcttctcctttaaaaaaaaaatcactccaagggagtttttagggaagaagcttagatttctaaggaactatcaaggaacagagggcataaaaacagtgatggaaattccctttccagcacaggaagaagcagtatgcttgtactgatgctaggcttctaaggacggactctgtgtttgaga

SEQ ID NO: 152799 - DNA, 601 bp, Human
ctctctctctctctctcctctctctctctcacacacacacacacacgccccattaagaaaataataatattgaaacagcaagccgtaagagtaaaaacaaacaaaggctgaaggagaagtgagcagtgtagcctgtctaggaaaccatctgattcacagactgaactttaacattttagactactggctaccaagaacatacatttgaaggccaatcgtcagagagagagagagagagagagagaaagagagggagagtatgtgtatttttctgtaaagtagtgggtggtctccttaaaaygggtttctttgtgtgcttaaatgagctcattctatttcttctgtgcttcatgttttttttttaaatttagaacttcagagagtatgatccttactacttagttgagaagttcacttttctacttgctctctttgtcttaaaattctctaggaaaaaatataaaggatttttctatttaaatgacactctaatgaaaatatcgtgagaaagaataaactaattctctatcaatccttttagataacacccaaactcttgcttaaatgtccattgtgtattcttttattattttgtgtatat

SEQ ID NO: 152800 - DNA, 601 bp, Human
tggtcccagttctaccactcactaggttgtgaccttggtgggaacatgaacattcttgggcctcatgggcttcaactgtataaaaggaaggggtcagagacagtgatttctatacttccttcccggtttaaaacatatgattcagttatgatcagaaatagacagaaaccacggagtatctcttcacatttttcagagttctgctgagaaaataaatctagaagtcccagcctgggaaataaaaggcagctgcttttacctgagtattctctctctctctctctctctctctctctctctcctctctctctctcacacacacacacacacgccccattaagaaaataataatattgaaacagcaagccgtaagagtaaaaacaaacaaaggctgaaggagaagtgagcagtgtagcctgtctaggaaaccatctgattcacagactgaactttaacattttagactactggctaccaagaacatacatttgaaggccaatcgtcagagagagagagagagagagagagaaagagagggagagtatgtgtatttttctgtaaagtagtgggtggtctccttaaaatgggtttctttgtgtgc

SEQ ID NO: 152801 - DNA, 601 bp, Human
tcatggtcccagttctaccactcactaggttgtgaccttggtgggaacatgaacattcttgggcctcatgggcttcaactgtataaaaggaaggggtcagagacagtgatttctatacttccttcccggtttaaaacatatgattcagttatgatcagaaatagacagaaaccacggagtatctcttcacatttttcagagttctgctgagaaaataaatctagaagtcccagcctgggaaataaaaggcagctgcttttacctgagtattctctctctctctctctctctctctctctctctcctctctctctctcacacacacacacacacgccccattaagaaaataataatattgaaacagcaagccgtaagagtaaaaacaaacaaaggctgaaggagaagtgagcagtgtagcctgtctaggaaaccatctgattcacagactgaactttaacattttagactactggctaccaagaacatacatttgaaggccaatcgtcagagagagagagagagagagagagaaagagagggagagtatgtgtatttttctgtaaagtagtgggtggtctccttaaaatgggtttctttgtg

SEQ ID NO: 152802 - DNA, 601 bp, Human; identical to SEQ ID NO: 34566

SEQ ID NO: 152803 - DNA, 601 bp, Human; identical to SEQ ID NO: 34567

SEQ ID NO: 152804 - DNA, 601 bp, Human; identical to SEQ ID NO: 34568

SEQ ID NO: 152805 - DNA, 601 bp, Human; identical to SEQ ID NO: 34569

SEQ ID NO: 152806 - DNA, 601 bp, Human; identical to SEQ ID NO: 34570

SEQ ID NO: 152807 - DNA, 601 bp, Human; identical to SEQ ID NO: 34571

SEQ ID NO: 152808 - DNA, 601 bp, Human; identical to SEQ ID NO: 34572

SEQ ID NO: 152809 - DNA, 601 bp, Human; identical to SEQ ID NO: 34573

SEQ ID NO: 152810 - DNA, 601 bp, Human; identical to SEQ ID NO: 34574

SEQ ID NO: 152811 - DNA, 601 bp, Human; identical to SEQ ID NO: 34575

SEQ ID NO: 152812 - DNA, 601 bp, Human; identical to SEQ ID NO: 34576

SEQ ID NO: 152813 - DNA, 601 bp, Human; identical to SEQ ID NO: 34577

SEQ ID NO: 152814 - DNA, 601 bp, Human; identical to SEQ ID NO: 34578

SEQ ID NO: 152815 - DNA, 601 bp, Human; identical to SEQ ID NO: 34579

SEQ ID NO: 152816 - DNA, 601 bp, Human; identical to SEQ ID NO: 34580

SEQ ID NO: 152817 - DNA, 601 bp, Human; identical to SEQ ID NO: 34581

SEQ ID NO: 152818 - DNA, 601 bp, Human; identical to SEQ ID NO: 34582

SEQ ID NO: 152819 - DNA, 601 bp, Human; identical to SEQ ID NO: 34583

SEQ ID NO: 152820 - DNA, 601 bp, Human; identical to SEQ ID NO: 34584

SEQ ID NO: 152821 - DNA, 601 bp, Human; identical to SEQ ID NO: 34585

SEQ ID NO: 152822 - DNA, 601 bp, Human; identical to SEQ ID NO: 34586

SEQ ID NO: 152823 - DNA, 601 bp, Human; identical to SEQ ID NO: 34587

SEQ ID NO: 152824 - DNA, 601 bp, Human; identical to SEQ ID NO: 34588

SEQ ID NO: 152825 - DNA, 601 bp, Human; identical to SEQ ID NO: 34589

SEQ ID NO: 152826 - DNA, 601 bp, Human; identical to SEQ ID NO: 34590

SEQ ID NO: 152827 - DNA, 601 bp, Human; identical to SEQ ID NO: 34591

SEQ ID NO: 152828 - DNA, 601 bp, Human; identical to SEQ ID NO: 34592

SEQ ID NO: 152829 - DNA, 601 bp, Human; identical to SEQ ID NO: 34593

SEQ ID NO: 152830 - DNA, 601 bp, Human; identical to SEQ ID NO: 34594

SEQ ID NO: 152831 - DNA, 601 bp, Human; identical to SEQ ID NO: 34595

SEQ ID NO: 152832 - DNA, 601 bp, Human; identical to SEQ ID NO: 34596

SEQ ID NO: 152833 - DNA, 601 bp, Human; identical to SEQ ID NO: 34597

SEQ ID NO: 152834 - DNA, 601 bp, Human; identical to SEQ ID NO: 34598

SEQ ID NO: 152835 - DNA, 601 bp, Human; identical to SEQ ID NO: 34599

SEQ ID NO: 152836 - DNA, 601 bp, Human; identical to SEQ ID NO: 34600

SEQ ID NO: 152837 - DNA, 601 bp, Human; identical to SEQ ID NO: 34601

SEQ ID NO: 152838 - DNA, 601 bp, Human; identical to SEQ ID NO: 34602

SEQ ID NO: 152839 - DNA, 601 bp, Human; identical to SEQ ID NO: 34603

SEQ ID NO: 152840 - DNA, 601 bp, Human; identical to SEQ ID NO: 34604

SEQ ID NO: 152841 - DNA, 601 bp, Human; identical to SEQ ID NO: 34605

SEQ ID NO: 152842 - DNA, 601 bp, Human; identical to SEQ ID NO: 34606

SEQ ID NO: 152843 - DNA, 601 bp, Human; identical to SEQ ID NO: 34607

SEQ ID NO: 152844 - DNA, 601 bp, Human; identical to SEQ ID NO: 34608

SEQ ID NO: 152845 - DNA, 601 bp, Human; identical to SEQ ID NO: 34609

SEQ ID NO: 152846 - DNA, 601 bp, Human; identical to SEQ ID NO: 34610

SEQ ID NO: 152847 - DNA, 601 bp, Human; identical to SEQ ID NO: 34611

SEQ ID NO: 152848 - DNA, 601 bp, Human; identical to SEQ ID NO: 34612

SEQ ID NO: 152849 - DNA, 601 bp, Human; identical to SEQ ID NO: 34613

SEQ ID NO: 152850 - DNA, 601 bp, Human; identical to SEQ ID NO: 34614

SEQ ID NO: 152851 - DNA, 601 bp, Human; identical to SEQ ID NO: 34615

SEQ ID NO: 152852 - DNA, 601 bp, Human; identical to SEQ ID NO: 34616

SEQ ID NO: 152853 - DNA, 601 bp, Human; identical to SEQ ID NO: 34617

SEQ ID NO: 152854 - DNA, 601 bp, Human; identical to SEQ ID NO: 34618

SEQ ID NO: 152855 - DNA, 601 bp, Human; identical to SEQ ID NO: 34619

SEQ ID NO: 152856 - DNA, 601 bp, Human; identical to SEQ ID NO: 34620

SEQ ID NO: 152857 - DNA, 601 bp, Human; identical to SEQ ID NO: 34621

SEQ ID NO: 152858 - DNA, 601 bp, Human; identical to SEQ ID NO: 34622

SEQ ID NO: 152859 - DNA, 601 bp, Human; identical to SEQ ID NO: 34623

SEQ ID NO: 152860 - DNA, 601 bp, Human
agggagccgtgaagattttgaaaccagagtgacttgcagtaactgcctaacaataaattcacagagtaaaatgcagaatagttgacatataaccaaggtttatgttgtatctagaaatatgttttatgctttaaaaaaaattgcaatgcactccaaaaatttttttctgataattcatgtacaacagaaggcactgttatccgcataaatccattgattctgcatggcagaaacctgagacgtgcaagtctatccaatcctctaaaacaaccttgggcattcagcctttggaacatatggkttgtccttttccgtccaatgattgtttttctttcatttcatacttacagtagctgtttaaaatatatatttcagggtgacaaaggtcaaaggggaaagagtagataaaagtgctgcctaatgccagatggtaactggcacagcaggagggccctaaaagcagcccctcatttcatccccttgaccctcacactcctcttgtgaaataaaatgcagcgatgacatttggtcagctgatgttctttccttcagttgttgctgggcacagtcccaaaattaaatgcggagaggactcctttgt

SEQ ID NO: 152861 - DNA, 601 bp, Human
gaaaaaccagagccagtgcatattttataatacaacccctgaaaaaagccccccagcagcagggtgagcagagggagccgtgaagattttgaaaccagagtgacttgcagtaactgcctaacaataaattcacagagtaaaatgcagaatagttgacatataaccaaggtttatgttgtatctagaaatatgttttatgctttaaaaaaaattgcaatgcactccaaaaatttttttctgataattcatgtacaacagaaggcactgttatccgcataaatccattgattctgcatggcaraaacctgagacgtgcaagtctatccaatcctctaaaacaaccttgggcattcagcctttggaacatatgggttgtccttttccgtccaatgattgtttttctttcatttcatacttacagtagctgtttaaaatatatatttcagggtgacaaaggtcaaaggggaaagagtagataaaagtgctgcctaatgccagatggtaactggcacagcaggagggccctaaaagcagcccctcatttcatccccttgaccctcacactcctcttgtgaaataaaatgcagcgatgacatttggt

SEQ ID NO: 152862 - DNA, 601 bp, Human
tttttaaatttcataaaattgagaagaaactttcctaaggtgcacacatcttaaaagagtatgactcggtgaattttttacatatacatacacctgtgtaaccaccgcagagcaagacagaatatttacagcaccccagtttcccacatcaccagggatcactcactatttggcagtacttattttttcccaaaaatcactaatacaccaggctggggaaaaaaccgagagtccgtttctataaaaaaaaatttgaaaaattagccaagcgtggtgcagcgagcctgtagtcccagttacygaggaggctggggcgggaagatcacttgagcccaggagttccaggttacagtgagctatgattgtgccactgcacgctagcatgggcgacagagggagaccctgtctctaaaagaaaaaagaaaaaaaaataattaaaacacaccagtgctttggaagcactttaaatcctggacattggattcaggtcatttactgtccgacctcgttattcccagtttccgcttctgccctgaaccccacttcacagggctgattgctaggctgtctacgcttgtaagaattcctgggagccctagca

SEQ ID NO: 152863 - DNA, 601 bp, Human
gtaatgacacttccgtctccaacactggggctcaagcgatcctctcacttcaacctcctgagtacctgggactataagggtgcaccaccatgcctggctaatttttaaatattttgtagagacagggtcttgctatgttacccaggctggtctcaaactcctgggctcaacgtcttagctgttctaacagtttctcagcatggactccacttgtatacatcatttctagagaaataaagtttatttctataatacaaaaaaagtgcacattacaagaattaaggaagggaaatttcacaawaatttctgcccacaaacaaagtcctcaagttgttctagtctccattctcaccttttcaaaagcttctgctatagttttgtttttaaatttcataaaattgagaagaaactttcctaaggtgcacacatcttaaaagagtatgactcggtgaattttttacatatacatacacctgtgtaaccaccgcagagcaagacagaatatttacagcaccccagtttcccacatcaccagggatcactcactatttggcagtacttattttttcccaaaaatcactaatacaccaggctggggaaa

SEQ ID NO: 152864 - DNA, 601 bp, Human
cttaagggaaaccagccctttcaaaagattctaccactgatatcaaccaaccccctgatgctgcccctccttttgtgcctgataagagatcacagaccacagaatggttctggccagtctactgagaatgcacagtaagggtttttctgtcctctgcttcaccttttgatataagagggccaaaaactccatcctgtgattgtggtaacaccgccattttttgtgcatggtacccatgaagctcaattactcatgggtactttcctcctttcataaatattcatgagtcatcctacagctwactgaatatgtatatttggccaccttcctcagcataaattcctgttccctttgcccctccctggaagtgtcagtttctggcttctggcctgcggctacacttctcagccagtcagaatggctgctctacagtctgaaaccattcatgagaaagagttctcctttctaaattatgaacttctcattcttcagctgacagaccataactgcagatccatctgaatgtatgaggaaaatgcctttcctttcaatgtcaactctgcaatattaaggacaatataacaccattattctaacattc

SEQ ID NO: 152865 - DNA, 601 bp, Human
cagttgggtatcttctgatttaattctgacattacctacctggagatagtgtcagattctatatgttgggggctcagtccctaagatttccctcctcacttagacaccagttgcaagtccaggcctccactggcttcaagttggggttcccacaccctccactttgggtttgcttaatttgctagagcaactcacaaacctcagagaaatacttagttatctttgcacatttattataaaggatactgcgaagaatatacttgaagagatgtgttagctacaggaccttcacctgttgagstattaggaggctctccaaaccccatcctcttgggtttttatgtaggcttcatcacgtaggcattattgtacttactcctaattcaactctaaattctgccaattgtcccaatttcctatcagtacacagtcagtctctccagtcatcagctatactatcaatatcatcttggagaattctctcctggaatctgccctgattattctctaatcttggtagacagctagctttctgggatcgctcttcatcatcattctggagatttccttcttgtctgaatctccagctttatttcatgtc

SEQ ID NO: 152866 - DNA, 601 bp, Human
ctcgcaaagcactgggattacaagtgtgagtcactgcaccttgccatttcaacatccaataagaagtgataacaaaaaattactttcagtgcgtctggtggtagaataataccccttaatacacattacaagagatcattaaataaactgaattctatcttaatattagtgtttcctctgctctcacaccccaatcatcaacacacaagatttctgtgaccaaatgtgggggttcttcccccagcacaccaaatattggacaccagttgggtatcttctgatttaattctgacattacctacctggagatagtgtcagattctatatgttgggggctcagtccctaagatttccctcctcacttagacaccagttgcaagtccaggcctccactggcttcaagttggggttcccacaccctccactttgggtttgcttaatttgctagagcaactcacaaacctcagagaaatacttagttatctttgcacatttattataaaggatactgcgaagaatatacttgaagagatgtgttagctacaggaccttcacctgttgaggtattaggaggctctccaaaccccatcctcttgggttt

SEQ ID NO: 152867 - DNA, 601 bp, Human
tctgtgtatttcctgaaaatggagttttaaaactcacatcctgttaaatcacccaaagaattcatcattaagacaagataattctgttaatgtttatctgctcataccatttcatctcaaccgcttttccgcaaagaggaaaaaataccctcagtccactcttgcctttaaggaaagtatctaaatgcttctttaatagcctgaagaggaaaaaaaaaaaggttttaggacaattgtatggtaggtgaacacttttcattcattatctcacttaatattcccaacaaccttaataagcagwtactattaattattataatctccagcttacatatgaagaaacaggtaacttgctcagacacacacccagtcagtggtaaatctgacttacacccagggctttcctgattagtaattaaaaataatttttttttcttggggatgttttgaaaattctttattaattctctaaatatgtactattttgggggtgatggagcctctggagccatggatttttcaacattaatttcatggtacgttctctaaacgtgtactcaagcctcagaagtaaacctgagaagtgtaactcctgtagttt

SEQ ID NO: 152868 - DNA, 601 bp, Human
aaattaacttagctaaattcctaaaccacctacaaaaactgaaccacatacaaggatccagaaaatgtaaaagggaaggctgttttttctccccccattggctccaaactgattttttaatttcaaaactcaatccagaaagacttcatacctgtttctgttgtttcttactgtttgagaatattatttccaattatatacccatcactaatagaaaaataaggaatttctgtgtatttcctgaaaatggagttttaaaactcacatcctgttaaatcacccaaagaattcatcattaagrcaagataattctgttaatgtttatctgctcataccatttcatctcaaccgcttttccgcaaagaggaaaaaataccctcagtccactcttgcctttaaggaaagtatctaaatgcttctttaatagcctgaagaggaaaaaaaaaaaggttttaggacaattgtatggtaggtgaacacttttcattcattatctcacttaatattcccaacaaccttaataagcagatactattaattattataatctccagcttacatatgaagaaacaggtaacttgctcagacacacacccagtca

SEQ ID NO: 152869 - DNA, 601 bp, Human
ctttagggtaactcatagtaaaagtggcttgttaaagtgaattctctttgtagagaattactcacaagaaatactttcttaatcactggttttataacaatgattcacgataacagaaactcctgtgttccctggtgggaggggaaggttgagctgaactgtggactatgaacattgtcctgccaaaaagctgtaattcattttgaatttctctgtccaccaccatttcaaatatctaaaaattaacttagctaaattcctaaaccacctacaaaaactgaaccacatacaaggatccagraaatgtaaaagggaaggctgttttttctccccccattggctccaaactgattttttaatttcaaaactcaatccagaaagacttcatacctgtttctgttgtttcttactgtttgagaatattatttccaattatatacccatcactaatagaaaaataaggaatttctgtgtatttcctgaaaatggagttttaaaactcacatcctgttaaatcacccaaagaattcatcattaagacaagataattctgttaatgtttatctgctcataccatttcatctcaaccgcttttccgcaa

SEQ ID NO: 152870 - DNA, 601 bp, Human
attttttttgagggtaattttgaaagtaactatctcttctggctcaatgaattggttaaaatatatgtcataatatagtttaaatattctcaatttcatgaccacacttgaatcttaaagtcatagcagccctctaacaaaggctctcagctacagttgattggttgctggctgcaaaaattctatcatctctacttgaaaatcaactcccaaaaaatgcatgcatactctgcgttagtcaccgatatttatattcagaatagaccattttttaggttattatattttacatttattaatmttttattttaaatttattttttgaggcagggtctatgttgtccagactggtctcaaattcctgggctcaagagatccttctgtcttggcctcccaaagtgctgggattacaggcggaggccaccacacctggcgcatttactaaccttttcatacattcttttttctttcctgctcagtggtcaaagttctcaacattcaagcttataaataaatgcatatcttggcaggtatgattgtatctgtatattatcattacaagagagttcagtatagagaatgatgtcgaggtgactttagg

SEQ ID NO: 152871 - DNA, 601 bp, Human
ctttaggggtgggagtgaggggggtgtgctgtgttatctttatctcttcaatgtcttaggcagggtctggcacatgatgggttctcagaaaatgcgtgttaataaaaataaaacaagcctaaaagcttgagtacagagaggctttgacctcagcttttatatacatatgtctatacctatttaggtagctatcacctatatttttaagcccttgcttcttatactatatagtatctacagtgaatctgcgtgctaaataggaaccatcggacacatgaatggtatcctcataatactcacrctgagaaaaacttttgtggggatatggatacaattatttacccaaatcaaaacaaaccttaaatactttggttccaggaatttcggtgattggttcttctgagtaagaaagattctgctctgtaaaaaattcttgtatcccaagttcactgatttccacaccaactacactgtgtccccggtctgcaaacctgcataaaatcatacatttacacttaaattatgttttcaaatgactaaatagagggttatattagagtaagcatatattttctttaatttagaggaatttatatgaatt

SEQ ID NO: 152872 - DNA, 601 bp, Human
taggatgccccgttcctagttgcccacctccagcttccctgtgccaacagcctcgcaacagcacatgccgggagcttttacttttgtccacttttaagcttccccactcctctgcctgcctttgagtctctgccagattctctctgcttgttcccacttgggtagtgtttgtttatttacactggctcattctgctcacagcataaagaccactcccaaacctatcattttgagcccaaacctcactccatgcttcagacataaaaccttcaccactccacaggtcccttaaactcatcawctctagaaaaagattcattctttctgcccttctcatttattcttgaccatccagccagtcatctgagccagaaatgtgaactcatcgctcctttggtcctcattcggtcacagaatcctgcgggtctatcgtaaatgttgctttaatccatcctaaccactctctatgccccatcactctccttgctcagggattcatgatgtctttcctggaccactgccatagcctcctgtctctctgccaggaggctacttcccttcaaatcacttcctatgaggcctcatgggtgatttaagtagt

SEQ ID NO: 152873 - DNA, 601 bp, Human
agggaggatacggaaggttttcctcttaatgaaaagcagcctcaaatcatttttcctttctaacaaagagcagcctataaaatcgagctgcagacatagatgccggcagtttgtgccaatcatgttcaaaatggtggctctatcttcccttctctgtcagccacctgtagagtaagaagcagacaacatggtgccagtgaagggaagagttcatttgcataataagattagggtggggcgaccagccttcccagcacgttatgtaaacatcacacttgatcgaaccaatctgtgagccctrtgtaaatcagacactgactcctcaggctgcactataaaatccggcgcttctacacctggcaggttttttcctctcggaagtcccctctctctcactaaagagagagctgttttacttttctctttctcttttttttttgcctattaaacctccactcctgaactcctcatgtgtgtctctgtcctaaattttcctggcacaagacgacgaacctggggaatttaccccagacaaggtagccacttcacaacctctgcagtgacttggtcaatgactgccagcttccctgatttttactac

SEQ ID NO: 152874 - DNA, 601 bp, Human
agaaattactaaggcagatagggaggatacggaaggttttcctcttaatgaaaagcagcctcaaatcatttttcctttctaacaaagagcagcctataaaatcgagctgcagacatagatgccggcagtttgtgccaatcatgttcaaaatggtggctctatcttcccttctctgtcagccacctgtagagtaagaagcagacaacatggtgccagtgaagggaagagttcatttgcataataagattagggtggggcgaccagccttcccagcacgttatgtaaacatcacacttgatcraaccaatctgtgagccctatgtaaatcagacactgactcctcaggctgcactataaaatccggcgcttctacacctggcaggttttttcctctcggaagtcccctctctctcactaaagagagagctgttttacttttctctttctcttttttttttgcctattaaacctccactcctgaactcctcatgtgtgtctctgtcctaaattttcctggcacaagacgacgaacctggggaatttaccccagacaaggtagccacttcacaacctctgcagtgacttggtcaatgactgccag

SEQ ID NO: 152875 - DNA, 601 bp, Human
ttgtgagacactgaatatacagatggacaatagatcctatatgacaatacaactctgaccccacaactgattcaggagttaagaagaaattactaaggcagatagggaggatacggaaggttttcctcttaatgaaaagcagcctcaaatcatttttcctttctaacaaagagcagcctataaaatcgagctgcagacatagatgccggcagtttgtgccaatcatgttcaaaatggtggctctatcttcccttctctgtcagccacctgtagagtaagaagcagacaacatggtgccagygaagggaagagttcatttgcataataagattagggtggggcgaccagccttcccagcacgttatgtaaacatcacacttgatcgaaccaatctgtgagccctatgtaaatcagacactgactcctcaggctgcactataaaatccggcgcttctacacctggcaggttttttcctctcggaagtcccctctctctcactaaagagagagctgttttacttttctctttctcttttttttttgcctattaaacctccactcctgaactcctcatgtgtgtctctgtcctaaattttcctgg

SEQ ID NO: 152876 - DNA, 601 bp, Human
gtgacactctagggtgtggactgggggcacactccaagagggggcaatataacatagactttaggatcctgggagctggggtgaagggcagtgtaggaaaggtgtgtcagcacacaagactgctagattttattctgaaatgaggtccccacacaggtttacaagtagaggaggaagggtctttgacaaccagcctgggatcactgggtcagcccagagatgggtgggcctggaggcaggagaacagctggatctcaactttgcctgcagattggaatcaaggggagctttaaacagtackgatgccagggccctacccctacagattctgatataattggcctggggtaagacctttggattgggaatttttataagatccagagatgatttcaaatgtgcagcctgggcggggaactgctgctccaagaggggcctggaagcaggactagccctttttggactgagtaaactccttggattctttaatgctttgagaatgaggtgggaggaagatgtgaaataaaaaataccatcaagcttcctactgatctgagcaacaattttttttttttttttttgagacagagtcttactctct

SEQ ID NO: 152877 - DNA, 601 bp, Human
gtaattccagcactttgggaggctgaagcaggcagatcgcttgagcccaggagtatgagaccagcctggacaacatggcaaaactccaactctacagaaaaaattagatgggtgtggtggcacacacctgtagttccagctacctgggaggctgacatgcgagggtcacttgagcctgggaggtcaaggctgcagtgagctgtgattgtgccactgccctccagcctgtgtgagagtaagaccctgtctcaaaaacaaacacttggagcaaaataatcctaaaaaataaacaacaacaacaaaaatcaagagaataaaacaaaaaaagaggtgacttttgaaagggtgacactctagggtgtggactgggggcacactccaagagggggcaatataacatagactttaggatcctgggagctggggtgaagggcagtgtaggaaaggtgtgtcagcacacaagactgctagattttattctgaaatgaggtccccacacaggtttacaagtagaggaggaagggtctttgacaaccagcctgggatcactgggtcagcccagagatgggtgggcctggaggcaggagaacagctggatctc

SEQ ID NO: 152878 - DNA, 601 bp, Human
tccgcccaccttggcctcccaaagtgctaggattacaggcgtgagccaccacacccggccacaagtatggacttcaaagccaaacactctggttttgaatctcaactctgtcacataccagctgcttaactttggacaagtaacttaatctctttgacctcagtttcctcatctgtataatggaatagtagcttataccttacagaattaaatgttaaaccacatgaaatattttgatttttttgttttttttttttttaaatattttacagacaaggtcttgctctgtcattcaggttgragtgcagtggtacgatcatagctcactgcagctttgaacttctgggctcaccctcctgcctcagcctcccaagtagctgggactacaagcacataccaccacggtcggataattttaaaaatattttgtagaggtggcgtcttgctttgttgcccagactggtctcaaactcctgggctcaagtaatcctcctgctttggcctcccacagtgctgggattacatgtatgatccaccatacccagcccacataaagtattttgaacaatacctggcataggcaagtgaccagtaagtatta

SEQ ID NO: 152879 - DNA, 601 bp, Human
gctggagtgccgtggcacaatctcggctcactgcaacctccacctgccgggttcaagcaattctcctgcctcagcctcccaagtagctggggctacaggtgtgcgccaccaagcccagctaatttttgtatttttatagagatagggtttcactgtgttggccaggctggtctcgaactcctgacctcatgatccacccacttcagcctcctaaagtgctgggattacaggcgtgagccactgcgcccagcctcctttttggccaagtgatgagtctgctccatacaactaagtaattcartatttccatgctatatccaagtaagcacataaatgacattattttaattgaaagagtatacagatgtggtcacattttactcagtatgcttcctcactcatattttaattttattttctaacaagactcggtataataagaatggtcatcaaaaacatcaataacaatgcttcaataataacagctctcatttatacagttctttagagatgaaggtatttcctacatatttcatttctttcaattcccacaaaaatcctttgaggtagtctaacaaagggatcatgagtgtggacttta

SEQ ID NO: 152880 - DNA, 601 bp, Human
gaattcaccagtggatcactcttccttgtaggtgaaagaaccacatcaaagcaaacttttgaacagaaactgttactttctgattctcatttttcagaagaaacttgctgtccccatgagggggatgtcagactggtttggtagggtttcctaggactgaaagacttcattcctcttagaatgtgaagtttttctctctcaaccagtctcaaaaagtccagaaaaatgaggtctgccctactggtttacattaggcaagaactcgagagtcacagcagaaaatacatcagtacttgacaaygtacaatctaaggagaagacacccagtcctaacgaaagcaccaatataatgtgctaacatggtaagtactgagtaccagcatgtagataaagaactaagatactaagtaccagcacatatataaaatactaagataaggctgggcacggtgacttacatctgtaatcccagcactttgggaggccgaggtgggcagatcacctgaggtcgggagttcgagaccagcctgaccaacatggagaaaccccgtctctagtaaaaatacaaaattagctgggtgtggtggcgctactgtaatcc

SEQ ID NO: 152881 - DNA, 601 bp, Human
tcctccttcttcccaataggactcatgagatttctcttctgtatcaggatcatccatttccccgctcttctctagtctgaattgtgaatggtaaacaaaatgggaaaggaatacaagaaaatcatgtacaatatagaagagaaaaacatgcttatagttcccattagtcaaaactggaattatctccatgtatatatgcagtatgcttcctatgagataaattaggagaaaataattcttatccatgtcatagaatttatatcaagaaactaggcaactggtaaaagaaaaaaaaaaaaamccaacaactttacctggatgtttagttggatcataagaaagaacacacaggagatactgaaacttctttcccaggagggaaaacattgtatctgcatagctacaaagaacacaagaaggtatttgttacatttctctacacaggcaaaggctggagggacaaaaggcagggaaggaagccagaagttactttcgctgatactactgagtttaaattctcctaataatcacaagaggttgattctcattttaaaagtgagaaatgggtttagcaaattatggcccctgcctaagctgggaa

SEQ ID NO: 152882 - DNA, 601 bp, Human
attgtctctgatttaattagggacactaggtctcatcttttaatgagtttttaagaccccaatttattcaagcagaaacaaaatactagctgggaacggtggctcacgcctgtaatcccagcactttgggaggctgaggagggcggatcacctgaggtcaggagttccagaccagcttggccaacatggtgaaatcctgtctctactaaaaatacagaaattagctgggtgtgatggcatacactgtaatcccagctacttgggaggctgaggcaggagaatcacttgaacccggaaggcrgacgttgcagtgagccgagatgaaaccactgcactccagcctgggccacagagtgagactgtgtctcaaaaacaaaacaaaacaaaaaaaccaaaatactaacatatgtaaatatttacaaaacaagcatgttaaaaagctcagttgaaaatcaaaaaggtgactcttacaaattaaaagtctatgtatttctccagccatgacaaaggttaagtttcaatgtttgaatgcattaaaatgagtccaggagaaaacatacccccaacagattcaaaacaaataaaagaatgcaatagatag

SEQ ID NO: 152883 - DNA, 601 bp, Human
acctggcttcccctctgcagaacctgacttgaggcgatgagtcacttctaaaaaatgcagaggcaactgagactgggggaacggctcggaaaaacggcacccgccgctggctctctgactgctttgggtagaggggtgttcgtggaagtagccgccgtatcatcacttttagggccaaaaatcaacctgcagatggccttttctttattctcatcagagtggtgttcgctgcaagttgtagcaatatttgaatggatgcattcttaaaaatgagtatgtatgggtgactgcatttaggaarttgaaccgggactaggtccaaacagccagagtggagatgaacacttggtaaaaacatctaggacctttggttttatagttatggaaatgcagaagcttctgggacttgagcactgtagtttactgagtactcctatttccttactgcttctgtagatttcattgaagctatgttccttagaattcttggtaaactatctaagcccacttagtgtaaaattacaacggtagagtgaactttagagaattggatttatagttactagagtctaattagactgcaagcctcttgaaagcaagg

SEQ ID NO: 152884 - DNA, 601 bp, Human
agccagagtggagatgaacacttggtaaaaacatctaggacctttggttttatagttatggaaatgcagaagcttctgggacttgagcactgtagtttactgagtactcctatttccttactgcttctgtagatttcattgaagctatgttccttagaattcttggtaaactatctaagcccacttagtgtaaaattacaacggtagagtgaactttagagaattggatttatagttactagagtctaattagactgcaagcctcttgaaagcaaggatgggttgtttggtagttcctacrgcaccaaacagtatttggctcacagcatgtaatggatagacaataaaagtgtgtgaaatagttaattcagtaccttaagtgtagatggagcatgacttcttgaatatactgcatattttgcaaggaaaggcgacttctccatgaatcccgaaatttaaaaaattcttaataacattacaatcaaagtgtcatataaatacttcttaaggataaagagaaaaagaagttgactatgagaaatcaggaaggtgattatcaaggtggtctttgctagtaggaagtaagtttttgttccccatc

SEQ ID NO: 152885 - DNA, 601 bp, Human
catctaggacctttggttttatagttatggaaatgcagaagcttctgggacttgagcactgtagtttactgagtactcctatttccttactgcttctgtagatttcattgaagctatgttccttagaattcttggtaaactatctaagcccacttagtgtaaaattacaacggtagagtgaactttagagaattggatttatagttactagagtctaattagactgcaagcctcttgaaagcaaggatgggttgtttggtagttcctacagcaccaaacagtatttggctcacagcatgtmatggatagacaataaaagtgtgtgaaatagttaattcagtaccttaagtgtagatggagcatgacttcttgaatatactgcatattttgcaaggaaaggcgacttctccatgaatcccgaaatttaaaaaattcttaataacattacaatcaaagtgtcatataaatacttcttaaggataaagagaaaaagaagttgactatgagaaatcaggaaggtgattatcaaggtggtctttgctagtaggaagtaagtttttgttccccatcgttaatgtgagaagtaatttaatttgttgat

SEQ ID NO: 152886 - DNA, 601 bp, Human
gtgaactttagagaattggatttatagttactagagtctaattagactgcaagcctcttgaaagcaaggatgggttgtttggtagttcctacagcaccaaacagtatttggctcacagcatgtaatggatagacaataaaagtgtgtgaaatagttaattcagtaccttaagtgtagatggagcatgacttcttgaatatactgcatattttgcaaggaaaggcgacttctccatgaatcccgaaatttaaaaaattcttaataacattacaatcaaagtgtcatataaatacttcttaargataaagagaaaaagaagttgactatgagaaatcaggaaggtgattatcaaggtggtctttgctagtaggaagtaagtttttgttccccatcgttaatgtgagaagtaatttaatttgttgatacagggtagggtttggtaaacctttgagttaagagctagatagtaaacatgtaggttttgcaggccatatggtctccttagcaactactcagttccacagttatagtttgaaagcagctaaagacaatacctaaaggaatggtatgtttgtgttttactttatttacagacattgaa

SEQ ID NO: 152887 - DNA, 601 bp, Human
tctgtttttttccaggcattaaaaaatgtaaaaactattcttagcttgagggaggagcagaaaacacaaaagtaagagagaagggaatggatttgtccttctagtagtagtttgctactcccactgattgattctgtgctagaatctggagaggagcctattgaaaggattaatgggccgcattctcttgagtgcctgttataccttggcagttaagttaaataccctccagaaaagcattaacttattttgagcattatggagttttgttttgttttgaatatttcctaacatctttatkcatgaggttttgttttgtttttaatttattatgtaacattttatatgtaaaaataatatgctaagtctaggtgagttatgaacattatattcaactgaacacctgtgaacccatcactaggtttataaactagggcttaagaactagatagttgtgaaaagatagctcatagaatgggaggaaatatttaggaatcatgtatctgataagggtcttgtatccacaacatataaagagttcttacaactcaataataaaaagaaaaataatccaatttaaaaatgggcaaaggatctgaat

SEQ ID NO: 152888 - DNA, 601 bp, Human
gaaaacacaaaagtaagagagaagggaatggatttgtccttctagtagtagtttgctactcccactgattgattctgtgctagaatctggagaggagcctattgaaaggattaatgggccgcattctcttgagtgcctgttataccttggcagttaagttaaataccctccagaaaagcattaacttattttgagcattatggagttttgttttgttttgaatatttcctaacatctttatgcatgaggttttgttttgtttttaatttattatgtaacattttatatgtaaaaataataygctaagtctaggtgagttatgaacattatattcaactgaacacctgtgaacccatcactaggtttataaactagggcttaagaactagatagttgtgaaaagatagctcatagaatgggaggaaatatttaggaatcatgtatctgataagggtcttgtatccacaacatataaagagttcttacaactcaataataaaaagaaaaataatccaatttaaaaatgggcaaaggatctgaatagctatctccaaagaagatatacaaatggccaataaacccatgaaaagatactcaacat

SEQ ID NO: 152889 - DNA, 601 bp, Human
gatttgtccttctagtagtagtttgctactcccactgattgattctgtgctagaatctggagaggagcctattgaaaggattaatgggccgcattctcttgagtgcctgttataccttggcagttaagttaaataccctccagaaaagcattaacttattttgagcattatggagttttgttttgttttgaatatttcctaacatctttatgcatgaggttttgttttgtttttaatttattatgtaacattttatatgtaaaaataatatgctaagtctaggtgagttatgaacattatrttcaactgaacacctgtgaacccatcactaggtttataaactagggcttaagaactagatagttgtgaaaagatagctcatagaatgggaggaaatatttaggaatcatgtatctgataagggtcttgtatccacaacatataaagagttcttacaactcaataataaaaagaaaaataatccaatttaaaaatgggcaaaggatctgaatagctatctccaaagaagatatacaaatggccaataaacccatgaaaagatactcaacatcattattcatcagagaaatgcaaatcaaaa

SEQ ID NO: 152890 - DNA, 601 bp, Human
tccagaccaaggaaatgtatacagctagaaagtagattttttgttgcttagggctgaaggggctggaggtgggttgagtagggaagtgatagataaaggtcacagggtttctttttgaggtgaaacatgaaaatatcctctaatcgactatagtgatagtcgcacgtatctgtgaatatactaaaaaccattgagttgtacacctttaatgggtgaattgtgtggtatgtgaattacatctcaataaaattgttaaagaaaataaacagaaaactaggggaaaaagtactagattgttagyatccagttgcatctttgtgtttttcctctgtgcctgctctcatgtccctcccaaccctgaattttgtgttaatcattccctggtttattgtaaaacagttttatcacatgtgtatgtattccaaaacaatagtgtttaggtttgtttttttggtttatgaaaaaaggtatttataatctcgcattctcttttgagatggagtctctctctgtcgtccaggctggaatggagtggcacagtctcagctcactacaacctccgcctctcaggttcaagagatgctcccgcctcagcctcctg

SEQ ID NO: 152891 - DNA, 601 bp, Human
aattgtgtggtatgtgaattacatctcaataaaattgttaaagaaaataaacagaaaactaggggaaaaagtactagattgttagtatccagttgcatctttgtgtttttcctctgtgcctgctctcatgtccctcccaaccctgaattttgtgttaatcattccctggtttattgtaaaacagttttatcacatgtgtatgtattccaaaacaatagtgtttaggtttgtttttttggtttatgaaaaaaggtatttataatctcgcattctcttttgagatggagtctctctctgtcgyccaggctggaatggagtggcacagtctcagctcactacaacctccgcctctcaggttcaagagatgctcccgcctcagcctcctgagtagctgggattacaggcgctggccaccatgcctggctaatttttgcatttttagtagagaaggggtttcaccatgttgcccaggctggtctcaaactcctgacctcaggtaatctgccgttctcggcctcccaaagtactgggattacaggcctgagccaccgcacccagcctaatcttgcattcttaaaattcaacattaggtcattaagaa

SEQ ID NO: 152892 - DNA, 601 bp, Human
tgtttttcctctgtgcctgctctcatgtccctcccaaccctgaattttgtgttaatcattccctggtttattgtaaaacagttttatcacatgtgtatgtattccaaaacaatagtgtttaggtttgtttttttggtttatgaaaaaaggtatttataatctcgcattctcttttgagatggagtctctctctgtcgtccaggctggaatggagtggcacagtctcagctcactacaacctccgcctctcaggttcaagagatgctcccgcctcagcctcctgagtagctgggattacagrcgctggccaccatgcctggctaatttttgcatttttagtagagaaggggtttcaccatgttgcccaggctggtctcaaactcctgacctcaggtaatctgccgttctcggcctcccaaagtactgggattacaggcctgagccaccgcacccagcctaatcttgcattcttaaaattcaacattaggtcattaagaattacccacattgggctgggcgtggtggctcacgcctgtaatcccaacattttgggaggccgaggcgggcgcatcacgaggtcaggagatcgagaccatcctgg

SEQ ID NO: 152893 - DNA, 601 bp, Human
tttcctctgtgcctgctctcatgtccctcccaaccctgaattttgtgttaatcattccctggtttattgtaaaacagttttatcacatgtgtatgtattccaaaacaatagtgtttaggtttgtttttttggtttatgaaaaaaggtatttataatctcgcattctcttttgagatggagtctctctctgtcgtccaggctggaatggagtggcacagtctcagctcactacaacctccgcctctcaggttcaagagatgctcccgcctcagcctcctgagtagctgggattacaggcgckggccaccatgcctggctaatttttgcatttttagtagagaaggggtttcaccatgttgcccaggctggtctcaaactcctgacctcaggtaatctgccgttctcggcctcccaaagtactgggattacaggcctgagccaccgcacccagcctaatcttgcattcttaaaattcaacattaggtcattaagaattacccacattgggctgggcgtggtggctcacgcctgtaatcccaacattttgggaggccgaggcgggcgcatcacgaggtcaggagatcgagaccatcctggctaa

SEQ ID NO: 152894 - DNA, 601 bp, Human
cctttgacttacacattgatggcatgtaaccacttactcatttccccaaaccaagataaaatgattagatctgacattctgacttctcatcctatttacattctagttgtaaaagtatttcccaacgttttaagaagtgtggaaaatctaaaatttcacaactcaatttcacagcagagccttttaacccggtcactcacggacatcttcatctccttatatcacctgggtttaggatgagagggaggacaactttattattacatcaaaggaacattactttaatcaaagtacatgaatrgttactaaacctcattaaaagttgcctcgtattgtatatcctgcggagtggtctagtatttccgatgtgatttagttaggtaagtctgataacaatgagccttgggcagatctagatctgtcgttgagttaggcagtgagttttgccattcattcaggatatttctccttgaacttagaaggaggaaagcaccttaaagtcagaacaaaccattatgaggaattttaaaattacttttactattttaagatatatataaaatttacgattttaaacttttttttttttttgagacagagt

SEQ ID NO: 152895 - DNA, 601 bp, Human
aaaccaagataaaatgattagatctgacattctgacttctcatcctatttacattctagttgtaaaagtatttcccaacgttttaagaagtgtggaaaatctaaaatttcacaactcaatttcacagcagagccttttaacccggtcactcacggacatcttcatctccttatatcacctgggtttaggatgagagggaggacaactttattattacatcaaaggaacattactttaatcaaagtacatgaatagttactaaacctcattaaaagttgcctcgtattgtatatcctgcggrgtggtctagtatttccgatgtgatttagttaggtaagtctgataacaatgagccttgggcagatctagatctgtcgttgagttaggcagtgagttttgccattcattcaggatatttctccttgaacttagaaggaggaaagcaccttaaagtcagaacaaaccattatgaggaattttaaaattacttttactattttaagatatatataaaatttacgattttaaacttttttttttttttgagacagagtcttgctctgtcgcccaggctggagtgcagtggcacgatctcctctca

SEQ ID NO: 152896 - DNA, 601 bp, Human
ttaggcagtgagttttgccattcattcaggatatttctccttgaacttagaaggaggaaagcaccttaaagtcagaacaaaccattatgaggaattttaaaattacttttactattttaagatatatataaaatttacgattttaaacttttttttttttttgagacagagtcttgctctgtcgcccaggctggagtgcagtggcacgatctcctctcactgcaagctctgcctcctgggttcaggccattctcctgcctcagcctcccaagtagctgggactacaggtgcccaccaccaygcccggctaattttttgtatttttagtagagacgggatttcaccgtgttagccaggatggtctcaatctcctgacctcatgatctgcccacctcagcctcccaaagtgctggaattacatgcgtgagccaccgtgcccggtccgattttaaacatttttaagcatactattcagtggcattaagctcattctcactgttgtgcaaccattattattgtccatctccagaactttttcatcatctgaaactgaaactttgtacccactaaatataactctggattctcctcttccacaatc

SEQ ID NO: 152897 - DNA, 601 bp, Human
agaatcactggattcttggccgggcacagtggctcatgcctctaatcccagcactttgggaggctgaggcgggcagatcacaaggtcaggagatcaagaccatcctagctaacatggtgaaaccccgtctgtactaaaaatacaaaaaaaattagccaggcgtggtggcaggtgcctgtagtcccagctactcgggaggctgaggcaggagaatggcgtgaacccaggaggcagagcttgcagtgagccgagatcgcgccattgcattccagcctgggcaacagagtgagactccgtctcaaaaaaaaaaaaaaaagaatcactggattcttatgaaaatgaattattttatcctaaggcaacaagaacagttaaattggaccacactaagaaaatgagatgatcagatttttcagaaccaggtaaaataggcttccaagtgttgcatgtatagttcagtctggttatagtgtgatatactggagttggaggcatccatttgtaatcttagcttcgaagctgctgtggtctgaatgtttatgtcctcccaaaattcttatgttgaaatcctcactgccattgtgatggtattaggagtgga

SEQ ID NO: 152898 - DNA, 601 bp, Human
aaaattcttatgttgaaatcctcactgccattgtgatggtattaggagtggaaggccttgggaggtgaataggtcatggggtagagcactcatgaatggattagtgcccttatgaaagagaaccaagggagaccctttgctcctttcgccaagtaaggacacagcaagaaagtgccatctatgagccagaaagtgggccttgatctgcattgatcttggacttcccaacctccagaactgtgagaaataaatttctattgtttataagctatccagtctgtggtgttttgttacagcagcytgaaagaaactaacatagtaacctgtgtattacccaaactgtgcaagtgatagatcaatatgatataagtgtgatctttccatcgaatgtatactgtcctggtattgctactcacccctctccagtggcaggaaaaccaaatgtctggcctaatgagttaggttgattgatggacagtttcaactgattggttacttgacatgaggtaggctaaatgcagatagtctatctctcggcagtcatgctagaagctgtggctagagattttcagggtacaatgcagatccacaattatttagg

SEQ ID NO: 152899 - DNA, 601 bp, Human
gaaggccagtctaatcaaatagtaaaccgatattaaaggataaactctaaaaaagaatgaaattttgactctcatacaaataaaaaatagacattttcaaacttatttaaaaaatgagagagccagaaaggttttgcagtcagttcaaaggagatcatttataagaatgctggaatgaatttgcttaatacatgtaaaactggcttcttccacaatgggagagggaaggtgattggacttctacagcataaagtttatttgcatgtctgtatgacttgctttactatcagttttctgcaasttaacttatatctctacagggttgtaaaatagcttagtcaaacacaatgaatgactgagatgacccagatgaataagtattagggtactcatgaaatttgtcttctcaatttttccttacattgacaattaaaataagttttgatatttcactaccatgtgatgttggagttcaaaaaattaagtgacatttctataacaaaattcctcccatttccatctcctcattatgtttcccagcattacattgataaaaacaaaaaataagaattaaattgatgctcaacattgacccatttta

SEQ ID NO: 152900 - DNA, 601 bp, Human
ttgctttactatcagttttctgcaagttaacttatatctctacagggttgtaaaatagcttagtcaaacacaatgaatgactgagatgacccagatgaataagtattagggtactcatgaaatttgtcttctcaatttttccttacattgacaattaaaataagttttgatatttcactaccatgtgatgttggagttcaaaaaattaagtgacatttctataacaaaattcctcccatttccatctcctcattatgtttcccagcattacattgataaaaacaaaaaataagaattaaawtgatgctcaacattgacccattttatttatttttattttattattattattttttattgagatggagtcttgctctgtcacccaggctggagtgcagtggcacgatcttggctcactgcaacctctgcctcctgggtttaagtgattctcatgcatcagcctcctggctagctgggactacaggcgcgagccaccatgcccggctaattttttgtacttttagtagagatggggttttaccatgttggccaggctggtctcaaactcctgacctcaggtgatccgcctgccttggcctcc

SEQ ID NO: 152901 - DNA, 601 bp, Human
tgtaatcccagttacttgggaggctgaggcaggagaattgcttgaacctgggaggtggaggttgcagtgagccaagatcgcgccactgcactccagcctgggtgacagtgtgagactccatctcaaaaaaaaaaaaaaaaaaattaaaagtctaagtacttatgacacgtctcaaaagaggataacagccattacattttatttatttctttgtaggcagttatatctttactttattcatcgttattgttctcctctttggaggcactcaccagaaggtattgtatgagtgtatatgtawaacagacagacagcactacagtattccccacttatccatgggggatacgttctaagaccccctgttgatgcctgaaagcatggatagtaccaaatcctacatagaccacgttttttcctatacatagctaccgtgataaagtttaatatataaggccgggtgtagtggggcacgcctataaccccagcactttgggaggccgaggcgggtggatcacctgaggtcaggattcgagatcagcctggccaacatggtgaaaccccaactctactaaaaatacaaaaattagccaggtgtggt

SEQ ID NO: 152902 - DNA, 601 bp, Human
acagtgtgagactccatctcaaaaaaaaaaaaaaaaaaattaaaagtctaagtacttatgacacgtctcaaaagaggataacagccattacattttatttatttctttgtaggcagttatatctttactttattcatcgttattgttctcctctttggaggcactcaccagaaggtattgtatgagtgtatatgtaaaacagacagacagcactacagtattccccacttatccatgggggatacgttctaagaccccctgttgatgcctgaaagcatggatagtaccaaatcctacatakaccacgttttttcctatacatagctaccgtgataaagtttaatatataaggccgggtgtagtggggcacgcctataaccccagcactttgggaggccgaggcgggtggatcacctgaggtcaggattcgagatcagcctggccaacatggtgaaaccccaactctactaaaaatacaaaaattagccaggtgtggtatagacgcttgttaatcccagccactcgggaggctgaggcaggagaatcgtgtgaacccaggaggcaaaggttgcagtgagctgagattgcaccactgcattcc

SEQ ID NO: 152903 - DNA, 601 bp, Human
aaaagaggataacagccattacattttatttatttctttgtaggcagttatatctttactttattcatcgttattgttctcctctttggaggcactcaccagaaggtattgtatgagtgtatatgtaaaacagacagacagcactacagtattccccacttatccatgggggatacgttctaagaccccctgttgatgcctgaaagcatggatagtaccaaatcctacatagaccacgttttttcctatacatagctaccgtgataaagtttaatatataaggccgggtgtagtggggcaygcctataaccccagcactttgggaggccgaggcgggtggatcacctgaggtcaggattcgagatcagcctggccaacatggtgaaaccccaactctactaaaaatacaaaaattagccaggtgtggtatagacgcttgttaatcccagccactcgggaggctgaggcaggagaatcgtgtgaacccaggaggcaaaggttgcagtgagctgagattgcaccactgcattccagcctgggcgacagagtgagaccccatctcaaaatttaaaaaagtttaatgtataaattaggcatagta

SEQ ID NO: 152904 - DNA, 601 bp, Human
tctctctctctctctcaaaatatcttattgtactgtgctcacctatatttggaccattgttgaccatgggtaactgaaactacagaaagtgaaactgggcaaagggcaactactctatttggatctgtaaatgtgtagctttcaccaagtttggaagtttttggtcatgatttcttcttttgttttgtttatttattatttttatttttatttaaagcacaaaagcataatgttttgtttttttgaaacagggtctcactctgtcactcaggctggaaggcagtgacacaatcttggctcrctacagcctcgacctcctgggctcaagtgatcctcctgtctcagcttcccaagtagctgggactataggctcaggccaccacactcagctaatttttaagttttttgtagaggcggggtctacctatgttgcccaggctggtcgtgaactcctgggctcaagcgatctccctaccccagcctctgaaagtgctgggattacaggtgtgagcgaccgcgcccagcctgagcagtggtttatatctacttcagtttgcaaagcctttgggaccgtcccacacatacacagttcagggacttg

SEQ ID NO: 152905 - DNA, 601 bp, Human
ctatatttggaccattgttgaccatgggtaactgaaactacagaaagtgaaactgggcaaagggcaactactctatttggatctgtaaatgtgtagctttcaccaagtttggaagtttttggtcatgatttcttcttttgttttgtttatttattatttttatttttatttaaagcacaaaagcataatgttttgtttttttgaaacagggtctcactctgtcactcaggctggaaggcagtgacacaatcttggctcgctacagcctcgacctcctgggctcaagtgatcctcctgtctyagcttcccaagtagctgggactataggctcaggccaccacactcagctaatttttaagttttttgtagaggcggggtctacctatgttgcccaggctggtcgtgaactcctgggctcaagcgatctccctaccccagcctctgaaagtgctgggattacaggtgtgagcgaccgcgcccagcctgagcagtggtttatatctacttcagtttgcaaagcctttgggaccgtcccacacatacacagttcagggacttgtgctggttcatacacagagccagggcatccccttctttagct

SEQ ID NO: 152906 - DNA, 601 bp, Human
ggggccatcctcaggacagagtagcgagaggaataaaataccaggaattctccccatactctgtggaccacaaggtcccctgttcccctacttttctgtcagtaagcccagatttctttttttttttttttgaggcagtctcactctgtcgcccaggctggagtgcaagggtgcaatctcggctcactgcaacctccgcctcctggattcaagcaattctcctgcctcagcctcctgcatagctgggattacaggcccatgccaccacgcctggctaatttttgtatttttagtagagacraggtttcaccatattggtcaggttggtctggaactcctgacttcatgatgtgcctgcctcggcctcccaaagtgctgggattacaggtgtgagcaacctcgccctgcccaggtttctttagaaaaaaagtttcaggtgcctgtgctgctgcttactgttctgccacacagttctgtgactacggccacgcttgggagagaaaaatgcaaacaaaacccaaaacctgggcttgcctcacactcttctattagccagggccccctttccagttcctctggccaaaaagaggagcttctgttg

SEQ ID NO: 152907 - DNA, 601 bp, Human
gcaattctcctgcctcagcctcctgcatagctgggattacaggcccatgccaccacgcctggctaatttttgtatttttagtagagacaaggtttcaccatattggtcaggttggtctggaactcctgacttcatgatgtgcctgcctcggcctcccaaagtgctgggattacaggtgtgagcaacctcgccctgcccaggtttctttagaaaaaaagtttcaggtgcctgtgctgctgcttactgttctgccacacagttctgtgactacggccacgcttgggagagaaaaatgcaaacraaacccaaaacctgggcttgcctcacactcttctattagccagggccccctttccagttcctctggccaaaaagaggagcttctgttggagtgtttgctacctgcacccccacccaattctgatttaaggtcgaccctgaagaaaaaaatgagaaaaaaaccagcattttactcccaaatgggttcccttttcaattttgattcttctcaattcatgtactattgttttgtcttttggaatcagatagttgccttttgtattttgaacacagtttggagagaggctgaagtgggcttctt

SEQ ID NO: 152908 - DNA, 601 bp, Human
aaaaaaaaaaaaatggccaggcgcattgcctcacgcctgtaatcccagcacttttggaggccaaggcaggtggatcacttgaggtcaggagttcaagaccaacctggccaacatggtgaaaccccgtctttaccaaaaaatataaaaatttagctgagtgtggtgatgcacgcctgtaatcccagcaactcaggaggctgaggcaggagaatcccttgaacctgggaggtggaggttgcagtcagctgagatcctgccactgcactccagcctaggtgacagagcaagactcggtctcaamaaaaaaaaaaaaaaaaaaaaatcaaagtcaagtgtgaaagtagacccaggaagctagagacacatgaagaagcaaaagggggctggaggaatgcttgggccaaactgatcacctggctattccatcacacttggatttgttggtaatttctattcataaaactggcccaacacttaagaactgatctttagggcttttcttttttcattttcttttaagagagttgctgaatcttttatttaattgcatataattacaatgaatgctggtaaattttgagattacaaggaatttcaacaa

SEQ ID NO: 152909 - DNA, 601 bp, Human
aaaaaaaaaaaatggccaggcgcattgcctcacgcctgtaatcccagcacttttggaggccaaggcaggtggatcacttgaggtcaggagttcaagaccaacctggccaacatggtgaaaccccgtctttaccaaaaaatataaaaatttagctgagtgtggtgatgcacgcctgtaatcccagcaactcaggaggctgaggcaggagaatcccttgaacctgggaggtggaggttgcagtcagctgagatcctgccactgcactccagcctaggtgacagagcaagactcggtctcaaamaaaaaaaaaaaaaaaaaaaatcaaagtcaagtgtgaaagtagacccaggaagctagagacacatgaagaagcaaaagggggctggaggaatgcttgggccaaactgatcacctggctattccatcacacttggatttgttggtaatttctattcataaaactggcccaacacttaagaactgatctttagggcttttcttttttcattttcttttaagagagttgctgaatcttttatttaattgcatataattacaatgaatgctggtaaattttgagattacaaggaatttcaacaaa

SEQ ID NO: 152910 - DNA, 601 bp, Human
aaaaaaaaaatggccaggcgcattgcctcacgcctgtaatcccagcacttttggaggccaaggcaggtggatcacttgaggtcaggagttcaagaccaacctggccaacatggtgaaaccccgtctttaccaaaaaatataaaaatttagctgagtgtggtgatgcacgcctgtaatcccagcaactcaggaggctgaggcaggagaatcccttgaacctgggaggtggaggttgcagtcagctgagatcctgccactgcactccagcctaggtgacagagcaagactcggtctcaaaaamaaaaaaaaaaaaaaaaaatcaaagtcaagtgtgaaagtagacccaggaagctagagacacatgaagaagcaaaagggggctggaggaatgcttgggccaaactgatcacctggctattccatcacacttggatttgttggtaatttctattcataaaactggcccaacacttaagaactgatctttagggcttttcttttttcattttcttttaagagagttgctgaatcttttatttaattgcatataattacaatgaatgctggtaaattttgagattacaaggaatttcaacaaacc

SEQ ID NO: 152911 - DNA, 601 bp, Human
ggggctggaggaatgcttgggccaaactgatcacctggctattccatcacacttggatttgttggtaatttctattcataaaactggcccaacacttaagaactgatctttagggcttttcttttttcattttcttttaagagagttgctgaatcttttatttaattgcatataattacaatgaatgctggtaaattttgagattacaaggaatttcaacaaaccttattactcgttatctaagtccattagtattgctataaaggatacctgagactcatttacaaagattagaggtttrtttggctgacagttctgcaggctgtacaagaaacatctgtttctggtaaaggcctcaggctgcttccatttgtggcaagagttgaagggaagctggaatgtgcagattacacggcgagagaagaagcaggaggagaggagaggtgccaggctcattttttccttgccactctacagctcacaaatggatgccagcctctttttaacaaccagctctcctgggaacgaatagagcaagaattcactcttgtgagaatggcaccaagccattcatgagggatctgccctcatgacccaaaca

SEQ ID NO: 152912 - DNA, 601 bp, Human
cttttcttttttcattttcttttaagagagttgctgaatcttttatttaattgcatataattacaatgaatgctggtaaattttgagattacaaggaatttcaacaaaccttattactcgttatctaagtccattagtattgctataaaggatacctgagactcatttacaaagattagaggtttgtttggctgacagttctgcaggctgtacaagaaacatctgtttctggtaaaggcctcaggctgcttccatttgtggcaagagttgaagggaagctggaatgtgcagattacacggsgagagaagaagcaggaggagaggagaggtgccaggctcattttttccttgccactctacagctcacaaatggatgccagcctctttttaacaaccagctctcctgggaacgaatagagcaagaattcactcttgtgagaatggcaccaagccattcatgagggatctgccctcatgacccaaacaccttccacctcccacctcccattaggctctacctggggatcagatttcaacataagttttgcagggggtcaaacaaaccagaccatagcactcatcattccagagagacaaggca

SEQ ID NO: 152913 - DNA, 601 bp, Human
cagtatctgggtaggtttcaccaccacttctgaccactgggagatgagaacagcaaagttactcagatttaatttttttttttttttgagacggagtccagagctggagtgcagtggcatgatctcggctcactgcaaggtctgccttccaggttcacgccattttcctgcctcaacctcccgagtagctgggactacaggtgaccgccaccacgcctggtcaacttttttgtatttttttgtagagatggggtttcactgtgttagccaggatggtcttgatctcctgacctcgtgatcygcccgcttcggcctcccaaagtgctgggactacaggcgtgagccaccatgcctggccagatttaatggtttttaactgtatctttacaaagaggcacaatcctttttcatttgtttgtttttaaaccttttttgagttataattttatatgccataaaattgacccaatttaaatgtcctaacctactttctgtctctatagattagcctttcctggatatttcttataaatggaatcatacaatacacagtcttcttgtctgactttcatttagtgtaatgcttttgaagttcacttgt

SEQ ID NO: 152914 - DNA, 601 bp, Human
cttcttgtctgactttcatttagtgtaatgcttttgaagttcacttgttttgttttgtagcatgtatcagtatttcactcttttttatggctgaataatactccattataatacatatgccatattttgcttaggcattcacaggttaatggacatttggattgtttccattttttggctattatgaacagtgctgctatgacatttgtgcacaagtctgtgtgtgaacatatatttttatttctcttgagtaaaatagagtggaatgactggttcatatggcaaatatgtgcttaacttytgaagaaacttccaaacagtttaaaccaactgtcccattttccatattcaccagcaatgtctgagggttccaattccttcatattctcaccagcactttttattatctgtcttttaggttataaccatactagtgtgtgtgaagtggtatctgattggagtcttgatttgcattttcctaatgattactgatgttgagccctttcacatgtgctcttggccatttgcctgtcttctctgggaagatgtctatttagatattttgctgactattaaactggcatatttgccttcttattga

SEQ ID NO: 152915 - DNA, 601 bp, Human
ttcaacttagaggaggaatatttatatataaggcaaattagggatggttctgaggggtgaaaccaccacagtggagggggcaaatgggatggcgaggaaattgtatatgtggtttcgatagtcgatggagatgtcagggagtaaagacctctccagagattactctgatttgtgagacactgcaagatctcttggaggagctgggatttgaggattgaaaattaacagtgctaggaagaaccttagaggcagcagaatcatggcataggagagggatagggtaggacacgtttgggacttggggagttgtccctgtggcatgtgggtatctcaggagcatggggaattgtagctagagagctggggtgagatctttctgaaggtcaagctgaagcatttttctcctgcagtgagacctgattagaggccctagaggagtcagttggctaaccaggatctcatacatgttttctccagtttcatgaaacattgagagtgttctttttcttatataactttctggtctcagctattctgattacaccatctcaaaaatcagagactcttgaaacatctttgcaataaaaagaaaatggtgctt

SEQ ID NO: 152916 - DNA, 601 bp, Human
atgaatactgtgatggtttgtttctcctatacataccattacccaattagtaatagtgaatcacagggttacttctcccagtgcttggtagtttcctgggaaataaaagaaagtcactgatacggttactgtaaagagaatttaacaattggccagacgcagtggctcacgtctgtaatcccagcactttgggagaccaaggcaggtggatcacatgaggtcaggagttcgagaccaccctggccaacatggcgaaaccctgtctctgctaaaaatacaaacattagcctggcatggtggwgggcgcctgtaattccagctacttgggaggctgaggcaggagaatcacttgaacccaggaggcggagattgcagtgagccaagattgtgccattgcactccagcttgggtgacagagtgagactctgtctcaaaaaaaaaaaaaaagagtttaacaatctaggacagtctgatttgatggtagtttaccaaatattttaaattttgatggacttacagagaaattagtccattgtaactttattttttgcagagagttcacatataaaccagttgcccagcctcactatgagaaaaggtt

SEQ ID NO: 152917 - DNA, 601 bp, Human
agccaagattgtgccattgcactccagcttgggtgacagagtgagactctgtctcaaaaaaaaaaaaaaagagtttaacaatctaggacagtctgatttgatggtagtttaccaaatattttaaattttgatggacttacagagaaattagtccattgtaactttattttttgcagagagttcacatataaaccagttgcccagcctcactatgagaaaaggtttgaaagtctccagtttcctgtcacttcaagtctatttccttttttttttctttatttcttcttaaaaaaaacacttwaaaaaatgggatacatgtgcagaacatgcaggttcgttacataggtatacttgtgtcatggtagtttgctgcacctattgacccgtcctccaagttcctcccctcagtccccatcccccaataggccctggtgtgtgttgtttctctctttgtgtccatgtattctcaatgttcagcccctacctatgagtgagaacatggggtatttggttttctgttcctgtgttagtttgctgaggatgatggcttctagtttcttccatgtccctgcaaaggacatgatctcattcctttttacgg

SEQ ID NO: 152918 - DNA, 601 bp, Human
agcttttctctgatgatcagtgatgttgagcttttttcttatgtttcttggccacgtaaatgtcttcttttgagaaaagtctatttcctatttaatcttagattcatgatcttcagaagcccttggatctgggtctctcttgcagaattggaagagaaacactcactaccattatttctgtatttttggcctagtgaggagaactttcagctagcaatcaggaaacctgaaagacccacctcttttattaacatgaaaatgttatccaagtagcattatctcttacttgttttgtgaactygttgtgaggaatttacaaaaccctttagacaatgtggagttttaacacaatttgaaatcctgaagaaaaaggagccatggaagagacccaaaggcttacattagagggagcaagtgtgctctttcaagtcatgggagggagccactgtggttccaagtaggaaaaactaatctagcatcttcttttaaatgaaaatttctcctatgaaaatctggctttcagcctgatctggaatggtgccagtgagtgggcaggcaaagaaaagacagtgagtggtagctaattaattagtcaatcaaa

SEQ ID NO: 152919 - DNA, 601 bp, Human
gtgggcaggcaaagaaaagacagtgagtggtagctaattaattagtcaatcaaaaagtatttatagttctctaggtatagggcaccatgctggactcagtgggagatgcaaagaagagtaagacccaacctcagcccctgaaaagcttgcagccggtctccttgggaggcgaggtgtacaggtgctgacaggaaagaaagcacaaggcaggtttttaattgggccgtatgtctcacagatgcaaaataggtaatccaggcacataggttgttattctaggcttatcaccattgacattgcrccatggagtgtcaacattcagagcatctgtgaaagctgcttttataactggttagagtgagctagttaagggcttaacagacccttcaccaatgagcacaagatgggttgggtgaagaaaatatgagggatgaaggagtgctgctagtttccaaaaatgaccccaaagagattgggccttcatcctttgctgtttagaagcaaaagagtcattgtaaaaatgttcagagggaaaatatgtgtaaatatgttcagagggaaaaataacgaattacataccacaattttcattttatggtaa

SEQ ID NO: 152920 - DNA, 601 bp, Human
agaaagcacaaggcaggtttttaattgggccgtatgtctcacagatgcaaaataggtaatccaggcacataggttgttattctaggcttatcaccattgacattgcgccatggagtgtcaacattcagagcatctgtgaaagctgcttttataactggttagagtgagctagttaagggcttaacagacccttcaccaatgagcacaagatgggttgggtgaagaaaatatgagggatgaaggagtgctgctagtttccaaaaatgaccccaaagagattgggccttcatcctttgctgtwtagaagcaaaagagtcattgtaaaaatgttcagagggaaaatatgtgtaaatatgttcagagggaaaaataacgaattacataccacaattttcattttatggtaaccgcacatacacgtagacttgagaaaactcttttaaacatgttggaggaataagtacatgggcagaggaaaatgaaatgttggggacaaaaataaggctatactgacctgaagttttctgttagtcatttccattgaccagatcttctagatgactgcttgacatttcaaatataactattcccactgacagca

SEQ ID NO: 152921 - DNA, 601 bp, Human
aaccttgaaaagtgaggggaaaattcagataagaaaaaaaaaaatgacccaaaaggaggatgggtgcacttctcattataatgaaactcaaaagagaatacaaaaaaattaattcaaaacaaggaattaacattaatctcaagtacagttttttaaaactgatttttttttttttttttctgagacagggtctcattttttcactcaggctggagtgcagtggggtgaacacggctcactgcagcctcgacctcccaggctcaagagatcctcctgcctcagtcctccaaatagctgggaytgtaggcgtgtgccaccacacccagctaatttttccattttatgtagagatgggtttcgctgtgttgcccaggctggtctagaactcttgggatccagcgatccacccgcctctgcctcccaaagtgctaggattacaggcatgagccactggccccggctcctaaaacaaattgtgaaaaggagaaagttgtgcgatgttatgttccttcctcttttttccccacacacactcacactctggtcaggtgtttgtgtatatcctttgacctttccttgccatcggcttctacttaaatag

SEQ ID NO: 152922 - DNA, 601 bp, Human
aagcaaattccttggtctatccccctggctctgactcattccttaccctgaccttgctgtctgtatttgctttgactaccctatgagtttcctcaacctaattcttaattcctggctgccacctccttgtcaaaacttggctaaatccactttggaatgctaaggcggatgggactgcctgggaagaatttggagaatctgcagctctgctctttcctcattcttgagagccaggctagtggctgagggtatatcgggagacagacagggagagagacagagagagtttggagagaaggcrgcatgatcatccgatcatcttgggccccatcagtctccttgggaatgctaacatgtctcctggtatagtctttcttttatttattcttcagtttatcttagaaactgttctgaaagttttaaacccagagacatctctccaacttccttgcatgagctgtattttgaccgccttaggggctgtggcaggatttcagtcttgcttgtggtgattttacatggagtgacatctgagtcgcttttcgactgcattccacaccaatctgtccagccctgcagtttgtgggctgactcctgttgt

SEQ ID NO: 152923 - DNA, 601 bp, Human
ccaggctggagtgcagtggcgtgatctcagctcactgcaacctccacctcctgggttcaagcaattctcctgcctcagtctcccaagtagttaggattacaggtgcccgccaccatgcctggctaacttttttatttttattattttattttatttatttatttttgagacagagtctcactctgtcgccaggctggagtgcagtggcacaatctcggctcactgcaacctctgcctcctgggctcaagtgattctactgcttcagcctcccaagtagctgggattacaggcgtgtgccaycaagcccagctaatttttgtatttttagtagagacggggtttcaccatgtaggccaggctggtctcgaactcctgacttcgtgatccgcctgcctcagcctcccaaagtgctgggattacaggcgtgagccaccgcacccggtcaccctgccccatttttatccccagtcctctaatcagctttaatccctatttatcccagccaagagtactgggtaactgaagatccctgtctctacaaaccaccccacctaagactaaattttgcttaaacataaccagaagccttacaaaaggaaa

SEQ ID NO: 152924 - DNA, 601 bp, Human
ctcagtgcctcttaagagcatattcatctttctttcatttagtgttcatactgctgtcccgcactcaatgactaaatatgttatctacataattatcaaaaaagaaactaatgttcttgattagaatgtaaattggaaggaattatcattctgtagattttcattttaaaaagaacaaatcactaaatttaggaactaaagttttgaaggaagctggtcttatgcaaaggcaaatatgactttgatgtaacataactacgtcacggtgttttacctttgcctattcctaaccaactatgctttttttttttttttttttttgagttggagtctcactctgttgcccaggctggagtgcagtgatatgatctgggctcactacaacctctgcttcccagattcaagcgattctcttgcctcagcctcccgggtagctgggactacaggcgcccgccaccacgcccagctaattttttgtatttttaatagagacggggtttcaccatgttagccaagatggtctcaatctcctgacctcgtgatccgcctgcctcgtcctcccaaagtgctgggattataggcgtgaaccaccatacctggc

SEQ ID NO: 152925 - DNA, 601 bp, Human
acgcagtggctcacgcctgtaatccagcactttgggaggccgcggcgagccgatcacgaggtcaggagatcaagaccatcctggctaacacggtgaaactccgtctctactaaaaatgaaaaaaattagctgggcgtggtggcgggcgcctgtagtcccagctactcgggaggctgaggcaggaaaatggcgtgaacccgggaggcggagcttgcagtgagccgagatcgcgccactgcactccagcctgggcgacacagagcaagactccgtctcaaaaaaaagagaaacttttagaagkaacataatcccttacaaatgcataataggcatagatcaaaggaccactctattatgatactggtattatgatgtgctttagaaggtgagtgtttttttcctctggtgataatcacttaagttgcgctcaacagttgaagtatttttgcgtttttataatgcgacaaacactgtgctaggtgcaagaaaattgaagatgaattatacacagtcctaatgctccagaatctttggtctcaatgcattactattcatggccccaaattctttgattaagggatgctcaaaggatgcagtttgg

SEQ ID NO: 152926 - DNA, 601 bp, Human
gcttaagaaaatttatgttctccctagtttttaaaaaatagaggaaaggaaggaaaagaatagaagacagaaggaagaaaggcaagcaagaaagagagaaagaaagaaacacttgtcatctgaaagtttagactccagctctacaacacaaagaaaagtacaggcagctatagtccatctgcccatgacgttaatactttgaacatgccgtttattttttctctcgcttacagaaccatgtgtcattggcattaagcttgcagctgttgcctctcacatcagccagaagtgggggttgaaytttattccaagaacacacctgttgcctaggaaaaaagccctcacatacctgattgtacaggatggaaatttgagagtgacacaaatgtgcatcatattaaatcctgtgcctgtgcttaaaagtcatttcacagataccagtaaggaataagggcagccaagctatgatttaacgtctgtctcgatgtgttggctgctggttgggcttaatttactgaacactcaatagcctattgacagaacagaccacaaaaaaggggatctaatagctacaattaggaatctctgctgaacctaagag

SEQ ID NO: 152927 - DNA, 601 bp, Human
aaatgaaagaaccacaatttgaacaaaagggcaataaaattcaactaaacgtaacacacataaggcatactatgattaaatcacatgctgtataatgttctgtccttgagttctttgacttctataaaggatgaacatgatcagaaaattattacagcctcacttttgatgggtcatagtcactatgctagatattcctagtctttaccatttatttaaatcatctacaaaatagcttgctcactttgtgccatgctgttcagttaatgagttcaaagagtggcaaaatgagaagtctctsttcctctgactcacactggcagattgtattaatatttggatttagagtggccctgcttttgacagcatgaccttgagctagtcccttcatctgctccttaacgaggcaggatgacataatttctcagggcctctgtctctcaatagcccatgcacctgactcatcagttctctcagcctgaaagcatgagggagctattcggtttccaaatgaagagcttgcaatagggtggcctcatcaccattataaagagcatcttcagccatgccagggaagatgccctgagaaacaagcagaagg

SEQ ID NO: 152928 - DNA, 601 bp, Human
atccaggatccccatcccaaaaaatcttatcagaagcaccactgtgaggctgactcagcaaaccagcccattccatgtcgttctcctcacctccccactctgccttcagccaacttgctcttcccatgaacttccagttttctgttcactgttttaatttgaacattaatttttattaccactagatgtggaatatcttggcaattgcaagcccgaagaatctgtatgtctttcagtttcaccaaatggcagagatccaaaaaatgacttgcatcaagaattctgcctctaggtttcatcyaggctttaaatggggcatcttctttcttactggcttagccattaatgatagccagaatttttagagaaggaagcatttaaaagtcatctattccagttatccacccctccacccccttgcttgcttgcttgcttttcttctttttcttgcttctttcttcccttcctttcttctccctcttttctttcttttcctttctttccatttattttcatccttctttccttccctacttccttctctccttttgttttttccctctttttgtcttcctcccttccttccgtctccctttccttt

SEQ ID NO: 152929 - DNA, 601 bp, Human
aaccagcccattccatgtcgttctcctcacctccccactctgccttcagccaacttgctcttcccatgaacttccagttttctgttcactgttttaatttgaacattaatttttattaccactagatgtggaatatcttggcaattgcaagcccgaagaatctgtatgtctttcagtttcaccaaatggcagagatccaaaaaatgacttgcatcaagaattctgcctctaggtttcatccaggctttaaatggggcatcttctttcttactggcttagccattaatgatagccagaattyttagagaaggaagcatttaaaagtcatctattccagttatccacccctccacccccttgcttgcttgcttgcttttcttctttttcttgcttctttcttcccttcctttcttctccctcttttctttcttttcctttctttccatttattttcatccttctttccttccctacttccttctctccttttgttttttccctctttttgtcttcctcccttccttccgtctccctttcctttgcttttattttcttttacttccttccttcccttctttttcctccctccctccctccctct

SEQ ID NO: 152930 - DNA, 601 bp, Human
agataaaacatcttctcttcttgctctctccttgtggtatagacaaacatctgactccttcgtctaaaaggactgtaggcctccacgtttctgtgctttcaggtcctacaagttgtcatggcagctgtgtctcccaccacccttgtggtaattggctgactggtgagaagcaagaccgcactgacctgcctccttcctcactccctctttctagaagaggaggataggtctccatgaccaggcttaggcccagggcagaggagagggtggaaggctactgtgcctcttagtgaccaggagratgctgcctccaggacagaactctgtccctctaggtcttcatttctgcgcctttgcactggcgtgggctcggcctgatcattactatgctgttggcaccaaatttgcagaattcagaaaagtcacagatagatcagcctctgttaccgtgtcttcccaagaacgtggagaagttttattctcagcgtagaacacatagtttgctaccaaacatgctttgattcacagcccatctcctgctaaatctcaggccttcattggacatccctgtgactccttttttacttaaagtttgtttcta

SEQ ID NO: 152931 - DNA, 601 bp, Human
caaaaattagccgggcgtggtagtgcacacctgtaatcccagctacttgggaggctggggcaggagaatcgcttgaacccaggagccggaggttgcaatgaatcaagattgtgccattgcactccagcctgggctacagagcgagactctgtcttaaaaaaataaagagagagagaaaaaagagagagagaaaaaaaaggctttttcttctaacactttcatggctttatttttgacacataaatttgatccacatttgagtttatcttggtgaatgacgttaaggcatggatccaactgttttttttttttccagataggttcctgcagttcccatcactatcattaatcagtccatttcccccatggatcgaaatgctgcctttatcacatgctaaacacctgtatatcttcaggtctgtttttggactttctgttcattccattgtgctgttcatgtctcagttccaactgctttagtcactgaggatttagagcagcagtagtcaacctttttggcaccagggaccgatttcctggaaaacagtttttctgtggaccggggagagggattgcactttatttctattgttattatata

SEQ ID NO: 152932 - DNA, 601 bp, Human
caccagggaccgatttcctggaaaacagtttttctgtggaccggggagagggattgcactttatttctattgttattatatactcatcagaagatagaatcagtgagagccctgagcttattttcctgcaactagacggtcccatttaggggtaatgggagacagtgacagatcatcaggcattatattctcgtaaggagcacacaacctagatccctcgcgtgcagtgttcacaatagggttcatgctcctatgagaatctaatgccattgctgatctcacaggtggtggagctcgggcrgtaatgcaagcgatggggagtggctataaatatagacgaagctccagtcacttgcttgctggcttgctcactgctcacctcctgctgtgcaccccacttcctaacaggccatggaccagtaccagtctgtgtgtcctgggggttggggacccctgattcagagtatgtttcatgtgtaatagagttaattccccccatgggtcttcctatccagagttctcctggatggtcttgcttgtctttgcctttttatttaaaatcagcttgtctgtttccagaagaaaaatgttggagttttta

SEQ ID NO: 152933 - DNA, 601 bp, Human
gcacacaacctagatccctcgcgtgcagtgttcacaatagggttcatgctcctatgagaatctaatgccattgctgatctcacaggtggtggagctcgggcggtaatgcaagcgatggggagtggctataaatatagacgaagctccagtcacttgcttgctggcttgctcactgctcacctcctgctgtgcaccccacttcctaacaggccatggaccagtaccagtctgtgtgtcctgggggttggggacccctgattcagagtatgtttcatgtgtaatagagttaattccccccatrggtcttcctatccagagttctcctggatggtcttgcttgtctttgcctttttatttaaaatcagcttgtctgtttccagaagaaaaatgttggagtttttattggaatcggttaaaattataagttagtattaaaatgttcacatgtgtgtgatgttgagtcttcctctccaaaaccaggatatgtctctccattgattcaagtccacttttgtatccttcaggagtaggattaagtttttctgcagagttttggcatgattcttgagtttattttggaggacaggggctgttattttta

SEQ ID NO: 152934 - DNA, 601 bp, Human
tcagcactttttcagtatatagttatttgcaagtagtaattactgacctcttcctttttatacctttcatgtctttttatttactattacctttaagacagtattttaaaaatgttgacagaggcttatcttttagcaggaatgtcagcccattaagtatgatgcttgttttgggctgaaaacaaactgtgtgtgtgtgtgtgtgtgtgtgtgtgtgtgtgtgtgtggtcattttaatgttcaattctgtatctcccatttttttattatactttaagttctagggtacatgtgcacaacrtgcaggtttgttacatatgtactcatgtgccgtgttggtttgctgcacccattaactcgtcatttatattacgtatttctcctaatgctatccctcccacatccccccaccccatgacaggccctagtgtgtgatgttccccgccctgtgtccaagtgttctgtttgttcagttcccacctatgagtgagaacatgcaatgtttagttttctgtccttgcaatagtttgctcagaatgatggtttccagcttcatccgtgtcgctacaaaggacatgaactcatccttttttatggctgc

SEQ ID NO: 152935 - DNA, 601 bp, Human
gcttgttttgggctgaaaacaaactgtgtgtgtgtgtgtgtgtgtgtgtgtgtgtgtgtgtgtggtcattttaatgttcaattctgtatctcccatttttttattatactttaagttctagggtacatgtgcacaacgtgcaggtttgttacatatgtactcatgtgccgtgttggtttgctgcacccattaactcgtcatttatattacgtatttctcctaatgctatccctcccacatccccccaccccatgacaggccctagtgtgtgatgttccccgccctgtgtccaagtgttctstttgttcagttcccacctatgagtgagaacatgcaatgtttagttttctgtccttgcaatagtttgctcagaatgatggtttccagcttcatccgtgtcgctacaaaggacatgaactcatccttttttatggctgcatagtattccatggtgtctcccatttttaagcaagaagattgttgaatttttttcaaaggtctttttcagcatctatagatgctaaaaatataacttttcttcttagatcttttaataaattacattaatatattagtatttcttcatattgagtcattctta

SEQ ID NO: 152936 - DNA, 601 bp, Human
tcagttcccacctatgagtgagaacatgcaatgtttagttttctgtccttgcaatagtttgctcagaatgatggtttccagcttcatccgtgtcgctacaaaggacatgaactcatccttttttatggctgcatagtattccatggtgtctcccatttttaagcaagaagattgttgaatttttttcaaaggtctttttcagcatctatagatgctaaaaatataacttttcttcttagatcttttaataaattacattaatatattagtatttcttcatattgagtcattcttatatttyaggaggctatttagttatatcgaagtgaccattctaaactttatctcatgtttctttcaagatgtttaaggaatttcacagtggcaaagagaaatacgaaattttctgagttatgtaaactaatttgttcaaggaaaacatgctgcctttgaaaaatccttatgtactttcaagctttattattaatatattattaaatatcaagtgcattttaaaatactttttaaatcttaagaccattgtatgtacacagtacataggcttatttcagatcctctgtccaaatgaaaacaaaattgt

SEQ ID NO: 152937 - DNA, 601 bp, Human
caagatgtttaaggaatttcacagtggcaaagagaaatacgaaattttctgagttatgtaaactaatttgttcaaggaaaacatgctgcctttgaaaaatccttatgtactttcaagctttattattaatatattattaaatatcaagtgcattttaaaatactttttaaatcttaagaccattgtatgtacacagtacataggcttatttcagatcctctgtccaaatgaaaacaaaattgtcgtttttactttgagacagggtctcactcctttcgcccaggctggagtgcagtagcamgatcaaggctcactgcagcctcaacttcctggggtcaggtgattctcccacctcagcctcctgaatagctgggactacaggtgcacaccaccacgctcagctaatttttcatatttttagtagagacagcgtttcaccatgttgctcaggctggtcttgaactcctaggctcaagcaatcctcccaccttggccccccaaagtgttgggattacaggagcgagccacggtgcctggccttaaaaatatacatttcctatcatagattcatagttaaactacagccaacagatttgaaatg

SEQ ID NO: 152938 - DNA, 601 bp, Human
gtacataggcttatttcagatcctctgtccaaatgaaaacaaaattgtcgtttttactttgagacagggtctcactcctttcgcccaggctggagtgcagtagcaagatcaaggctcactgcagcctcaacttcctggggtcaggtgattctcccacctcagcctcctgaatagctgggactacaggtgcacaccaccacgctcagctaatttttcatatttttagtagagacagcgtttcaccatgttgctcaggctggtcttgaactcctaggctcaagcaatcctcccaccttggccycccaaagtgttgggattacaggagcgagccacggtgcctggccttaaaaatatacatttcctatcatagattcatagttaaactacagccaacagatttgaaatgtgtaactgttgaaaacaaaagttcaaagtaactttaaaatgcatttttttctgttatgtacgtaacctacacttttcaaatttaaaattaaaaaaaaaacagcaacaataacgtgtaggaattgtaatgaactcttgttgcgttcacttctttgcataactcgttattgcctgtacaaacaaattaagcaggaag

SEQ ID NO: 152939 - DNA, 601 bp, Human
ggctggagtgcagtagcaagatcaaggctcactgcagcctcaacttcctggggtcaggtgattctcccacctcagcctcctgaatagctgggactacaggtgcacaccaccacgctcagctaatttttcatatttttagtagagacagcgtttcaccatgttgctcaggctggtcttgaactcctaggctcaagcaatcctcccaccttggccccccaaagtgttgggattacaggagcgagccacggtgcctggccttaaaaatatacatttcctatcatagattcatagttaaactacrgccaacagatttgaaatgtgtaactgttgaaaacaaaagttcaaagtaactttaaaatgcatttttttctgttatgtacgtaacctacacttttcaaatttaaaattaaaaaaaaaacagcaacaataacgtgtaggaattgtaatgaactcttgttgcgttcacttctttgcataactcgttattgcctgtacaaacaaattaagcaggaagaggaagaacctccacaatgacattagcctttcctggcctgttttcagtagttggtactttaggggcaattaaattctttggtcgagt

SEQ ID NO: 152940 - DNA, 601 bp, Human
cctggggtcaggtgattctcccacctcagcctcctgaatagctgggactacaggtgcacaccaccacgctcagctaatttttcatatttttagtagagacagcgtttcaccatgttgctcaggctggtcttgaactcctaggctcaagcaatcctcccaccttggccccccaaagtgttgggattacaggagcgagccacggtgcctggccttaaaaatatacatttcctatcatagattcatagttaaactacagccaacagatttgaaatgtgtaactgttgaaaacaaaagttcaaaktaactttaaaatgcatttttttctgttatgtacgtaacctacacttttcaaatttaaaattaaaaaaaaaacagcaacaataacgtgtaggaattgtaatgaactcttgttgcgttcacttctttgcataactcgttattgcctgtacaaacaaattaagcaggaagaggaagaacctccacaatgacattagcctttcctggcctgttttcagtagttggtactttaggggcaattaaattctttggtcgagtaagtcaggcaaagctgaatcctcactggagttgctgaatctgaaag

SEQ ID NO: 152941 - DNA, 601 bp, Human
atttttagtagagacagcgtttcaccatgttgctcaggctggtcttgaactcctaggctcaagcaatcctcccaccttggccccccaaagtgttgggattacaggagcgagccacggtgcctggccttaaaaatatacatttcctatcatagattcatagttaaactacagccaacagatttgaaatgtgtaactgttgaaaacaaaagttcaaagtaactttaaaatgcatttttttctgttatgtacgtaacctacacttttcaaatttaaaattaaaaaaaaaacagcaacaataacrtgtaggaattgtaatgaactcttgttgcgttcacttctttgcataactcgttattgcctgtacaaacaaattaagcaggaagaggaagaacctccacaatgacattagcctttcctggcctgttttcagtagttggtactttaggggcaattaaattctttggtcgagtaagtcaggcaaagctgaatcctcactggagttgctgaatctgaaagagattcctctactccttagagctcatgatataatgattggaatattgcactaggggaaggaaacctgggtttcacctccaagttg

SEQ ID NO: 152942 - DNA, 601 bp, Human
acatttcctatcatagattcatagttaaactacagccaacagatttgaaatgtgtaactgttgaaaacaaaagttcaaagtaactttaaaatgcatttttttctgttatgtacgtaacctacacttttcaaatttaaaattaaaaaaaaaacagcaacaataacgtgtaggaattgtaatgaactcttgttgcgttcacttctttgcataactcgttattgcctgtacaaacaaattaagcaggaagaggaagaacctccacaatgacattagcctttcctggcctgttttcagtagttgrtactttaggggcaattaaattctttggtcgagtaagtcaggcaaagctgaatcctcactggagttgctgaatctgaaagagattcctctactccttagagctcatgatataatgattggaatattgcactaggggaaggaaacctgggtttcacctccaagttgaccatgaacttagtgtgcagctgtggatggggttcttaattctctgggtctttgaatctgcacatgatgatgttcgccgccaggaaacctgtggagcacctgccctgattcttcctttctgttctgtgttcgctga

SEQ ID NO: 152943 - DNA, 601 bp, Human
caattaaattctttggtcgagtaagtcaggcaaagctgaatcctcactggagttgctgaatctgaaagagattcctctactccttagagctcatgatataatgattggaatattgcactaggggaaggaaacctgggtttcacctccaagttgaccatgaacttagtgtgcagctgtggatggggttcttaattctctgggtctttgaatctgcacatgatgatgttcgccgccaggaaacctgtggagcacctgccctgattcttcctttctgttctgtgttcgctgacataagcaaaayggaacagacaacatgtgcaggggtgaatttgtgagcatgcccagggctgctgtgcttggggtgaatcacattacccttgggtacctcttcacttgcatctgggaaaaaactgattgagtctcacatgcatgatattcctctgtggaaatgcatggcatgtatctacagctcagtccatgccagaagttcctgagagctggctgggtgtggtggttcaggcctgtaatcccagcatttttagaggccaagtggggggaattgcttgaggccaggagttcaagaccagcctaagcaatatag

SEQ ID NO: 152944 - DNA, 601 bp, Human
agcacctgccctgattcttcctttctgttctgtgttcgctgacataagcaaaacggaacagacaacatgtgcaggggtgaatttgtgagcatgcccagggctgctgtgcttggggtgaatcacattacccttgggtacctcttcacttgcatctgggaaaaaactgattgagtctcacatgcatgatattcctctgtggaaatgcatggcatgtatctacagctcagtccatgccagaagttcctgagagctggctgggtgtggtggttcaggcctgtaatcccagcatttttagaggccragtggggggaattgcttgaggccaggagttcaagaccagcctaagcaatatagtgagaccccatcactattttttttttttgagacagaatatcactctttcacccaggctggagtgcagtggcagcatcttggcttactgcaacctcttcctcctgggttcaagcgatcctcgtgcctcagcctcccgagtagctggaactacagatgtgcgccaccatgccaggctaatttttctgcgtttagtagagatggagtttcaccatgttgaccaggctggtctcaaactcctgacctcaag

SEQ ID NO: 152945 - DNA, 601 bp, Human
gcaggggtgaatttgtgagcatgcccagggctgctgtgcttggggtgaatcacattacccttgggtacctcttcacttgcatctgggaaaaaactgattgagtctcacatgcatgatattcctctgtggaaatgcatggcatgtatctacagctcagtccatgccagaagttcctgagagctggctgggtgtggtggttcaggcctgtaatcccagcatttttagaggccaagtggggggaattgcttgaggccaggagttcaagaccagcctaagcaatatagtgagaccccatcactattttttttttttgagacagaatatcactctttcacccaggctggagtgcagtggcagcatcttggcttactgcaacctcttcctcctgggttcaagcgatcctcgtgcctcagcctcccgagtagctggaactacagatgtgcgccaccatgccaggctaatttttctgcgtttagtagagatggagtttcaccatgttgaccaggctggtctcaaactcctgacctcaagtaatccaccgcctcgacctcccaaagtgctgggattacaggcatgagccactggccccggctggccccat

SEQ ID NO: 152946 - DNA, 601 bp, Human
accctttcattagctgagcatggtggcacgcacctgtagccctggcttctcgggagactgaagcgggaggatcattttagcccaggagttctaggctgcagtgggccactatcacggtattgcactccagcctgggtgacagaggaggctctgtcctaaaaaaagaagaaaaaaatatgcttttagaggattgtttccaatgtcctgaattaatcatgttactgaatactgcagaatatatgttctttgtcttgcctcttgccttgacgcctcttttccctacttgccgtctttctaaaastgtgcccataattggaaatttgttgttgttttctatctagacttcgagataactctgttgtttgcctggaggctgcttcagcaatacttttgtacaaaaggaatgacctctttacatactgatttcgtttagcttatcttgttatttctattcatgcacccattcccacaaaacacacagacacacacacacacacacacgtgcgcacgtgcactccctccactcatctatgaattcctcatgatattgtattggctacatgtaagaaaaaacagtctcagtcaaatgtatgggcacact

SEQ ID NO: 152947 - DNA, 601 bp, Human
aaaacacacagacacacacacacacacacacgtgcgcacgtgcactccctccactcatctatgaattcctcatgatattgtattggctacatgtaagaaaaaacagtctcagtcaaatgtatgggcacactggctgaagcatcactctgattctagggaatgtgtttgcagatttattatattactatgcataaagcaagtacaaaatatgttttccaaccttcagtatttttttccttttctggttgtctttacattgtggtttaacactgttagttttaaaacatgccagattttacayacacacacatatgttataacatattacacaccaagtctttttcatgtatcaaatataagatgttttagtgatgtaaaagagaactcacatgtgtttgcaatacaaatcctttcccttttagaaaacccttttaaaaaaatattttaaatagtgaggtacttggaatgctgatacttgactttcaattgctttagttaaaacaaattcatatacaggtaaagtagcatgatttataactttgggcccacctgttgagagttggggtttattacaaggttccagaattatgctcttttcttc

SEQ ID NO: 152948 - DNA, 601 bp, Human
ttccttttctggttgtctttacattgtggtttaacactgttagttttaaaacatgccagattttacatacacacacatatgttataacatattacacaccaagtctttttcatgtatcaaatataagatgttttagtgatgtaaaagagaactcacatgtgtttgcaatacaaatcctttcccttttagaaaacccttttaaaaaaatattttaaatagtgaggtacttggaatgctgatacttgactttcaattgctttagttaaaacaaattcatatacaggtaaagtagcatgatttrtaactttgggcccacctgttgagagttggggtttattacaaggttccagaattatgctcttttcttccagccctgtctctgtctagcactgtgcccataatagctagtaagtgttttctaaatacataagtgaaaacaagtatttaaatggatgaatcaaattattaaggaagaatggaatcaatggacagatgaatttactgtggcggacagcttgaatcaagccaaacctagaccagtagttaaaaaacaaatcatcagctaggcgtggtggctcacgcctgtaatcccagcattttg

SEQ ID NO: 152949 - DNA, 601 bp, Human
agtgagatcccctctccccaaagctcatttgtaaattatttcttagaaacttggaagacattctcccatagacatttcccatagaccatgggtggttgggctcccatggaaagatatcgaacagcaccgccgcacgtgctgtgcacagaggctgcagctcgaaaactattcactaacggtttgtaccatgagataagtacagaaattatgcgttacactttgaaaacttgtatagcagtgcaacagaggaattgtctgctaaatctagtaattgaaataacttagacttgtactatacttygtatttcagtttttttaatttcatttttctagtactgcatttttacttattttacaaaggtatcagtctgtgatagatgagacattatgaagaaaaaccttccctataggttactgagcagtacttacataatgcaaaatactaaaacatttattttaccatgcttttagttaaatgagacaagaaaacaataacatgaaatgaaaaatagtcatctgttatgaatgctgacacctaggggaatgtgagtttaattagagaaagtcaaagacataaatagggatttctatgtgtattttc

SEQ ID NO: 152950 - DNA, 601 bp, Human
ggttgggctcccatggaaagatatcgaacagcaccgccgcacgtgctgtgcacagaggctgcagctcgaaaactattcactaacggtttgtaccatgagataagtacagaaattatgcgttacactttgaaaacttgtatagcagtgcaacagaggaattgtctgctaaatctagtaattgaaataacttagacttgtactatacttcgtatttcagtttttttaatttcatttttctagtactgcatttttacttattttacaaaggtatcagtctgtgatagatgagacattatgaagaaaaaccttccctataggttactgagcagtacttacataatgcaaaatactaaaacatttattttaccatgcttttagttaaatgagacaagaaaacaataacatgaaatgaaaaatagtcatctgttatgaatgctgacacctaggggaatgtgagtttaattagagaaagtcaaagacataaatagggatttctatgtgtattttcagctgactttgggtctgattcctttctactttagataccaaacaagatttttcttttttctttatatgagtatatagttatgctgctttggtg

SEQ ID NO: 152951 - DNA, 601 bp, Human
aaatctagtaattgaaataacttagacttgtactatacttcgtatttcagtttttttaatttcatttttctagtactgcatttttacttattttacaaaggtatcagtctgtgatagatgagacattatgaagaaaaaccttccctataggttactgagcagtacttacataatgcaaaatactaaaacatttattttaccatgcttttagttaaatgagacaagaaaacaataacatgaaatgaaaaatagtcatctgttatgaatgctgacacctaggggaatgtgagtttaattagaraaagtcaaagacataaatagggatttctatgtgtattttcagctgactttgggtctgattcctttctactttagataccaaacaagatttttcttttttctttatatgagtatatagttatgctgctttggtgcttagcaaccattattggggttaccttggaattcacgagtgggacaaaaagacaggaaaagagattttctgaggataaccgagtaggaattgaaagaaagaagagtagggaggtggcatatgcacttaagagagatttgtcttgttaaaaataaattctggagggat

SEQ ID NO: 152952 - DNA, 601 bp, Human
ctgcatttttacttattttacaaaggtatcagtctgtgatagatgagacattatgaagaaaaaccttccctataggttactgagcagtacttacataatgcaaaatactaaaacatttattttaccatgcttttagttaaatgagacaagaaaacaataacatgaaatgaaaaatagtcatctgttatgaatgctgacacctaggggaatgtgagtttaattagagaaagtcaaagacataaatagggatttctatgtgtattttcagctgactttgggtctgattcctttctactttagwtaccaaacaagatttttcttttttctttatatgagtatatagttatgctgctttggtgcttagcaaccattattggggttaccttggaattcacgagtgggacaaaaagacaggaaaagagattttctgaggataaccgagtaggaattgaaagaaagaagagtagggaggtggcatatgcacttaagagagatttgtcttgttaaaaataaattctggagggatattcattgaattactgacggtggtcacccttgtggggtgggattattgagtgtttttacagtttaaacatccatg

SEQ ID NO: 152953 - DNA, 601 bp, Human
gtcttgttaaaaataaattctggagggatattcattgaattactgacggtggtcacccttgtggggtgggattattgagtgtttttacagtttaaacatccatgtcttttgaactttttacaacaagcatgtgttgctgttatcatcagaagaggggaaaaggaatatttggtgctagaataaaaatgcttggaatcaagatactgcctgaaaggcagttcatctagcagcaaaaaacaaagtaaagagaaaatgtgggcatcagctggtgtgaccaatcctgcacagcttggctgcaggrcaccctagtggtcaggggtcccagctgcctgggaatccacggggaatgaggaaccagtgtttagcaagcacctttcatggttgagcggtcatagtgagttctcaatgcaggtgagttaatattgggtggacctggttcatgaatgaccaaatctggttcttagctttttaatttaagaggcagagtctccctctgtcacccaggctggagtgtggtggcatgatcatagttcactgcagcctcaaactcctgggctcaagagatcctcccacctcagtctcccaagtaactgcgaccaca

SEQ ID NO: 152954 - DNA, 601 bp, Human
gaaaaggaatatttggtgctagaataaaaatgcttggaatcaagatactgcctgaaaggcagttcatctagcagcaaaaaacaaagtaaagagaaaatgtgggcatcagctggtgtgaccaatcctgcacagcttggctgcagggcaccctagtggtcaggggtcccagctgcctgggaatccacggggaatgaggaaccagtgtttagcaagcacctttcatggttgagcggtcatagtgagttctcaatgcaggtgagttaatattgggtggacctggttcatgaatgaccaaatctgrttcttagctttttaatttaagaggcagagtctccctctgtcacccaggctggagtgtggtggcatgatcatagttcactgcagcctcaaactcctgggctcaagagatcctcccacctcagtctcccaagtaactgcgaccacaggcagctaattaaaaaaaaaaaaaaaaaagtttgtagagacagggggatctcactatgtttcccatactggtattgaactcctggtctcaagcagtcctcccaccatggcctcccaaaatactggcattagagatttgagccatcgtgactggccc

SEQ ID NO: 152955 - DNA, 601 bp, Human
ggtgctagaataaaaatgcttggaatcaagatactgcctgaaaggcagttcatctagcagcaaaaaacaaagtaaagagaaaatgtgggcatcagctggtgtgaccaatcctgcacagcttggctgcagggcaccctagtggtcaggggtcccagctgcctgggaatccacggggaatgaggaaccagtgtttagcaagcacctttcatggttgagcggtcatagtgagttctcaatgcaggtgagttaatattgggtggacctggttcatgaatgaccaaatctggttcttagctttttwatttaagaggcagagtctccctctgtcacccaggctggagtgtggtggcatgatcatagttcactgcagcctcaaactcctgggctcaagagatcctcccacctcagtctcccaagtaactgcgaccacaggcagctaattaaaaaaaaaaaaaaaaaagtttgtagagacagggggatctcactatgtttcccatactggtattgaactcctggtctcaagcagtcctcccaccatggcctcccaaaatactggcattagagatttgagccatcgtgactggcccttagctaaatttta

SEQ ID NO: 152956 - DNA, 601 bp, Human
tcaggggtcccagctgcctgggaatccacggggaatgaggaaccagtgtttagcaagcacctttcatggttgagcggtcatagtgagttctcaatgcaggtgagttaatattgggtggacctggttcatgaatgaccaaatctggttcttagctttttaatttaagaggcagagtctccctctgtcacccaggctggagtgtggtggcatgatcatagttcactgcagcctcaaactcctgggctcaagagatcctcccacctcagtctcccaagtaactgcgaccacaggcagctaattaaaaaaaaaaaaaaaaaagtttgtagagacagggggatctcactatgtttcccatactggtattgaactcctggtctcaagcagtcctcccaccatggcctcccaaaatactggcattagagatttgagccatcgtgactggcccttagctaaattttacagtcactagagattaactttcttttcttgccttattttcgttttccatattagtaagagaggcaattttttaaaaggggaaggaaaactagtatttgtggagggtctgctaggtatcaggccctgggcacagctatcaaca

SEQ ID NO: 152957 - DNA, 601 bp, Human
acaggcttgagctaccacacctggccaagagtttttaatgtatctttcgaggtaatgaaaccatgcctcagaaaggttgggtaagttgggaatggctatgtgtgtagtaaggggtagagttgaattcgatcccaggcctatctgaagttcatgcttgtggtttctctactacatcacactgctttacagtaatttcagtccttcattattaagcagtaattactgagcttctgttgtaacaaaggcccttctatataggcacctactggcttagtcctctggaatatatcttctatgtggsgccacaaggcatgtatacatgcatgaaagcttggataagaatatgacttaaataacacaaaatgaaaggataatgccgtaatgcttagtgtcacagtggattctaatataaggagtaccttgttgtctctgatttttctgagcggccttagtagccaagtgtcctttatttgtgaaaacccaagattcatcaaccatgaaggatttgctggttctctaagtcaaaagatttggcttaaatatgttgataaagtgcttcagattccttaagtgatagaaaaacaagttagagaatttggag

SEQ ID NO: 152958 - DNA, 601 bp, Human
ccaggttgggtgtttgctgtctgctccacacagttcacaccttatcacttgttactcacatgcactaatgattctgtgttcctgtcttgtttcccctgatttatatctaatttagcatctcagcacatagtaggtattcagaaaatactttttttttttttgagacagagtctcgctctgtcacccaggctggagtgcagtggtgtgatctctggtcactgcaacttccgcctcccgggttcaagcgattctcctgcctcagcctctcgagtagctgggattacaggaacccgccaccacrctcagctaatttttgtatttttagtagagacggggtttctccatattgaccaggctgctctcaaactcctgaccgcaggtgatccaccagcctcagcatccctaagtgctgggattacaggcgtgagccaccacgccctgcccagaaaatactttttgattataaaattgtgtaataagtttctgtttcactcaggtcttttcaatagatttttttctgataatgaaaaaaaatgtttgacataggaaaaatagacaatccatatttgaaaaagagaacaaaaaccattcagaatcccac

SEQ ID NO: 152959 - DNA, 601 bp, Human
agaaaatactttttgattataaaattgtgtaataagtttctgtttcactcaggtcttttcaatagatttttttctgataatgaaaaaaaatgtttgacataggaaaaatagacaatccatatttgaaaaagagaacaaaaaccattcagaatcccactacttgaaggtaacttccactgataccatggcatgtttatttcataaggacattatttgaaagtctaaaaaacccaatcattgtacagtctgttttctccttgatacgatagaatcacaacgtaatctgtgctgactgtgtgtrtagggcaagtggcacctgccaagccctagcagggtataggtatttcagatgagatattaaaatgccgactaatgatgggaccagtcacagaccaagaaaagctggcccttctgtctcaccatggcaatttcagattcaaccacaaatagcaggcaatctgatttctcatttcttaactcttcgcgttagactgtgttactgacaaaacagattttaccctcagaataagttttcgcacaagcagacgtatatgtttctttgtcgatggcacttctggcttacttctttgtgccacttcct

SEQ ID NO: 152960 - DNA, 601 bp, Human
ttcactcaggtcttttcaatagatttttttctgataatgaaaaaaaatgtttgacataggaaaaatagacaatccatatttgaaaaagagaacaaaaaccattcagaatcccactacttgaaggtaacttccactgataccatggcatgtttatttcataaggacattatttgaaagtctaaaaaacccaatcattgtacagtctgttttctccttgatacgatagaatcacaacgtaatctgtgctgactgtgtgtgtagggcaagtggcacctgccaagccctagcagggtataggtakttcagatgagatattaaaatgccgactaatgatgggaccagtcacagaccaagaaaagctggcccttctgtctcaccatggcaatttcagattcaaccacaaatagcaggcaatctgatttctcatttcttaactcttcgcgttagactgtgttactgacaaaacagattttaccctcagaataagttttcgcacaagcagacgtatatgtttctttgtcgatggcacttctggcttacttctttgtgccacttcctaatggcacactgggaagagagtaatttcccaaacttatcaggc

SEQ ID NO: 152961 - DNA, 601 bp, Human
aaaagctggcccttctgtctcaccatggcaatttcagattcaaccacaaatagcaggcaatctgatttctcatttcttaactcttcgcgttagactgtgttactgacaaaacagattttaccctcagaataagttttcgcacaagcagacgtatatgtttctttgtcgatggcacttctggcttacttctttgtgccacttcctaatggcacactgggaagagagtaatttcccaaacttatcaggcaaaataggaaaaagtccatgggaacccaacaagtcatagcaaagaaacattccrtacttctttattttattcttggctatgacagcacaaagggggcagtttggatgttggtttaatgccccactccatctctatgacacctccaaccatccccaaataaatatgctaaaaataacaataataagcacaaagaataaaatcgtatgtagttagtataagcatctttagaggactttgctatttttcataagcagaagcaatccaagtaaaacagcgcacttatcagagagtttcttagtgacttcccatatcacagtttcactgtcctttcccccagataactgtctctgagcc

SEQ ID NO: 152962 - DNA, 601 bp, Human
tctttagggatggagagtgtcattgaggaagcagtgaagacactattcccacaaagttaacccacagtggtaattagtacgggattagggagagggcagtaggctcaggtcagtagacccaactctaatcctacatttgtccaccaatcttgggaaattcactaacctctccaggtcttgattgcttttttggagaggcggagacctgtctctgggtaaataaatatatttattgtcccagggctctttctctttttattcttttttttttttttttttccttgcccaggctggattgccrtggcgtgatcacggctcactgcagcctcagcctcctgggctcaagcaaccctcccacctcagcctcccacctcagcctcccacctcagcctcccgagtagctggaaccacaggcaggtgccaccatgcctggctaattttttaatttttatagagacagggttttaccatgttgcccaggctggtctcaaactcctgggctgaagagatccacccacctcagcttcccaaagtactgggattacgggcatgagccactgcgtccggctcagggctccttcaagcagatccctgggatgca

SEQ ID NO: 152963 - DNA, 601 bp, Human
aatgctaacatgtagaaccccaaatcaaagggcagatcacacacttgaaactctcaagtcacccgcttggccctcttccaagtgtactttacctcctttcattcctgctctaaacttttttttttttttgagacagagtctcgctctgtcgcccaggctggagtgcagtggtgcaatctcagctcactgcactctccgcctcccgggttcatgctgttctcctgcctcagcctcccaagcagctgggactacaggcgcccaccaccatgcccggctaattttttgtatttttagtagagayggggtttcaccatattagccagaatggtcttgatctcctgaccttgtgatctgccctcctcggcctcccaaagtgctgggattacaggcgtgagccaccgcgcccagcctaaactttttaataaactttccctcctgctctcaaacttgcctcagtgtctctctctgcctgtgcccctcggttgaattctttcttatgaggaagcaagaactgtgtggttgctgctgacttgtacagatttgctgctgctaacagttttgtagtggatggcctctgagctgttttgttaattcatctgct

SEQ ID NO: 152964 - DNA, 601 bp, Human
tatctttcttattctgaaaagatacagaaacggggttggtgcttatgttcatgtttacaaaatcaagcatcttcagtcttgttttaagcaaaatcatgaaatgggtgaaatttgtctttagcattctattacctctttttggggctcatttcttgtctcaatttcatctgtcaggttcttctttacctcttcattggcagaaactctagggacttttcctttagggtagagtagaggaccctaaacaacaaatctgaaaacacagtgtctctaattatgaaaaacagggcatcagtagacyaactggggaggtatgtgaggatggcattggcagtagggcctgcaaattgcactgagtacacagatgcccattcttccatctttagaggaagaggggccccttccctttgctgtctggttctcaagaagagggctgatgcagtttcagaaggatctggaaatgcctttagcacaagcatccagggtggatgcttttgccatcttccaagtattgcctgtggcctttccccccgttgtgcctgttcattttgccatccacatgggactttgcagcctgtagtgcttccagtgaaacaatgca

SEQ ID NO: 152965 - DNA, 601 bp, Human
agtcttgttttaagcaaaatcatgaaatgggtgaaatttgtctttagcattctattacctctttttggggctcatttcttgtctcaatttcatctgtcaggttcttctttacctcttcattggcagaaactctagggacttttcctttagggtagagtagaggaccctaaacaacaaatctgaaaacacagtgtctctaattatgaaaaacagggcatcagtagaccaactggggaggtatgtgaggatggcattggcagtagggcctgcaaattgcactgagtacacagatgcccattcytccatctttagaggaagaggggccccttccctttgctgtctggttctcaagaagagggctgatgcagtttcagaaggatctggaaatgcctttagcacaagcatccagggtggatgcttttgccatcttccaagtattgcctgtggcctttccccccgttgtgcctgttcattttgccatccacatgggactttgcagcctgtagtgcttccagtgaaacaatgcaaagctttgatgagtatccagaaatcaactgggcttccctagggagccagctgtctttcctgaggggattagatg

SEQ ID NO: 152966 - DNA, 601 bp, Human
tagaggaccctaaacaacaaatctgaaaacacagtgtctctaattatgaaaaacagggcatcagtagaccaactggggaggtatgtgaggatggcattggcagtagggcctgcaaattgcactgagtacacagatgcccattcttccatctttagaggaagaggggccccttccctttgctgtctggttctcaagaagagggctgatgcagtttcagaaggatctggaaatgcctttagcacaagcatccagggtggatgcttttgccatcttccaagtattgcctgtggcctttcccccmgttgtgcctgttcattttgccatccacatgggactttgcagcctgtagtgcttccagtgaaacaatgcaaagctttgatgagtatccagaaatcaactgggcttccctagggagccagctgtctttcctgaggggattagatggaaataagtcatatttcactagtgtctgctggctcccaaggatggttttaaactgatttctgaaattcattcccctgttcttcatcctaagaccacacggcaatagatgttccaccagcctatctgagaaccccggttgctggtgtgataactgata

SEQ ID NO: 152967 - DNA, 601 bp, Human
aaacagggcatcagtagaccaactggggaggtatgtgaggatggcattggcagtagggcctgcaaattgcactgagtacacagatgcccattcttccatctttagaggaagaggggccccttccctttgctgtctggttctcaagaagagggctgatgcagtttcagaaggatctggaaatgcctttagcacaagcatccagggtggatgcttttgccatcttccaagtattgcctgtggcctttccccccgttgtgcctgttcattttgccatccacatgggactttgcagcctgtagtkcttccagtgaaacaatgcaaagctttgatgagtatccagaaatcaactgggcttccctagggagccagctgtctttcctgaggggattagatggaaataagtcatatttcactagtgtctgctggctcccaaggatggttttaaactgatttctgaaattcattcccctgttcttcatcctaagaccacacggcaatagatgttccaccagcctatctgagaaccccggttgctggtgtgataactgataaagttcaaacagaatgcacagacttgactttgtcaaaattatccctttcc

SEQ ID NO: 152968 - DNA, 601 bp, Human
cattcaaatattctacactatgaggataataattgggtccctgaatagagactctaacaaaaggaacagaagagacactgaaagatgtgataaaatttcccagaaatgaagaaaggactaaacctattccaggaaatatactatggaatgttcaaaacgcaaacatatcttagtgaagctattaaacctcaaggataaagaaataattcttgagatatcaaatcagaataagtcaatttcctacaagggagaaaaaaatcaagctagtctcagatgtcaccattgccacatctggggccaygctctctgaaaatggagagagaaagtgacccaaggatattatatcccatcaagatcttgttaaaatataaagacaacagggagacgtgcttcaacctgaaagaactaaaaaacaactgagagcttgttgaagaaaatacacaataatgaatgcctggccagttaaaaaaaaataaaattaactcagaaacggagaagttatgatgagaatcattaggtttgcataaatgcagaactaatacttaacaactgtgtacactaatactacagattgaatattattgctatcagtttggagaaa

SEQ ID NO: 152969 - DNA, 601 bp, Human
agtttgagaccagcctggacaacatagcaagaacttacctctactaaaaaatttaaaagttagccgagtgtggtggtgtgcgcctgtggccccaactactcaggaggctgaggcaggaggattgcttgagcccaagagttggaggcttccgtgaaccaagattgcaccactgcactgcagcctgggtgacagagtgagaccatgtctctaaaacaaacagacaaaaaaagaaaaacaaacaaaacaacaaaaaaaaaaaccctgtaatctttgaaacctttttttttttctttttttgagacgtagtctccctctgtcacccagtctgaagtctgaagcgcagtagcacaatctcggctcactgcagcctctgccacccaagttcacatgattctcctgcctcagcctcccaaatagctgggactacaggcatgcaccaccatgcatgggtaatttttgtgtttttagtagagacagggtttcaccatgttggccaatctggtcttgaactgctgacctcaggtgatccacccactttggcctcccaaagtgctgagattacaggcatgagccgccatgccttgcctaatctttgaaactt

SEQ ID NO: 152970 - DNA, 601 bp, Human
tgagttgacttgtgtgatctttatactagtctcacaatctttttataatcaaggaaatgtttataactaatttttagctcagattttgagctgctttgttaccaaagactgttcacatctatgatcatctctaacctccatgtatggattttattagctcctatttcctaagtagcgtagatgggctaaattggtggttaagtgttttgtgtttatgggtcgtctacggagcttcattgcagtttctggttcatcaggcctggattgtgtcccaagattctgctttttaataagctcctgsgtgatgcccatgctgctgatcctcattctcaaaacaccaaaattggaaagagttttcatgactctataagaacttaggtatagtccatctcgcctttctcttccaccataaatatgaatgaacttttcttaggttaaagatatttagaggtgttagaggatctgatgctaactgcaacaatattaccaatgtagtaattttaacaacttttaatctattgtaaaattaccaagtaaggcccatggtaaattttaatacagaaggaatcaaattgtgagaacagatgttaagagcaaatta

SEQ ID NO: 152971 - DNA, 601 bp, Human
ggaaagagttttcatgactctataagaacttaggtatagtccatctcgcctttctcttccaccataaatatgaatgaacttttcttaggttaaagatatttagaggtgttagaggatctgatgctaactgcaacaatattaccaatgtagtaattttaacaacttttaatctattgtaaaattaccaagtaaggcccatggtaaattttaatacagaaggaatcaaattgtgagaacagatgttaagagcaaattaatggttggcggaggtccgtctcattccccaggccctgaaaatttycgattctctaaaccaaagcgtgatcaccacctgcccaaactactgacattgtatcatgcaaataactgcattccctctaccaagggttcataataacaacttttgacaatgctgattgtgtcacgaatgaaattattcattaaaaagtagtggcactaccagcatactttgttttatcagaaaaaaataaaaattgttattttggctaaatattctgcatccgaagtttaagaacatttatataaataaaaaataaattgagcatatgttatgacacaatagcttaaatgtaataactca

SEQ ID NO: 152972 - DNA, 601 bp, Human
tgattgtgtcacgaatgaaattattcattaaaaagtagtggcactaccagcatactttgttttatcagaaaaaaataaaaattgttattttggctaaatattctgcatccgaagtttaagaacatttatataaataaaaaataaattgagcatatgttatgacacaatagcttaaatgtaataactcactttgaattatgaaacaaactcctgaaattgaaaattttgagctaagaatcctgggaatccagaactttgaccttcaggggatgacactcagctccataaagaggcaagaccrgagacctgagaccctccctggaacggacattcccagccatgcttgtgcagtagaatcacctgcaaaattttaaaaaataccagtacctgggtcccaacccaagggactgtgacttcattggtctgaggagtggcctgtgctttgagatttctatgggcttcacgggtgattctgactttcaaccagagctgtcagcccccacccaagatggatatatcacctccctccacgtgaaaggagttagctcacagcctaggtaggaggctctgtagagatgaaaatattccgtgttccaccatg

SEQ ID NO: 152973 - DNA, 601 bp, Human
cgaagtttaagaacatttatataaataaaaaataaattgagcatatgttatgacacaatagcttaaatgtaataactcactttgaattatgaaacaaactcctgaaattgaaaattttgagctaagaatcctgggaatccagaactttgaccttcaggggatgacactcagctccataaagaggcaagaccagagacctgagaccctccctggaacggacattcccagccatgcttgtgcagtagaatcacctgcaaaattttaaaaaataccagtacctgggtcccaacccaagggactstgacttcattggtctgaggagtggcctgtgctttgagatttctatgggcttcacgggtgattctgactttcaaccagagctgtcagcccccacccaagatggatatatcacctccctccacgtgaaaggagttagctcacagcctaggtaggaggctctgtagagatgaaaatattccgtgttccaccatggatgcattttcctccttgctcttctcaatctctgctttgcagaagagcaaaatgaaactgggaaatcacaaagcgatgtgttgtagattcagccttagcctgccttttc

SEQ ID NO: 152974 - DNA, 601 bp, Human
agaacatttatataaataaaaaataaattgagcatatgttatgacacaatagcttaaatgtaataactcactttgaattatgaaacaaactcctgaaattgaaaattttgagctaagaatcctgggaatccagaactttgaccttcaggggatgacactcagctccataaagaggcaagaccagagacctgagaccctccctggaacggacattcccagccatgcttgtgcagtagaatcacctgcaaaattttaaaaaataccagtacctgggtcccaacccaagggactgtgacttcaytggtctgaggagtggcctgtgctttgagatttctatgggcttcacgggtgattctgactttcaaccagagctgtcagcccccacccaagatggatatatcacctccctccacgtgaaaggagttagctcacagcctaggtaggaggctctgtagagatgaaaatattccgtgttccaccatggatgcattttcctccttgctcttctcaatctctgctttgcagaagagcaaaatgaaactgggaaatcacaaagcgatgtgttgtagattcagccttagcctgccttttctgtgaagtg

SEQ ID NO: 152975 - DNA, 601 bp, Human
gttgagtcccaagactctgcggttctaaaatgttcccaggtgatgtgatactcctcgtccagagaccacactttggatcctgtgctgtatggatggctctcactgttacaattgaagctcagatttatttcaggtgcttcagaatttcatttccaacggtctctagaccactgcttctcaaacttcagtattcatttgaatcatctggagatcttgttaaagtgcagagtctgattcagttggtctcaagtggggtgcaagagtctgtagttctaacaggctccccggcgatgctggtgcygctgatttctcactacacattgagcagcaagactttagtcattgccatccacaatcccaacaagcacagaatcccttggtagtcaaatctcgaattcatattctcttctcctaccatttctgtagcaaagtaggccgtgttatgctgcagtaacaaacatctctaaaatcttagtgatggacaactgcagaggtttatttcttgtgcgcactatatagctatctgttgcaagtcagcttagtatctagtagatgagttactaaataatgactcatataattatttacttagtgttgtaac

SEQ ID NO: 152976 - DNA, 601 bp, Human
gccgtgttatgctgcagtaacaaacatctctaaaatcttagtgatggacaactgcagaggtttatttcttgtgcgcactatatagctatctgttgcaagtcagcttagtatctagtagatgagttactaaataatgactcatataattatttacttagtgttgtaacagggctctgagagaaaagagtatagaattaatctttaataggagttttgggcattggggagggaagatctttcagggctggagaaccttccagggagtcccttggatcctgctaatgaatgcaagtgaccactyttgctgccacagcataaggcaaaactaaaccaacatgagtggtcggttgtggctcacgtcagccttgtgagaccctgagagagaacctagctctgccttggcccagaattctgatctacagaaactgtgagatgataaatggatattgttttaagccactgagtttgtggtaatttgtaacacagcaatagaaaactaatagggattctctcaattcccttgttgctgaactctaaggtaatgaatttttaaaaactttttgtgggtacatagtaggcatatgtatttatggggttcatg

SEQ ID NO: 152977 - DNA, 601 bp, Human
gaatcttctatctttttctcggtatctactggagaattaacttggtaatccactgacccactctaaccaaaccaacttgtcaagttacccacttgggggaaggcagttaaactttctaagcccgtgttttcttgtctttaaaatagggataacaaataattcctatctcaaagggttattgtgaggattaaatgagaaaaagcaggcgagggtcatgtgactgactagaaaagttcattattagtcagtgttgtctgactgctttagcaaaaagtccccaaatctcaaaggcttaacagargagattttttttcttgttcacataaggtctgctccagtgtttttggttgccattcttccacatggtagttcagggtccaggcttcttccatcttggggcacccaactcctctaattcctcagccattgaattggaaaagagaatgcaggaaggttttatgggctgggcttggaaatggcctatgtcacctcaccttcattcagtcttctggtcattcctagctgcaaaggagactggggaatttaacccacctctatgcctggaaggaagaagtaacagatttggtgagcatttggccag

SEQ ID NO: 152978 - DNA, 601 bp, Human
gaagctcaatatttgcttgcttagccaccatcaatctgatataaaaagtgtaagagttgcaagtttttctctcatgacctgaatcaaaaagtaatttagaaagaggtcactgtgtcattcaacaaatctttttaaaagccaaacatattttgaccttttatttggatttgctacttgttaattgtttcagcagccttaacttagatcctctttgcagaacatagcttctgtcatctgtacaaagctgtatatgtgaaaattgaaggcaaggagaaggtaattccagctggcattccagtckggatctgctgtcataaattacttagcagagggcatggttcgttactttttatggtcatgttctatatttgtatgtgctggggggtggatcacatgacaaaaccatcatttgatattagtgtttatgtgcaccaaccagtgagggctcgattgaagcttcactgtgcagtacttttaatttgtatatttagctcttaattgaaaatgcaggcacttccataagtactaaaactacaaataatctaaataaattttatataattgtctttaggagaagacaaactgctgtaaaccaagctaa

SEQ ID NO: 152979 - DNA, 601 bp, Human
tttgttctattctccaaatccgttcccctagtgcagcttcatgcttaagtttatagtggcaaacacctcgaaaatgtccttcttgtttgatatttttttcccataactaaacaggaaaaaaaaaatgggcatgtcaggttttggttcatccactgctttgagaactagtgtttccatatctggaatcgtttgttagataaatttgcctgtaagtagttgcttcagatctttgtcaggccttgttcatcttacatactgcagccctctttaatttcctcaactccattaatttatttttcargcttttctttcactaagtatttatcgcatgcctactctatagtagtcagagcacttagcacgtctgcatctattatttcatttgtatgagaacatactttggaaaataaggtcgggatgatgttatttgaacttcctcagcacctatgtagtagtctctgtcaaacaacaagtaacttctgaaataactgttattttagaaacacttctactgttatttttttgtgcatattttccatcccctcaacaagatttgcagagcctcagggatctttagagttgatatctctttgcttttctg

SEQ ID NO: 152980 - DNA, 601 bp, Human
acaggaaaaaaaaaatgggcatgtcaggttttggttcatccactgctttgagaactagtgtttccatatctggaatcgtttgttagataaatttgcctgtaagtagttgcttcagatctttgtcaggccttgttcatcttacatactgcagccctctttaatttcctcaactccattaatttatttttcaggcttttctttcactaagtatttatcgcatgcctactctatagtagtcagagcacttagcacgtctgcatctattatttcatttgtatgagaacatactttggaaaataargtcgggatgatgttatttgaacttcctcagcacctatgtagtagtctctgtcaaacaacaagtaacttctgaaataactgttattttagaaacacttctactgttatttttttgtgcatattttccatcccctcaacaagatttgcagagcctcagggatctttagagttgatatctctttgcttttctgacatattgtggtcttcacaatattttttattagatgccaagtttgatgagaagagaggctcgggttccgagtcacttgttttgtttgaggaataaaagctaggttcggcc

SEQ ID NO: 152981 - DNA, 601 bp, Human
caaagaatcacagcattctgaggctgtacccaggagtgcactggggagggctcccttggcactggtcttttcattcaacttttctttgttctgccatctcccaaggcttaaatgggaaaaggagaaagacgagaacaacgggaagtatgtgaggagagaggatagagaaagataatcctatccctgtggcttgtcagttagaatgagggagggagttgtgagctgatcatgtggctatgcaccttagaactttttcccacaatacttctctgaactgctttggtcttattttcttacttctttttttttttttttttttttttttgagatggaatctcgctctgctgcccaggctggagtgcagtggcgcaatctcggctcactgcaacctctgcctctcgggttcaagtgatcctcctgcctcagcctcccgagtagctgggactacaggtgtgtagccactcccagctaattttttgtatttttagtagagacggggtttcaccatgttggccagaatggtctcaatctcctgacctcaggtgatctgcccggcctttcggcctcccaaagtgctgggattacaggcgtgagccaccgt

SEQ ID NO: 152982 - DNA, 601 bp, Human
catacttaacaagatcatcattgaaacctccccataattatgtcctgacctatcgattgcttgtgaaaaaactattgttcccatgtatataaggaatagcatagatctttgtgattaattttgggggaagatctatttttcttgaaaagaaactgtgatttaaatgtaatcctgtcatttaggttgtttcatgtaactgttagtttcttcttaatgattacaatttttaactttgcttctgttctttgtttagttgttcaggtatgtcctaaacagagttttaacttatataattactaaytttacttcttgcattttccacttttcatatatatgaaatatatataatatatataaatatattaattatatatcattaataataattatgtataatatataaaattttatgttgcttgggtcataaacatttactcttttagataggctgtatctattgcaatcctataatgacccctcggttgctttttttccttgagacaaggtcttgctctgttacccaagctggagtgcagtagcgtgatcttagctaactgcaaccaccgcctcccaggctcaaatgatcctcccgcctcagcct

SEQ ID NO: 152983 - DNA, 601 bp, Human
ctcggctcactgcaacctccgcctcctgatttcaagtgattctcctgcctcagcctcctgcctgagtagctgggattacaggtgcacaccaccacacctggctaattttgtattttttttttttttttttttttttttagtagagacagggtttcaccgtgttggccaggctggtctagaactcctgacctcaggtgacctcggcttctcaaagtgctgggattacaggtgtgagccactgcacccagcataaatatgtatgttttttaaacaagattgttgaattttattttttaatccrgtcaattactttctaattctttttaataagcaagtttaggctgttcacatgtgctttttgatatgttatttgtcctgaagcccaagtaaatgtatgtttattgtagtcgttcttgctttttcttttaatttctgtggtttttatggcagattttaaactctatctctttctgaacttggccaaaggataaccttaagtaggctgatgttaacattttaacaataatatattccagaaaaaccattttaactgcttctatttatttcaattaactaagtaaacttggattcttttctagga

SEQ ID NO: 152984 - DNA, 601 bp, Human
tattcctctgtaccaataactgcttcttctctctctctctttggaagctttcatcgtgagcccattcagacctgctcaggtggagagttccaggcccatttgcccctttaagttgcaaaagtgtgttttcataggagtcaggctgccagttggtggggtttcatttattcgatttctttattgtttatgaagcctatcatactgtgtttgttgtgtcttgttttcttattttctaaaatcttacagataacaatacaaggagggattaccatctgtaaaactccttcccaaaagtgcaggktacatagatagcattcagcaattttcttgatttcttttttttcctccattgttttcctgtctaatttttgtggacagtcatatgaaaatctcggtgacttcctgagacttcacgtgcacacgtagaactgacgtaaaaatgaaggagcggcattggtgtgcatttggtcacactccagggagacatacccagattagaccaactcctcagggtgcagacaaggtgacgtcaaaggacacagttggactgggattcattcttacaatgggataaggcagggcttaggcccctgtgagaaag

SEQ ID NO: 152985 - DNA, 601 bp, Human
tgagaagagtcccagagagcagagtggcaactgctacactcccaagcttatgtccttggtctgccagcctgagatgagaactatttttgcagaccaaaatgaaagaccacggactcccttttttgttttttctttgcagaccaaaatcaaagacggatggactctatttttttggcagaccgaaatcaaagatgatgggctccattcatttcctttccagagctcttccctgatagcgaagatgttgtgggcagagaaagatagaaaagaatcatttccatagcagttgcacgagtctgcrtctgtgtattcagtgcttgggtggctcccccttctcacgcaaggccttgtcacaagctcctgtgtcatgaattgttggaacctgcagcctggctcaaatgaccacaggggtgcctctttgtcagacatacgctgtgcatctggcggcatcatgagggtaatgtgatatggctcacaattttaattttaacaaaaaaatacatctgtcagactcatttcagctgacaggataaatatcatatttcattgccagtttgtaaacacctcacttttcatctctatctgacatgtttcctgggtg

SEQ ID NO: 152986 - DNA, 601 bp, Human
agacggatggactctatttttttggcagaccgaaatcaaagatgatgggctccattcatttcctttccagagctcttccctgatagcgaagatgttgtgggcagagaaagatagaaaagaatcatttccatagcagttgcacgagtctgcgtctgtgtattcagtgcttgggtggctcccccttctcacgcaaggccttgtcacaagctcctgtgtcatgaattgttggaacctgcagcctggctcaaatgaccacaggggtgcctctttgtcagacatacgctgtgcatctggcggcatyatgagggtaatgtgatatggctcacaattttaattttaacaaaaaaatacatctgtcagactcatttcagctgacaggataaatatcatatttcattgccagtttgtaaacacctcacttttcatctctatctgacatgtttcctgggtggtttacaaattgaaaaatcaaatggaatacatttggggccgagcatgtatgctatgtcagtcaagtctgagggtagtgtttatatggagccgggtccgtgcaagcaatacagaggtggctgaccaggaaatgtgacagtggcagatttgt

SEQ ID NO: 152987 - DNA, 601 bp, Human
taaataaataagtaaataactgacagtgttgaagcatggccaggatatcataagacaatcgagattattctttagaaatcagcctcaaaataccattgattagatgtttaaagcctagggatctaaacatgttttctcttacccactgttactgtaatccaaaggccaactgaagtcacccttccacttaggatccagtaagatgtgctggaaccctcattccgtgtcctgtggacatgccaggatatctggaagtgctcacacaacacaccgtcacggtcacccccggcttccaggcccmgccactgcagaggactcagctgtgtcttttctgctcatggagccctgcagttctccttgattgcattggcaggaggcagttgcagttttaatagcaacctccaagcaaggaactcagaatcatcctctgtgtcccccactgccatcacttttcttgctcacctcattcattaactcagcacttaattgctgagcacgtactatgtgccaggtgctgaagatactgaagaaaagaagccatcctcgtgcctgctggaagccctgtcccttacctgcctttcggagccatctccttctccca

SEQ ID NO: 152988 - DNA, 601 bp, Human
agtgctgggatttcagacatgagccaccgcacctggcccagttttttttgttttgttttgttttgagacagggtcttacactgttacctaggccggagtgcagtggtgccatcatggctcactgcagcctcaaactcctgggctcaagtgatcctcccacctcagcctgcctagtagctgggactacaggtgtgtgccactatgcctagctagttttgtttgtttgtttgtttgttttgtagagacagagtcttgctttgttgcccaggctgatctctaactcctgggctcaagtgatccycccgcctcagcctctcaagtagcagggacacccacttagttttattttaatttttgtagagatgaagtctcactatactgtcctggctggtcctgaactcctggactcaagtgatcctcccacctcggccttccaaagagctgagattacaggcatgagccaccacatccaacctgattcttactccatgccattcaggaaaatttgttgtttcctgagcatagcttggctttgtgctctttttggtatctttttctgctgttctctcagccttccccttcagatttcttctcatccata

SEQ ID NO: 152989 - DNA, 601 bp, Human
ctgggatttcagacatgagccaccgcacctggcccagttttttttgttttgttttgttttgagacagggtcttacactgttacctaggccggagtgcagtggtgccatcatggctcactgcagcctcaaactcctgggctcaagtgatcctcccacctcagcctgcctagtagctgggactacaggtgtgtgccactatgcctagctagttttgtttgtttgtttgtttgttttgtagagacagagtcttgctttgttgcccaggctgatctctaactcctgggctcaagtgatcctccckcctcagcctctcaagtagcagggacacccacttagttttattttaatttttgtagagatgaagtctcactatactgtcctggctggtcctgaactcctggactcaagtgatcctcccacctcggccttccaaagagctgagattacaggcatgagccaccacatccaacctgattcttactccatgccattcaggaaaatttgttgtttcctgagcatagcttggctttgtgctctttttggtatctttttctgctgttctctcagccttccccttcagatttcttctcatccataagta

SEQ ID NO: 152990 - DNA, 601 bp, Human
ggctgtttgccaaccactataaaggatcatggcgccttaacagctggtgaagctgcccttgtgccctttggctgaatgtcagctataagctcagccctcctgctgacatgtctgtttcccgtgcaagtaaactcttcaggctgtgcccatagctccactgggtaaaccacaggacgtgtgctactaaaagaaatctgtttctctttcattcttcttctgccttgagccggtagaaactcagtgtcattaacatcatgtcccagaaatgtgagtttctgatcctggggttcttctagcaccyttgcattgaacttgaacagcttttcccaaggactgtcccccaacgcccccgagattgtcagggtgccccatctgttctccaccttttccagtatgtcccagagtcatgtaagtaaattgcctgagattctcaaaaagagatgacctaagtttccaccccattctaaagggcctgcattgtaagcatgtccttcttaccgcatatcgtgggcaccatgttctcagttctttcatcagctacagtgtttaactcagcaataattattccatttcgtccagctatccatgatatgctttttct

SEQ ID NO: 152991 - DNA, 601 bp, Human
atattactcatcagttgtggcccctgggaacacctggttgagggcagccgaaacagtacgtctaaatcggaattcctggtctttgcgctaaagcctgctccttctgccatttcccccatctcagttgatggcgactccatccttctagttgttcaggtcagagaccaaggagtcattcctgactcctcatttgctttgataccccacatccggtctaaaatctacttttcacaatctccactacattcactctggcctgagctgccttcatctcttgtcggaattattgcagtagtctcgratacgatgtccctagttctgcgtttaccctccaataatctattctcaatacagcagccagagcgatccttagaaaagaaaaccacatcatgttattcctctgctcaaaactccatggtgatctccgctttattcaggataaaagccaaaatcctttcagcagctcccatgattggtgccccaacaccctgtcattttctgtctgacttcaaaccctggccctttctccctcagtcgctccattccagctacatggttctgcttgctccttaaacactggaggcacattcctacctcatga

SEQ ID NO: 152992 - DNA, 601 bp, Human
ccatctcagttgatggcgactccatccttctagttgttcaggtcagagaccaaggagtcattcctgactcctcatttgctttgataccccacatccggtctaaaatctacttttcacaatctccactacattcactctggcctgagctgccttcatctcttgtcggaattattgcagtagtctcgaatacgatgtccctagttctgcgtttaccctccaataatctattctcaatacagcagccagagcgatccttagaaaagaaaaccacatcatgttattcctctgctcaaaactccayggtgatctccgctttattcaggataaaagccaaaatcctttcagcagctcccatgattggtgccccaacaccctgtcattttctgtctgacttcaaaccctggccctttctccctcagtcgctccattccagctacatggttctgcttgctccttaaacactggaggcacattcctacctcatgatctttgtagtggccgtttcctctctctggggagcccttcctccagatgtctacatggctaatgccacttccagatatttattcaaatgtcaccttctcaatgagacctgtgctgg

SEQ ID NO: 152993 - DNA, 601 bp, Human
aaatctacttttcacaatctccactacattcactctggcctgagctgccttcatctcttgtcggaattattgcagtagtctcgaatacgatgtccctagttctgcgtttaccctccaataatctattctcaatacagcagccagagcgatccttagaaaagaaaaccacatcatgttattcctctgctcaaaactccatggtgatctccgctttattcaggataaaagccaaaatcctttcagcagctcccatgattggtgccccaacaccctgtcattttctgtctgacttcaaaccctrgccctttctccctcagtcgctccattccagctacatggttctgcttgctccttaaacactggaggcacattcctacctcatgatctttgtagtggccgtttcctctctctggggagcccttcctccagatgtctacatggctaatgccacttccagatatttattcaaatgtcaccttctcaatgagacctgtgctggccatcctattttaagtgggaacccaccccccatatatatttctgatcctcctcactaggttctacctttttccctctatggtttttaacagttaacatgcta

SEQ ID NO: 152994 - DNA, 601 bp, Human
tgttattcctctgctcaaaactccatggtgatctccgctttattcaggataaaagccaaaatcctttcagcagctcccatgattggtgccccaacaccctgtcattttctgtctgacttcaaaccctggccctttctccctcagtcgctccattccagctacatggttctgcttgctccttaaacactggaggcacattcctacctcatgatctttgtagtggccgtttcctctctctggggagcccttcctccagatgtctacatggctaatgccacttccagatatttattcaaatgtmaccttctcaatgagacctgtgctggccatcctattttaagtgggaacccaccccccatatatatttctgatcctcctcactaggttctacctttttccctctatggtttttaacagttaacatgctatataatttagttatttatataattatttatctgcgtctctctccccctgtgatggttaattttatgtgtcgacttggctgggccctggggtgtccagatatttggtggagtattattctgggtgtttttggatgagattaacatttaaattggtagactgagtaaagtagatt

SEQ ID NO: 152995 - DNA, 601 bp, Human
tattcaggataaaagccaaaatcctttcagcagctcccatgattggtgccccaacaccctgtcattttctgtctgacttcaaaccctggccctttctccctcagtcgctccattccagctacatggttctgcttgctccttaaacactggaggcacattcctacctcatgatctttgtagtggccgtttcctctctctggggagcccttcctccagatgtctacatggctaatgccacttccagatatttattcaaatgtcaccttctcaatgagacctgtgctggccatcctattttaartgggaacccaccccccatatatatttctgatcctcctcactaggttctacctttttccctctatggtttttaacagttaacatgctatataatttagttatttatataattatttatctgcgtctctctccccctgtgatggttaattttatgtgtcgacttggctgggccctggggtgtccagatatttggtggagtattattctgggtgtttttggatgagattaacatttaaattggtagactgagtaaagtagattgcgcttccaaatcagttggagtgcctcatccaatcagttg

SEQ ID NO: 152996 - DNA, 601 bp, Human
tccctctatggtttttaacagttaacatgctatataatttagttatttatataattatttatctgcgtctctctccccctgtgatggttaattttatgtgtcgacttggctgggccctggggtgtccagatatttggtggagtattattctgggtgtttttggatgagattaacatttaaattggtagactgagtaaagtagattgcgcttccaaatcagttggagtgcctcatccaatcagttgaaggcctgaatagaacaaaagtctgaccctcccttaagtaagagagaattcttacygacagcctttgagctgggaaattgggttttttgttttgttttgtcccctgcctttggactcgaattgaaagatcgttggctcttcctggatctccagcctgccagccttcagacttggactggaacttacaccattggctctcctgggtctccagccagctgactgcagatcttgggacttgtcagcctccataatcacatgggccagatccttgtcataaataaataaataaacatatcctattcattgtgtttccctggagaaccctgactaatacatgccccttgccacttaaacaa

SEQ ID NO: 152997 - DNA, 601 bp, Human
ataatttagttatttatataattatttatctgcgtctctctccccctgtgatggttaattttatgtgtcgacttggctgggccctggggtgtccagatatttggtggagtattattctgggtgtttttggatgagattaacatttaaattggtagactgagtaaagtagattgcgcttccaaatcagttggagtgcctcatccaatcagttgaaggcctgaatagaacaaaagtctgaccctcccttaagtaagagagaattcttaccgacagcctttgagctgggaaattgggtttttttttttgttttgtcccctgcctttggactcgaattgaaagatcgttggctcttcctggatctccagcctgccagccttcagacttggactggaacttacaccattggctctcctgggtctccagccagctgactgcagatcttgggacttgtcagcctccataatcacatgggccagatccttgtcataaataaataaataaacatatcctattcattgtgtttccctggagaaccctgactaatacatgccccttgccacttaaacaaaagagggcagggacatcagagtgctgtctgtat

SEQ ID NO: 152998 - DNA, 601 bp, Human
ttggaagtgaccaaaaatcccccttggacgacaaagaagcatctcagctcaagactcgaagatgaaagttcattggccgtgagtgtgtgctgcaaaagaaaaagactgcaatttagtggcttttttccttaaaaagcctgctttttcacacaagtttaggtgtgtgaaagagaaagcaagaaaatacagagaaagagacaggaaagagactgtaactgtcaatggtgggagttgttagaagtggggacagggctggccaacaaatgacctgcagaaaagacagcaacagaggacagaatcscagtgcagtggggggatagctatgccagcagcccatccagagatgtttatagctcctgaaagcaactgctgtgcatgcgtgtgtgggtggcggggggggggggtaagtcagggaaaacaggctgctttacctctgttaaatgcccttgaaagcatctccatggttataagtgagacaaccagagaggaaggggcaaatgaatacacagtgagcagcccagcaggcctccatgaaaccctgaagctaccccacaggcctcttatagcagcatctccctgggtctattcacagaataccagt

SEQ ID NO: 152999 - DNA, 601 bp, Human
aaagaaaaagactgcaatttagtggcttttttccttaaaaagcctgctttttcacacaagtttaggtgtgtgaaagagaaagcaagaaaatacagagaaagagacaggaaagagactgtaactgtcaatggtgggagttgttagaagtggggacagggctggccaacaaatgacctgcagaaaagacagcaacagaggacagaatcccagtgcagtggggggatagctatgccagcagcccatccagagatgtttatagctcctgaaagcaactgctgtgcatgcgtgtgtgggtggcggkgggggggggtaagtcagggaaaacaggctgctttacctctgttaaatgcccttgaaagcatctccatggttataagtgagacaaccagagaggaaggggcaaatgaatacacagtgagcagcccagcaggcctccatgaaaccctgaagctaccccacaggcctcttatagcagcatctccctgggtctattcacagaataccagttccttagaaaactgtgggtgaaattaaaagctccgtggatcaaaaagcttgaaaaacatcaggttaagcaaagttaaacaggtttctttagtat

SEQ ID NO: 153000 - DNA, 601 bp, Human
agaaaaagactgcaatttagtggcttttttccttaaaaagcctgctttttcacacaagtttaggtgtgtgaaagagaaagcaagaaaatacagagaaagagacaggaaagagactgtaactgtcaatggtgggagttgttagaagtggggacagggctggccaacaaatgacctgcagaaaagacagcaacagaggacagaatcccagtgcagtggggggatagctatgccagcagcccatccagagatgtttatagctcctgaaagcaactgctgtgcatgcgtgtgtgggtggcggggtgggggggtaagtcagggaaaacaggctgctttacctctgttaaatgcccttgaaagcatctccatggttataagtgagacaaccagagaggaaggggcaaatgaatacacagtgagcagcccagcaggcctccatgaaaccctgaagctaccccacaggcctcttatagcagcatctccctgggtctattcacagaataccagttccttagaaaactgtgggtgaaattaaaagctccgtggatcaaaaagcttgaaaaacatcaggttaagcaaagttaaacaggtttctttagtatct

SEQ ID NO: 153001 - DNA, 601 bp, Human
tgctgtgcatgcgtgtgtgggtggcggggggggggggtaagtcagggaaaacaggctgctttacctctgttaaatgcccttgaaagcatctccatggttataagtgagacaaccagagaggaaggggcaaatgaatacacagtgagcagcccagcaggcctccatgaaaccctgaagctaccccacaggcctcttatagcagcatctccctgggtctattcacagaataccagttccttagaaaactgtgggtgaaattaaaagctccgtggatcaaaaagcttgaaaaacatcaggttamgcaaagttaaacaggtttctttagtatcttgttcagtattctgaagtgaattgtgggccaccaaaagagggggcgccatatgcagaagcctcccaaccctgttgaccaggaagcacggctcatgttgagctactcaccaaatgagctagtgctctatgggatgcattgctctgttttgtttttttttctttctttctttttttgtaaagatgcagtctcactctattgcccaggctggtctcaaactcctgggttcaagccatctgcccacctcagcctcccaaagtgctgagaatacag

SEQ ID NO: 153002 - DNA, 601 bp, Human
ttaaaatatgttggtaatgacaacgtagattattatctatctgaaggatacaaaaatgacttcagagaaggcattttaccctatgatttgctgaacacttttgcagaaaagacattgtattaaaaatgcccaatttgcaactgcaagtgtattgttctacctttatagagcagtagaacaatctcatgtcaaacttcagggctgccccggaggtcttatttaaatagttctatgtcccaggctccagatctcttcctttctcctgaagatgtcagtaaaggggcatcgtaatgatgatccygggcccccattaaacattaaattaaattataaatgggagcctgtcatcattattatgtttttctgtatgtctaaaatagcttgttttattttattttatttattttatttatttatatttttttgagatggagtcttgctctgtcgcccaggctggagtgcagtggcacgatctctgctcaccgcaagctccgcctcctgggttcacgccattctcctgcctcagcctcctgattagctgggattacaggcgcccgccaccacgcccagataatttttttgtatctttagtagaggtggg

SEQ ID NO: 153003 - DNA, 601 bp, Human
cgcccagccagctcatctaattctgaaagttatttttgtatgaatggagaagtcggttgctgaattagcagaattgagtgtgacctgtagccataggcgaagtggactggggacaatgtagaatgccaacaaagactaaagtcactgtaaatatgataagccatcacattttcttaaaaagggctgggtgtggtggctcacagctgtaatcccagtactttgggaggccgaggtgggtggatcatttgaggtcaggagttcaagaccaacctggccaaccccacctctgctaaaaataaamttatctgggcgtggtggcagccacccgttgtcccagctactcaggaggctgaggcaggagaattgcttgaacctgggaggcggaggtcgcagtgagccaatatcgcgccactgcactccagcctgggacagagtgagactccatctcaaaaaaaaaaaagggttgcgggggaggcctcagtgaaagatttccactttttcacatggattatggcaactgtggtgaaaccaggaagcctctcccaaagcattttccacaggaataggatgaagtcattttactaaccttccggtcttaccc

SEQ ID NO: 153004 - DNA, 601 bp, Human
ctcatctaattctgaaagttatttttgtatgaatggagaagtcggttgctgaattagcagaattgagtgtgacctgtagccataggcgaagtggactggggacaatgtagaatgccaacaaagactaaagtcactgtaaatatgataagccatcacattttcttaaaaagggctgggtgtggtggctcacagctgtaatcccagtactttgggaggccgaggtgggtggatcatttgaggtcaggagttcaagaccaacctggccaaccccacctctgctaaaaataaaattatctgggcttggtggcagccacccgttgtcccagctactcaggaggctgaggcaggagaattgcttgaacctgggaggcggaggtcgcagtgagccaatatcgcgccactgcactccagcctgggacagagtgagactccatctcaaaaaaaaaaaagggttgcgggggaggcctcagtgaaagatttccactttttcacatggattatggcaactgtggtgaaaccaggaagcctctcccaaagcattttccacaggaataggatgaagtcattttactaaccttccggtcttacccaactttatacc

SEQ ID NO: 153005 - DNA, 601 bp, Human
aaatatgataagccatcacattttcttaaaaagggctgggtgtggtggctcacagctgtaatcccagtactttgggaggccgaggtgggtggatcatttgaggtcaggagttcaagaccaacctggccaaccccacctctgctaaaaataaaattatctgggcgtggtggcagccacccgttgtcccagctactcaggaggctgaggcaggagaattgcttgaacctgggaggcggaggtcgcagtgagccaatatcgcgccactgcactccagcctgggacagagtgagactccatctcaaaaaaaaaaaagggttgcgggggaggcctcagtgaaagatttccactttttcacatggattatggcaactgtggtgaaaccaggaagcctctcccaaagcattttccacaggaataggatgaagtcattttactaaccttccggtcttacccaactttataccaggattattgcagtgtgtgatctatttgccatttgaaatataaatgatcaacactcaatttcactgtcttccatgaaggagtcttcaaaatgggggctgtgccatactgctgggttttttccacatctcaagccaca

SEQ ID NO: 153006 - DNA, 601 bp, Human
atctgggcgtggtggcagccacccgttgtcccagctactcaggaggctgaggcaggagaattgcttgaacctgggaggcggaggtcgcagtgagccaatatcgcgccactgcactccagcctgggacagagtgagactccatctcaaaaaaaaaaaagggttgcgggggaggcctcagtgaaagatttccactttttcacatggattatggcaactgtggtgaaaccaggaagcctctcccaaagcattttccacaggaataggatgaagtcattttactaaccttccggtcttacccaamtttataccaggattattgcagtgtgtgatctatttgccatttgaaatataaatgatcaacactcaatttcactgtcttccatgaaggagtcttcaaaatgggggctgtgccatactgctgggttttttccacatctcaagccacagcattaataatgttaaaaatatctgcaattttcatacttcagacagtaaaagcacggcattaccataaccaagaacaaatgcatgctgttctcaaagatgattatatgtttcttttagaccccttaacagacggcaggtcctgaattctcctgct

SEQ ID NO: 153007 - DNA, 601 bp, Human
ctcactgcaatctccgcctcccgggttcaagcagttctcctgcctcagcctcctgagtagctgggactacaggcatgcaccaccacacccagctaatttttttgcatttttagtggagacggagtttcgccatgttggtcaggctggtctcaaactcctaaccgcaaatgatctactcaccttggcctccgaaagtactgagattataggcgtaagccaccccgcccggcctggttctttcaatatatgaatacagcaagtcatttattttagctttatagaggtgtggtctctctgagtmataatcattaaaattcacattcccctaccatagcttcttccagagtatatgaaaactgaagataggtttgcagctcctaatgtgtatttgggtcctgctcaatttgttaccccttaaagactgatttcaggtaaaagggcaccatactcttagtccttattacaagttttgctagaacgttcttcaagtcaaaataatactgcattggttaaaaaaaaaaaagaatttgcccatatagacttgaatttcatccactgttaaattttttaatggaaaatatactgaatcagacatggtggc

SEQ ID NO: 153008 - DNA, 601 bp, Human
ctacaggcatgcaccaccacacccagctaatttttttgcatttttagtggagacggagtttcgccatgttggtcaggctggtctcaaactcctaaccgcaaatgatctactcaccttggcctccgaaagtactgagattataggcgtaagccaccccgcccggcctggttctttcaatatatgaatacagcaagtcatttattttagctttatagaggtgtggtctctctgagtcataatcattaaaattcacattcccctaccatagcttcttccagagtatatgaaaactgaagatagktttgcagctcctaatgtgtatttgggtcctgctcaatttgttaccccttaaagactgatttcaggtaaaagggcaccatactcttagtccttattacaagttttgctagaacgttcttcaagtcaaaataatactgcattggttaaaaaaaaaaaagaatttgcccatatagacttgaatttcatccactgttaaattttttaatggaaaatatactgaatcagacatggtggctcatgcctgtaatcccagctctttgggaggctgaggagggaagataccttgaggccaggagttcga

SEQ ID NO: 153009 - DNA, 601 bp, Human
gtaatcccagcactttgggaggctgagctgggcagatcattgaggtcaggagttcaagaccagcctggcaaacatgacaaaacactgtctctactaaaaatataaaaattagccaggcatggtaacgcacttctgtaattccagctactcaggaggctgaggcatgagaattgcttgaacccaggaggcagaggctgcagtgagccgagattgcaccattgcactccagcctgggcgacagagcaaaactctgtccaaaaaaagcccatgtagaaacggtttatggaaatgtcatttgttktaggagaaatttcggagctccctacataacatagaaaagaaatagaaaagaaaatggctggcagggcgcagtggctctcacgcctgtaatcccagcactttgggaggccgaggtgggcagatcacctgaggtcaggagtttgagaccagcctggtcaacatagtgaaaccccatctctactaaaaatactaaaattagctgggtgtggtggcacatgcctgtaatcccagctgcttgggaggctgaggcaggagaatcacttaactcgggaggcagacgttgcagtgagcttagatcgtg

SEQ ID NO: 153010 - DNA, 601 bp, Human
gaacccaggaggcagaggctgcagtgagccgagattgcaccattgcactccagcctgggcgacagagcaaaactctgtccaaaaaaagcccatgtagaaacggtttatggaaatgtcatttgttgtaggagaaatttcggagctccctacataacatagaaaagaaatagaaaagaaaatggctggcagggcgcagtggctctcacgcctgtaatcccagcactttgggaggccgaggtgggcagatcacctgaggtcaggagtttgagaccagcctggtcaacatagtgaaaccccatcyctactaaaaatactaaaattagctgggtgtggtggcacatgcctgtaatcccagctgcttgggaggctgaggcaggagaatcacttaactcgggaggcagacgttgcagtgagcttagatcgtgccactgcactccagcctgggccacagagtgagacttcatctcaaacaaacagcaacaacaacaaaaaaggaaatggctaagtcgtccatggtaagaatgcaatgaaacactctacagccattaaaatgctttaccagttaatgttaagtgataaagtcaattgcaaaagtttatga

SEQ ID NO: 153011 - DNA, 601 bp, Human
gataggatggagggaggagtccaaggactgaaaaactacttactgggtactgtgcctactacctgggtgacgggatcattcacacccccaaacctcagcatcatacaatatacccacgtaacaaacctgcacatgtatcccctgaacctaaagtaaaggttgaaattattccaaaaaaaagagaacaagatagatgtcattttaatgaggtggaattatgattaaaatgtcctttaaatgttcttaacttctcttttagtgttctaaagtgtattgaatagtatttttgagtacctaggcratcctaggactttggtatcttagtagcagcataagatcacagcctgtgtctgttcccactttaattcccatgtgagatgttgcgctgacctttgcccctttcagctttatctctcacatcctctcccatgtctcaccgtgtgttccagcaacccctcactccttgtggtatcctgaacaaagccagtgcttggattgcaccaaatgaaattgatgttgtttcaaaatttaccgaactcatattgtgtaacctttattgcaatgtcctgaacctatatcctgctgtataacctaatttccc

SEQ ID NO: 153012 - DNA, 601 bp, Human
acttgaatgaaacagcttctttgtgaattccattcagaggtaaaactcactgtcctgaaagcagtaccccagcacccaaccctccatgctggatgtccctgtcagtatagtaagcaggcttcatgccaaaggagagtttgtggtttttcaagagagtgtggggccttctacatttgttttccaacacttttacaaatgttaacacgacccttcaagactgatgtttctttttatattctacttcgcctattttctccatagcactgaaatgcacagtgcaagatacaactaagcggattgktttttttttcctaaccacaacattgtgacttttgagaagagaattcaaaaacatgtgaagggttttaataagtaagggtatgtgtggatatggatgggtgtttatgtagactaattggaattattttttatcgatttccaatgagatagtgttttgttgtacagccatgtatcataaagagaaagtgtcacatctttgccatggtgatagatcattattagagaacagtaaaatgaaaatcaggagcccttggctctattattatttcatggtagataaaggccagaggaatgagaatcc

SEQ ID NO: 153013 - DNA, 601 bp, Human
tatttcatggtagataaaggccagaggaatgagaatccatttatggaaaatagtgtcaacaaatgctagcctgttaattctctaatggtgcccatggaaaatgaatagaaaattacttttaaatggtttgaatacctttaatgcaatgtgcaaagctgagtaattgtgtttatgaatataaaagagaattgattattaattacagaaaaatataaatgtagttgtcttcctttgttctaaagtgaatacttattatgttcaagcttcacaaaacaatacttgctcttactatgtacaacayattcagatattttattttttatttcattttttataaaattctggctgagacccaataaattgatttcatgaccccactagtgagtcatatctcacattttttaaaatgtgttataagctaggtgtggtggctcacgcctgtaatcccagcactttggaaggctgaggcgggtggatcacctgtggtcaggagtttgagaccagcctggccaacatagcaaaacactgtctctactaaaaatacaaaaattagccaggcatggtggcgggcacctgtaatcccagctacttgggaggctga

SEQ ID NO: 153014 - DNA, 601 bp, Human
catggtagataaaggccagaggaatgagaatccatttatggaaaatagtgtcaacaaatgctagcctgttaattctctaatggtgcccatggaaaatgaatagaaaattacttttaaatggtttgaatacctttaatgcaatgtgcaaagctgagtaattgtgtttatgaatataaaagagaattgattattaattacagaaaaatataaatgtagttgtcttcctttgttctaaagtgaatacttattatgttcaagcttcacaaaacaatacttgctcttactatgtacaacacattcmgatattttattttttatttcattttttataaaattctggctgagacccaataaattgatttcatgaccccactagtgagtcatatctcacattttttaaaatgtgttataagctaggtgtggtggctcacgcctgtaatcccagcactttggaaggctgaggcgggtggatcacctgtggtcaggagtttgagaccagcctggccaacatagcaaaacactgtctctactaaaaatacaaaaattagccaggcatggtggcgggcacctgtaatcccagctacttgggaggctgaggcaa

SEQ ID NO: 153015 - DNA, 601 bp, Human
ttatgaatataaaagagaattgattattaattacagaaaaatataaatgtagttgtcttcctttgttctaaagtgaatacttattatgttcaagcttcacaaaacaatacttgctcttactatgtacaacacattcagatattttattttttatttcattttttataaaattctggctgagacccaataaattgatttcatgaccccactagtgagtcatatctcacattttttaaaatgtgttataagctaggtgtggtggctcacgcctgtaatcccagcactttggaaggctgaggcrggtggatcacctgtggtcaggagtttgagaccagcctggccaacatagcaaaacactgtctctactaaaaatacaaaaattagccaggcatggtggcgggcacctgtaatcccagctacttgggaggctgaggcaagagaatcgcttgaacccgggaggcagtggttgtagtgagccgagatcgtgccactgcccttcagcctgggcaacaagagtgagacttggtctcaaaataaataaataaataaataaatagttataaaacgtgttacatttatacaaaataaatatgatccatag

SEQ ID NO: 153016 - DNA, 601 bp, Human
caataaattgatttcatgaccccactagtgagtcatatctcacattttttaaaatgtgttataagctaggtgtggtggctcacgcctgtaatcccagcactttggaaggctgaggcgggtggatcacctgtggtcaggagtttgagaccagcctggccaacatagcaaaacactgtctctactaaaaatacaaaaattagccaggcatggtggcgggcacctgtaatcccagctacttgggaggctgaggcaagagaatcgcttgaacccgggaggcagtggttgtagtgagccgagatcrtgccactgcccttcagcctgggcaacaagagtgagacttggtctcaaaataaataaataaataaataaatagttataaaacgtgttacatttatacaaaataaatatgatccatagagcacatcaggcatcatggattgccatgacagctgttatttatattatacatattatgtgctcacataatatgccaggggaatattctattcaaaatggtaaaagcaaagcatctacttcacttctctaatggaagagaaaatgataaagttttggtcagatattaaaaatgattaaaaatctt

SEQ ID NO: 153017 - DNA, 601 bp, Human
catttatacaaaataaatatgatccatagagcacatcaggcatcatggattgccatgacagctgttatttatattatacatattatgtgctcacataatatgccaggggaatattctattcaaaatggtaaaagcaaagcatctacttcacttctctaatggaagagaaaatgataaagttttggtcagatattaaaaatgattaaaaatcttttgtcaagctttaaaacatatgcctagaaatatatttcctgattttttatcttattcttccaaggtttgggcagctattaaaaagtayattataacaattatatttttgaattttaaaatcaaatttcttttaaattattaaaaacgacttaaagattccaaagcatagtccatagcataaatcaagctaatttctcctctctgactgtggcctgtcgacattccagcaaaatggaggataaacagttatagccagagttgcagcattcttgcagagaagagaaaaggactcctagaatcatctgattgaatggtctttgggaggaaaaaataaagcaagaccatttcatttgtttgcccactgatcacaactctgtaaaaactatgt

SEQ ID NO: 153018 - DNA, 601 bp, Human
agaccccacaccagaaactaacttgctgttttcagttagtttcatccttgggactggacctctttttcatatgagtttgtgtcatttcctcagtgctaagtttcaaatgcacttcgttgaacaaattgatcttttggcacaaacccattagcagcactgttacttaggatccctcgcagttggtcagagctgtaatattccttggcatttccttcaaatcagataactaaagtcgaaagactaaggcctagtctttacccttataattattgaaataattgacttttttcctacaaaactsttcatttctgtgaatctataaatgcagactattatcctgttctaaaaacagactattatctgttcagaaaattctgctcagataaaggtcatgtaaagaattctatgattaggagaaatgtgattattttattaactttcggttgttaaacttgttgacatatttctgtcctttcctatatttctgaattactttagctttgggatcaaataagatataattatttgtagagtagaataaaactgcacatggatgaatgtatatacagtcttatgtaatagtgatgtagttctatttttt

SEQ ID NO: 153019 - DNA, 601 bp, Human
ttagtttcatccttgggactggacctctttttcatatgagtttgtgtcatttcctcagtgctaagtttcaaatgcacttcgttgaacaaattgatcttttggcacaaacccattagcagcactgttacttaggatccctcgcagttggtcagagctgtaatattccttggcatttccttcaaatcagataactaaagtcgaaagactaaggcctagtctttacccttataattattgaaataattgacttttttcctacaaaactcttcatttctgtgaatctataaatgcagactattaycctgttctaaaaacagactattatctgttcagaaaattctgctcagataaaggtcatgtaaagaattctatgattaggagaaatgtgattattttattaactttcggttgttaaacttgttgacatatttctgtcctttcctatatttctgaattactttagctttgggatcaaataagatataattatttgtagagtagaataaaactgcacatggatgaatgtatatacagtcttatgtaatagtgatgtagttctattttttttgttgttactgttttttgttttgttttgtttttt

SEQ ID NO: 153020 - DNA, 601 bp, Human
aataaaactgcacatggatgaatgtatatacagtcttatgtaatagtgatgtagttctattttttttgttgttactgttttttgttttgttttgtttttttgatacagagtttcgctctgatgcccaggctggagtacagtggcacgattgcagctcactgcagccttgacctcctgaactcaagcagtcctcctgcctcagcctcctaagtagctgaggctacaggcgtgcaccaacatgcctggctaatttttatattttttttgtagagacgtgatttcaccacgttgcccaggctgktctcaaactcctgggctcaagtgatccgcctgccttggcctccctaagtgctaggatgataagcatggtaggatgataagctgcacccagccaatgtaattcttaataatacgggttttaaaaatccatcctatacactatcatccatcctagcctctcctgaacctccaggaaaatgcaagtcgttggtggtggttacaattatagacaaggtggcgtttcatttttcccaaagcaaaatgctttaggatcacttcttttcctccaggtagatatttcttttctttctgtttcttggtg

SEQ ID NO: 153021 - DNA, 601 bp, Human
atatccaaattttcatttagaacttgtaccaaacccacaccttaggggtattaatcaaagtgaatgggcagcgcctcagatgatgtgttggttgtctgatgacaaagctcactgttctctatggctcttcccacggagtggccctggccagtgtacctgaccacagctgcgtcgttctacttagttcagtttgggcttctaggtcccttctggggctctgggtggccagttactcttattctcttatggaagggttccacattgctcaacaggggttagaagtgtcatcaactggctgggygcagtggctcatgcctgtaatcccggcattttgagaggccgaggcgggcagatcatgaggtcaggagatcgagaccatcctggctaacacggtaaaaccctgtctctactaaaaatacaaaaaaaaaaattagccgcacaaggtggcgggtgcctgtagtcccagctaccgggaggctgaggcaggagaatggcatgaacctgggaggcggagcttgcagtgagccaagatggcaccactgcactccagcctgggccacagagcgagactccgtctcagaaaaaaaaaagaagtgtcatc

SEQ ID NO: 153022 - DNA, 601 bp, Human
cttattctcttatggaagggttccacattgctcaacaggggttagaagtgtcatcaactggctgggcgcagtggctcatgcctgtaatcccggcattttgagaggccgaggcgggcagatcatgaggtcaggagatcgagaccatcctggctaacacggtaaaaccctgtctctactaaaaatacaaaaaaaaaaattagccgcacaaggtggcgggtgcctgtagtcccagctaccgggaggctgaggcaggagaatggcatgaacctgggaggcggagcttgcagtgagccaagatggyaccactgcactccagcctgggccacagagcgagactccgtctcagaaaaaaaaaagaagtgtcatcaactaacaaagaagcctcaaatgcacaggtagatagtaaagttaggttggaagtggctgtgagttcagcctgacagagaccacataattaaaccaatatggcttaagcatctactatgcactgagttctgggcaaggggctaagaatacaaagatgggtagatggcattgtggacacgattcctgtccacggaaacgcgcattctagctgaagaagatgagcaatgcaccatga

SEQ ID NO: 153023 - DNA, 601 bp, Human
ttattctcttatggaagggttccacattgctcaacaggggttagaagtgtcatcaactggctgggcgcagtggctcatgcctgtaatcccggcattttgagaggccgaggcgggcagatcatgaggtcaggagatcgagaccatcctggctaacacggtaaaaccctgtctctactaaaaatacaaaaaaaaaaattagccgcacaaggtggcgggtgcctgtagtcccagctaccgggaggctgaggcaggagaatggcatgaacctgggaggcggagcttgcagtgagccaagatggcrccactgcactccagcctgggccacagagcgagactccgtctcagaaaaaaaaaagaagtgtcatcaactaacaaagaagcctcaaatgcacaggtagatagtaaagttaggttggaagtggctgtgagttcagcctgacagagaccacataattaaaccaatatggcttaagcatctactatgcactgagttctgggcaaggggctaagaatacaaagatgggtagatggcattgtggacacgattcctgtccacggaaacgcgcattctagctgaagaagatgagcaatgcaccatgat

SEQ ID NO: 153024 - DNA, 601 bp, Human
atcgagaccatcctggctaacacggtaaaaccctgtctctactaaaaatacaaaaaaaaaaattagccgcacaaggtggcgggtgcctgtagtcccagctaccgggaggctgaggcaggagaatggcatgaacctgggaggcggagcttgcagtgagccaagatggcaccactgcactccagcctgggccacagagcgagactccgtctcagaaaaaaaaaagaagtgtcatcaactaacaaagaagcctcaaatgcacaggtagatagtaaagttaggttggaagtggctgtgagttcakcctgacagagaccacataattaaaccaatatggcttaagcatctactatgcactgagttctgggcaaggggctaagaatacaaagatgggtagatggcattgtggacacgattcctgtccacggaaacgcgcattctagctgaagaagatgagcaatgcaccatgatagaacagggggagcagtgtgctagggaatccacacaaggcatgacgcttgcatagaccaggaccacgtggaagatacggcccatcctgtagtgcagcatggttctggggccaacagcaacctgggcacttgtt

SEQ ID NO: 153025 - DNA, 601 bp, Human
aagcctcaaatgcacaggtagatagtaaagttaggttggaagtggctgtgagttcagcctgacagagaccacataattaaaccaatatggcttaagcatctactatgcactgagttctgggcaaggggctaagaatacaaagatgggtagatggcattgtggacacgattcctgtccacggaaacgcgcattctagctgaagaagatgagcaatgcaccatgatagaacagggggagcagtgtgctagggaatccacacaaggcatgacgcttgcatagaccaggaccacgtggaagatayggcccatcctgtagtgcagcatggttctggggccaacagcaacctgggcacttgttagaaagctcaggccccttgattgggcgcggtacctcaagcctgtaatcccagcactttgggaggctgaggcgggtagatcacctaaggtcaggagttcgagaccagtgttgccaacatggtgaaaacctgtctctactaaaaatacaaaaattagctgggcgtggtggtgcagacctgtaatcccagctactcaggaggctgaggcaggagaatcgcttgaacctgggaggtggaggttgcagt

SEQ ID NO: 153026 - DNA, 601 bp, Human
aagctaggttggaaaataagccttgtgaattagactccttcctgggtgggcacgaagagccacaaaagggctgacacttgatttggatcttgacggtgagcaggagttccctaggcaaacagtaaagggaagggcagttttggggcagagaattcagcatatgtacgtaagacatgaacaatgtactttgagagaaaggctggtggttttgcagagctgaatgtggcaaaaggtgaggccagaaaggcaggttggggccagatggtgaaatccttatgcattatgctaagaaggtggggcyatgtagtgtttgaagttgtttcctttgccataggttttgttgtttgttttttgtttttgagacagagtctcactctgtcgccaggctggagtgcagtggcacgatctcggctcattgcaacctccgcattctgggttcaggtgattctcctgcctcagcctccagagtagccggtactacagccatatgccaccatgcctggctgatacctcaggtgatccactcgccttggcctcccaaagtgctgggattacaggtgtgagccaccgtacccagcctgcatgggttcttaagcagaaa

SEQ ID NO: 153027 - DNA, 601 bp, Human
tgccataggttttgttgtttgttttttgtttttgagacagagtctcactctgtcgccaggctggagtgcagtggcacgatctcggctcattgcaacctccgcattctgggttcaggtgattctcctgcctcagcctccagagtagccggtactacagccatatgccaccatgcctggctgatacctcaggtgatccactcgccttggcctcccaaagtgctgggattacaggtgtgagccaccgtacccagcctgcatgggttcttaagcagaaagcaacacactgtgaataatgacttakgaattgcataagatagatggagaggggaagagattagaggccctgatacgtgttgggagactttagtggatggctagagggtgaggtagttagtatgtgacctagagtgtgacaatggcaatgcaaagagatggagtagccactgagttggaggacaagggacataaaatctaacacaaaatttccaatctggaagtctgggagagaatcgtggtaatataaaaatagggaaatcgcaaggaggagctggtagagaaggaagaaaaatcttcacctggggtttcactgcattgtgtttga

SEQ ID NO: 153028 - DNA, 601 bp, Human
tgatacctcaggtgatccactcgccttggcctcccaaagtgctgggattacaggtgtgagccaccgtacccagcctgcatgggttcttaagcagaaagcaacacactgtgaataatgacttaggaattgcataagatagatggagaggggaagagattagaggccctgatacgtgttgggagactttagtggatggctagagggtgaggtagttagtatgtgacctagagtgtgacaatggcaatgcaaagagatggagtagccactgagttggaggacaagggacataaaatctaacacraaatttccaatctggaagtctgggagagaatcgtggtaatataaaaatagggaaatcgcaaggaggagctggtagagaaggaagaaaaatcttcacctggggtttcactgcattgtgtttgaggtgcgggaggtataggagagacatccaaacacgtggagtcaggaggtgagatttagatctggaattcactgaagggggagaccccgatgtacgtgttgggagtcatctacctagaaaagaccggcaaataaataagatggttaaaaaagagagagtgagatcaaggataaaaccttg

SEQ ID NO: 153029 - DNA, 601 bp, Human
gacatggccctggtgggcatgtcttctggagaggtgctttcacctctttcccccattgcagcgagtcttcagtctggtttggcattcaagtcctgcccagccccagtcaagcctgcctcataccttaataagaatctataaatattttagagtatttcttttcttttcttttctttttttttttttttttgagttggagtttcgctcttgtcacccaggctggagttcagtggtggcatgatcttggctcactgcaacctctgcctttcgtgttcaagcgattctcctgcctcagcctccygagtagctgggactacaggtgcgcgccaccacacctggctactttttgtactttttttaaaaatagaaatggggtttcaccatgttggccaggctggtctcgaaatcctaacctcaggtgatcctcccgccttggcctcccaaagtgctgggattacaggcatgagccaccacacctggccattttagagtattaaatctctctctccatcaatcaaaatagtagtagcttttaaagctgcctactttaatggtcagtattattttatttaccagaactttttcataatcaagaattcaa

SEQ ID NO: 153030 - DNA, 601 bp, Human
tcgctcttgtcacccaggctggagttcagtggtggcatgatcttggctcactgcaacctctgcctttcgtgttcaagcgattctcctgcctcagcctcccgagtagctgggactacaggtgcgcgccaccacacctggctactttttgtactttttttaaaaatagaaatggggtttcaccatgttggccaggctggtctcgaaatcctaacctcaggtgatcctcccgccttggcctcccaaagtgctgggattacaggcatgagccaccacacctggccattttagagtattaaatctytctctccatcaatcaaaatagtagtagcttttaaagctgcctactttaatggtcagtattattttatttaccagaactttttcataatcaagaattcaaagctctctaaaataagggctagcaagttaatatacatttattgaacctgcgaggcggttgaacctgtgaggcggaggctgcagtgagcgtagatcacacactgcactcctgcactccagcctgggtgacagagcaagattccatctcaaaaaaaaaaaagaaagaaaaaagaagcttctccaacctctgcttatcaccatg

SEQ ID NO: 153031 - DNA, 601 bp, Human
ctttttttaaaaatagaaatggggtttcaccatgttggccaggctggtctcgaaatcctaacctcaggtgatcctcccgccttggcctcccaaagtgctgggattacaggcatgagccaccacacctggccattttagagtattaaatctctctctccatcaatcaaaatagtagtagcttttaaagctgcctactttaatggtcagtattattttatttaccagaactttttcataatcaagaattcaaagctctctaaaataagggctagcaagttaatatacatttattgaacctgcraggcggttgaacctgtgaggcggaggctgcagtgagcgtagatcacacactgcactcctgcactccagcctgggtgacagagcaagattccatctcaaaaaaaaaaaagaaagaaaaaagaagcttctccaacctctgcttatcaccatgcccaccacaagctggaagttatccttccgtcctcagcggctgcatagcacttcttatactctccatttcttttgtgttgcttagcatttcctaccttatatggcagttattttctcattcagtaacatgtttatgaagcacttaaccatg

SEQ ID NO: 153032 - DNA, 601 bp, Human
aaatggggtttcaccatgttggccaggctggtctcgaaatcctaacctcaggtgatcctcccgccttggcctcccaaagtgctgggattacaggcatgagccaccacacctggccattttagagtattaaatctctctctccatcaatcaaaatagtagtagcttttaaagctgcctactttaatggtcagtattattttatttaccagaactttttcataatcaagaattcaaagctctctaaaataagggctagcaagttaatatacatttattgaacctgcgaggcggttgaacctgygaggcggaggctgcagtgagcgtagatcacacactgcactcctgcactccagcctgggtgacagagcaagattccatctcaaaaaaaaaaaagaaagaaaaaagaagcttctccaacctctgcttatcaccatgcccaccacaagctggaagttatccttccgtcctcagcggctgcatagcacttcttatactctccatttcttttgtgttgcttagcatttcctaccttatatggcagttattttctcattcagtaacatgtttatgaagcacttaaccatgtttcaggcactgtgcc

SEQ ID NO: 153033 - DNA, 601 bp, Human
ctgggattacaggcatgagccaccacacctggccattttagagtattaaatctctctctccatcaatcaaaatagtagtagcttttaaagctgcctactttaatggtcagtattattttatttaccagaactttttcataatcaagaattcaaagctctctaaaataagggctagcaagttaatatacatttattgaacctgcgaggcggttgaacctgtgaggcggaggctgcagtgagcgtagatcacacactgcactcctgcactccagcctgggtgacagagcaagattccatctcaaaaaaaaaaaagaaagaaaaaagaagcttctccaacctctgcttatcaccatgcccaccacaagctggaagttatccttccgtcctcagcggctgcatagcacttcttatactctccatttcttttgtgttgcttagcatttcctaccttatatggcagttattttctcattcagtaacatgtttatgaagcacttaaccatgtttcaggcactgtgccacattgaaacatggaattccctcctaagagagttccaaaaaccctacgaaaggaggaaagacacattttggttgaggcttg

SEQ ID NO: 153034 - DNA, 601 bp, Human
tcagtattattttatttaccagaactttttcataatcaagaattcaaagctctctaaaataagggctagcaagttaatatacatttattgaacctgcgaggcggttgaacctgtgaggcggaggctgcagtgagcgtagatcacacactgcactcctgcactccagcctgggtgacagagcaagattccatctcaaaaaaaaaaaagaaagaaaaaagaagcttctccaacctctgcttatcaccatgcccaccacaagctggaagttatccttccgtcctcagcggctgcatagcacttmttatactctccatttcttttgtgttgcttagcatttcctaccttatatggcagttattttctcattcagtaacatgtttatgaagcacttaaccatgtttcaggcactgtgccacattgaaacatggaattccctcctaagagagttccaaaaaccctacgaaaggaggaaagacacattttggttgaggcttgaaggctgttttccagatagtcagttgggcaagagccttccaaactagacacgccctgagcaaagactcaaagtctgggagccaagtgcctgccacgtctgggaaca

SEQ ID NO: 153035 - DNA, 601 bp, Human
tccagcctgggtgacagagcaagattccatctcaaaaaaaaaaaagaaagaaaaaagaagcttctccaacctctgcttatcaccatgcccaccacaagctggaagttatccttccgtcctcagcggctgcatagcacttcttatactctccatttcttttgtgttgcttagcatttcctaccttatatggcagttattttctcattcagtaacatgtttatgaagcacttaaccatgtttcaggcactgtgccacattgaaacatggaattccctcctaagagagttccaaaaaccctacraaaggaggaaagacacattttggttgaggcttgaaggctgttttccagatagtcagttgggcaagagccttccaaactagacacgccctgagcaaagactcaaagtctgggagccaagtgcctgccacgtctgggaacacagaagtatcctctcttcctaaactatgagctcattgaatgcaggctccatttccagttcagcctgagatcagtagcagtgactggtaccctggttctgggacagcagtgacttgaaaacagataggattcaaacacatttgctaaatccactgtattcat

SEQ ID NO: 153036 - DNA, 601 bp, Human
aaaaaagaagcttctccaacctctgcttatcaccatgcccaccacaagctggaagttatccttccgtcctcagcggctgcatagcacttcttatactctccatttcttttgtgttgcttagcatttcctaccttatatggcagttattttctcattcagtaacatgtttatgaagcacttaaccatgtttcaggcactgtgccacattgaaacatggaattccctcctaagagagttccaaaaaccctacgaaaggaggaaagacacattttggttgaggcttgaaggctgttttccagakagtcagttgggcaagagccttccaaactagacacgccctgagcaaagactcaaagtctgggagccaagtgcctgccacgtctgggaacacagaagtatcctctcttcctaaactatgagctcattgaatgcaggctccatttccagttcagcctgagatcagtagcagtgactggtaccctggttctgggacagcagtgacttgaaaacagataggattcaaacacatttgctaaatccactgtattcatttgtcatcacaatgaaatttccaaagcgttagtccattaactatagatca

SEQ ID NO: 153037 - DNA, 601 bp, Human
ttctaaaggtaaaacaaacccttcataaaacagaacacacaggctgggcgtagtggctcccgcctgtaattccagcactttgggaggctgaggcaggcagatcccctgaggtcaggagttcgagaccagcctggccaacatggtgaaaccccgtctctactaaaaatacaaaattagccgggcatggtggcgcatgcctatagtcccagctacccgggaggctgaggcaggagaatcgctggaacccaggaggcggagattgcagtgagctgagatcatgctactgcactccagcctgggygacagagcaagactctgtctcaaaaaaaaaaaaaaaaaaaaaaagaacacataggcaagccctggccacggtttattggtccagtctgcacccttgatgcaaactaagcatccctaaataaacaaaatgcatatataatatggagccaaaggtaactaatctttctaacagctattgttttgccttaacccccacctctactatctactaagtatagataattggagaaagtacagtcgtttctgtatgcccctgaaatctgaaagaaaaaaacctgaatttagtggtagttcagactta

SEQ ID NO: 153038 - DNA, 601 bp, Human
gaaattccagatttgatctaaatgtcagcaaagccaaactaataattatggccacatatcaaggcaatttatgcagaatatatggatcacttgagcatattagattgtgttcattatattctttttcatttttgttctctttctttttttttttttttttgagacaaagtcttgctctgtcgcccaggctggagtgcagtggcacgatctcggctcgctgcagtctcgcctcccgggatcaagcgattcttgtgcctcagctttctgagtagctgggattacaggttgtgccaccatgccyggctaatttttatatattttgtagagatgaggtttcaccatgttggcctgttggccaggctggtctcgaactcctgacctcaagcgatccacctgccttggcctcccaaagtgctaggattacaggcgtgagccactgtgcctggccatgtgttcattatattcttctggactctactctgagggcttggtctgcttttatcaaaaatttttactttgagcatgtagaaaagaaatcaccacctatgtttttagaagggccacatctgggtatacaggtagcagtttgagtacccataca

SEQ ID NO: 153039 - DNA, 601 bp, Human
tctttctttttttttttttttttgagacaaagtcttgctctgtcgcccaggctggagtgcagtggcacgatctcggctcgctgcagtctcgcctcccgggatcaagcgattcttgtgcctcagctttctgagtagctgggattacaggttgtgccaccatgcctggctaatttttatatattttgtagagatgaggtttcaccatgttggcctgttggccaggctggtctcgaactcctgacctcaagcgatccacctgccttggcctcccaaagtgctaggattacaggcgtgagccacygtgcctggccatgtgttcattatattcttctggactctactctgagggcttggtctgcttttatcaaaaatttttactttgagcatgtagaaaagaaatcaccacctatgtttttagaagggccacatctgggtatacaggtagcagtttgagtacccatacaggcattctgtttttgacttcagtacactatttaataaattacctgagatattcaaccctttattgtaaaataggcttggtgttagaaggttttgcccaaccgtggactaatgtaagtgttctgaacacgtttacgtt

SEQ ID NO: 153040 - DNA, 601 bp, Human
caaagtcttgctctgtcgcccaggctggagtgcagtggcacgatctcggctcgctgcagtctcgcctcccgggatcaagcgattcttgtgcctcagctttctgagtagctgggattacaggttgtgccaccatgcctggctaatttttatatattttgtagagatgaggtttcaccatgttggcctgttggccaggctggtctcgaactcctgacctcaagcgatccacctgccttggcctcccaaagtgctaggattacaggcgtgagccactgtgcctggccatgtgttcattatattyttctggactctactctgagggcttggtctgcttttatcaaaaatttttactttgagcatgtagaaaagaaatcaccacctatgtttttagaagggccacatctgggtatacaggtagcagtttgagtacccatacaggcattctgtttttgacttcagtacactatttaataaattacctgagatattcaaccctttattgtaaaataggcttggtgttagaaggttttgcccaaccgtggactaatgtaagtgttctgaacacgtttacgttagcctaggctaagccacgaggttcaat

SEQ ID NO: 153041 - DNA, 601 bp, Human
gaaaggcccccagaaactttgtttttattgacagaagtctcaaaattctaagaagtggagccgggtgcagtggctcacgcctgtaatcccagcactttgggaggccaaggcaggaggatcacttaagcccaggagtttgaaaccagcctgggcaatgtggtgagaccccatctctacaaaaaaaaaatttttttaattccaataaatgataaaaataagagaatggagacaaaagtcataaattcaattcagttacactcacattatacaggatgatcatcttttagttttatgtgcacckttttacttgactatagttgtcttctaataaaagtgtgctataaatatgaatgtaaaatttgcaagttattatggaaattaacaaatttggaaaggtgtcagtttcactaagttattgatcaatgtacatcttgcataaaatagaaagaaattagttttgacattgaaaatataaacacactctgtctgggcgtggtggctcacgcctgtaatcccaacactttgggaggccaaggcaggcggatcacgaggtcaggagatcgagaccatcctggctaacatggtaaaaccccatctctac

SEQ ID NO: 153042 - DNA, 601 bp, Human
agtgttggccaggcgtggtggctcacgcctgtaatcccagcactttgggaggctgaggcaggcataacacctgaggtcgggagttcaagactagcctgaccaacatggagaaaccctgtctctactaaaaatacaaaaaattagctgggcgtggtggtgcactcctgtaatcccagctactcgggaggctgaggcgggagaatcacttgaacccgggaggtgaaggttgcggtgagccgagatcacaccatcgcactccagcctgggcaacaagagcaaaactccatctcaacaccccccmccaaaaaaaaaaaaaaaaaaagaacttggaagtgttttccctttcataataaaatctaaagtaataaagcgattagtatttcaagaagtaacatttaatgaaaacaaattttgatgtacattagtatagaactatattaaatagagtatacttatatatagtatatgtatccaaaaaaatcacaaaccttccacacactgcatattggtttcattattttatagctacagttcatatatttaaaaatagaggaggcagctgttcccaggacagctgaaattaacttagagtaagggattt

SEQ ID NO: 153043 - DNA, 601 bp, Human
cactgcatattggtttcattattttatagctacagttcatatatttaaaaatagaggaggcagctgttcccaggacagctgaaattaacttagagtaagggatttgcagtacagtagctttttaaaaagtctttgtgccaatttaaaaaaagtatataattgaatatctgctctcaaaattaatcttaatagaccttaaatgcagcatttttcggcgttgtgctgtgttcttgcaacagaagtgaacttttgtactctgaatatgggcatttaaaatcatagatgtgcagcttttctttctttttttttttttttgaaatggagtctccctctgtcaccaggctgaagtacagtggcgtgatctcggctcactgcaacctctgcctcctgggttcaagcgattctcctgcctcagccttctaagtagctgggacaacaggcgtgtgcaccatgccgagctaatttttgtatttttagtagagatgggatttcaccctgttggccaggatggtcttgatctcctgacctcgtgatccacccacctcggcctcccaaagtactgtgattacaggcgtgagccactgcgcccagcctcattttt

SEQ ID NO: 153044 - DNA, 601 bp, Human
ttctcaagactgtcactggtaaatggtagggaagagaaccctgtcatgtcttacccatctcagtcaggttcctgggcaggtactgttagttcagaggctcttcctagccctcgttcttggcaccgcctagacaaggtttgcccatctgggagcgatccttttgtatctctagactgatctaactcagattgtaaaggatacaaaatctgccctccgcccgtgccccctctcctgtgggctctgctgtcccacagagcctgttctcccacagttgcccactgggattgagaagtagtggatyactcgatgggcacccaaggctgcaggctctgatctgatcctttccttctcatccagtctagacaacctggtacattacctctgccatgagagtctaactttaaaatgaaatcaccctgaggggtcgtgtttttcaatctctagtctccagaagacaggtcacaaccctatctcagaacaacttgagccctagacggagagtcaagatctgggtacatgtacccccctactgcaaccagtgagtacacaggagaaatgaaccaggcaagaggccagtttctagaagcagggcacagagtca

SEQ ID NO: 153045 - DNA, 601 bp, Human
tcccacagagcctgttctcccacagttgcccactgggattgagaagtagtggatcactcgatgggcacccaaggctgcaggctctgatctgatcctttccttctcatccagtctagacaacctggtacattacctctgccatgagagtctaactttaaaatgaaatcaccctgaggggtcgtgtttttcaatctctagtctccagaagacaggtcacaaccctatctcagaacaacttgagccctagacggagagtcaagatctgggtacatgtacccccctactgcaaccagtgagtacrcaggagaaatgaaccaggcaagaggccagtttctagaagcagggcacagagtcacaacaaaaccagcatccagggtgacttaattgtcaaagcacaagacatcttatattcccataggatcaagactggttccagaggtgctgtaggagctcagtcaactgctaaaaggcactgggggatggaacaaggggttgtggagataaaaactgagccagatattgcaccacttcccaatacttctgtcgtatttattctagccggaggcccacaggctgtgctacatatgagtcaaggtagccc

SEQ ID NO: 153046 - DNA, 601 bp, Human
agagcctgttctcccacagttgcccactgggattgagaagtagtggatcactcgatgggcacccaaggctgcaggctctgatctgatcctttccttctcatccagtctagacaacctggtacattacctctgccatgagagtctaactttaaaatgaaatcaccctgaggggtcgtgtttttcaatctctagtctccagaagacaggtcacaaccctatctcagaacaacttgagccctagacggagagtcaagatctgggtacatgtacccccctactgcaaccagtgagtacacaggaraaatgaaccaggcaagaggccagtttctagaagcagggcacagagtcacaacaaaaccagcatccagggtgacttaattgtcaaagcacaagacatcttatattcccataggatcaagactggttccagaggtgctgtaggagctcagtcaactgctaaaaggcactgggggatggaacaaggggttgtggagataaaaactgagccagatattgcaccacttcccaatacttctgtcgtatttattctagccggaggcccacaggctgtgctacatatgagtcaaggtagcccagacct

SEQ ID NO: 153047 - DNA, 601 bp, Human
ccccctactgcaaccagtgagtacacaggagaaatgaaccaggcaagaggccagtttctagaagcagggcacagagtcacaacaaaaccagcatccagggtgacttaattgtcaaagcacaagacatcttatattcccataggatcaagactggttccagaggtgctgtaggagctcagtcaactgctaaaaggcactgggggatggaacaaggggttgtggagataaaaactgagccagatattgcaccacttcccaatacttctgtcgtatttattctagccggaggcccacaggctgygctacatatgagtcaaggtagcccagaccttcctttaatttggctaatgactttttttttttttttttgagatggaatctcactcttgtcacccaggctggagtgcagtggcgcaatctcggctcactgcaacctctgcctcccaggttcaagcgattctcctgcctcagcctcctgagtagctgggattacaggtgcccaccaccacgccaggctaatttttgtatttttggtagagacggggtttcgccatgttggtcaggctggtcttgaactcctgacctcaggtgatcttctgcc

SEQ ID NO: 153048 - DNA, 601 bp, Human
acggggtttcgccatgttggtcaggctggtcttgaactcctgacctcaggtgatcttctgcctcggcctcccaaagtgctgggattataggcgtgagccaccgtgactggccatgactttttttttttaagtccaaatatagcataaaagatttccctgaagaaggctttagaatcaaggagatatgtgattcaataatgtctttaccattgactggccatttaatattgaatttaaacagcctttctgatttcctgccgtatttttgttaaagagatatttcagtacagtcccagtaatrtggttgtcataattaagattaatttcaacacataggaaagaatgtttattcccaaatttgtctacagattggaatcacctagggaaggtccaaaaatacagatgcctatgttgctacctcctccacccacaagagtatttctgtgacacagcctagtcgtctttggaatttttggcctcccaaagtgctgggattacaggcgtgagccaccacacccagctaatttttgtatttttagtagagacagtgtttcaccatgttggccaggctggtcttgaactcctgacctcaggtgatcca

SEQ ID NO: 153049 - DNA, 601 bp, Human
aacctctgcctcccaggcttaggtgatcctcccacctcagcctccgcagtagctgggactacaggcatgcatcaccatgctcagctaattttttgtattttttgtagagacagggtctcactttgttgcccaggctggtttcaaactcctggctcaagtgatccaagcgatctacccttctcggcttcccaaagtgctaggattacaggcatgagccaccatgcccgagccagcatgttttgttttgttttgtttttaactgaaaactactacagattaagaatcgctgattttgatactkcataatactaaattgtttatgacaataaggatattctgttttcattaatatttggcacttacgtaatgttttacctttcatatttgatattgaaaattgatgagtccaagccacatttccattactcgcaattttttaagcttcgtgactatttaatttgtttatagttccctattataggtatacagttctacttgagggttcaaaagtaaaacagggccgggcacagtggcttacacctgtaatcccagcactttgggaggctgaggcgggtggataatcttgaggtcaggagttcga

SEQ ID NO: 153050 - DNA, 601 bp, Human
ccacctcagcctccgcagtagctgggactacaggcatgcatcaccatgctcagctaattttttgtattttttgtagagacagggtctcactttgttgcccaggctggtttcaaactcctggctcaagtgatccaagcgatctacccttctcggcttcccaaagtgctaggattacaggcatgagccaccatgcccgagccagcatgttttgttttgttttgtttttaactgaaaactactacagattaagaatcgctgattttgatactgcataatactaaattgtttatgacaataaggwtattctgttttcattaatatttggcacttacgtaatgttttacctttcatatttgatattgaaaattgatgagtccaagccacatttccattactcgcaattttttaagcttcgtgactatttaatttgtttatagttccctattataggtatacagttctacttgagggttcaaaagtaaaacagggccgggcacagtggcttacacctgtaatcccagcactttgggaggctgaggcgggtggataatcttgaggtcaggagttcgagaccagcctgaccaacatggcaaaaccctgt

SEQ ID NO: 153051 - DNA, 601 bp, Human
taaaagtaaaacagtatataggccaagtttgtggtatatgtgtgtttctatcctaccagttttaagttctgtgaaaatatcacagatatacaatattttggatattttccaaaatattaaaactggtactttgggaggccagggcaggaggattacttaaagccaggagttcaagaccagcctgggcaacatagtgagacctcatctctcaaaaaaaaaaaaaattaaaaattagccagttagagtggcacatgcctgttgtcccagctattcaggaggctaagccaggagaatcgcttgmgcccaggagtttggggctgcagtgagctatgttcacgccactgcacacagcctgggcagtagagtgagaccctgtctccttaaaaaaaagcaaaactgaactaaagcaagtctctctcttgtctatcacgtcttattgccatttgaatttgttaggctttcatactgaaaacaaaggttgtgctttacatagcagtgaaaataagaataaccatagctcttggatcaggaagaatctaattttcagttggttcactaacagccaacatttgatgaaaagtcatgtggatcctggaccctc

SEQ ID NO: 153052 - DNA, 601 bp, Human
catgtgtgttgtcctcctagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggtaagtgaagcattttaacctttattttcctgacatgcgccaatgaaaggaccaacagccaaaccatttaccaagatctgaaggatttcttttttttaatttttktattggtacataacatttgtatatatttatggggtacctgtgatattttgttacatgcgtagaatgtgtaatgatcggcactttgggggtttgaggtgggaggatcacctgaggtcaggagttcgagaccagcctggccaacatggtgaaaccctatctctactaaaaatacaaaaattagccgggcatggtggcacgtgcctgtaatcccagctacttgagaggctgagacaggagaatcacttgaacccgagaggtggaggttgcagcgagccgagatcacgccactgcactccagcc

SEQ ID NO: 153053 - DNA, 601 bp, Human
tgttgtcctcctagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggtaagtgaagcattttaacctttattttcctgacatgcgccaatgaaaggaccaacagccaaaccatttaccaagatctgaaggatttcttttttttaatttttgtattgrtacataacatttgtatatatttatggggtacctgtgatattttgttacatgcgtagaatgtgtaatgatcggcactttgggggtttgaggtgggaggatcacctgaggtcaggagttcgagaccagcctggccaacatggtgaaaccctatctctactaaaaatacaaaaattagccgggcatggtggcacgtgcctgtaatcccagctacttgagaggctgagacaggagaatcacttgaacccgagaggtggaggttgcagcgagccgagatcacgccactgcactccagcctgggtg

SEQ ID NO: 153054 - DNA, 601 bp, Human
aaaattagccgggcatggtggcacgtgcctgtaatcccagctacttgagaggctgagacaggagaatcacttgaacccgagaggtggaggttgcagcgagccgagatcacgccactgcactccagcctgggtgacagagtgagactctgtctcaaaaaaaaagaatgggtaatgatcaagtcaggatatttagggtgtccattaccttgagtatttatcatttctatgtgatggaagcatttcaaggcctcttttctagctattttgaaatatttaagacagtgttgttaactatatttaccctactctgctgtcgaattagaatttattccttctgactatatgttcgtacccattaaccaccaaggtgaagtgacagaggcaaaaaccactggctagagtagaaaccagggtgtttctgaatgcttccataaactttattttcacaggttctcatgcattcttttcttcaactttttaaattattttgtgagtggtggtaaaatacacgtagcataaaatggactgttcaccatgtttaactgtccagctcagtggcattaagtctgttcatatggttgtgctgccatcaccaccaccc

SEQ ID NO: 153055 - DNA, 601 bp, Human
agaggctgagacaggagaatcacttgaacccgagaggtggaggttgcagcgagccgagatcacgccactgcactccagcctgggtgacagagtgagactctgtctcaaaaaaaaagaatgggtaatgatcaagtcaggatatttagggtgtccattaccttgagtatttatcatttctatgtgatggaagcatttcaaggcctcttttctagctattttgaaatatttaagacagtgttgttaactatatttaccctactctgctgtcgaattagaatttattccttctgactatatgttygtacccattaaccaccaaggtgaagtgacagaggcaaaaaccactggctagagtagaaaccagggtgtttctgaatgcttccataaactttattttcacaggttctcatgcattcttttcttcaactttttaaattattttgtgagtggtggtaaaatacacgtagcataaaatggactgttcaccatgtttaactgtccagctcagtggcattaagtctgttcatatggttgtgctgccatcaccaccacccactacagaactcttttcatcttgcagaaccaaaaatctgtaccctga

SEQ ID NO: 153056 - DNA, 601 bp, Human
gttccgtttttcccatcctaacaatgacagagtaagacctgtggtttcatctataaggagatggttccaaaagaatatattgcaaagccatacttcatgctgagctcgtactaatttcagtgtgcagtggtttctgtttatatatgctggtgtttaatatttgtatttgtcttaattctaggagtaccaagaggacaggaatgaccttgtgatttcagagactgagctgaaacaagtggcttacattttcaaatgcgaaaaatcaactattcagataaaagggaaagtaaactccattatmattggtagggcagaattatggctctatggttattatgatgttttataaacaagctgtatgtatttagtggagttggttttttgttgtgttttttctccccacagacaactgtaagaaactcggcctggtgtttgacaatgtggtgggcattgtggaagtgatcaactcccaggacattcaaatccaggtaagcagagcctttccaaccatgctgtaataagcagagcctttccaaccacgctgtaataagcagagcctttccaaccacgctgtagtaagcagcctttccaaccacgctgt

SEQ ID NO: 153057 - DNA, 601 bp, Human
gaatcaactaatgcataaataaaagtactgtgagactctcctagtatgattagccccattccaaagagaacttttttctcaggaaaaattggtcctagatcatgaagaggaaaagtttttctaaagaatcagtgagatcatcagaaaaacaacttgagaagtagggttggagttgaatttgcaaaacagaagaaaatctgtgaattaaaatatataataattttgatttagccacatggaattttatgatatgccaaaatctaaaggacttcttggttttggccaattataacttctatcttttttttttttttgagacagagtctcgctctgtggcccaggctggagtgcagtggcccaggccaggcgcaatctcggcacactacaacctgcacctcccaggttcaagtgattctcatatgcctcagccccctgagtagctgggattacaggtgaccaccaccatggcccagctaattttttgaatatttaatagagacagggtttcgccatattgggcaggctggtctcaaactcctgacctcaagtggtccacctgcctcggcctcccaaagtgctgggattacagtcatgagccaca

SEQ ID NO: 153058 - DNA, 601 bp, Human
tgatcatggttcatagaaacctaatgagaccacactttctgaagagctattttggatggtgggagttcctatgtaaagaaacatgctttttcccactttacattatttttaattttaaaaaactagaagtaacagcagtgaagtaatatttgatggcagaggtgagggtacatgtttagccatagtcatgcaatcatagtgtgtcacagttgaaaagtatcttggaaagaatgcaacctaacacacataccacaaacacaccttaattttagagagtttatttcaagctccctttcattcwtacagaaattaagcttaggtagcaatggtgaaaccatatataagcagttagcattttttttaatgtaaatacatcacatctgaaatacacaaccaagtaaattaagtataaaatgtgaaaatgggaagttctaaatattcatcatgtttttggagggagaaaaaaatcttaaaccaagaagaaacagaggaaattttcaaacagataggcagatatgtctacctaaaaatttaaaacttctgaattccattcagtggaatactgtgtaaccattttttttgtattatactttaagttcta

SEQ ID NO: 153059 - DNA, 601 bp, Human
ttcttctaaatgtactcatgtaaacacatatatatgcacacatagatctatagatatatctatatctgataatcctaggtaagtcagaagagatatactacatttcataactgaattgagtgtctgtggaactcctatagcagaaatcacacttcatttgaaacttcaaaattcccattaaaattctgcagcaatgaagacgcatagaaaaaaaaagaaagaaaaagaaaataaagtcagaaacaagaagagaattcctcctgtcattgcttcttgttcaataatgcattgaaagttctarctgaccgggcacggtggctcacgcctgtaatcccagcattttgggaggccaaggtgggcaaatcacgaggtccggagattgagaccatcctggctaacacagtgaaaccccgtctctactaaaaatacaaaaaataaaccaggcgtggtggcgggtgcccatagtcccagctactcaggaggctgaggcaggagaatggcatgaacccgggaggcagagcttgcagtgagctgagatcgcgccactgcacttcagcctgggcaacagagtgagactctgtctcaaaaaaaaaaaaaaaag

SEQ ID NO: 153060 - DNA, 601 bp, Human
taaaatgctaattgtgaaaaataaatacttttaaactttgataataacatgtagaagaaaaattttatgcctcagagtaggaaataaattaattagggtcaaaaagcacaaaccataaagaaagtactggtcattttaactacattaaaatttaaattatatgtttaacagaagacatcatatgaagctgaaagacaagccatggactgaagaaagatatttgcaaggcagataatagaaaaggatttgtatctagaatttataaagaacttaaatcaataagaaaaaggctgctgggcgyggtggctcacgcctgtaatcccagaactttgggaggccaaggtgggtggatcacctgaagtcgggagttcgagaccagcctgaccaacatggagaagtcccgtctctactgaaaatacaaaattagccgggcatggtgacgcatgcctataattccagatactcaggaggctgaagcaggagaattgcttgaacccagcaggcagaggttgtggtgagccaagaatcgtgccattgtactccagcctgggcaacaagagcgaaactccatcttcaaaaaaaaagaaagaaagaaagaaaa

SEQ ID NO: 153061 - DNA, 601 bp, Human
attagtgatgtcttctcacactcacccattctgcattcagactgtccttactttgcgtggtgctaggttaactgaatcttatgcctacaggaactacaatttgaggattgcctatatactaaagtctgatgctataggattgctaaggaagtgaaacaatgagaaccctgatacatcagtgttgggggagtaaatctgtgacattcactgcaatgcaaattggcagcatctaagaaagtcacattcatagtctgtgactgagtaatttcactcttagtgtatacactaaagaagccccagyacgtgtgccaaggagacaaatgtaaaaatgtttattgcaatatcattcataatggcaataaaaacaatttaaatgtccaccagttggtaagttaataaataaatcctcccaataggatactagttggtagtttaactcgtatagcagctaaaatgaaccagccgggtgcagtggctcacacctgtaatcccagcactttgggaggccaaggcaggtggatcacctgaggtcaggagttcgagacagaggtggaggttgcagtgagctgagatggcgccattgcactctagcctgagtgac

SEQ ID NO: 153062 - DNA, 601 bp, Human
ttgtctcctgaaatgaatacatttcaaaatacctagacattcatctcatgtaagcctcaaattcagccactgagatttttatctagcaaaggacttatgtgaaaagaatggtagtgtttcttatttaagttcaggaaaaatctactcagtttttactcaagaatagttttacttgtaagtgacaacattagaacttgttttaatcctagtttcatagagatttgtcaaaagtaaaatttcaagcaaatgaatatgaatgcatcttgtttcttttatcatgaaatcaaatacatgttttgartctactaacagggttgtgaggctttttctgaacatctagctgctgtttccaaattaatctcttaattttgtctcaggaaagagacactgaggtttgagaatccacttgtgtggtcttttcattctgtccctgagtgacacctatcctattctgcctgaagactttgccattaactcacctccccagctttgacccagtgaattctaatgcttggttaagcccaagctaaagccaagaggaattgagattgtatttattcgagggcattgttatttctgtttctttgctttggtcccaggt

SEQ ID NO: 153063 - DNA, 601 bp, Human
taatggggagagtgccaacaatttccattaataagacagaaggttgccacatatacctcagtgaagatgcattagactgtgagatcgtgagcgccaagtcatctgaaatgaacatacttatccctcaggatggtgattatgtaagtacctttcaaaaggctgtcaagaatttttctggagccttcattattaacattcttagagattgattaatcagctaccaacctgcgagctttatttgtagcataattcacaggcaggcgaggaattcagggagctgtcttccacatctcttcccgcytattagcttcttgactgtactcactcctggatttccgattctcaaggtagtgtactaataattcatttaatggaccagcgtttatcaaatagcacagcatgcatctgagttcgtattaggtaggactaaatattttcctttgctctggtggaggtaaacaggaaagaaggagaaataaatacttaggggaaaaaatgtgaggacagagaaaagacagtaagtagggctatttgtgcagctatgcttaagtgagaggttaagtgtaagaatcgggaagttttatgaaaatgccagttccca

SEQ ID NO: 153064 - DNA, 601 bp, Human
gccacgtgtcatacattacaggccagaattcatcatttcagtttaaaaaaacaaaactctgcaagcctcaggccatgctttactagtaagtgtgtatggacagtctaaccctgagatacagaagagtcctctcttgggccctccacctaaaaaaattcctgaagagctgatgccaacagcttcagagtaggagagtcaaaaattggagggagccctggcctttgcagctgtttaagcagaaggaaggctcagctgcatgggactggatctgctaagaaaagcagtgggatttggatgaacmctgcagactaatgaagctggaatctatgggcgtgggacccaggcacctgtaactgttaaagcttcccaggtgattccagtggggagccaacattgaaatccaccggcctaaaggatgagtgtaaatcaaaacctgagcgttcatgctaaaaaccaaggtcttggccgcgtgctgtggctcacgcctgtaatgccagcactttgggaggccgaggcgggcagatcacgagctcaggagatcaagaccatcctggctaacacagtgaaaccccatctctactaaaaatacaaaaaattagct

SEQ ID NO: 153065 - DNA, 601 bp, Human
gcaactctgccaaaagagataccaaatcagagtggctcttcagcagcactacactgtgtaaggcttgtccttatacagtggggtctcgctatgttgcccaggctggtcccgaacttctgggctcagaggatctgctggcatcagcctcacaaagtgctgggattacaggtgtcagccaccgtgcctggcccaggcctttccttttgaatgaatgaatggcttcatcccaaagaaacagttggatcctacatctaggaagataggtacccatgtgtgttccatggaaacaccacagctcatratcatgggcatcagcttatcagacacatgaggtttcaatgagcaccgcatggactggaagtccgaggaggcccagaagacaggtccaaggcctccttgccttagagaggttttctatcttcttctgaaggtctctgtccttcttccttgccttggaggaggtcttctatcctcttctgaaatgactggagaatcactgtctgggaaagcagagtgttgacttagactacttttattttgactattctctattattctttgtctgtacgtgtttgtacgtgtattttccaatgggagaagt

SEQ ID NO: 153066 - DNA, 601 bp, Human
tgtgttccatggaaacaccacagctcatgatcatgggcatcagcttatcagacacatgaggtttcaatgagcaccgcatggactggaagtccgaggaggcccagaagacaggtccaaggcctccttgccttagagaggttttctatcttcttctgaaggtctctgtccttcttccttgccttggaggaggtcttctatcctcttctgaaatgactggagaatcactgtctgggaaagcagagtgttgacttagactacttttattttgactattctctattattctttgtctgtacgtgtktgtacgtgtattttccaatgggagaagtagagtgccttggtgaagggtaaccaacgtgtatataaccctaggctcatttttacaatttatcaaagagtagagagctacctctgggataaaacctttctactccatgtgattggaaccagcagcattggcatcacctgggagcttgttggaaatgcagattctcattccattccccagacctactgaatcagaatctgcattttcataagatcctgaatcagaatctgcattttttttttctgagacagagttttgctcttgttgcccagg

SEQ ID NO: 153067 - DNA, 601 bp, Human
tagagagctacctctgggataaaacctttctactccatgtgattggaaccagcagcattggcatcacctgggagcttgttggaaatgcagattctcattccattccccagacctactgaatcagaatctgcattttcataagatcctgaatcagaatctgcattttttttttctgagacagagttttgctcttgttgcccaggctggagtgcaatggcgcaatctcggctcaccacaagctctgcctcatgggttcaagtgattctcctgcctcagcctcccgagtagctgggattacagkcatgcgccaccacgcccggctaattttgtatttttagtagacacggggtttctccatgttggtcaggctggtctcgaactcccaacctcaggtgatccacccaccttggcctcccaaagtcctaggattacaggcatgagccacagagcccagccagagagaatctgcattttaataagatcctgggtcagaatctgcattttattattattattattattttattttattttattttttggagatggagttttcacttttgttgcccaggctggagtccagtggcatgatctcggctga

SEQ ID NO: 153068 - DNA, 601 bp, Human
ggcctcccaaagtcctaggattacaggcatgagccacagagcccagccagagagaatctgcattttaataagatcctgggtcagaatctgcattttattattattattattattttattttattttattttttggagatggagttttcacttttgttgcccaggctggagtccagtggcatgatctcggctgaccgcaacctctgcctcctgggttcaagcgattctcctgcttcagcctcccgagtagctgagactacaggcgcatgccaccattcctggctaattttttgtattttttwagtagagatagggtttcaccatgttggccaggctggtctcgaactcctgacctcaggtgatccccctgccttggcctcccaaagttctgagattacaggcttaagccactgcacccggccagaatctgcattttcataagatcccagttgattcatgtgcatgttaaagtttagtggagagtagtaggtaagatagagcgcagatttgaattctagctgcgctgttactggccacatcatttggggccagttgcttactctcaggcctctgtttcctacagatggcatccccaagaactc

SEQ ID NO: 153069 - DNA, 601 bp, Human
aatagcctattgtccttattatggtagtggtgattattattattaccatttcctccactgtagggtccagccccactgggtctgtggatttttctcctcgtgtgtggagatgagagatcatagaaataaagacacaagacaaagagatagaagaaaagacagctgggcccgggggaccactaccacctagacgcagagaccggtagtggccccgaatgcctggctgcactgttatttattggatacaagaaaagggggcaggggaaagagtgtgagccatcaccaatgacaggaaggtcaygcaagtcatgtgtccactggacaagggtcccttccctgtttggcagccaaggcggagacagagagaggacagcttacaccattatttcttctatgtatttcaaagactttaagtactttcgctaatcctgttactgctatcgagaaggcagagccaggcgtacagggtggaacatgaaagcagaccaggagagtgaccactgaagcacagcatcacagggagacaggcctctggatggctgcgggcgggcctgactcatgtcaggccttccacaagaggtggtggagcagagtcttctct

SEQ ID NO: 153070 - DNA, 601 bp, Human
tgctctgttgcccaggctggagtgcagtggcatgatctcagctcactgcaagctccgcctcccaggttcacgccattctcctgcctcagtcccccgagtagctgggactacaggcgcccgccaccacgcccggctaatttttgtatttttagtagagatggggtttcaccttgttagccaggatggtcttgatctcctgacctcgtgatctgcccgccttggcctcccaaagtgctgggattacaggcatgagctacagtgcccggctttttttttttttttttttgagacagtcttgctytgtcacccaggctagagtgcagtggcgtgatctcagatcactgcaacctctgcctcccgggttcaagcaattcttctgcctcaacctcccgagtagctgggattataggtgcccaccaccgcacctgacttatttttgtatttttagtacagacggggtttcaccatcttggccaggctggtcttgaactcctgacctcatgatccacccgcctcggcctcccaaagtgctgggattacaggcgtgagccaccgcgcccagccaggtgttgcttttattagtactattaattattatcat

SEQ ID NO: 153071 - DNA, 601 bp, Human
ttagtacctggtacatggtataaatggtctatagatgtaaggtgctgcttttttttttttttttttttttgagatggagtcttgctctgttgcccaggctggagtgcagtggcatgatctcagctcactgcaagctccgcctcccaggttcacgccattctcctgcctcagtcccccgagtagctgggactacaggcgcccgccaccacgcccggctaatttttgtatttttagtagagatggggtttcaccttgttagccaggatggtcttgatctcctgacctcgtgatctgcccgccytggcctcccaaagtgctgggattacaggcatgagctacagtgcccggctttttttttttttttttttgagacagtcttgctctgtcacccaggctagagtgcagtggcgtgatctcagatcactgcaacctctgcctcccgggttcaagcaattcttctgcctcaacctcccgagtagctgggattataggtgcccaccaccgcacctgacttatttttgtatttttagtacagacggggtttcaccatcttggccaggctggtcttgaactcctgacctcatgatccacccgcctcggc

SEQ ID NO: 153072 - DNA, 601 bp, Human
gttgttcccctttctgtccatcggttcccatgatttagctctcacttattagtgagaacacgcggtatctggtgttctgttcctgcattcgttttctaagaatgatggccgccagttccatccatgttcctgcaaaggacacgatcttgttgtttttcatggctgcatagtattccatggtgtacatgtaccacgttttctttatccagtctatcgttggacatttaggttgattccatgtctttcctattgtgaatagcactgcaatgaatatacatgtgcatgtgtctttatggtagarcaacttatatttctttgggtacatacccaatagtgagatggctgggtgaaatgatagttctgtttttagctctttaaaaaattgccgcattgctttccacaatgattgaattaatttacactctcaccaacagtgtataagggttcccttttcttcgcaactttgccagaatctgttattttttgactttttaataatagccattctgactggtgtgagatggtatctcattgtggttttgatttgcatttccctagtcattggtgataatgaacacttcttaatatgctttgttggcca

SEQ ID NO: 153073 - DNA, 601 bp, Human
tcattacccgggtagtaagcatagtacttggcaggtttttgtttttttttcctgagcctctccctcctcctcccacaggccccagtgtctgttgttcccctttctgtccatcggttcccatgatttagctctcacttattagtgagaacacgcggtatctggtgttctgttcctgcattcgttttctaagaatgatggccgccagttccatccatgttcctgcaaaggacacgatcttgttgtttttcatggctgcatagtattccatggtgtacatgtaccacgttttctttatccagtytatcgttggacatttaggttgattccatgtctttcctattgtgaatagcactgcaatgaatatacatgtgcatgtgtctttatggtagaacaacttatatttctttgggtacatacccaatagtgagatggctgggtgaaatgatagttctgtttttagctctttaaaaaattgccgcattgctttccacaatgattgaattaatttacactctcaccaacagtgtataagggttcccttttcttcgcaactttgccagaatctgttattttttgactttttaataatagccattctgac

SEQ ID NO: 153074 - DNA, 601 bp, Human
tttctccctacaggaaaaattcttcaaggtgaaatgacaggaaactcccagacgcttgcaaagagagccgtgtatttgaagtcaggtatcatgaaaagtcttcctttcttgtagaattcactcttaagaaggtaccatagcaggctgggcacagtggctcacgcctgtaatcctagcactctgggagactgagcgtgcagaacatctgaacccaggagttcaagactagcctggccaatatggcaaaaccctgtctctactaaaaacacaaaaattggccgggtgtgctagtgcgcgcctrtaatcccagctactcgggaggttgaggtaggagaattgcttgaacccaggaggcggagattgcagtgagctgagatcatgccattgcactccagcctgggtgacagagcaagactcagtctaaaaacaaacaaacaaacaaacaaacaaacaaacaaaaccctcaggtactacagcctacatgtattcccccatttcagaaaggggcatttacatgcaaaaaaaagcaggcaaaatacatgtttccagttttattgttttaaagaaggcatataaattaggaagtccttcagccactaaa

SEQ ID NO: 153075 - DNA, 601 bp, Human
agggttggacaaaaagagccatatttttcttcttgcagagagcctataaacagacatgcaagtaggagatatattgctaaattcttgtcctagcaagaaatattaatattaataccctgggaaaggaatgcattgtggggggaggtctataaacggccgctctgggaatgtcttacctggttgagataagcactgagatacgccctggtctcctgcagtaccctcaagcttactagggtggggaaaaactccaccctggtaagtttgtggtcagaccggttctctgctctcgaaccctgtyttctgttatttaagatgtttatcaagacaatatgtgcaccactgaacatagacccttatcagtggttctccttttgcctctgtcctgttccctcagaagcatgtgatctttgctagactggtattagtagttctgctttttgtcctttgaagcatgtgatctttgtacctactccctgttcttacacctcctccccttttgaaaccctcaataaaaacttgctggttttgaggctcaggtggacatcatggtcctaccgatatgtgatgtcacccccggcggcccagctgtaaaattcct

SEQ ID NO: 153076 - DNA, 601 bp, Human
cttagtgtgagccaaatttgcctccctgcaacttgccttctggagtcatcctcaaatgtatccttccaaaggacagcccaggaatagcttaaaggtagctctcacattttacttggagtcatctagtatccatgttttgttttgtttttccaagatggagtcttgctctgtcatccaggctggagtgcagtggcatgatctcagcttgctataacctctgcctcctgagttcaagcgattctcctgcctcagccttctgagtagttgggattacaggtgcgtgctaccacgcccagctaattttttttttttttttgagacaatgtctagctctgttgcccaggctggagtgcagtggcgtgatctcggctcactgcaacctccacctcctgggttcaagcggttcttctgcctcagcttcccaagtagctgggattacaggtgcctgccaccatgcctagctaatttttgtatttttagtagagacggggtttcactgtgttggccaggctggtctcggactcctgacctcatgatccacccgcctcggcctcccaaagtgctgggattacaatcataagccaccgtgtccggccaattt

SEQ ID NO: 153077 - DNA, 601 bp, Human
cggcaacgggagccctgctactaccagagcagtccattccaccacttgcccctgtgatcatcctgccttagtgtgagccaaatttgcctccctgcaacttgccttctggagtcatcctcaaatgtatccttccaaaggacagcccaggaatagcttaaaggtagctctcacattttacttggagtcatctagtatccatgttttgttttgtttttccaagatggagtcttgctctgtcatccaggctggagtgcagtggcatgatctcagcttgctataacctctgcctcctgagttcaascgattctcctgcctcagccttctgagtagttgggattacaggtgcgtgctaccacgcccagctaattttttttttttttttgagacaatgtctagctctgttgcccaggctggagtgcagtggcgtgatctcggctcactgcaacctccacctcctgggttcaagcggttcttctgcctcagcttcccaagtagctgggattacaggtgcctgccaccatgcctagctaatttttgtatttttagtagagacggggtttcactgtgttggccaggctggtctcggactcctgacctcatg

SEQ ID NO: 153078 - DNA, 601 bp, Human
attgtgtacaattctatttgtggacttgcattttcatttatcctgggtaaatacctatgagtgggattcttgggtcataaaagaggcaaatgatcaacttgataagaaactgccagtcctcccccagattgcagcttgtgtattcattttcatagtggtcttttgatgagcacatgcttttaattttgattaagtccaacttaaacaattttttcttccatggttagcactttctgtggcctgagaatatgtgactatctcaaaatcctgtgttcttctgtaggcattatagtttaagttkttgtatttaaggttatgtatgattcatctcaaattaatttttgtatatggtgtgaagtaaagaacaagggtgatttttctccacatagagatgtagttgtttcagtctcatttgttgataggacatatcattccccattgaatttctttggtggttggtaatttctttcatcattctcattttacaaacgaggaaataggctcagagaagttaaataacttgtccaaaataacggcagcagtcccagaattcaaagcctgtattctttttttttttttctttccttttttttcttttttt

SEQ ID NO: 153079 - DNA, 601 bp, Human
agtaatgccaaagatacaacatattttgggccagatataaaataaaatctgcctaaagttaatgactactatagcattaggatgcgtgtgtttataaataaaattattattaactgacactaagcaaacagattttaaagctagaaaaaaggcaatggatggaaatgtgaactgggggaagatctacggttaaggcaaagagttctgttatattggcaaagaggtccccctgggacctgcattaaccaagctttgttaaatactattttaagtctgcttgtcttacctggtaactgtccarccctctttggagtttggtggacctggcagttacacagccgatggatactgacaggatggcttcaaccataagtggcagtgtccctgaatgctgcacaggtttcaccgtgacttgtactctacgggaatgaccctgaagagggtggggaggagtatgggtgccaggaatgataatgaaaaggaacgggataaagaaggggaaaaggattagagaataaagatacaaatagttagaaaatccccagaaacaatgtgtaagagtggaacagagagaaaacattaaaaaaaaacccaaaacaaa

SEQ ID NO: 153080 - DNA, 601 bp, Human
cgatagggagagtgctcccgatcacatatgacggtgagggaggcagatttaacagtgattcttcccagttcctaattcatatctggtagtaaactggggactcaatgaagcacacacatttttttttaggctactgggggacaagatcctaattttattttttttgagacagccttcctctgtcacccaggctggagtgcagtggtatgatcttggctcacttgcagcctctgcctcctgggttcaaatgactgtcatgcctcagcctcctgaatagctgagatgacagtcatgcaccacsacacctggctaattttctgtatttttagtagagacggcgttttgccatgttggtcaggctggtctcgaactcctgggctcaagtgatcctcccacctcagcctcccaaagtgctgggattacaggcatgagcaaccgcgcctggccaagttcctaattttagagattcttttcatggagtactgaatagttctgactgataatacgatcaattcttagatcaattcttagaggttttcatctttttatttttaaaatgagaatgtttagaaaatgaagatttaatgagcaaaaatgatca

SEQ ID NO: 153081 - DNA, 601 bp, Human
ggggtagactatttgactgagatttgagataggcttaggaagacagagtggcaaaactacagggaacattctcttgcccaatctcagtttgagcaatgaggcaaacatcctttaagccttaaaggatgaaatgatttaaccttaggaccacacagataatggcaggtcagaactgtaagccatgtctgaggtctccaacctcagctgtcttccctgatgcaatcatcccaggggaaagctggggcaacctcaggctatatacatacaagggtctgtactacactgttgaaataaaagcaayagcatactatttggaatataaggattggtcagtactctctattgaccataacaatcacttgaaagaatcataactgtcccaaacacagggcaacattgtaaaataaataaacaaagtaacaatttttgcaaaaacatttggcaaaacaaagtaatcacgttgaaaacaaaagggtcttggtagaaaaaaattttccttataaacgagaacctagaatcccttaatttagatttatgactaaaaagtgctttaagaatatagtcaaaattattttcatatatacttcaaaatgaactgctt

SEQ ID NO: 153082 - DNA, 601 bp, Human
gaatgctggcaattagcagtagctgtgccccatgccacaggattgacagcagtagcaatacctgataactatccatatcatcaccatcctcatcatctctctggtaggaaaaaataaacacaaaggacaagcattttgtttttcaaaccacatacagggaaaataattatttaagcttaacacacattaaaatggacagcttacctaacataagcaaaataaaacactaaattgaatctcaaaaaaggtaaaatggatttaattcacttgtctataaagaatttttcacataaagagtcaytgaaacataaaaacttggctgggctcatgcccgtaatcccaacactttgggaggctgaggcaggaggatctcttgaagctagaagtttgagacccgcctgggcaacaatagcaagaccccatctgtacaaaaaattttaaaaaattagctggatttggtagtgtgcaactgtattcccagctacttgggagactaaagtgggaggatcacttgagcggaggagatggaggctgcagtgagctctgattacaccactccacctcagcctgggcaacagagcaagaccttgtctccaaaaac

SEQ ID NO: 153083 - DNA, 601 bp, Human
caagagcatgcatagggagctaagaggggcttcaacaccaatttaaggaactgcaagccagaaatagcagaaagagcattggaacagcaattatgagactgaggttattttactggttctgtaatttggggaagttatccaacagatgagtctccttaacctgtcaaacagggataaaagaagtcgtatctacttcatgtacttgctggaaggatcaaatgaaatacggatgtgacactgctttatagaactatacatgatgttacaaagacaggattaaaaaacaccataggccgggcayggtggctcacggctgtaaccccagcacttttggaggccgaggtgggcagatctcctgaggtcaggagttcaaaaccagcctgaccaatatggtaaaaccctgtctccactaaaaatacaaaaattagccaggcgtggtggtgggcgccttgtagtcccagctactcaggagactgaggcaggagaattgcttgaacctgggaggaggaggttgcagtgggccaagatcatgccactgcactccagcctgggcgacagagggagactccatctcaaaaataaaaataaaaaaataaaaaac

SEQ ID NO: 153084 - DNA, 601 bp, Human
agaatgaaagatgtgtgaaaggagggagggttgtgtacagaagagaccaagcagtgttttatcaaaaactggcccagggatgggcatggtggctcatgcctgtaatcccagcactttgggaggcaaaggcaggaagatggtttgaggactggagttcaagaccagcctgggcaacacagggagatcttgtcttataaaaaaaaacaaaaaaacactagctgggtgtggtggcacaggcctgtggtcccagctacttgggaggtgggaggatggcttgaacctgggagatcgaggttgcagygcaccaagatcgtgccactggtactccagcctgggaaacagaatgagaccctgtctcaaaaaaacaaaaaacaaacaaaaaaacccaacttgcccagctgcatcagaaccgcctcagaggcctcttaaagtgaagagtccctttagaaatgcaaattcttatttaaaaaaataaaaaaagaagagtcgtgggtccttcctttctcttctgaatcaacataactagggatgacacccaggcctacatgttacaaacactcaagatgatctgaagtttgaaaacactttacacgagagagac

SEQ ID NO: 153085 - DNA, 601 bp, Human
gaatgatgaggagatggaaacaagacaaaagtcagatgtagcagttttacaggacatacaagagaaagaaaataaattcaactcactgtaatcaaatagatttctttcctcaccttttttaaacagcaacacaaatgttctattttttaaagtccccggtctttttccccaaagcaaaccatagcagtttagtgagcaggcccacaagccttgtgtgctaatctgaagccttttaagagaaacttgggggttaattacctcatcatcactgtgctttatgatgggcaggtagaaaaactgrctgccatgctccttgggcaggatggagttcacgccggatgcatgggggccaacaagctgctcattggcactgaggtcatccgctaaccacatcaggagcacagaaaaaacagtaggggaaagtcagtttttaagcaaacaccaaaaatttaaatatatgctttttacagttgaagtttacacataacacatttttcttttttctttcattccttattctgcagttgaaatagagactccaagactcacaacagctttttttcttttttaaaaaatcattatgtttaatagagatgaggtc

SEQ ID NO: 153086 - DNA, 601 bp, Human
cttggccaggatggtcatgttttgcacatcacagcaccaaaaaacactgctttgtgatagagagagggaaaaatcttttgagctcagagccagaatggcacaatcaggccccgttattacctgtttgttgtaaatattggctgcaattcgttttcgtaatactaactccatagcagcagggtggctgagttgaactgtggttttcacaattaggtaaatcctttcattctgtggtgtgaccctattcaagtgaacagaatcatgcaccgaggaatcccaagaggctgtggctgaaacctakgagttggggaatgatgaggagatggaaacaagacaaaagtcagatgtagcagttttacaggacatacaagagaaagaaaataaattcaactcactgtaatcaaatagatttctttcctcaccttttttaaacagcaacacaaatgttctattttttaaagtccccggtctttttccccaaagcaaaccatagcagtttagtgagcaggcccacaagccttgtgtgctaatctgaagccttttaagagaaacttgggggttaattacctcatcatcactgtgctttatgatgggcaggtag

SEQ ID NO: 153087 - DNA, 601 bp, Human
tgccttcctgtgatctctccagggcttaatcagtctttcctgagatggctagaacaacactggagaggatcagtttcactgacagcacctctgagatgggatccgtcaaagcagtaggatagggatttgtttggagtctgccttttgtcctggttttgtcactcacttgcttggacctggcacttaatctctcagcctcagtttttctacttttcaaacagtgaaatatcacagctccactgcctggtaggattacacctctccaatcagtcaaggtgaaactgcccttactggatgacaytgacctctgctatcctaatgcccactaccttggataaatgagaatcagactataacttggccaggatggtcatgttttgcacatcacagcaccaaaaaacactgctttgtgatagagagagggaaaaatcttttgagctcagagccagaatggcacaatcaggccccgttattacctgtttgttgtaaatattggctgcaattcgttttcgtaatactaactccatagcagcagggtggctgagttgaactgtggttttcacaattaggtaaatcctttcattctgtggtgtgaccctat

SEQ ID NO: 153088 - DNA, 601 bp, Human
tttgtatttttttttttttttttgagatggagtctcgctgtcgcccaggctggagggcagtggcgcgatctcggctcactgcaggctccgccccctggggttcacaccattctcttgcctcagcctcccgagtagctgggactacaggcgcctgccacctcacctggctaactttttttttttgtatttttagtagagacggggtttcaccgtgttagccaggatggtctcgatctcctgacctcgtgatccgcccgccttggcctctcaaagtgctgggactacaggcgtgagccaccgygcccagccagttattttgtattttacaaattgtagaagcattacaagttactatgtttttgaaatgcagaatactcagcataacagaaaaaactgaagctaagaatccctgtctccaaccccaagggatactaacgtccagctgttagttgggaatttgactacagaatctgcagcatgttcaggatttctgtggttgcttctctctcccatctgctgccttcctgtgatctctccagggcttaatcagtctttcctgagatggctagaacaacactggagaggatcagtttcactgaca

SEQ ID NO: 153089 - DNA, 601 bp, Human
ttgtatgtttagtagagatagggtttctccatgttggtcaggctggtctcgaactcccaacctcaggtgatccacccgcctcggcctctcaaagtgctgggattacaggcatgagccactgcgcccggcctaaagtagcatatattttacctttggtatattggatactatttcataggttacaccacaggaataaaatatatttttcagggatattctcctcttcaaactctgcgtgaaactctagtagaaaaaaaaaaaagctgtattaagctatgtgacaaatgtaagttattttgtwtttttttttttttttttgagatggagtctcgctgtcgcccaggctggagggcagtggcgcgatctcggctcactgcaggctccgccccctggggttcacaccattctcttgcctcagcctcccgagtagctgggactacaggcgcctgccacctcacctggctaactttttttttttgtatttttagtagagacggggtttcaccgtgttagccaggatggtctcgatctcctgacctcgtgatccgcccgccttggcctctcaaagtgctgggactacaggcgtgagccaccgcgccca

SEQ ID NO: 153090 - DNA, 601 bp, Human
cgttttagaagtctggagaatgaacacattctccattatttagatactgatattttttaaagtagcatatatattttttttttttttttgagacagagtttcgctcttgttgcccaggctggagtgcaatggcgcgatctcggctcactgcaacctctgcctcccaggttcaagcgattctcctgcctcagccttcctgagtagctgggattacaggcatgcgccaccatgcccagctaattttgtatgtttagtagagatagggtttctccatgttggtcaggctggtctcgaactcccracctcaggtgatccacccgcctcggcctctcaaagtgctgggattacaggcatgagccactgcgcccggcctaaagtagcatatattttacctttggtatattggatactatttcataggttacaccacaggaataaaatatatttttcagggatattctcctcttcaaactctgcgtgaaactctagtagaaaaaaaaaaaagctgtattaagctatgtgacaaatgtaagttattttgtatttttttttttttttttgagatggagtctcgctgtcgcccaggctggagggcagtggc

SEQ ID NO: 153091 - DNA, 601 bp, Human
caccacactcggctaatttttttttgtattttagtagagacggggtttcaccatgttgcccaggttggtcttgaactcctgagctcaggcaatctgcccacgtcggcctcccaaagtgttaggattacaggcgtgagccaccgcacccggccattactttattttttattctaattataaaagtaacatatgtttatttatagatttaaatatagactgcatcagttctacatacatacacatttataaaactgaaatattattttacccacttattattatttgcttagcaatttatcaraaatattttttttaagataaataaaactgcagggtgtggtggttcatgtctataatcccagcactctgggaggctgaggcaggtggatcacagacaggagttcgagaccagctggccaacatggtaaaaccctgtttctactaaaaaatacaaaaattagctgggcatggtggtgggtgcctgtggttccagctatctgggaggctgaggcactacaattgcttgaacccaggaggcagaggttgcagtgagctgagattgtgccactgcactccagcctgagcgacagagcaagactct

SEQ ID NO: 153092 - DNA, 601 bp, Human
actcataaccaatagttaacattattttgcatattttatgcttcacataagtggtatcttactatatatggtcttattcaatagtctagtcaagtattgatatgtgtactatttttagtatcatttaattctaaatacaacctgtatatttatgagaatctctagagtatatatctaagggatgtaatctctgggttgtacaggagtatattttgactgcttttccatacaggttttagaatcagcttatcaaatcttacaaaaaattctgttgagaatgattagcttaaggacatgccarttttttgatactgtgaattctcatcaacgagcatagtaatagtcattattttagtatagtccttctttttggtgatagctgtattcaggttttctatttcttcttgattcagtttttacaggacatttccattttatttaagcttttacatttgttggcataacatcaagttatgaggtctcgctatgttgcccaggctggtctcaaattcctggcctcaagcaatcctctcgccttggcttccaaaagactttacttgatcagattgaggttgaaaaaaatatttttttttttagatta

SEQ ID NO: 153093 - DNA, 601 bp, Human
aatctgtgatgtcacaaagagttactaaagtgctagtctgtgtgaacaaagtgagatagcaaatttctacactcttttcaagatccagcttaagcaccactaaccagaccaatttcagctcacgctgattttccattcctctgaattctcacagcccttattatctgcatgttcattttggcaccttatcatttaacatctcattttctgtgtatcttatttccatagttataagacagaaagtagaggctcaataaatattcaatgaattaatactgtgtaaattttcttgcgagcctctttttttccccctcaggccaccctgctatatatgactaagggaggacaattcttcttccttgcttgtatcatttcttacctttttggcctctttcctccctttccaatttgttagtataatggcgaatataccttatattttacctactaatataaggtataaggtaacagaaccgatatatatggccaaagaatactgttcccattaaggcactggtagactgtataatttaggtaataatgtcaccatgaatcaaactcattttgggtatcgtttttgaaaactgctttatgaatcaaa

SEQ ID NO: 153094 - DNA, 601 bp, Human
ccagtctgtgaaaaaaaaaataaacagatagccaggcatggtggtgtctacttgttgtacttgctactcaggaggctgaggcgagaagatcgcttgagccccaggggttgaggctgcagtgagttataatggtgccactgcactccagcccgggcaagagagagagagggagaccctgtctaaaaacaaaacaaaaaaaccccacaaacaacaaacaacaaacaaaaaaacccccaaaaaaccatggaacagatgtaggcaagaatagacataaatctgtgatgtcacaaagagttactamagtgctagtctgtgtgaacaaagtgagatagcaaatttctacactcttttcaagatccagcttaagcaccactaaccagaccaatttcagctcacgctgattttccattcctctgaattctcacagcccttattatctgcatgttcattttggcaccttatcatttaacatctcattttctgtgtatcttatttccatagttataagacagaaagtagaggctcaataaatattcaatgaattaatactgtgtaaattttcttgcgagcctctttttttccccctcaggccaccctgcta

SEQ ID NO: 153095 - DNA, 601 bp, Human
tatctgggagaacaatgaaattcataggctaatatttggctaagcattaaaacagatgtatgcccaccctgtgcaacatagggacaccagtctgtgaaaaaaaaaataaacagatagccaggcatggtggtgtctacttgttgtacttgctactcaggaggctgaggcgagaagatcgcttgagccccaggggttgaggctgcagtgagttataatggtgccactgcactccagcccgggcaagagagagagagggagaccctgtctaaaaacaaaacaaaaaaaccccacaaacaacaarcaacaaacaaaaaaacccccaaaaaaccatggaacagatgtaggcaagaatagacataaatctgtgatgtcacaaagagttactaaagtgctagtctgtgtgaacaaagtgagatagcaaatttctacactcttttcaagatccagcttaagcaccactaaccagaccaatttcagctcacgctgattttccattcctctgaattctcacagcccttattatctgcatgttcattttggcaccttatcatttaacatctcattttctgtgtatcttatttccatagttataagacagaaa

SEQ ID NO: 153096 - DNA, 601 bp, Human
agctaaatgcattaaatgcatgattacttactccaagtaagtgcacttcctctaggtagattaacttcagaatctaggcaatatgtataggcacattagaaagattttggtattaaaaagatctctttgttacactttttataaaggccagaagcaataaaagtgcctttctccctttttctaagcaaacttaagcaaaaaataaataaataaataagataaaattgtaggtcatggccacatccatgcaaaatatcattaccaatggtcacatttttattttctttaagacaaagacccmatacatgtcttaatttcttctagcatttggatgattgtctgtgaaagggccttaaacccaccaccaggcaatatgacagaaatggttccggaacttacaatcttcttctcacgtttgctattgtgttctactggcatgctgctgccattgcttcctgagggtacaatgcagccagggttatgtgcctgaggtggaggcatgctctgcaaaggttaagacacacagatgcatcacacacaaagacgacaacggccaaaatacatattaagtacatgcaagttagaaaagcaatgctaacac

SEQ ID NO: 153097 - DNA, 601 bp, Human
gatccctcactgagatcaatctctgagacagagaagcagaaagaactctgaaccaggattaacagctttctgtccaggcaaaccatttgtgtaagagctaccttaatgtggagaggttaactctttacgaaatgcattgtcctcatctgtaaaacgaggtttattaataatacctgccttctctaaatcacaaaggaaagttcaagtcaaatagcatatgagaaggtgttttaggacttttgatttatgaaacaaaatcaaatgtaaggtggtataccagattggattgttggaaaattayacaactaagtaataggacgaatcatgagtttaggatgagttcttaatggttttcaatataggcccaacatttatttttgctaatgcagtgactcttgtcatactttctttttttttttttttaatttcactttttctctgtttggtcaccaagtccttaaattatattagagcctttctctgacctcttgggctcaaggagagtttaattaatagttgtaattgttttgtaggttaaaatttactcctatactttaaagtgtcaaggttttgcctgaagctaattaaaacagtcaaatca

SEQ ID NO: 153098 - DNA, 601 bp, Human
agctaccttaatgtggagaggttaactctttacgaaatgcattgtcctcatctgtaaaacgaggtttattaataatacctgccttctctaaatcacaaaggaaagttcaagtcaaatagcatatgagaaggtgttttaggacttttgatttatgaaacaaaatcaaatgtaaggtggtataccagattggattgttggaaaattacacaactaagtaataggacgaatcatgagtttaggatgagttcttaatggttttcaatataggcccaacatttatttttgctaatgcagtgactcytgtcatactttctttttttttttttttaatttcactttttctctgtttggtcaccaagtccttaaattatattagagcctttctctgacctcttgggctcaaggagagtttaattaatagttgtaattgttttgtaggttaaaatttactcctatactttaaagtgtcaaggttttgcctgaagctaattaaaacagtcaaatcataaccttataagtaggttttatatatatagatatagagatatatggaaacatccagctatctttaggaaattgttgcatatacagttttctaata

SEQ ID NO: 153099 - DNA, 601 bp, Human
tcctgggttcacaccattctcctgcctcagcctactgagtagctgagactacaggcacccgccaccacgcccggctaattttttgtatttttagtagagagggcgtttcactgtgttagccaggatcgtcttgatctcctgacctcgtgatctgctcgcctcggcctcccaaagtgctgggcttacaggcgtgagccaccacacccggcccagtcttgtgtcttaaataccatttccacattgacacctccagaatatttatctctaaacctgacctccagaaggtgcagcaaattgtgtraaccatgtctccactacacgcctaaaggcaaagaccctaacgcattcaaaaccaaactccattttcttgtccagtcttcataatcacactgtgagagaggtccctgtttttgaaacaaataaacaggagcagaggagataagtaacttgcccaatgtcacctatctagtaagtaggagagatgggatttgaacatcgtagagaaagcttgaattatgcttcataatatgaacttcctaatcagtcttcatcatttcaaacctttgtccacatgttcctttctactcagaactttccccta

SEQ ID NO: 153100 - DNA, 601 bp, Human
gccaccacacccggcccagtcttgtgtcttaaataccatttccacattgacacctccagaatatttatctctaaacctgacctccagaaggtgcagcaaattgtgtaaaccatgtctccactacacgcctaaaggcaaagaccctaacgcattcaaaaccaaactccattttcttgtccagtcttcataatcacactgtgagagaggtccctgtttttgaaacaaataaacaggagcagaggagataagtaacttgcccaatgtcacctatctagtaagtaggagagatgggatttgaacrtcgtagagaaagcttgaattatgcttcataatatgaacttcctaatcagtcttcatcatttcaaacctttgtccacatgttcctttctactcagaactttcccctagctccccattgtcttcaggctcctcatacaacttcctcccagctttgctatggacacacccacctgtgacctccttgagggaagaagctgcctgtatttttgtgtgtccaatgcttggtacacagtaggtcttcacaaagtatctggagtaaatgaccccatagataacttgaggataatagtgagcaatctaa

SEQ ID NO: 153101 - DNA, 601 bp, Human
aaggacacttgtttctgttttcccagcccataccagaaagcagtctcttgaccttctggacaaatcattagcaaagattaaaagctgagacttagtactctttaatcttatttttcaaagtctgtcttgttttcaaactttctgtgacaatgatttctattgttgataataaaatataaaaagtaatcctaattctttacccttggtatcaactttaaaattgattttacaattttacaaaattgtaattagattacaaaaactggaatttgtagtcattttcaactaaatacttcaaaamttacaaaaactggaatttatagtcattttcaactaaatacttaaaaaattaataaaaaatccaagctattctaactcctttaatgactattcattcagactttcttaaagcacatacagctttatgacaggcactatactgagttctggagttaaaaaataacaacgattaagttttgtgtattatttactgtaggccaggcaccctcctggacacattatttgaaaatataatatatcctttaatgcttacaaccctgttagttatatactgttattcccattgtataggtaagcaaac

SEQ ID NO: 153102 - DNA, 601 bp, Human
atgacctaatttggtcaaattattcagttggcatatatttgatatttaatatctataagtgaatgactatatagaaaaagcagtgccatactatattcatggagtaaaaggactatttttcgacttaaagtgaatcttaatgtgaccttatttcctctttcgcagtaagtaaattatttgatttacacaccaaaaaagtgtattgaaagtcagaatgatttccattgggattttataatttaattaaaacagacccaccttttaacaaaagtgctaagatcaattcttgctaggaaactaytaatattaaacagatatatttaaattatcttcctgcagttattgaaaaaagtccttaactaatattagtttaggaaacaaaaataagattattaacttaaaattgcattgttaaagtgttcttatcagatatatacttttaagatgatttttaaagatgcttctattttgagtgctattatccaaagtactaaaagttcattttaggccaggcgcggtggctcacatctgtaatctcagcactttgggaggccaaggtgggtggatcacctgaagtcaggagttcaagaccagcctggcc

SEQ ID NO: 153103 - DNA, 601 bp, Human
tgaacccgggaggcggaggttgcagtgagccgagattgtgccactgcactccagtctgggagagaaaaagcgagactttgtctaaaataaaataaaatataaaagtttgttttataaacagcatatagggtcttataaagtggcctttcatgctgacctcatcaatgagccaaccatcactgctataatggttttagacgtgcgctatctctgcctggtgttttattgttgttttgctttgttgtaatcaaataatactgttacatttgttaaggacagaatctgttgctattccagataratattggtatcgtttgtttattctagaggattgccaaaaaattcacagtctcgtgatagtacagggtaagaaagcagagtagctgtcaagggctagttcaagtcaaagcctatggaagagaccgagtttggaagtggagagaagggctggtgatgaagacaggaggatgaaaaactagaaatattccagctctgaagaactgtaccaaatatgtcatattaggtatgtgagatgtgtggtggatttgggccaggaatgttttggtgttttccatggttttggactcaacttccttttagg

SEQ ID NO: 153104 - DNA, 601 bp, Human
aagatgtgttacttctgactgctttctactggtggggtagaaaagttgggtcagccagaacgatcattggatgttacactcctccttctcacagggcaaacttctcagatactgcccaggtggtatgtgatattttctcctatactgcgtaattatcaattcctttgggattaatcttaatgaaaaaaagcccacatgcagaaccagagtattcttggccctttgaacaaactagatgcttctagcatgatatgaaagaacatcaagctccagaggacgtcagaattggcctccaagttgyataatataaagctgccctagtgacagaggacccactaactggtcagtccacttgaggatctttgttagggctctgtattgacaatctaggaactaaataccctgaaagtcccaagaaatatagaattacctcaacgttttggagcttacctctccagcctaagtggcacttttacacatgaatttcctaaggaggaatttggattcccaaaaacattatccttaaaagtgcaaactcacctttctaggcctctgaggatgctgtacagtaagtggcccaggatggtctaaatgagttggt

SEQ ID NO: 153105 - DNA, 601 bp, Human
cagctttgctgccgtttggccagtttttattgatccggctgcctgggctgactctcagtagtaacctaacaatactgtgtggtttttaacagataatgtatatttgggaaccagacagaataaagatgcaatcatgtaataaaatggcccaggaaattccttaaggaagttttctctggccctcccactcccccttgaggtgacatcgtcctgttatctgctgcctgctgtaccctgcctgttccatttcatagcactcttgttaagttctgtcttatgtcaggttttgctgttattctayaacaggaatacaagcaggtgccctatccctaaaaccctgcacaatgccatggcttaattgcaagtattaaataattacaaaaaaaaattcaggatggagaagccatcaaaattattacaatctcaaaattccttaagaagcggagttttctgctctccactcccagatgataatgtcctgtctcttttgactaaatattcacccattctcttcctctaatcaagtagcttttgataatactaacagagctacctatgagcaggtaaaaaatagttataggagaatcctggtcacctagag

SEQ ID NO: 153106 - DNA, 601 bp, Human
atactgtgtggtttttaacagataatgtatatttgggaaccagacagaataaagatgcaatcatgtaataaaatggcccaggaaattccttaaggaagttttctctggccctcccactcccccttgaggtgacatcgtcctgttatctgctgcctgctgtaccctgcctgttccatttcatagcactcttgttaagttctgtcttatgtcaggttttgctgttattctacaacaggaatacaagcaggtgccctatccctaaaaccctgcacaatgccatggcttaattgcaagtattaartaattacaaaaaaaaattcaggatggagaagccatcaaaattattacaatctcaaaattccttaagaagcggagttttctgctctccactcccagatgataatgtcctgtctcttttgactaaatattcacccattctcttcctctaatcaagtagcttttgataatactaacagagctacctatgagcaggtaaaaaatagttataggagaatcctggtcacctagagtgcctatgaaaagtgatgttttaattaattaaattctatggccatttatattctgactcttgcttttgaac

SEQ ID NO: 153107 - DNA, 601 bp, Human
aaatggcccaggaaattccttaaggaagttttctctggccctcccactcccccttgaggtgacatcgtcctgttatctgctgcctgctgtaccctgcctgttccatttcatagcactcttgttaagttctgtcttatgtcaggttttgctgttattctacaacaggaatacaagcaggtgccctatccctaaaaccctgcacaatgccatggcttaattgcaagtattaaataattacaaaaaaaaattcaggatggagaagccatcaaaattattacaatctcaaaattccttaagaagyggagttttctgctctccactcccagatgataatgtcctgtctcttttgactaaatattcacccattctcttcctctaatcaagtagcttttgataatactaacagagctacctatgagcaggtaaaaaatagttataggagaatcctggtcacctagagtgcctatgaaaagtgatgttttaattaattaaattctatggccatttatattctgactcttgcttttgaacatctttttaatatgtgtgtgtacactttccttgcttggtgagtacatcatttaaactttctttggtattt

SEQ ID NO: 153108 - DNA, 601 bp, Human
ttctgctctccactcccagatgataatgtcctgtctcttttgactaaatattcacccattctcttcctctaatcaagtagcttttgataatactaacagagctacctatgagcaggtaaaaaatagttataggagaatcctggtcacctagagtgcctatgaaaagtgatgttttaattaattaaattctatggccatttatattctgactcttgcttttgaacatctttttaatatgtgtgtgtacactttccttgcttggtgagtacatcatttaaactttctttggtatttgaaaaargccttgcagttatcctttgatcacatttgcaaattttcaccattactatttaatcaataaatgaattcattgcttgagcacctgctcagtgcatttcacattggactagttgctatggggacagagaggaagtaaggtatcaaggagatggggtggctgagcctgaggaactgtgtgggcatacaatacgagatagtgctgtggggcagagatgggtggtttgggccattagtgctgtagagctttaggcttctgattcagacaggaaatatgtcaaatgtgttctgatgcaagacagaa

SEQ ID NO: 153109 - DNA, 601 bp, Human
agttatcctttgatcacatttgcaaattttcaccattactatttaatcaataaatgaattcattgcttgagcacctgctcagtgcatttcacattggactagttgctatggggacagagaggaagtaaggtatcaaggagatggggtggctgagcctgaggaactgtgtgggcatacaatacgagatagtgctgtggggcagagatgggtggtttgggccattagtgctgtagagctttaggcttctgattcagacaggaaatatgtcaaatgtgttctgatgcaagacagaacattgccrtcttttctaaagattgatacttagttttaatttttctcattttttaggagggaattaaaatttagagccctgattaactgaaggttccagctatttagattttcaatacatatggtccaccttttctaggcatagtgtattttgcgagatggtcttaaaatgcatcagcataaagcaaaatccaggctgtgtctccaatagtacatataattagttgcattgttcttagctattagaagaaacttttaaatgtgtgcgtaaagactggaagaacagaagtgtcagtattaatttactaaa

SEQ ID NO: 153110 - DNA, 601 bp, Human
atcaataaatgaattcattgcttgagcacctgctcagtgcatttcacattggactagttgctatggggacagagaggaagtaaggtatcaaggagatggggtggctgagcctgaggaactgtgtgggcatacaatacgagatagtgctgtggggcagagatgggtggtttgggccattagtgctgtagagctttaggcttctgattcagacaggaaatatgtcaaatgtgttctgatgcaagacagaacattgccatcttttctaaagattgatacttagttttaatttttctcattttttaggagggaattaaaatttagagccctgattaactgaaggttccagctatttagattttcaatacatatggtccaccttttctaggcatagtgtattttgcgagatggtcttaaaatgcatcagcataaagcaaaatccaggctgtgtctccaatagtacatataattagttgcattgttcttagctattagaagaaacttttaaatgtgtgcgtaaagactggaagaacagaagtgtcagtattaatttactaaatgagtagagtgaggacatcacaatggtgaaattcagggacaacct

SEQ ID NO: 153111 - DNA, 601 bp, Human
cagggagacgcaccctgagctgagttcgagagttgaccaagagaagggacagcattgggagaaagttacctgaatgtcacagaagtaaacagaaagagagagagcacatacgatgttttgggcaatgcaggggagacacccattcatcctctccttcagtgaatacatactgaactcttacactgtgcctggtattgctgtaagcctcggggatatggcagggaaccaaacaaaaagatctgctctcatggagctttcgttctaatggagagagacaagacatttgacaaattaaagaaayagaatgtatagcacaccagacagcactaagtatctagcaccttctgtagagagaaagaaacccagatgggtagtcaagaatactggagaaggaggtatgatcttaagtaggataattaggaaggtctcactgagaaggtgctgagccaattcccagggcctcagggagggaaatatgaacaatatatcatctgcctcaataatatataactttctaggaggatattgacattgtaatccaataaattctataattttaaaatctaagatgtgctaattatttaataaatatttttcaaca

SEQ ID NO: 153112 - DNA, 601 bp, Human
cgcaccctgagctgagttcgagagttgaccaagagaagggacagcattgggagaaagttacctgaatgtcacagaagtaaacagaaagagagagagcacatacgatgttttgggcaatgcaggggagacacccattcatcctctccttcagtgaatacatactgaactcttacactgtgcctggtattgctgtaagcctcggggatatggcagggaaccaaacaaaaagatctgctctcatggagctttcgttctaatggagagagacaagacatttgacaaattaaagaaatagaatgtmtagcacaccagacagcactaagtatctagcaccttctgtagagagaaagaaacccagatgggtagtcaagaatactggagaaggaggtatgatcttaagtaggataattaggaaggtctcactgagaaggtgctgagccaattcccagggcctcagggagggaaatatgaacaatatatcatctgcctcaataatatataactttctaggaggatattgacattgtaatccaataaattctataattttaaaatctaagatgtgctaattatttaataaatatttttcaacaagtgtgtg

SEQ ID NO: 153113 - DNA, 601 bp, Human
cataaggcagcctcagataatcagatgttgcttaggatgcatcaccccatttgtgcctgacctcctgtttactttcaactccatgttttagagttcttgaatcagtagcctgccttctgtctcagcctctggctcctcttgaatttgttatttattctgcttctctttggtttttcatatctaagaactgttttattgttccgttatccagtgactcctctatagctcatgagaatttcctgctgcagctcctggccccagagattcctaatggctctgtccatggtggaggtagtgaggwgttgggggtgacttgggtaaggcagaataaccttgagcaaggtgatgaatacattgcaaatttagccgtttctggtgctgataacaaagatgggggagcatataaataagagctgtgacctttgaaagaatagagattgataagtgttgcaagatggaagttggggagaatctcataagtagccagtgggaacaaggagaatatgtttgcaaagcactgttggaacatttccccaaggaatgatgaactctgcataaaactaacttttgatgaaggagaaacagtagctggaccatttgg

SEQ ID NO: 153114 - DNA, 601 bp, Human
agaactgttttattgttccgttatccagtgactcctctatagctcatgagaatttcctgctgcagctcctggccccagagattcctaatggctctgtccatggtggaggtagtgaggtgttgggggtgacttgggtaaggcagaataaccttgagcaaggtgatgaatacattgcaaatttagccgtttctggtgctgataacaaagatgggggagcatataaataagagctgtgacctttgaaagaatagagattgataagtgttgcaagatggaagttggggagaatctcataagtagmcagtgggaacaaggagaatatgtttgcaaagcactgttggaacatttccccaaggaatgatgaactctgcataaaactaacttttgatgaaggagaaacagtagctggaccatttggggaaatatggagaagatggaataagaattttatagggcaatatggactatagttcataacacagtaccaatataaaattttctgaatttaccacttctactgtgatatattttttcaaatttctaccgatgatattaaactgaacgaatgttaattgaaaattataagatattaaagtattac

SEQ ID NO: 153115 - DNA, 601 bp, Human
attaatctgaatataaaaggatatgtaaatcaaatgccgtatatgccgtatagggataaacaactttaaccactatctaatctgtattaaacaacaacaacaacaacaaaataaaaacataagatgtcactggattttcttctaaaaatcatagtttaatgttttgctatacactggcgggaaagaaatatattccttcattgtgcactggttgtctttttctaacaaatattccatctcagttaatttacagtgctaactggaaataaactttatcgatataatgtacatcaataaactstatttatttaaaatgtcagtggatgagttttgccagatgtatagacctctgaagctacgtaccactacagtcaacgtacagaacccttccacccaccaaagatttgctcatgcctctttgctgacagtgccaaaacacaaaacagggaataatcagtctgcattattggtaactgttttattgaatgtatagggattttggtgccccttttttaaaaaacaaaaacaaaaacaattccctgtattgaagttgttgttgttgttgttgttttgagacggagtttcactcttgtcgcccagg

SEQ ID NO: 153116 - DNA, 601 bp, Human
cgcccaggctggagtgcaatggcatgatctcggctcactgcaacctccacctctcaggttgaagcgattctcctgcctcagcctcctgagtagctgagattacaggtgcccgccaccatgtccggctaatttttgtatttttagtagagacggggttttgccatgttggtcaggctggtcttgaactcctgacctcaggtgatctgcccgcctctgcctcccaaagtgctgggattacaggcatgagccactgtgcccagcctttggtggccttttaaaataaatctttcctattataaaytgtatcttaaaacagtcccataaactcacagaactgtacatgctataaagcaaatgttctccaccaatcatgtcattgtaagttgcactctacttttcaaactgttttcacagctcagtggaggaacacagcacacaatgaggggaacatttttcctacatcatcaacgaggaagcaaagcctcagcagttagtttatgaagccgaggccagcgaataggcagggttaggacaagaacaagttgccttctcccctgttccagatttggctttcaagacagagctagaaattcacaaatgg

SEQ ID NO: 153117 - DNA, 601 bp, Human
catgatctcggctcactgcaacctccacctctcaggttgaagcgattctcctgcctcagcctcctgagtagctgagattacaggtgcccgccaccatgtccggctaatttttgtatttttagtagagacggggttttgccatgttggtcaggctggtcttgaactcctgacctcaggtgatctgcccgcctctgcctcccaaagtgctgggattacaggcatgagccactgtgcccagcctttggtggccttttaaaataaatctttcctattataaactgtatcttaaaacagtcccatwaactcacagaactgtacatgctataaagcaaatgttctccaccaatcatgtcattgtaagttgcactctacttttcaaactgttttcacagctcagtggaggaacacagcacacaatgaggggaacatttttcctacatcatcaacgaggaagcaaagcctcagcagttagtttatgaagccgaggccagcgaataggcagggttaggacaagaacaagttgccttctcccctgttccagatttggctttcaagacagagctagaaattcacaaatggaaacagcaactccgaacaccac

SEQ ID NO: 153118 - DNA, 601 bp, Human
gaactgggttcaaacttggtctctgtatttaccacctctgtgactttaggtgagacttagcctccctaagctgtagttttccatctgtaaaatgggcatagcagaactttcctcatgggagctttatgaagcttcaggtagatcatttatataaagtgcttggcatagggccaacacagtgtgatcatgtaatagatacttgattttttaaattttctctaattttattgtcctgtatgtatagatttaattttcaagtgcagagtcaaaagatattaaatatatttttgaattttgaaaygtgattaaaggaaaaccaaatcctaagtgacctaaaattcatattgggttttaatttaccggtgtttgttttttacttagcactaaatctcttacaatatagagtgttgctttgctactgtaatcaagttcacacctgcaacgtgactttaagtttaaaagatacaatgtagaaaatgcattcttactatcctagggcattttttttaacctccttaaccatggcatttgaagtttggacatgaataacagtgctttttttttaagttggagaaaggaaacctatacctgccaagagttg

SEQ ID NO: 153119 - DNA, 601 bp, Human
cttcaggtagatcatttatataaagtgcttggcatagggccaacacagtgtgatcatgtaatagatacttgattttttaaattttctctaattttattgtcctgtatgtatagatttaattttcaagtgcagagtcaaaagatattaaatatatttttgaattttgaaatgtgattaaaggaaaaccaaatcctaagtgacctaaaattcatattgggttttaatttaccggtgtttgttttttacttagcactaaatctcttacaatatagagtgttgctttgctactgtaatcaagttmacacctgcaacgtgactttaagtttaaaagatacaatgtagaaaatgcattcttactatcctagggcattttttttaacctccttaaccatggcatttgaagtttggacatgaataacagtgctttttttttaagttggagaaaggaaacctatacctgccaagagttggaaatgaaaataggaagagcccctggaactctagtgtgttagattgaaaacattatttagaggaacagactgggaaaccagtgaatattttggcttttatagaaagggagtgtgcctcataaacaggacag

SEQ ID NO: 153120 - DNA, 601 bp, Human
agtcaaaagatattaaatatatttttgaattttgaaatgtgattaaaggaaaaccaaatcctaagtgacctaaaattcatattgggttttaatttaccggtgtttgttttttacttagcactaaatctcttacaatatagagtgttgctttgctactgtaatcaagttcacacctgcaacgtgactttaagtttaaaagatacaatgtagaaaatgcattcttactatcctagggcattttttttaacctccttaaccatggcatttgaagtttggacatgaataacagtgctttttttttaagttggagaaaggaaacctatacctgccaagagttggaaatgaaaataggaagagcccctggaactctagtgtgttagattgaaaacattatttagaggaacagactgggaaaccagtgaatattttggcttttatagaaagggagtgtgcctcataaacaggacagttggaatgtatggaaaatttccagtgaaaacaagaaacaaagcacatgactaatactgcttttccaagttagacaaatgcagctttaaccagaatttgccactgaggggccttgggggccctccttgaatct

SEQ ID NO: 153121 - DNA, 601 bp, Human
cccagcaggtgagtgtcagaagacaaattgaagtattcagctaaataagcaactgcaaaactgaatttattcctcttcaagaactactcttcttgtatgttgagtgaccatttggctgccaagagaaactgctttgcctaggaaataatatggactgaaaaatcagtttcaaacacaaatgaaaaatattccttatgtttggtcatcttctttccacatcaaatatacatgtaaagatgtatataagatataatctgaagataatcaaacagctattaactggatttctgcatttcgcctrtccttcaaaaccagcctcaagtctacctttatgttgagagagtgtatctttaactcatggtgttctctttctcctttcacatttcctgtaaactcatcatgaattgccttgtttattgttttgatttctcattcaacaacaccagaatactctgtgtttagggtaaccttagacttcagttttcctgaggagtttcagtttacacgtcttgcaccggtacaattaacagtgcccctttcaggttaaaaagtgtctcagtgtagttcataaattatatagtcaccccatgtgtgcagcaat

SEQ ID NO: 153122 - DNA, 601 bp, Human
ttattcctcttcaagaactactcttcttgtatgttgagtgaccatttggctgccaagagaaactgctttgcctaggaaataatatggactgaaaaatcagtttcaaacacaaatgaaaaatattccttatgtttggtcatcttctttccacatcaaatatacatgtaaagatgtatataagatataatctgaagataatcaaacagctattaactggatttctgcatttcgcctatccttcaaaaccagcctcaagtctacctttatgttgagagagtgtatctttaactcatggtgttckctttctcctttcacatttcctgtaaactcatcatgaattgccttgtttattgttttgatttctcattcaacaacaccagaatactctgtgtttagggtaaccttagacttcagttttcctgaggagtttcagtttacacgtcttgcaccggtacaattaacagtgcccctttcaggttaaaaagtgtctcagtgtagttcataaattatatagtcaccccatgtgtgcagcaatcagagctttttcaatgcaaagttgattatgatgggcataaatgaatcataataaaaagttctagta

SEQ ID NO: 153123 - DNA, 601 bp, Human
ataatatggactgaaaaatcagtttcaaacacaaatgaaaaatattccttatgtttggtcatcttctttccacatcaaatatacatgtaaagatgtatataagatataatctgaagataatcaaacagctattaactggatttctgcatttcgcctatccttcaaaaccagcctcaagtctacctttatgttgagagagtgtatctttaactcatggtgttctctttctcctttcacatttcctgtaaactcatcatgaattgccttgtttattgttttgatttctcattcaacaacaccrgaatactctgtgtttagggtaaccttagacttcagttttcctgaggagtttcagtttacacgtcttgcaccggtacaattaacagtgcccctttcaggttaaaaagtgtctcagtgtagttcataaattatatagtcaccccatgtgtgcagcaatcagagctttttcaatgcaaagttgattatgatgggcataaatgaatcataataaaaagttctagtatgatcccatctgactgggcttcttgtgatggcccatttcaacaccatgggtgtcattagtggcttcacaatggttctt

SEQ ID NO: 153124 - DNA, 601 bp, Human
tgatttctcattcaacaacaccagaatactctgtgtttagggtaaccttagacttcagttttcctgaggagtttcagtttacacgtcttgcaccggtacaattaacagtgcccctttcaggttaaaaagtgtctcagtgtagttcataaattatatagtcaccccatgtgtgcagcaatcagagctttttcaatgcaaagttgattatgatgggcataaatgaatcataataaaaagttctagtatgatcccatctgactgggcttcttgtgatggcccatttcaacaccatgggtgtcaytagtggcttcacaatggttcttcttgtaaattccctcatgacctagagttttgatttatgccatcctagcccactttaagctctgactcatgctgggattgccctaaacagggcagggcagactaatggaatgcattgcattgtcctaacatttcttaacctgcccaaggttgaacatgcttgtttgtttttcttttgctctccaaaaatctttatgctagcgtaaaggcctgttgtaatcacataaattactcactatgtaacaggagaagttgaaatttgtccctgaaacataaagat

SEQ ID NO: 153125 - DNA, 601 bp, Human
agtgtagttcataaattatatagtcaccccatgtgtgcagcaatcagagctttttcaatgcaaagttgattatgatgggcataaatgaatcataataaaaagttctagtatgatcccatctgactgggcttcttgtgatggcccatttcaacaccatgggtgtcattagtggcttcacaatggttcttcttgtaaattccctcatgacctagagttttgatttatgccatcctagcccactttaagctctgactcatgctgggattgccctaaacagggcagggcagactaatggaatgcrttgcattgtcctaacatttcttaacctgcccaaggttgaacatgcttgtttgtttttcttttgctctccaaaaatctttatgctagcgtaaaggcctgttgtaatcacataaattactcactatgtaacaggagaagttgaaatttgtccctgaaacataaagattatatataataaaagccttaaaaacctacctattgagaaccaaagatatttagtgctgtttcctaactggcattacaagaaaattctgctcagtcaggggatactcacctttcaagggacaaggaacatgtaatg

SEQ ID NO: 153126 - DNA, 601 bp, Human
ctaaacagggcagggcagactaatggaatgcattgcattgtcctaacatttcttaacctgcccaaggttgaacatgcttgtttgtttttcttttgctctccaaaaatctttatgctagcgtaaaggcctgttgtaatcacataaattactcactatgtaacaggagaagttgaaatttgtccctgaaacataaagattatatataataaaagccttaaaaacctacctattgagaaccaaagatatttagtgctgtttcctaactggcattacaagaaaattctgctcagtcaggggataytcacctttcaagggacaaggaacatgtaatgaatttaaatttggtttagatctgtgtaataaggaaaagtaagtgaatttggtgatcttgtacctgaggatggcggcattaaaaaaagactattttaacttaatatcatttcattaacttctttaaaaataagctagttcagctgaactacacaatatcagaagaccaagtgtaagaaaacggtaatcggccgggcgcggtggctcacgcctgtaatcccagcactttgggaggccgaggcgggcggatcacgaggtcaggagatcgaga

SEQ ID NO: 153127 - DNA, 601 bp, Human
tttcttttgctctccaaaaatctttatgctagcgtaaaggcctgttgtaatcacataaattactcactatgtaacaggagaagttgaaatttgtccctgaaacataaagattatatataataaaagccttaaaaacctacctattgagaaccaaagatatttagtgctgtttcctaactggcattacaagaaaattctgctcagtcaggggatactcacctttcaagggacaaggaacatgtaatgaatttaaatttggtttagatctgtgtaataaggaaaagtaagtgaatttggtgaycttgtacctgaggatggcggcattaaaaaaagactattttaacttaatatcatttcattaacttctttaaaaataagctagttcagctgaactacacaatatcagaagaccaagtgtaagaaaacggtaatcggccgggcgcggtggctcacgcctgtaatcccagcactttgggaggccgaggcgggcggatcacgaggtcaggagatcgagaccatcctggctaacacggtgaaaccccgtctctactaaaaatacaaaaattagccaggcgtggtggcgcgcgcctgtagtcccagc

SEQ ID NO: 153128 - DNA, 601 bp, Human
tacactctaatcatttatcaccctctgggggagattattgtatagacattgctagtgccccacccatgctctttttatagggctggtgcacccatccccagctgctctgcattctggccgtttatggctcacagttgtcactttctcaaaggaattgccctccaccaaaaggagccacattgcttagagatgcctggaacatcaacccgctccaaccccactcctccccgtaccaggctgcctgcagccagtgactgtctgatatggggtagaaaacaggccccaggctcccaggtgggayaactttgtgttgtcgtttgggctcaaagctatgggaggggtcaggttgaggccacactcccattgcaccaacgtatatgcttgctgccatgcctcactgcctgtcccagtaaatcacttgctaacaatctctactctagggtctttctcaggggaattaaaacaattgttttttcttgtaatgtcctcattcccccagcttcctcctgagctactatgtaagaattgaacattattgtactacctccttctcttccaaatacacgttcagactatcaaacctaatcactggaccagcaaa

SEQ ID NO: 153129 - DNA, 601 bp, Human
ttcccccagcttcctcctgagctactatgtaagaattgaacattattgtactacctccttctcttccaaatacacgttcagactatcaaacctaatcactggaccagcaaacagagaaggcaagatagagaggaatccaaactggttttcactaaacataaatactattgtaggtttttctaagtgaaagtagaggcaaaattatttagagaaaatagtttgccccataaagatacttattttcatttccatggtctgaatgcttgtttgctacaagtttgaaacaaattaaacactgtgstgtaggcaaaggagaggaatgtgccagcctaggctgggccacactgcaagagagtagtatttcctgaaagcgtaattcaggagccaactacaaatattttgaatttcatgaatattgttcaattaattctatatgagcacagtttaaataagcattggtggtacttagtaactaaagtttttccacagatgtgttatcattatttgaatgacatctgcttctttgtctatttcaacaaatagatccttgctccccctgttttgagggatcatctcagacactaacttcccggtaatgtat

SEQ ID NO: 153130 - DNA, 601 bp, Human
cattattgtactacctccttctcttccaaatacacgttcagactatcaaacctaatcactggaccagcaaacagagaaggcaagatagagaggaatccaaactggttttcactaaacataaatactattgtaggtttttctaagtgaaagtagaggcaaaattatttagagaaaatagtttgccccataaagatacttattttcatttccatggtctgaatgcttgtttgctacaagtttgaaacaaattaaacactgtggtgtaggcaaaggagaggaatgtgccagcctaggctgggcsacactgcaagagagtagtatttcctgaaagcgtaattcaggagccaactacaaatattttgaatttcatgaatattgttcaattaattctatatgagcacagtttaaataagcattggtggtacttagtaactaaagtttttccacagatgtgttatcattatttgaatgacatctgcttctttgtctatttcaacaaatagatccttgctccccctgttttgagggatcatctcagacactaacttcccggtaatgtatcttctctactacttcagaacctccctactcagatccacct

SEQ ID NO: 153131 - DNA, 601 bp, Human
atttatttgttttaatttttatattaaataatagcatatatttctctgcaaaagagagattcagtaatcaagtaatgtattttaaggtatatttacatgactatgatatgtatatctagaaggaggaaaacccagttatactctaaactttactcttaagcatgctcaattcgtctgattttgactgttatcaaagcagaacatgtattaattacaacagtgtttacttgttttattttttaaggaagtagctttatacggttattcaaatttaatttaatttgtatagtaaatgcaattrggaaagggatattgcctggaaaaaaatgcatttctcacaaatcattttgtttaggagtaacagaagaatccagaatgattgattctaaatatcaagtactacagtctttgtcagttgtaattgttctttttgccagataaccatgaacatcctttaaatgttgttgaaattttattgactttactacagaaaaaaactagaaatgtctctaaaaacttgtacttgatccaatcacttgatttatggaaagatcccattctaaacactgaaacttctactgtcctttttagttagttttgg

SEQ ID NO: 153132 - DNA, 601 bp, Human
cagtaatcaagtaatgtattttaaggtatatttacatgactatgatatgtatatctagaaggaggaaaacccagttatactctaaactttactcttaagcatgctcaattcgtctgattttgactgttatcaaagcagaacatgtattaattacaacagtgtttacttgttttattttttaaggaagtagctttatacggttattcaaatttaatttaatttgtatagtaaatgcaattgggaaagggatattgcctggaaaaaaatgcatttctcacaaatcattttgtttaggagtaasagaagaatccagaatgattgattctaaatatcaagtactacagtctttgtcagttgtaattgttctttttgccagataaccatgaacatcctttaaatgttgttgaaattttattgactttactacagaaaaaaactagaaatgtctctaaaaacttgtacttgatccaatcacttgatttatggaaagatcccattctaaacactgaaacttctactgtcctttttagttagttttggggaatttgctggtccattttttcccctgtcacttctatcagctaaatattttcaaaataat

SEQ ID NO: 153133 - DNA, 601 bp, Human
aattctgggaaataatttaaaaattgttcagcttaaatcaatgttcatgttgcaaaatctgaataaaatgcaggtgttctaagagatcttcagtaagccagtttgtagtgatgccaaaattgtatttgtaatagattggatggatgtgtatatattcaactttatgggcttttaagaatcttttttttactaaataaatgcagtactttttacttaatagccatttttatatattagctgtatttttaaaactttatcacccaagggactttcattttaaagacagcatgttacatttacracaagtttgaggacacataacatctttctttgtttttttgaacatagagattaatatacacatgaacatacacgtatatatgtgtctatatatatgtgtgtgtatgtgtatatagataatatacccaacatagataatattaattataatgacattacaacagtttctttatcgaatgcctactatgccgtgagcactctgttgggatgctttaccttacttcatcctcacatcagcaatttgatatggttatagttagccctttgttactgcggaggagatggagacttggagagttta

SEQ ID NO: 153134 - DNA, 601 bp, Human
tttgatatggttatagttagccctttgttactgcggaggagatggagacttggagagtttaggtaactagcttagtaagtagctgtgctatggaacattggaagtttcctcccagtaactatttagcaatactacctcatcacacctgttgtcaacagttgtaagacaatgagaaaatataagacacacagcacatgctaacaaatccagaaatagaattacttagaatatacacacttattgacaatatgcaattaaatctttttctgatttctgtcaaggcaggttttttttgttatcrttgttgttttgtgttttgttttgtttgtttgttttgagatggagtctcgctctgttgctcaggctggagtgcaatggcatgatcttggctcactgcaacctccgcctcccgagttcaagcaattctcctgcctcagcctcccgagtagctgggactacaggtgtgtgccaccacacccagctaattttttgtatctttagtagagacggggtttcactgtgatacccacatggctcgatctcctgatctcatgatccgcccacctcagcctctcaaagtgctgagactacaggtgtgagc

SEQ ID NO: 153135 - DNA, 601 bp, Human
aacaaatccagaaatagaattacttagaatatacacacttattgacaatatgcaattaaatctttttctgatttctgtcaaggcaggttttttttgttatcgttgttgttttgtgttttgttttgtttgtttgttttgagatggagtctcgctctgttgctcaggctggagtgcaatggcatgatcttggctcactgcaacctccgcctcccgagttcaagcaattctcctgcctcagcctcccgagtagctgggactacaggtgtgtgccaccacacccagctaattttttgtatctttrgtagagacggggtttcactgtgatacccacatggctcgatctcctgatctcatgatccgcccacctcagcctctcaaagtgctgagactacaggtgtgagccaccattcctggcctacctggttactttctctagatgggagatagcaatgtgacataaaactgccccaggggctccagaactgctggtacagttatacttctaaagcactaggccccaaaccaatttttctcagatttccagatgataaaaatattagcatcatttttttctttttttttttgtgagtcacaatggatg

SEQ ID NO: 153136 - DNA, 601 bp, Human
gttactttctctagatgggagatagcaatgtgacataaaactgccccaggggctccagaactgctggtacagttatacttctaaagcactaggccccaaaccaatttttctcagatttccagatgataaaaatattagcatcatttttttctttttttttttgtgagtcacaatggatgtcaactttctaaccctttttatttctattttcttcctgctctttcctgaaaattttcacacagctatagcaaggcaaagaaagtagctgggactacaggcatgtgccaccacacctgggtartttttgtatttttagtagagacagggtttcaccatattggtcaggctggtctcgaactcctgaactcaggtgatccacccacctcggcctcccaaagtgctgggattacaggcatgagccactgcgcccagccagcagtattttttttaaacttttattttagatacagagtgtacatgtgcaggtttgttacctggtatattgcatgatgctgaggtttagggtactaatgatccgatctcccagatactaagcatagtacctgacagtttttcaacccttgctcccctccctactttc

SEQ ID NO: 153137 - DNA, 601 bp, Human
ctttatgaggcactgagaactaaaacaaatgagcacaagaggaggatctgaggatctgtgctttagcacattataatacttcttccattggcttaagaatttccattgggatcaataaaaaataatccttattaaaatgcagtgttcgaatataaagaataaggtgcatattgcaacatcactaggcaaatagctgaacaagcagcaactgcaatcataaagtgggaaaacccactcaggcacaacctctaatgaggtgtcagtgcagtgctgagggctgctagggaaccattgctggaargtagttttcttgtaatgttggatgggagggcaaatgaactaggtagacccagaagctgaagacagactgtccgtgtctgtaaacagcagtcatgctttgttgtatatgcagtgtagagatttttactttcacagaagggtgtgtttgtatgtgtgttgtgggaggggagggaaggagagagagtgtgtgtgtgtgtgggagagagagaagaaattcctagcacacactgactaatagcattcagtatactttgaacattcagtgaaaagaattcctgtaattgttgatattggtatattt

SEQ ID NO: 153138 - DNA, 601 bp, Human
accaacatttctctctctctgggtcatcatcgttaggtgtctgaaatatgagattagagatgggaactagaactttttaaagaaaagaatcagaatacaaagaaaacagattttcacttgtgaatttgtttttgccatgtgtactatggaagtaggagccttatctgagcttgaaactaggtactaggttaacttagaacagagtcagacaattgttagaaacaaagactggagtcctagattccacagcttcccttccatgagactacagtcctttaattttttttttttttttttttttacttgagtagcgttggggtacaagtggtttttgattacgtggatgaattgtatggtgatgaagtctgggctcttattgtttctatcagccaaattgtgtacattacacaataggtaatttttcatccctcagccctctcccaaacccttcttctgagtttccaatgtccattaaaccattttgtatgtctttgggtacctatagcttagctctcacttgtaagtaacacgtactgtttggtttttcattcctgggctactttgcctaggataatggcctccaattccatccaagttgctg

SEQ ID NO: 153139 - DNA, 601 bp, Human
aacagattttcacttgtgaatttgtttttgccatgtgtactatggaagtaggagccttatctgagcttgaaactaggtactaggttaacttagaacagagtcagacaattgttagaaacaaagactggagtcctagattccacagcttcccttccatgagactacagtcctttaattttttttttttttttttttttacttgagtagcgttggggtacaagtggtttttgattacgtggatgaattgtatggtgatgaagtctgggctcttattgtttctatcagccaaattgtgtacatgacacaataggtaatttttcatccctcagccctctcccaaacccttcttctgagtttccaatgtccattaaaccattttgtatgtctttgggtacctatagcttagctctcacttgtaagtaacacgtactgtttggtttttcattcctgggctactttgcctaggataatggcctccaattccatccaagttgctgcaaaggacattatttttttacggctgagtggtattccatggtgtgtgtatatatatatataccagattttctttgtgcactcttccactgatgggcacttagat

SEQ ID NO: 153140 - DNA, 601 bp, Human
ttaactgccaacacaaaagtcttacctgttgagtgaaactcttggtcaagtctgaactgaaatagacttaatttcatgtttcagttgagtcaaggctacaagttggcgaaagtcaaattaggtctgtgtcttagttcatctgtactgctaaaacaaaatatctgtgactgggtaatttacaaacaatacaaatttccttcttacagctctggaggctggggagtccaggattaaggtgccaacatccagtgtcttgtgagggacttcttgctgtgtccttacatgatggaagcgcagaagsacaaagagagctaaaagctttggagccttaatcccattcagaagggtggggccctcatgatctaatcacctcctaaaggccccagctcttaatactattgcattagaggctaaggttcaacatatgaatttggggggacacactcagaccacagcagtttgcaaatgtggttaatgtctacacctaaattggttttctttctggaaacaaaactaaaaaggtcactcacttttctgaacattttagtagtaagcagattttacagtttggcagcctacaacagatggaaaatttttaggc

SEQ ID NO: 153141 - DNA, 601 bp, Human
aaggccccagctcttaatactattgcattagaggctaaggttcaacatatgaatttggggggacacactcagaccacagcagtttgcaaatgtggttaatgtctacacctaaattggttttctttctggaaacaaaactaaaaaggtcactcacttttctgaacattttagtagtaagcagattttacagtttggcagcctacaacagatggaaaatttttaggctaaggaattttcatactctgggtagccaagctggtggtaaaggaagcacaaaatattagagttcactttagttctktgagttccaggccaggtctagaaagatttgtgaagtgaagaagttttggacaatgtatacacaaagttgatataaagtgaaggacaaggcatagaaggagatacatagaggagataatagaacattaaaggtattagggaaagatgtttcctgcttactccattgagtgtctggggaaatacagggaagggtgctccatactaccccagttagcacttctaactgcaaacacaggagtaaacacagttcctccctctctactcttctcctactaccttcccctctcatccccttccacct

SEQ ID NO: 153142 - DNA, 601 bp, Human
aatgttggggaaagttgagagagaaagaaaaaaagagaaaacggttggaatatggctagctagagattctgtggtctctattccctttaaaattaccatgtccatgtccatgtgtgattgggcacatacacacatgtgcatgagtgtgcacatgcacacagttttcttttatatgtaatacattttttaaagggatgaacttggattagaagaaagaaaacgagatggcaaagagagatactaaatgtgactgcctctggggagcaatccttaaatatgccctcttcctccacccctactyatccctctctaaagcagagtgagaggcaccttttccctgttcttctagcactttggtgaaatctctctgtgcatcttatactatgtgatactgtttgcttatatatgtctcttctcttcttgtctgtgatccacctatatccgggatgtcccttttgtttactttgagtgagatggacagatcacaccgtgacttccagtgtccttagaacatcttatgttaaagaatagactgtaggaagtctgagattgttctactaaaaactcatgataaaatgatgtatgactcattctgtatcat

SEQ ID NO: 153143 - DNA, 601 bp, Human
ggtatctattaattacaatgagccggtcgactctttccaataaattatatatctttgttgtcagatttttgtaataaaaggtcctcttgtttcagtttttcatttgtttcaattgttcatttgtttcattttagtctagaattatatacgctttctattttgagagtaaattataactgttttctccttcattgcagaagacaatagatgtgcatcttcaaatgcagcatcctgtgccaggtgccttgcgctgggtccagaatgtggatggtgtgttcaagaggtgtgccattttttttttctttttctcatggttgacttgagctatagcatgacttcattttcctaatattctgtgccttgaaggtgcatcaggaaaaataaagatactgctgaacataaggaaaattttatttggttttatgcttggaaacagcatatctggctgaatataaaataaatcataacatttttattaggaaaattatggtaattttgaaatgaagtgcaaaccattttatgttttccatgtgttctatagagagaattggcaaccacagctagtaacttttgatagttaagtaggctttggtgtggaatt

SEQ ID NO: 153144 - DNA, 601 bp, Human
taaggtcaggagtttgagaccagcctggccaacatggtaaaaccccatctctacaaaagatacaatagttagctgggcgtggtggtgtgtgcctgtagtcccagctactcgggaggctgaggcaagagaatttttagaacctgggagatggaggtggcagtgagccgagatcgtgccactgcactccagcctggatcaggagggagactctgtctccgacacagaaaaaaaaagccaaccagagaaacttcagtctgagcttttccttctcaaataggttttagatgcagaaagttggagwaggatttttgcttgtgtttttcttgtagaaatagtaaaaacataaggattagaagaaattaaaatgatataaaataccaaaaatgcaatatttgctatgtcattttctttggatgtaattgatatacactaaaaacatcagtgattttctttcttttaaacaggatttcatttcaggtggatcaagaagtgaacgttgtgatattgtttccaatttaataagcaaaggctgctcagttgattcaatagaatacccatctgtgcatgttataatacccactgaaaatgaaattaataccca

SEQ ID NO: 153145 - DNA, 601 bp, Human
gctgggcgtggtggtgtgtgcctgtagtcccagctactcgggaggctgaggcaagagaatttttagaacctgggagatggaggtggcagtgagccgagatcgtgccactgcactccagcctggatcaggagggagactctgtctccgacacagaaaaaaaaagccaaccagagaaacttcagtctgagcttttccttctcaaataggttttagatgcagaaagttggagtaggatttttgcttgtgtttttcttgtagaaatagtaaaaacataaggattagaagaaattaaaatgatatmaaataccaaaaatgcaatatttgctatgtcattttctttggatgtaattgatatacactaaaaacatcagtgattttctttcttttaaacaggatttcatttcaggtggatcaagaagtgaacgttgtgatattgtttccaatttaataagcaaaggctgctcagttgattcaatagaatacccatctgtgcatgttataatacccactgaaaatgaaattaatacccaggtgacaccaggagaagtgtctatccagctgcgtccaggtttggtcattttcaaataaatctataatgatt

SEQ ID NO: 153146 - DNA, 601 bp, Human
ccagaactgtgctatttcttccagactctgattatcagaaaaacaaaatccattactttcttggccctgggcatattcccagtttccaattaaaactgtgctctttcccatattaaataatgacacagcccagtatggacattgtgagcaacagttggaaaggaatatacaaaaatgaaagtaattagattggtaagattatagctcttcccaccttccattgcaaaaaattatttagtgtcgtaaataaattcttttttagaaaaagagagacagggtgaaacaaaaattgtacgttctygtacacctaattccaattgaatacatccactaaactctgcccttagatattcctataattacacatgcctctctcttgcctgtgttttcttttgcctttatcttagtactagaaagtttgaacattttccgtaagctgttaaccatctttatctctcttttttgtgtaatttgtgtctccatacaaatatgcctatttttctaattgaatgccaattttcagcagcttatatataaagcttaacctatatcatttgcctctaataaatatgactacattcttaaaaatgtcttactcttt

SEQ ID NO: 153147 - DNA, 601 bp, Human
ctgattcttcaggatcttaatccaggccatcgcccctttcagcacacatgtaattcaattatatttcagctttctgactcaaatgagtctgaaaatacttcccagttcacacctgaatttaagagtaagttgttaatatcatctttcctgcaaatctttcagaattctcaattcctgcctcttcactcttcattttccttcaacaggattttcaaaacagcagaactgaaaaacccacaccttaatatttgcacatgaagtaaataggaattatataatagaatagaaaaataataaacastctcttagtctgtttggctgctataacaaagtacgttgattgggtggcatacacaacagaaatttattttctcatggttctaggggatggaaagtccaagatcaagaggctagtagatatggttcctggtgagaggtctcatcctggcttgctacgtccacacagggcagagagaaagtgatcaagagagagaacacacatgcaaaagagtgagagagtgaaagctctccagtatctcttcttagaagtgcactaatcccatcatgtcggctccatcctcatgacctcatctaaacctaa

SEQ ID NO: 153148 - DNA, 601 bp, Human
taagcacaaaaatctataataaactgtttaagtcttgagataattttctaggaaaatatgtctaaaattgactcaagatagagaaccctaagaaacctaatatacaagaagtttaaaaagttataaatgtttataattataaaaattataattacctcccttaataagaaatactccctaaaaacattaggtctaaatgctttcatgagcagaaatgtttcatgttcattcaaatattgaaggaatacattatctctgtggtatataaacttttacactactttatttatttatttacttwtttattattattattattattattattattattttgagacggagtctccctctgtcacccaggctggaatacagtggtgcgatctcagctcgctgcaacctctgcctcctgggttcaagtaattctcctgcctcagccccctgaatagctgagattacaggagcctgccaccatgcctggcaaatttgttttgtatttttagtagagacagggtttcaccatgttggccagactggtcttgaactcctcgactcaggtgatccaccagcctcggcttcccaaagtgctgggatttcagga

SEQ ID NO: 153149 - DNA, 601 bp, Human
catcgagcccggcctaaactcttacatcactttaggggatgcctagaagctacttaattattacaaggttagtataaccctattatcaaattcttaataaaattttagcaaatcaaattaactgtatgtgataagaagaacaatatcaccaaacaaataggcttaagctagaaaaccaaagatagttgatttttggaattgatgtatttttatgatgttagtttgccaaaaagagataaaacatattgttatctcaatagataataaaaaataattcaataaaatttagtgcccatttccrgcaaaaccaaaatcgaagaatactcccttaggatatgttaaaatccttctcaaaagtatacataaatatgattacatttttaaaaatgaaataagagttataaacattttgaaaagataaagcaaaattatcatgctatggaaaatccaagcaaatcaaatgaaactaactattgaatatttttaaattttactctggcaggttgttttttaaaatattcaaaaatcagtgaatttcctttgtaatattaaatataatgaagaaaaatgatcaattgtgtgattatctcataaaagcaac

SEQ ID NO: 153150 - DNA, 601 bp, Human
gatagttgatttttggaattgatgtatttttatgatgttagtttgccaaaaagagataaaacatattgttatctcaatagataataaaaaataattcaataaaatttagtgcccatttccggcaaaaccaaaatcgaagaatactcccttaggatatgttaaaatccttctcaaaagtatacataaatatgattacatttttaaaaatgaaataagagttataaacattttgaaaagataaagcaaaattatcatgctatggaaaatccaagcaaatcaaatgaaactaactattgaatayttttaaattttactctggcaggttgttttttaaaatattcaaaaatcagtgaatttcctttgtaatattaaatataatgaagaaaaatgatcaattgtgtgattatctcataaaagcaacctagaatgtaaactgtttaggaataaacttttaaaaaagtataagatccattgtgctacctaatagaaaatacgaataaatggagaagaattttatgctcctgaatataatatcataacaatgacagttctctatatagtctataagtataacaaagtccaagtgaatcaataaatgtaa

SEQ ID NO: 153151 - DNA, 601 bp, Human
ttttatgctcctgaatataatatcataacaatgacagttctctatatagtctataagtataacaaagtccaagtgaatcaataaatgtaagacaatcaatcccagtcaaatttgaatgcagttttttaaaacacatcttcactgaaacttattatgcatgtatctttgtatataaccgcatatttatttagcatgcattcctggcagtagatctgctaggtcaaatgtatgacaatgtatttactttttaatgtagattgttacattattcacacaaaaaattcgatgttcagtttagccyttcattagtcaaccatgcctgctttcattctttttaatgtctgctatttgtttagtccattagctgttttcttttgcctttttcctagaactagaaagtttgaacatttttcctaaggtattaatcatcttcatctctctttttttgtgtgtgatttctgtctccatacaaatatgcctatttttctaattgaatgctaattttcagaggtttattatatattatttgcctctaataactataactatattcttttaaatgtcttgctcttttttaaatacataagtttgaaaattataa

SEQ ID NO: 153152 - DNA, 601 bp, Human
tcctagaactagaaagtttgaacatttttcctaaggtattaatcatcttcatctctctttttttgtgtgtgatttctgtctccatacaaatatgcctatttttctaattgaatgctaattttcagaggtttattatatattatttgcctctaataactataactatattcttttaaatgtcttgctcttttttaaatacataagtttgaaaattataagttgcattttttctactggtatgttacaaataatttatacacttcaatgagtttagcttgttcttttttatagatataatgaygatttggtccttctgagactataaatgaacagttcaaaagttggaaaattgtttcagtgctgtagacaagcaatgatagtggtaatgacacaggagaaaactaggtaaacttgagagagaatggagaggtggaatccacaggagttggtgattgataggccatgtgggactcccaggatctggcaagcaacttagtgtggtagggaaatctgtatgaatgaagtggtgttgatttaaactgggatgtcttgagttgagagagagagacttaagctatatgaggctgaagctcaggggaga

SEQ ID NO: 153153 - DNA, 601 bp, Human
atacctaagtggaaaatgcattgagctcttaatattaattttgatttatcactttattcttctctgataaaaatttatgacttccaatgtagcatctgttaagaatttttcatgaatatatttattacatcatgtactgactagggtttcttaaaaaatgttagtaggactatattttaattggatgttttaaatgacatttaaaaatgacattttctttacttttcacttcttataatatactttttcttattttcacttatgaatcttatggaaaatgataacagaaatagactattgrtcctagttgatgttctctaaggaaactggatattaactctttaggaaaataggacagagaagggaattctctaattctaattcagaaataatacaatgtatatgataaggattagtttaacctatatttcattaacttaagaaaatgtttcaaacttggttcgttttaataatgtgcaaaaagaatcttctaatttagtgtagatttagtaagattttccagatatgcttcacctgtttcttaatttcaaaatttagaaaacaaaacagaacttgcacattttctctccaccccctggca

SEQ ID NO: 153154 - DNA, 601 bp, Human
aatgtactggagtctgtaccttgccattataaactggtcccatttgggggcccttctccttcccctgctgaagtataatgaatagaaattggcttatcattcttccacttacagctttccacattttctcttggttttaaaatttcatcttaagcagatcatttttttacttatcttttcctagtgtgcagtcatgttcgttgtgcccagtacatcagagatgctcacaccattctttgagtagtttaaaaactcattttaaccactttttattctttgtattcaaaccaatcactggcartagctctaagtaggtcatcaactctcctccatgtcttctttctaattctgccacagactcacttcttcccgttaaaattaatggaaggaaatgagtgtctgagttcttagaatctcaaaaggcatgaggataaagctttcctggagataatataagtggtggcaggaagatttgggagccagatgatactcttttcctcttagagaaactctgtggaagctctgcctatactgtgggaaataaattctagacgctggcttctttctgtagtaaacatgtgggccctttaaaatgttgaac

SEQ ID NO: 153155 - DNA, 601 bp, Human
ctgccacagactcacttcttcccgttaaaattaatggaaggaaatgagtgtctgagttcttagaatctcaaaaggcatgaggataaagctttcctggagataatataagtggtggcaggaagatttgggagccagatgatactcttttcctcttagagaaactctgtggaagctctgcctatactgtgggaaataaattctagacgctggcttctttctgtagtaaacatgtgggccctttaaaatgttgaaccaaaatgtgcttcaaatatagtttagttataaaacatttatgggggastatgtatgtgccaactacagaggcttcagagatgaagaaacagttcttaccctagtgttgcttagaatctagtagtagtaagtaataattactaacatatgcatttactatataggcaatactagggtaaatattttacatagattaccttatttagtagctcttagctgctaaaaaaaaaaaaaaagataaagatgtccagtctagagtctcataattgtatggtaaacactaaaatggtggtatgatccagttgccatggaaacacaggggcggggccctcagctcagtttaggaagg

SEQ ID NO: 153156 - DNA, 601 bp, Human
gtaattacatgaagaagaagaggttgggccaccacaggcagaggaaggaccacaggcagggcacaggagtatgcatttgtaggctgtatatggggaagtaaagcagatttgtcttgctagagctaaagatgtagacaagagtaagtattatgtaggaacttcgatctgacatgtttagccattgggcattggccatctggtggagagctgttgacaaaaaataagtaatttggattttaaaaggatcgactcggtggtatagataatgatggctggaaaatgagacgatagaggtagacawatgaagaggttatggaaataatccaggcaaaaagacaatgaagggcaaggatggataggagtatatcccagtattctggcatgctagagttcaattgaaatgtttaacttgatgaataataggtaaggaaagtgagtgaaaactaaactactagattcttaactcttaaacccttcactgggtcaaaagtaatgagtttgaacatagtgtcgaaattaacctgattctaccttgtgtttgaaattctacattcataaaggaaaaaaaaaaggaaatgttatggtcggtcccaaattatag

SEQ ID NO: 153157 - DNA, 601 bp, Human
atttggattttaaaaggatcgactcggtggtatagataatgatggctggaaaatgagacgatagaggtagacatatgaagaggttatggaaataatccaggcaaaaagacaatgaagggcaaggatggataggagtatatcccagtattctggcatgctagagttcaattgaaatgtttaacttgatgaataataggtaaggaaagtgagtgaaaactaaactactagattcttaactcttaaacccttcactgggtcaaaagtaatgagtttgaacatagtgtcgaaattaacctgattytaccttgtgtttgaaattctacattcataaaggaaaaaaaaaaggaaatgttatggtcggtcccaaattatagtcaattataactattttcctcaaagttggtcttacctatgtttagtggtaagaattgattgtttaatataggaaaaaagacctaaaattggtgagataatgtgattcaaattccaaaaaaaaaaggaaaattagatagctctgcattcagaagaattgaatgatattttaaagacattcacataaacacacacccaaatagattcttcacatttacttgtattccaa

SEQ ID NO: 153158 - DNA, 601 bp, Human
taaggaaagtgagtgaaaactaaactactagattcttaactcttaaacccttcactgggtcaaaagtaatgagtttgaacatagtgtcgaaattaacctgattctaccttgtgtttgaaattctacattcataaaggaaaaaaaaaaggaaatgttatggtcggtcccaaattatagtcaattataactattttcctcaaagttggtcttacctatgtttagtggtaagaattgattgtttaatataggaaaaaagacctaaaattggtgagataatgtgattcaaattccaaaaaaaaaaggaaaattagatagctctgcattcagaagaattgaatgatattttaaagacattcacataaacacacacccaaatagattcttcacatttacttgtattccaaaaacagaaaactattgaaaagaatgaaggatggcaacaaagtacatgaacaaaaaaacaactgaagcatcaccagaattttgttttctgttgtagaaacttacttaggttactttctgagactggcaaagaaagataccagaaatttaaagtaatcattaccctttatcttcaacacccaaaccccctaaaatgaca

SEQ ID NO: 153159 - DNA, 601 bp, Human
aaaaaaaaaaggaaatgttatggtcggtcccaaattatagtcaattataactattttcctcaaagttggtcttacctatgtttagtggtaagaattgattgtttaatataggaaaaaagacctaaaattggtgagataatgtgattcaaattccaaaaaaaaaaggaaaattagatagctctgcattcagaagaattgaatgatattttaaagacattcacataaacacacacccaaatagattcttcacatttacttgtattccaaaaacagaaaactattgaaaagaatgaaggatggyaacaaagtacatgaacaaaaaaacaactgaagcatcaccagaattttgttttctgttgtagaaacttacttaggttactttctgagactggcaaagaaagataccagaaatttaaagtaatcattaccctttatcttcaacacccaaaccccctaaaatgacaagaacagctataattaatttaatgtgaaattaaaaagggaacactgacatatcatctattaatattcaatacaaatattaacccatggtgccttgcaactaaaaatatctggagagcacatgccaggttaagtttaa

SEQ ID NO: 153160 - DNA, 601 bp, Human
ttttgctgatgctgtacaggccctggttgtttgctgaggtcaccaacctatacctttgctgggtccctggcacaatatgctgaccatctattacatctagcagtacctctgaaaacagccatttatctttagacagagccaccataaactgcaacgattcaccaagataaaaataccatgataccatgtggccggtttacaaaaacaatcttttttaaatctacaaagatagcaacacttttcatcaacagcagttcacctagagagagtcgacactttttgtctgagtgaaaaacaaaamcaaaaaaacgctgatccacacatcaaggttcaagtccctgaacatgaaccgctctcccagtagtgttgaatttctacttctcatcgatctggcccagtgtaccagtgtctaacattcccctgaatttaatttctccactcaaattgcagaacactgccacaggaacagttctttctgtcaacagaagcccaaaagcagagcagaatataggatatgctctcaggaggcagcctagcttctgaaggcaagggatgagagaatggactgggctgggccatgtgtgccctatttctcctttca

SEQ ID NO: 153161 - DNA, 601 bp, Human
aataaaattgtagttccctgcggggactaccgacatttgtccttgtggcagccccctctcctcatccagttgttttgcccaaggtgggtgcctcgctcatgggccccctcctcagcatgtgttcattgaacacctaccgtgtgttggacaaatgctgacccctaccttccccaggtcctccatgtggcactgcagggcaccattctttagcccactgtctcattccttcacttggctaactgatgggaagaatcttaccaactaactagtgatgaggtactaattattttgaatagcttgytgtactacacagtaccagagttttctcatctcctgtgtaaatacactttaacccagaggaataaatttatgcctttatccaataggagatcacctttttttaaagataccttcccagttttcctcaagtcattccacacgtacatccccctcactgtcttgagatcgaatgccgcttgctggtttgcactgtgtttttctagctactaaggcaatggaggttcatataatgatacaataccctgttacatttatatggagctggcccatttgttattatccctattcagcctatagaatt

SEQ ID NO: 153162 - DNA, 601 bp, Human
tctcctcatccagttgttttgcccaaggtgggtgcctcgctcatgggccccctcctcagcatgtgttcattgaacacctaccgtgtgttggacaaatgctgacccctaccttccccaggtcctccatgtggcactgcagggcaccattctttagcccactgtctcattccttcacttggctaactgatgggaagaatcttaccaactaactagtgatgaggtactaattattttgaatagcttgttgtactacacagtaccagagttttctcatctcctgtgtaaatacactttaacccaraggaataaatttatgcctttatccaataggagatcacctttttttaaagataccttcccagttttcctcaagtcattccacacgtacatccccctcactgtcttgagatcgaatgccgcttgctggtttgcactgtgtttttctagctactaaggcaatggaggttcatataatgatacaataccctgttacatttatatggagctggcccatttgttattatccctattcagcctatagaattgtgggaaatgaactgtaggatttggagaccaataaattggtatggttttcaaattg

SEQ ID NO: 153163 - DNA, 601 bp, Human
acgttgataaaacagtttcaccatacattagcatccaccccgaaaggattcataatcaatgcaggtatctagggtttgatgtggatatgctaaattaattttttgcttataaaatctcactttgtttttaatgtaaagaacttaccaaattttatatttttatcttataaaataagaataaaaatatttggtgaggtggggaggtttcttcatatctgaaaacttctgagatgaactgtagattgggctttttattttatatttctttaaatatttagtcagtttttatcaccaaaaaaaacaaaaaaacaaacaaaaaaccctacctaatgttagtaactttgaatgaagcttcaatagttaggctgccatgtatataaatacctctttggaaattctgtatttttattttttgattgctccaaaattgctgaattatgatttgacacattttaaagagtttgtgccaacacgtcatctatctctccattactgtactgtgactggggataatgatgttgtctccgatgtgactacaaagaaatctcagttatcacaaagaaagtgggtcaaaagatgagaatttgattgcttagaaaga

SEQ ID NO: 153164 - DNA, 601 bp, Human
gattcataatcaatgcaggtatctagggtttgatgtggatatgctaaattaattttttgcttataaaatctcactttgtttttaatgtaaagaacttaccaaattttatatttttatcttataaaataagaataaaaatatttggtgaggtggggaggtttcttcatatctgaaaacttctgagatgaactgtagattgggctttttattttatatttctttaaatatttagtcagtttttatcaccaaaaaaaacaaaaaaacaaacaaaaaaccctacctaatgttagtaactttgaaygaagcttcaatagttaggctgccatgtatataaatacctctttggaaattctgtatttttattttttgattgctccaaaattgctgaattatgatttgacacattttaaagagtttgtgccaacacgtcatctatctctccattactgtactgtgactggggataatgatgttgtctccgatgtgactacaaagaaatctcagttatcacaaagaaagtgggtcaaaagatgagaatttgattgcttagaaagagccttttttcttatcattttagatttctgattctaaataacatatg

SEQ ID NO: 153165 - DNA, 601 bp, Human
gcatcactttaaaaattagtgcagtattaaaaaaaactaatatcatatttcaactaaattcctcaaaagcattttccagaagtgtttctcagctgttcaatgataagaaatcactgcacattcttatattcaccttaaaaattcacagcgcagattaaatattgaaagcctttaactgtcctatattaaaaaacatgtttaatcatctttatttttttgaataccaaatgcttatagtcttatttcctatttgcaaagaaattgtcatcagcattgagcttatctctaattttataagcayagattttcgtcgtataaagtttccctggcacaaaagaagtactcccttttcacacaactgtacaattttactgttaagtattccagaatgcttaagaagagcaaaataaactttacacttcttcttttcccacacagtgactacaatttagactgcatgcctccccatggatacatccatgtgctgtctttgacagagaacatcactgagtttgagaaagcagttcatagacagaagatctctggaaacatagatacaccagaaggaggttttgacgccatgcttcaggcagctgtctgt

SEQ ID NO: 153166 - DNA, 601 bp, Human
tgcagtattaaaaaaaactaatatcatatttcaactaaattcctcaaaagcattttccagaagtgtttctcagctgttcaatgataagaaatcactgcacattcttatattcaccttaaaaattcacagcgcagattaaatattgaaagcctttaactgtcctatattaaaaaacatgtttaatcatctttatttttttgaataccaaatgcttatagtcttatttcctatttgcaaagaaattgtcatcagcattgagcttatctctaattttataagcatagattttcgtcgtataaartttccctggcacaaaagaagtactcccttttcacacaactgtacaattttactgttaagtattccagaatgcttaagaagagcaaaataaactttacacttcttcttttcccacacagtgactacaatttagactgcatgcctccccatggatacatccatgtgctgtctttgacagagaacatcactgagtttgagaaagcagttcatagacagaagatctctggaaacatagatacaccagaaggaggttttgacgccatgcttcaggcagctgtctgtgaagtaagacgtttcacat

SEQ ID NO: 153167 - DNA, 601 bp, Human
ctcccttttcacacaactgtacaattttactgttaagtattccagaatgcttaagaagagcaaaataaactttacacttcttcttttcccacacagtgactacaatttagactgcatgcctccccatggatacatccatgtgctgtctttgacagagaacatcactgagtttgagaaagcagttcatagacagaagatctctggaaacatagatacaccagaaggaggttttgacgccatgcttcaggcagctgtctgtgaagtaagacgtttcacatgatcgagtgtttgctaagatgcmaaactttcaaagaatttagacgttttattttctctttgatttgtggagtgaaaacgtagtgtagaagaaaacatatcttactatctcttactcctcaccaaggtgattcatttcggtatgtgtttgggacagaggggctaaattcagggagggatttaaataggaaaagacaaaagggaaagaataggttatgaacgcgaaaattctttccaaaagggctgcttttctcatgcgccacactccaaggaggaactagaagtagactgttgccctcctcacttcagcttgttctcctacttt

SEQ ID NO: 153168 - DNA, 601 bp, Human
agaagatctctggaaacatagatacaccagaaggaggttttgacgccatgcttcaggcagctgtctgtgaagtaagacgtttcacatgatcgagtgtttgctaagatgccaaactttcaaagaatttagacgttttattttctctttgatttgtggagtgaaaacgtagtgtagaagaaaacatatcttactatctcttactcctcaccaaggtgattcatttcggtatgtgtttgggacagaggggctaaattcagggagggatttaaataggaaaagacaaaagggaaagaataggttwtgaacgcgaaaattctttccaaaagggctgcttttctcatgcgccacactccaaggaggaactagaagtagactgttgccctcctcacttcagcttgttctcctactttttttttttttgagacggagtctcgctctgtcgcccaggctggagtgcagtggcgccatctcggctcactgcaagctccgcctcccgggttcacgccattctcctgcctcagcctcccgagcagctgggactacaggcgcccgccaccacacccggctagttttttgtatttttagtagagacggggtttca

SEQ ID NO: 153169 - DNA, 601 bp, Human
gggactacaggcgcccgccaccacacccggctagttttttgtatttttagtagagacggggtttcaccgtgttagccaggatggtctcgatttcctgacctcatgatccgcccgcctcggcctcccaaggtgctgggattacaggcatgagccaccgtgcctggcctctcctactttttaatctatattgttcttcctccagtggaacactagaaatctctagccaggaactagtgtggtcacatggctgtgggaaaatagaggatgtacaaataaaagttaaagctatttacgcagcagygttgtacccacgcacatcgttctagcctgacttactgttcgtcaactcaaacgtaatgtttacttgaggtaaaaaccacagtacacatctgtgttattgtacaaagtctaattacatgtttatttttaagagtcatatcggatggcgaaaagaggctaaaagattgctgctggtgatgacagatcagacgtctcatctcgctcttgatagcaaattggcaggcatagtggtgcccaatgacggaaactgtcatctgaaaaacaacgtctatgtcaaatcgacaaccatggtaatgcagca

SEQ ID NO: 153170 - DNA, 601 bp, Human
atctgttaattttgtttgctgtttcccgacagagacgtggccttttctacttcagaaaatgttaaatctttttctgcttctcaggtttgtctcagatgcatactaataaaaatgcaaattcatggaacacttattttgtgccaggtatggaatacaactagaaagttttaagtccatgtgcagcttttaaaaacgattgttccatcttttggggcatcgaaagactacaaagtacctgatttcagcttgctgaatgatctgcttcaaattgtaaacactatgagaacattttttttttttttgagacggaatctcactgtgtcgcccaggctggagtacagtggcaccatcttggctcactgtaacctccgcctcccaggttcaagcgattctcctgcctcagcctcccgagtagctgggactacaggcgcgtgccaccacacctggctaatttttttttttttttttttttttttggattttttagtagagacggggtttcactgtgttagccaggctggtctaaatctcctgacctcatgatccacctgccttggcctcccaaagtgctgggattacaggcgtgagccactgcgcctgg

SEQ ID NO: 153171 - DNA, 601 bp, Human
gactacaggcgcgtgccaccacacctggctaatttttttttttttttttttttttttggattttttagtagagacggggtttcactgtgttagccaggctggtctaaatctcctgacctcatgatccacctgccttggcctcccaaagtgctgggattacaggcgtgagccactgcgcctggcctgagaacattttaatagtaattttataggagaactaatttgaatgcttctcatattctcaaaaagagtggcctggaaaggatctctgcaaacaatatttagtaggaattgttttaaytgaaagcaaaattgcatgtagaaatcacctgtgccagactcaaagtagcctggctctgcttgtgtaatgcctttcaaatggggtaaaattatggtttgcaaaagtgacacaataaaattcaactttgataaaaatttttatagaatggaatattctcattaaattagatgttgtaggtaagtcatacttaagcagaaagctttttgttgccattattattgaaaaacttacaaaaatcaatgcatacccttcttcagtaaatagggtatcgtgattacaactgatgtcatatttgccagg

SEQ ID NO: 153172 - DNA, 601 bp, Human
caataaaattcaactttgataaaaatttttatagaatggaatattctcattaaattagatgttgtaggtaagtcatacttaagcagaaagctttttgttgccattattattgaaaaacttacaaaaatcaatgcatacccttcttcagtaaatagggtatcgtgattacaactgatgtcatatttgccaggagccacaaactcaaacatctgcagggccaggtaagaaagataagcaagtgacataggtcaaggaaagcacatccaagagcatatcttgcctttaggaaaggcctccaaawctctcttattaagcagtcatttgttaaaaactgtcttttcttgagcagacctatggtgtttgtctctttatgttcagttaacagcattcaacattccagtgaaatgtagatattgctttacttctactttataaatgaggagggaaaaaggtgctaaagagatcagcatcttgtctggaatcacacacccttatatagcagtgtccatagtagactttaagctgtttgacatgaaccgctactcatcattggtcttaataattacagaacagtaagtgaaggctttacgaagttaaccta

SEQ ID NO: 153173 - DNA, 601 bp, Human
aatgatggtttccagctttatccatgtccctgcaaaggacatgaactcacccttttttatggcttcatagtattccgtggtgtatatgtgccacattttctttatccagtctatcattgatgggcatttgggttggttccaagtctttgctattgtgaacagtattgaaatgcatgtgtctttatagtagaatgatatataatcctttgggtatatacccagtaatgggattgctgggtccaatgatatttctggttctagatccttgaggaatcaccacactgtcttccacaatggttgractaatttacactcccaccaacagtgtaaaagcattcctatttttccaaatcctctccagtatctgttgtttcctgactttttaatgatcgccattctaactggcctgagatggtatctcattgtggttttgatttgcatttctctaatgaccacgactgatcttcttaataagcttctgaccaaactagaactttctagatttaagttttatgtacatttggtcaaagtgacttcctgtttttggaaaggggaagagattaagaagtcttcaaaagctgcttacattttagagtgccac

SEQ ID NO: 153174 - DNA, 601 bp, Human
tacactcccaccaacagtgtaaaagcattcctatttttccaaatcctctccagtatctgttgtttcctgactttttaatgatcgccattctaactggcctgagatggtatctcattgtggttttgatttgcatttctctaatgaccacgactgatcttcttaataagcttctgaccaaactagaactttctagatttaagttttatgtacatttggtcaaagtgacttcctgtttttggaaaggggaagagattaagaagtcttcaaaagctgcttacattttagagtgccacttaaataytgattttatgtcagttaagtaaaagctggttgaaaacatgtattaaattgtccttaaaatacaaatgtttccaaaaattaagaagggtgaatgcttagcaagctgtgactatcttgtcaaagcaaaaatacttgaaaagcagttgttgtcattaaaaaatatttccaatacagacagatttaccttgcctctgcttgttctctttattcactagcattatgcaaactgtcatcaatctattttaagattatgcctttcattaggaacaagtaataagaatttagctggcagaatttgtgt

SEQ ID NO: 153175 - DNA, 601 bp, Human
ttggtcaaagtgacttcctgtttttggaaaggggaagagattaagaagtcttcaaaagctgcttacattttagagtgccacttaaatactgattttatgtcagttaagtaaaagctggttgaaaacatgtattaaattgtccttaaaatacaaatgtttccaaaaattaagaagggtgaatgcttagcaagctgtgactatcttgtcaaagcaaaaatacttgaaaagcagttgttgtcattaaaaaatatttccaatacagacagatttaccttgcctctgcttgttctctttattcacyagcattatgcaaactgtcatcaatctattttaagattatgcctttcattaggaacaagtaataagaatttagctggcagaatttgtgtttttggagttttttttttttccattgctttacaattatattcttaagaattgctctgagaaaaacttttcctatgcagacctacgtgttaatactttttaagcttcttcattagttggtttcatatcatgtgtaaaggcaactcatgaaaatttgatttgtttctatcacaacaattatagatgacagagaaataaagtgttatttgttact

SEQ ID NO: 153176 - DNA, 601 bp, Human
atatgtttataggcatatacatatacatgcatacatatttgcagttcaatacttgttactgaatttcaccttagaatgtgattgccactaacgtgtctctatttctgaatattaaattatctgtcagttacaccatttggagtccagtgttaatctaaagaggtgctgttcactctttgttagttagttgaattcagctctcttcatctttttaagttacaggtttttatgggacttttgtctataaaatattttaatacatggatattgatgttatgttttcaaaaatttaaatgtcttyagtaaaaccatagtccttcccaggtacatttttatgtaagtcatacagttttcttcatactagatgtttgaataggatggagctatgaaatttcattcccttatttattttattattcattacaggaacacccctcactaggccaactttcagagaaattaatagacaacaacattaatgtcatctttgcagttcaaggaaaacaatttcattggtataaggtatgttaactctgaaaatgttaaaattaaatttttttcattggtaattgaaattaagacatttctttagaaccacaga

SEQ ID NO: 153177 - DNA, 601 bp, Human
catttaagcataaattctatttaggtttgtaacatctagaaccaaatctgagaactgagaattgtattggatacacttgagtccagcctgatgcttagggtggtctcaaatgtgacaatggtggagaagacttatcaggcaaaaagtagttcacaatccgtctttgcatcttgcatgtctagagtgcttcttcttattctggtacatgagcatatcctcataataggttaaagttagagaatatcagcttaattctaaatagcactgacacacctagctttggtctaggtcattcaataayggaccaaaaggggccatcgaagtgtctgagccagtcaaagccttcacacataagaataatcttggtggtgtctggagtcttttgggccaggtgagaccctcaagcaaaatagacagcaactgtgtcacactggaggtgccatggaccccccagcatagaactgttcctctgcaaccctgttatagctttcttttcacaatctttaaggctctttcttcctagaaactctcttgttctcattttcatgaagctatgacaccctaattttcattgtgcatctctgtttacttggtctccctc

SEQ ID NO: 153178 - DNA, 601 bp, Human
tcgaagtgtctgagccagtcaaagccttcacacataagaataatcttggtggtgtctggagtcttttgggccaggtgagaccctcaagcaaaatagacagcaactgtgtcacactggaggtgccatggaccccccagcatagaactgttcctctgcaaccctgttatagctttcttttcacaatctttaaggctctttcttcctagaaactctcttgttctcattttcatgaagctatgacaccctaattttcattgtgcatctctgtttacttggtctccctcatctcctttgctatctytgtttctcccatctgctccctaattatacatttcccctcagtggccagtccccagtgccctctacttatttttaaaaactgcagagaaattacattttcttggcttcaataaatacttgaacccatttccatttgccacaagctggtgttccccctaccagtttccctattacctacctaccttatctgaaagcactactttaatcgtaacacttcttcctttagaaatctatggtgaagctttatttatttatttagggtaaatgtatggagtacaagtgcaagtttgttacatgtgta

SEQ ID NO: 153179 - DNA, 601 bp, Human
cctctttgctgtttctctaacattatttcttggcagcattattggctctagcagtttcttcctattcctttaaaaatttgccattaactgataaaccataaaaccaggtttattattaactaaattatgcacaaagtcagaatcaactggctccaaagcctgggaagctccggtgtgagccccatgcatgcccctgtagtcacctcctttgactgcctagagatcttttttatcaatcacctttcacctgggttctaacaacctcatggctgataatccatcctccatctggctgccagartgatctattgaaatcacaagtgtgaccacagtactcccttgagtaaaagtttcagcggtgccctctgaattagaggaccaaatctctaaggtggcacatgaggccatgtctctgcttgcctttctggcctcattgccccactgttccttgccttgcagggatgcttctcatccctccagccatgcttctaatcctcctgtgcacaaacactcagccaggctgattctctcctctgtgcctttgttcttgctgcccaccctcgcttctcatgtctggaagcccttctccctcattacttta

SEQ ID NO: 153180 - DNA, 601 bp, Human
attgtcattgtttaaatgctactgatatgttttataggatcttctacccctcttgccaggcaccattgctggtgaaatagaatcaaaggctgcaaacctcaataatttggtagtggaagcctatcaggtatgtatatattagatacaattttttaaataaaatttttacctcaatttctgtgacaaggtacaaagtagtgccatgtcatctcgagaggaggagtagaaagcatattagattaggaattaggaatctgaagttcatccctggccctaccactaactagctttttgctttggkaaagtcatttctgctttctgtgcctcacttttctcattgacagtcaacagagattgggctagaggctatctaaatttccttctacatccagtgctcagtgaatcatcaagtcatagctatagaatgtacattattaccatgaaattgcgtcatttcctatgccgtaatgataaagtagaagtccacagttacgtaaggcaataatctgccagggcagttaaactatctgggatatagcaattattaagaggagtcggttgggatctctatgatcaaccacttgattgttcaacaattatt

SEQ ID NO: 153181 - DNA, 601 bp, Human
aaagaacagtgagactgaagagggacttatcacagaaaatcaaatgtgtctacaattcattcccatcagtagtctgttcccaagaataatcaaaataagacaagagcttatgctgtaagaaaccactctaaattctttagtatgaacccatttattactccaaaaaaagtatataaatttacagatttttacctgtgtgtcagactgccccagtggcaaaggagacagcaacatttggttattttgcctagcataggtatgcaatgccttagtccagtgtagttctcatcaaccgtaaacwgtggaaaaataatattaaatccaacaaaaacttactggggctaactactctccttaagttggaattctgttattattttatatatgtttatattatcaaaaatcttctaaactttcattttgtcttcacagtccaacagaatcaattcacaatccattgaagaattatatagaatctgcctctgtacctattagatactaaaagggaagctcaagattatgtctggggttggatttctgaatccccaaactgggcaaaattttaaggatttgtcttcacatcaggcttgaaaaacattgg

SEQ ID NO: 153182 - DNA, 601 bp, Human
acctattagatactaaaagggaagctcaagattatgtctggggttggatttctgaatccccaaactgggcaaaattttaaggatttgtcttcacatcaggcttgaaaaacattggcctaactagctaagatcttttccttttctttctttttttttttttttagatggaattttactctgtcttgcccaggctggagtgcagtggcgagatcttgactcactgcaacctccacctcccaggttcaagtgattgtcctgcctcaagctccagagtagctgggattacaggcgtatcacgcayacccggctaatttttgtatttttagtagatgcagggtttcaccatgttagccacgctggtctggaactgctgatctcaagtgagccacctgcctcagcctcccaaagagctgggattacaggcgtgagccaccacaccaggccaactaagatcttaagagaagcagaattttagaagggtaaactgaggatgctcattgcgttaggcatttccttctgatctgctggttttccacatatgaacatctttgtataccactggaagtttatattgatttaccaagattatacaattaattgt

SEQ ID NO: 153183 - DNA, 601 bp, Human
taactagctaagatcttttccttttctttctttttttttttttttagatggaattttactctgtcttgcccaggctggagtgcagtggcgagatcttgactcactgcaacctccacctcccaggttcaagtgattgtcctgcctcaagctccagagtagctgggattacaggcgtatcacgcacacccggctaatttttgtatttttagtagatgcagggtttcaccatgttagccacgctggtctggaactgctgatctcaagtgagccacctgcctcagcctcccaaagagctgggatcacaggcgtgagccaccacaccaggccaactaagatcttaagagaagcagaattttagaagggtaaactgaggatgctcattgcgttaggcatttccttctgatctgctggttttccacatatgaacatctttgtataccactggaagtttatattgatttaccaagattatacaattaattgttgcagtgtgtatgagctctctggaagacatagtcttacctactgtaaataatatttactttgagaaattagaggaaagtctcttgttctaaagatacgctaccagaattccatgatc

SEQ ID NO: 153184 - DNA, 601 bp, Human
tacaggcgtatcacgcacacccggctaatttttgtatttttagtagatgcagggtttcaccatgttagccacgctggtctggaactgctgatctcaagtgagccacctgcctcagcctcccaaagagctgggattacaggcgtgagccaccacaccaggccaactaagatcttaagagaagcagaattttagaagggtaaactgaggatgctcattgcgttaggcatttccttctgatctgctggttttccacatatgaacatctttgtataccactggaagtttatattgatttaccaarattatacaattaattgttgcagtgtgtatgagctctctggaagacatagtcttacctactgtaaataatatttactttgagaaattagaggaaagtctcttgttctaaagatacgctaccagaattccatgatcaattatttgtcagtaagcacgtgtttctttgttgattataccattgaagaagagaaatcactcaagtaaagaattagaagccactggaaattatttttcttttcataacccgctgctcactctctttctttaggcacatacttcgtttttccttttttttgtttgt

SEQ ID NO: 153185 - DNA, 601 bp, Human
gcgtatcacgcacacccggctaatttttgtatttttagtagatgcagggtttcaccatgttagccacgctggtctggaactgctgatctcaagtgagccacctgcctcagcctcccaaagagctgggattacaggcgtgagccaccacaccaggccaactaagatcttaagagaagcagaattttagaagggtaaactgaggatgctcattgcgttaggcatttccttctgatctgctggttttccacatatgaacatctttgtataccactggaagtttatattgatttaccaagattayacaattaattgttgcagtgtgtatgagctctctggaagacatagtcttacctactgtaaataatatttactttgagaaattagaggaaagtctcttgttctaaagatacgctaccagaattccatgatcaattatttgtcagtaagcacgtgtttctttgttgattataccattgaagaagagaaatcactcaagtaaagaattagaagccactggaaattatttttcttttcataacccgctgctcactctctttctttaggcacatacttcgtttttccttttttttgtttgtttttt

SEQ ID NO: 153186 - DNA, 601 bp, Human
tttcataacccgctgctcactctctttctttaggcacatacttcgtttttccttttttttgtttgttttttttttggcaagtgaaggatttttgcatgtggtagactcttagttgtatggaataaaatgcacacagatctgaagtatacattaaaggtagctggatcctttggaatttgaagattgtaatgaaagaaattagtgtgtgcctgccacacaataggcattaaatagatatttattgaatgagtgtatacatgggtgaataaatgaatgaatggttttctgcccagtaagaggmcctattttggtattaaggattgcagcaagcttgactgacacaaacaagtcccaaggacttgggaaaaattctaagccattcttggagagccttatagaactatatctgtccagtaattcttgctccttcagtgtagaaatggcctccctaaaatgtacttgtcaattctgtgtcaataagtcattttagctatcatgatagtctcaattgtttgaaacaaaaatatttctttagcagctttatatggcagaagcattttccacattttaaggtgtcaagatttaccctttgtgatgatat

SEQ ID NO: 153187 - DNA, 601 bp, Human
gcagaagcattttccacattttaaggtgtcaagatttaccctttgtgatgatatatgtgttctcaaggtttaattacactttatcataaaatatagttattactggattaaaaatgactgttttgttaacagactgataaatatctttgaagggctcaaaatgcagtcatggaaatatgtaaaaaaaatagaacaatttgaatgcagataatctaatccttcagtatttcttatgtatttcaaatataattgggtcattatgtggaaacactgtttttattcatccttttatagaaacagmctctttgatctagttaaaattaaatctataatgatttaataagcttgactctgctttgttgctgacatttgaaactactctcgtatgtaatttaaaaataatgtctctgcagaagctcatttcagaagtgaaagttcaggtggaaaaccaggtacaaggcatctattttaacattaccgccatctgtccagatgggtccagaaagccaggcatggaaggatgcagaaacgtgacgagcaatgatgaagtatgtgggtgtgcatttttcccttttaaaataaactaagttgtttggcgtac

SEQ ID NO: 153188 - DNA, 601 bp, Human
aactactctcgtatgtaatttaaaaataatgtctctgcagaagctcatttcagaagtgaaagttcaggtggaaaaccaggtacaaggcatctattttaacattaccgccatctgtccagatgggtccagaaagccaggcatggaaggatgcagaaacgtgacgagcaatgatgaagtatgtgggtgtgcatttttcccttttaaaataaactaagttgtttggcgtactttcttacagaaaaagcaaaccattctgaaaaattttacttactactgactctaagaatcttatttatacttsaaggaaactttcattgtctctcctcaaagttcctacttgttttagctcagctgattgttctctccaactctcaggttttaatatgtatatgtgtgtgcgtgtgtgtgtaatatgaaacaatcatgtatcaatagtaactttaaacttaggcgtcatgaccggtataaattaggaaatcacatattctcaaataagtagtgtctgtacttataataatgataatgcctttttgatttcatattcacaaactctcaaagtaaatgtaaaattgaaagtcacatatcacagaaaagaatggga

SEQ ID NO: 153189 - DNA, 601 bp, Human
aagaatgggaatgatagaacagttgataaaggctaagaatttcaaaatctttcactttgtgattgccccagtacactcataattatctaaattatctagaaggaggtagggaaatttattaagaacaatacaaaatgggaagagtcatcatttaccaaaaaaaaaaaaatgggatgtaaaggagagagatccagattgtaacagtatcaggaaacagcaccagaggagatagagattctccaaggattggcacaacggagagagtaacacaaagaaacatactctttaagggagtctttgytgggtgaagtgattttgagtgagtcatttacgtcatgaggcattgtctcatgtttaaatgaatgacttggactagtagatttccaaccccttttaatctaaagtgcaatgatgattaattatgtaatgtcatgctatagaaaaaaagaaaaagttattgaaagtgatagaagattctaaaaatgaataaaagagactcttctctttagttagaatatgtttttctatcttaggaattttagagctgtgtattttaaattaattattgcaagtttctaattctgtggtttcttctatgatc

SEQ ID NO: 153190 - DNA, 601 bp, Human
accagaggagatagagattctccaaggattggcacaacggagagagtaacacaaagaaacatactctttaagggagtctttgctgggtgaagtgattttgagtgagtcatttacgtcatgaggcattgtctcatgtttaaatgaatgacttggactagtagatttccaaccccttttaatctaaagtgcaatgatgattaattatgtaatgtcatgctatagaaaaaaagaaaaagttattgaaagtgatagaagattctaaaaatgaataaaagagactcttctctttagttagaatatrtttttctatcttaggaattttagagctgtgtattttaaattaattattgcaagtttctaattctgtggtttcttctatgatcactccgtggattttgttcaaaggacatcatataccagtttgcaaaatgcactttggcttttcattaaaactacagagaaaactttttactagcaaatatagcactaagttactttatgaaaaaacgcttactgtcttagaaatagttatttccttcaaaatgtcattttggaagaatggtttttcttagcttttacattgttttttttcttttcattt

SEQ ID NO: 153191 - DNA, 601 bp, Human
cttactaagtaatctaaaagattcgtccttgaggccacacacagaccaaattttaaacatgaaataaattaaaataaaaatacgaagatcactcttgggccattcaatttactgccacctacaggttagattccacaaaatctaatcaacattagcaaactaaaacaaaatactgtttttaaatgaattaaataaactacctgtcatctgagttctgtgataattttcctgtgacaatgtgctaaatttactcattgagaaaaacatctttttagtatttgcattttagtaaataaatatktgttaaattattgacgaatggaaacgtcatcataagcatatgggacgtaacaaacctataaaaaataaatgctataatgtagtctcagctgaaaatttggcctgtatcacctaaatgtgcaatggaaaattgtctttttattctgtaacatacatagaatatcttaatatacaaacatttattcaactgtaactgacatcatgggtaggatggattatagatgactttagaatgaaccagcagttgtctactgtattttatagggaggaaaaatattattttacagtgaagagaaagaat

SEQ ID NO: 153192 - DNA, 601 bp, Human
aatactgtttttaaatgaattaaataaactacctgtcatctgagttctgtgataattttcctgtgacaatgtgctaaatttactcattgagaaaaacatctttttagtatttgcattttagtaaataaatatgtgttaaattattgacgaatggaaacgtcatcataagcatatgggacgtaacaaacctataaaaaataaatgctataatgtagtctcagctgaaaatttggcctgtatcacctaaatgtgcaatggaaaattgtctttttattctgtaacatacatagaatatcttaayatacaaacatttattcaactgtaactgacatcatgggtaggatggattatagatgactttagaatgaaccagcagttgtctactgtattttatagggaggaaaaatattattttacagtgaagagaaagaattttctgaagtcacgtcccacagctgtcaatctctcaagagggtttcaaatacatttgagtatttgtcccagtctctgtttgcagtgaaatatcgaatgtactagcttttctatatgagtatgatactactgacccacaagcagttgagaatctgctttgaattgtttc

SEQ ID NO: 153193 - DNA, 601 bp, Human
tgtgctaaatttactcattgagaaaaacatctttttagtatttgcattttagtaaataaatatgtgttaaattattgacgaatggaaacgtcatcataagcatatgggacgtaacaaacctataaaaaataaatgctataatgtagtctcagctgaaaatttggcctgtatcacctaaatgtgcaatggaaaattgtctttttattctgtaacatacatagaatatcttaatatacaaacatttattcaactgtaactgacatcatgggtaggatggattatagatgactttagaatgaascagcagttgtctactgtattttatagggaggaaaaatattattttacagtgaagagaaagaattttctgaagtcacgtcccacagctgtcaatctctcaagagggtttcaaatacatttgagtatttgtcccagtctctgtttgcagtgaaatatcgaatgtactagcttttctatatgagtatgatactactgacccacaagcagttgagaatctgctttgaattgtttctgtgtaagtgcagactgtaactgacatgtactttctccactagtctcctttgggaataaaaacacatgt

SEQ ID NO: 153194 - DNA, 601 bp, Human
ctataaaaaataaatgctataatgtagtctcagctgaaaatttggcctgtatcacctaaatgtgcaatggaaaattgtctttttattctgtaacatacatagaatatcttaatatacaaacatttattcaactgtaactgacatcatgggtaggatggattatagatgactttagaatgaaccagcagttgtctactgtattttatagggaggaaaaatattattttacagtgaagagaaagaattttctgaagtcacgtcccacagctgtcaatctctcaagagggtttcaaatacatttgagtatttgtcccagtctctgtttgcagtgaaatatcgaatgtactagcttttctatatgagtatgatactactgacccacaagcagttgagaatctgctttgaattgtttctgtgtaagtgcagactgtaactgacatgtactttctccactagtctcctttgggaataaaaacacatgttcacaggcctgctggcggggagtcagcataagcctgcacagcacagagggcttggccgacatttgtctggcctggacctcattagttttacacttagcaaattgagctggtcctacagt

SEQ ID NO: 153195 - DNA, 601 bp, Human
ggcttggccgacatttgtctggcctggacctcattagttttacacttagcaaattgagctggtcctacagtagaatctgtggaacaattaccctgtgaggtgctcagcaataaaagaagagagagagggagctaagaaaggaaaggaagggagagagatagaaggaaggaagggagggaaggaaggaggaaggaagggagagagggagaaaagaggaaggttggtttgtggctagataagcttcagaattcctatatcatcatgtgaaatgtacccccttttgacgatttctagtgcacawtggcatattaagttttggacacttttactgtctaaaatccatttaactatgtgtaactatgttttcttcaccccacatgcataatgttcccccaccacacacaccatctttctttctttttttcatttaccatctaagaactgctcacagtatagaggaggatctgctctgctaacttactaaatagtgcactgaggatgtgaatgcaattgttcaacttctcaagagacctgatctttaaacatggcactagcagtactgaagcactagaaaagtttgcctcacagtcctgcaaagtta

SEQ ID NO: 153196 - DNA, 601 bp, Human
aaagaggaaggttggtttgtggctagataagcttcagaattcctatatcatcatgtgaaatgtacccccttttgacgatttctagtgcacattggcatattaagttttggacacttttactgtctaaaatccatttaactatgtgtaactatgttttcttcaccccacatgcataatgttcccccaccacacacaccatctttctttctttttttcatttaccatctaagaactgctcacagtatagaggaggatctgctctgctaacttactaaatagtgcactgaggatgtgaatgcarttgttcaacttctcaagagacctgatctttaaacatggcactagcagtactgaagcactagaaaagtttgcctcacagtcctgcaaagttatcctaggccttcagcaacatcagaagactgagagaataggtgatggaagccatatcaaatacctgtatcttttctaatttcaagtcaggcagttaacattactttggcctttgcagtttcttgatatgtgtgtttttaatgtaaaacggaatatgcaatgacattcaagtagtctggcagccactgaagcaggggtgcccttcgtgctt

SEQ ID NO: 153197 - DNA, 601 bp, Human
cactagcagtactgaagcactagaaaagtttgcctcacagtcctgcaaagttatcctaggccttcagcaacatcagaagactgagagaataggtgatggaagccatatcaaatacctgtatcttttctaatttcaagtcaggcagttaacattactttggcctttgcagtttcttgatatgtgtgtttttaatgtaaaacggaatatgcaatgacattcaagtagtctggcagccactgaagcaggggtgcccttcgtgcttgttagcggagtgcattagcatggggagattatctacagyagaacagctttgaaaacagaccctcctaaatccagcactgtttgtgtcagaccaatgaaaaagtgatgctgttcccattcattggactgtcagtgcgtttccatggagatgatacaggaatccatggttgaaaactctttacaaagtcagtgatccagataacataggtcctgcggtgtcttcctcacagggcatggagagtgtgaagcaggcagatgccaatgcttcagtggctgggaaggtgatcgatgccagtgcccttcagcagcagcccagcactgtgtcaattcaaagggccaa

SEQ ID NO: 153198 - DNA, 601 bp, Human
agaaaagtttgcctcacagtcctgcaaagttatcctaggccttcagcaacatcagaagactgagagaataggtgatggaagccatatcaaatacctgtatcttttctaatttcaagtcaggcagttaacattactttggcctttgcagtttcttgatatgtgtgtttttaatgtaaaacggaatatgcaatgacattcaagtagtctggcagccactgaagcaggggtgcccttcgtgcttgttagcggagtgcattagcatggggagattatctacagtagaacagctttgaaaacagaycctcctaaatccagcactgtttgtgtcagaccaatgaaaaagtgatgctgttcccattcattggactgtcagtgcgtttccatggagatgatacaggaatccatggttgaaaactctttacaaagtcagtgatccagataacataggtcctgcggtgtcttcctcacagggcatggagagtgtgaagcaggcagatgccaatgcttcagtggctgggaaggtgatcgatgccagtgcccttcagcagcagcccagcactgtgtcaattcaaagggccaagtgtgcagtggaagaggcacg

SEQ ID NO: 153199 - DNA, 601 bp, Human
atctggacactcactaccttagctttttttgaaattagaggttgcctgctacccagcttactatttagtaagcgtgtgatctcggacaagttgttataattttctgtgcctcagtttcctgatatcaaaagtgaggatagtaataataccttgctgtatatctgtgaaagtatcaaatgattcatataaaaaaactcacctttgtacttgatgcatggcaatcatagaataaatgttagctgttactgctatgttttatatttaatatatatatatattttttttttgtgacagagtctcrctctgtcgcccggctggagtgcagtgacatgtcactgcaagctccgcctcccgggttcacgccattctcttgcctcagcctcccgagtagctgggactacaggtgcccgccaccacgccgggctaattttttttttttttgtatttttagtagagacggggtttcaccgtgttagccaggatggtctcaatctcctgacctcgtgatccacccacctcggcctcccaaagtgctgggattacaggcgtgagccactgcgcccggccttatttttaatattttaatgataaagaacaatgg

SEQ ID NO: 153200 - DNA, 601 bp, Human
taataataccttgctgtatatctgtgaaagtatcaaatgattcatataaaaaaactcacctttgtacttgatgcatggcaatcatagaataaatgttagctgttactgctatgttttatatttaatatatatatatattttttttttgtgacagagtctcactctgtcgcccggctggagtgcagtgacatgtcactgcaagctccgcctcccgggttcacgccattctcttgcctcagcctcccgagtagctgggactacaggtgcccgccaccacgccgggctaattttttttttttttgtatttttagtagagacggggtttcaccgtgttagccaggatggtctcaatctcctgacctcgtgatccacccacctcggcctcccaaagtgctgggattacaggcgtgagccactgcgcccggccttatttttaatattttaatgataaagaacaatggtgtctgtgacacaccctagaaataagtgatatataaatgaaaggttatatattaaatgaaggtgacattactgttttgtgccaataaatttttcagtaacaatttgagatctgcacaaagacttctaatctaaacactgt

SEQ ID NO: 153201 - DNA, 601 bp, Human
atttaatatatatatatattttttttttgtgacagagtctcactctgtcgcccggctggagtgcagtgacatgtcactgcaagctccgcctcccgggttcacgccattctcttgcctcagcctcccgagtagctgggactacaggtgcccgccaccacgccgggctaattttttttttttttgtatttttagtagagacggggtttcaccgtgttagccaggatggtctcaatctcctgacctcgtgatccacccacctcggcctcccaaagtgctgggattacaggcgtgagccactgcrcccggccttatttttaatattttaatgataaagaacaatggtgtctgtgacacaccctagaaataagtgatatataaatgaaaggttatatattaaatgaaggtgacattactgttttgtgccaataaatttttcagtaacaatttgagatctgcacaaagacttctaatctaaacactgtaacttccagtttgttttattcaacattttaaaccattgactttctcagattagtagctcaagtaagttttttagaattatgcatggtaatttatttaaatcatttggaaatgcaatcct

SEQ ID NO: 153202 - DNA, 601 bp, Human
ctggctcacttaatgtcatacaactctttgagattggtataatctccatgttatagatggggaaactgaggctcagggaaattttgtatgagggctgctgtctcttaactagtaatgttaagatacatgtcttagatcaagatcttcaaactaaaagttccatacacttttcattatgtcacatttataatcattcatccttaagctatatttttatcaaaatgaaaagtactaggaaggaatggcccttttgaagttacatattttgtaaaagcagatcatcattacttaggatttttttggcttcacctgaaacatgaaagcaaatattgattagacatgaggaagttcagaactagaagcaagtttggattatgaaggaaaattatggctccacagattttatctgttactgaaatgagtttacatggggaactcatatttctggttcactgaggccttgacagccaatttatttggatgcctttccatggaagtacgttgcatgggaattcagctgtgtagatgagaggggaaaactaaccactcagccacaccatagcaagcatactcagtggttatagggtaccatctctgggag

SEQ ID NO: 153203 - DNA, 601 bp, Human
tggctacagaaggagggaaaacctctgagccagagaataacaataaaaaacccaaaacctcaggctcccaggtaaaagcaaacaaattaaaaaaattcatcacgacacattaggagagagagggagttatgccctttgaatgtccagaagtaacagaataaaatgtttatccactcaaagcatctttctgagagtgtggaacttaaattgtaaattcatcaagttttcacctctttgagggtataacgctgtttaaaattacatcaggaattcagactataagaaaacggtgtgtgtgttsccaagggcattttgagtttaggaacataacactttacaaagttgtaaagaaatttccttttatttaaacttgatattataggacttgcttccttattcatatagttcttatctacttttgttcgtatttctttttgatttctgctgcttcctaaattgttatgtagagctgtcaaaataagtaaccccctggcaactactggcctccactaaatccgcccactttttttcccccccctctcctttaccgtcccattttgggtaggactctcagccctctcctctggctttactggcagct

SEQ ID NO: 153204 - DNA, 601 bp, Human
agcaaacaaattaaaaaaattcatcacgacacattaggagagagagggagttatgccctttgaatgtccagaagtaacagaataaaatgtttatccactcaaagcatctttctgagagtgtggaacttaaattgtaaattcatcaagttttcacctctttgagggtataacgctgtttaaaattacatcaggaattcagactataagaaaacggtgtgtgtgttgccaagggcattttgagtttaggaacataacactttacaaagttgtaaagaaatttccttttatttaaacttgataytataggacttgcttccttattcatatagttcttatctacttttgttcgtatttctttttgatttctgctgcttcctaaattgttatgtagagctgtcaaaataagtaaccccctggcaactactggcctccactaaatccgcccactttttttcccccccctctcctttaccgtcccattttgggtaggactctcagccctctcctctggctttactggcagctacttgcagcaaaatagggactcctggtgaaaatcaagcaactggacaacaacaaattattatagatccaagtcaag

SEQ ID NO: 153205 - DNA, 601 bp, Human
ccagaggtttttcccttagccattgtgagggtaaagaaatgttttggccaaccaaacttagattaacttgaatggtgcattaaaataaacacaggatccagtttttggtactgtaagttttgaattgtgggggtcaagggatttgcctttcaaacaaactttccaggtgattgtaaaactcactgaagtggctgggtgtggtggctcatccctgtaatcccaacactttgggaggccagggtgggaggattgcttgagcccactagttcaagaccagcctgggcaacatagggagaccccrtctctacaaaaaatttaaaaaaattagctgggtgtggtggcacacctgtggtctcagcgtcttgggaggctgaagtaggaggatcgcttgtacccgggggatccaggctgcggtgagctgtgattgcctcactgcactcccacctgagtgacagagcgagaccctctctcaaacaaacaaactcactgaagtttgagaatcaagtgtctggtcatcagcagtgaaccagaagacagaatatggaagcaagtgggggtgttgagctagttcgtttgtgcctcagagaacagattttggtgg

SEQ ID NO: 153206 - DNA, 601 bp, Human
aacagaaaaaagtaaaatcatacaaggtaaatctaatgaaaccagtacttgaagctggggagcttcatacttcgttttatgaaatgagaatgttagcaacaacctagggggatcctcttcccattaacaacgtgttcagtataatgtgtttctgtgctttggtctcagctgtaaatcctgaccttcatgctaagcattagttagaattgtagtaggaactaaatatgtgtatgctctgcatactttttgttttgttattgggattctaaatttaacttaaaatttttttacttttactttwaaaaaaaatagatttagggggtacaagtgcggttgtgttacatggatatattgcatagtggagaagtctgggattttagtgtacccatcaccgaaatagtgaaccttgtacccaacaggtatttttttccaccctcaccctgccctccaccttttgtagtccgcagtgtctgttattccacctgtatgtccatgtgtaatcattttttttttttttttagctcccacttgtaagtgtgaacgtgctgagtttgacttcaaaggaaaagcagaaaccttactttaagctcaaagacaacta

SEQ ID NO: 153207 - DNA, 601 bp, Human
tctaatgaaaccagtacttgaagctggggagcttcatacttcgttttatgaaatgagaatgttagcaacaacctagggggatcctcttcccattaacaacgtgttcagtataatgtgtttctgtgctttggtctcagctgtaaatcctgaccttcatgctaagcattagttagaattgtagtaggaactaaatatgtgtatgctctgcatactttttgttttgttattgggattctaaatttaacttaaaatttttttacttttacttttaaaaaaaatagatttagggggtacaagtgcrgttgtgttacatggatatattgcatagtggagaagtctgggattttagtgtacccatcaccgaaatagtgaaccttgtacccaacaggtatttttttccaccctcaccctgccctccaccttttgtagtccgcagtgtctgttattccacctgtatgtccatgtgtaatcattttttttttttttttagctcccacttgtaagtgtgaacgtgctgagtttgacttcaaaggaaaagcagaaaccttactttaagctcaaagacaactaattgtacctctggcttaagctcctttatttt

SEQ ID NO: 153208 - DNA, 601 bp, Human
tgaaaccagtacttgaagctggggagcttcatacttcgttttatgaaatgagaatgttagcaacaacctagggggatcctcttcccattaacaacgtgttcagtataatgtgtttctgtgctttggtctcagctgtaaatcctgaccttcatgctaagcattagttagaattgtagtaggaactaaatatgtgtatgctctgcatactttttgttttgttattgggattctaaatttaacttaaaatttttttacttttacttttaaaaaaaatagatttagggggtacaagtgcggttgygttacatggatatattgcatagtggagaagtctgggattttagtgtacccatcaccgaaatagtgaaccttgtacccaacaggtatttttttccaccctcaccctgccctccaccttttgtagtccgcagtgtctgttattccacctgtatgtccatgtgtaatcattttttttttttttttagctcccacttgtaagtgtgaacgtgctgagtttgacttcaaaggaaaagcagaaaccttactttaagctcaaagacaactaattgtacctctggcttaagctcctttattttaacta

SEQ ID NO: 153209 - DNA, 601 bp, Human
atcatctgcttttcaaattctgaatcggaatatataatgagtaatacttagggaatattggggcaggcatgaaagcaggttgaggatattggggcaggcatgaaagcactcacagctctaaatttacttaatcaagaaggaagatagggaatggtgctacgcatagatcttgtagaaataacagacttacaaaatgatagaattgtaggtggaaagaatcttggagattatggctcagcagttgtaaccttttgatactgctgctaaagtctatttataaaggcattttgtgtttttactrtttgaagtgaaagcagaaatatgggtcgaagattctgcactgctacattaagtcaatccttacacagtaaggattgacagtaacgggggaacctggcctaatatcagagtgtacacatatatgtgctcttctgtacttttctgatgcggatttgagttaagattggctgttaagattggatgttcataatgcttgtcattttgctacctagtgaaggagcaaattgtggcaaaggaaacctgttgaaccacaaattgcttatttaagtgtgtggtgagatgagggcttaatgaaattgta

SEQ ID NO: 153210 - DNA, 601 bp, Human
gcaggaggacctgtgaaaatgatttgggatgtattggcttaaaatgaactgagagtagaataaagcttctgtaccttgtgcttgtgagatacttctgcaatattgtgcgcagtaccgggtggcacattttaaatgggacattgacagactcgcaaatgtatcaagaaggattcccagaatgaagaatgtggaaaacatttcgtactagcaataatcaaagaacggagttttatctttaaaagaaaacaagaaattgtgacagctgtctttagatatatgaggggctttttttttttttctracgtagttctataattttgtttggccctggaaaaacatatgtatatgcacacacaaagacagactagagttacacaacagtggaatggtttgtttcattaagtagtgatcattcattaaagattggatgttcatcggtcaaagattttgtagactgcagaagaatttcttgtaccatatagaaaatttgcttaaactataaactctgagtcttcttctaattctaaaatttaaggtctatgaaattagaatatatattttatttcgttctgggtacttccatccagcacatggccagagt

SEQ ID NO: 153211 - DNA, 601 bp, Human
taaaaaacagcttgttgaacttttctaggacctacactggtgacgtgaaagacatggtaagggattaggtaaaaacatcaggttggtttgttcttttcccctgctctgtatcaagcatggtaataggcattgagaaactaaagatgaagtgagacatgttttctgccctcataggatatattatctgttgtgggagacacactgtacttctctgcttctaggacatgctttttacattttatttttatttcattttatgtgtgtgtgtgtttgtgtgtgtgtgtgtgtgtgtgtgtgtgtrtattttttttttttttttttgaaacggagtcttgttctgtcacccaggctggagtgcagtgccacaatctcggctcgctgcagcctctgcctcccaggttcaagtgattctcctccctcagcctcccaagtagctgagattacaggcacccgccaccacgcccagccaatttttgtatttttagcagagaggggagtttcgccatgttggccaggctggtcttgaactcctgacctcaggtgatccacccgcctcagccttcctaaatgctgggattacaggcgtaagccaccacgcctg

SEQ ID NO: 153212 - DNA, 601 bp, Human
gctgagattacaggcgcctgccatcacacccagctaatttttctatttttagtagagatggggtttcaccaggttggccaggctgttcttgaactcctgacctcaggtgatccacccaccttggcctcccaaagtgctgggattacaggtttaagccaccatgcctggctcaattagtattttgtaaacattacaaaattgagaattagctcaaggagtgttcatataaaagttgaattgtgagcctcatgtgagtagagtctgtgttatatatgtaagtatgtgtattaatttataattytattttttctcacaccttgatgagcattgcttagtatctgtcattctgatactgaaccagaagaaaggacacaggtggagaactttgatttcataggagaatgggatggacagatccttggaatagactcaagatatatattaaaggagtgagagagtttacgatcgtaaaaggaaaagtgatgagtaaacggaaataaagggaatttaaatctgattgcttcatatgttttggtagacagttgaaggtaagaatcttaccagttaggggatactttgagaagaaattgaaggtatgtaa

SEQ ID NO: 153213 - DNA, 601 bp, Human
tggaaaatccttgctctggtctagttggggatatctatgccagggagttgaaggagaagagagaagaggaagagactaggtgaatatgatgacaagtactaacgggatttatataagagaaagaaatacttaaaagtggtttgtgaattctgcaggtttttccaaatatttaaatctacatatgaaccaggttgagacaaatctttgacagatgtcataaatactacaaactataacatgcttgttgaagcaaactttattatttctgattttgttagtataggtttttaaagttaaagcrtatttttattttcagaatttctctcacctgttgttgttattggtaggttgtcactgcctttactgattttaattatagggcaagtaaatggttttaatatccccttgttagactttcatctattacctgtactccctactggcagactgcatccatgaattcagtcagcaagtaaatactcagcatctgtattgtgcggcttgatatgttccttagatgattgaataacatgggactgaactcctgcttccataatattccagtggggagagaaattatgcagttttctttaatgaatga

SEQ ID NO: 153214 - DNA, 601 bp, Human
tttgctcatggccacatagtgaatgatggaaccagagtctaaacgtacttgtactattaccacttactgccctgaattgtgtactctctgtatactgtagtgtttgttttctgtgatcatttatggactcagtttattgtttgtctcttatatgccactgtttaagcactttatgtgtattaactgtttatttttcacaatcctatgaagaaggtggtggtggtgacctcaaattatagaacaggaaaccaaggctatcagaggttaatttacttggccaagatcatatagccagtaagtkagggtgctagtaagtaaaaattctttataaaacaagtccgggtgaataggactgtaatctccctttacagctaaccactactactttaagtattttattgtaattactgtaatatgctcaataagaaacagattcctagatctttagctgagtgctccactccttgtgttcttttgggggtttgaggtacatatgccacaaagggaattagaaagaaagtttttattactttgatggactgtgttgattgggaatttgaggctagtaataacatctccctgactaaatatttgtgtatca

SEQ ID NO: 153215 - DNA, 601 bp, Human
cctgcaaatgcttttttcaaaacacacaccaaccaatccagagcctgcatcctaaccacctcctatattaggttctcatactttagaccacctgctctaatcaccccccagggcgaggtaccaaacaactagggacagcccctgtgccccacggtcttctaaagttattcaaactagccaaccctaagcctgtttaccctgctttgcctgttccttgtggtggaaaccacaataaaggatctcgccaacagtttctactcctgcttttgtctcctaactgacccgtatgctccacatcctrtggcaggttgtgccgcctcctcttgggaactgtaacaaacttatcttttcagtggcaatcaattttctattaatacactatcttttaaaactttgggctactgattttttttcaatccttgtggcaaagaatcttattattaagaaagtattaaatactgttagatttaaagctttttttggaagtaacttgaagagattcagaatggtactgaaatacatatgcgtgtataggtaaatatgtacatatgtttaagtatacgtgtgtgtatatatacatgcatatgtataatgtatgtgt

SEQ ID NO: 153216 - DNA, 601 bp, Human
atgagactaaaatttgataacagtagtaccatagttcttgaaacatgatttttctcttcagttctcatttttattaagaacaaattatgataggactgatttgtttgcaaaataagctttagttctgttatacttggcctaatgagttgcataaagcacagcaagaataattatttgccatataggctccttttaaaattggctttgatggaacttccttccataaggagtctcagataaggctttttaaaaccttaagcccagctatcagttggtgccatcaaatacctgtatgaattgsacaaattccccttgtcttgcttggggctcctgggcctgtcaaaagtgacattctttacttgccacaggtcgggaatcctgtacagggactgtgttgacaatgtatgagttcagttttccagaggggcttttcttggctttataagtcaattttgattcttaaaggaaagcatgccattccagtcaaaaccttggtaaaataaccagtttctccaattgtgtcctgttgcaaaagaaaacagattttattgcacttatgcaaataactatattgccattagttaagaatactcacaagtag

SEQ ID NO: 153217 - DNA, 601 bp, Human
gggtgtgaatcttttctttttagggaaggggtgccatacgcccccattacctgacaggatttggaggagagttgatcagagcaggacattagcacagagtaggcagcttttgaacccaaaagggaaatttataatttttacttgccacatctagagtttcccttggctttgtactgttgatggcaacaatgtctgatttggaagccagccagagcagagagccccttcagctcaagagtgtcaggagttgagattttgtcttgggggtgggggcgtgcttcaaccctcaggaatgtcctgktccagtggctgagcttgtggcagaggggtcaagctgtgcagggatttttccctgattatcccattggggaagtttgacttccagtagcctggcttcccacaccacttgcaattaactgaaggagtaggcttttgtagtttttgtccagtttatttttaggccaaacagtattacaaaggaaaactagttttttgttttaaggtttgaaggatcaaacttttcccagttttttgaggatgcatccatggggcatgtcctggggtatggaaacatgattacccatctgtgaagagagatcag

SEQ ID NO: 153218 - DNA, 601 bp, Human
gggagtgtgtgtttaagaagtcaggtggcatgcaaagtgaaaacgaagaggcagatgtgcccctgaggcaggcagtctggcgggtgtgcaaggccatttcagattacccacagggaaaacaggagaaaaggtggtgtgagtttttgggaaagagccgattttagttgaaaaagcagaggaaatcctagacagcacacggtcttaggctttagccctaccattctcacaagccgcctgtcagtgatatgtctgggatttcctctgctttttcaaataaaatgtctcaggtctgcctgatgtrgaccccaaggtctttcccatccccacaagctatctgtcagggtgaactgagagatcagcccagtggagggggagcagagccactgtggccaagaggaatagttctgggggttggttagtaagcaggagagtgaaaggaagaggaaaacttcctacaggggttgaatgcctccagcctaagaaggaaggcatagaggtatcttaccactgggaaacatatctgagtcacatgtcaccaaagtatgtatctgctccccagggagcctataacttcctaaataaaataagatttttttatata

SEQ ID NO: 153219 - DNA, 601 bp, Human
gcaaagtgaaaacgaagaggcagatgtgcccctgaggcaggcagtctggcgggtgtgcaaggccatttcagattacccacagggaaaacaggagaaaaggtggtgtgagtttttgggaaagagccgattttagttgaaaaagcagaggaaatcctagacagcacacggtcttaggctttagccctaccattctcacaagccgcctgtcagtgatatgtctgggatttcctctgctttttcaaataaaatgtctcaggtctgcctgatgtagaccccaaggtctttcccatccccacaagcyatctgtcagggtgaactgagagatcagcccagtggagggggagcagagccactgtggccaagaggaatagttctgggggttggttagtaagcaggagagtgaaaggaagaggaaaacttcctacaggggttgaatgcctccagcctaagaaggaaggcatagaggtatcttaccactgggaaacatatctgagtcacatgtcaccaaagtatgtatctgctccccagggagcctataacttcctaaataaaataagatttttttatatattgagtaaagcatttagcaactttattttat

SEQ ID NO: 153220 - DNA, 601 bp, Human
ctagacagcacacggtcttaggctttagccctaccattctcacaagccgcctgtcagtgatatgtctgggatttcctctgctttttcaaataaaatgtctcaggtctgcctgatgtagaccccaaggtctttcccatccccacaagctatctgtcagggtgaactgagagatcagcccagtggagggggagcagagccactgtggccaagaggaatagttctgggggttggttagtaagcaggagagtgaaaggaagaggaaaacttcctacaggggttgaatgcctccagcctaagaagcaaggcatagaggtatcttaccactgggaaacatatctgagtcacatgtcaccaaagtatgtatctgctccccagggagcctataacttcctaaataaaataagatttttttatatattgagtaaagcatttagcaactttattttataatataaccttttatcataggagaatgataaagaataatctggtccctgccagatttcctttttcttgccaactcttatacttggtctagcatgaggccctgagatgctcttattgccccaactttcagcttttgtaatggaaaacatacata

SEQ ID NO: 153221 - DNA, 601 bp, Human
gcctgtcagtgatatgtctgggatttcctctgctttttcaaataaaatgtctcaggtctgcctgatgtagaccccaaggtctttcccatccccacaagctatctgtcagggtgaactgagagatcagcccagtggagggggagcagagccactgtggccaagaggaatagttctgggggttggttagtaagcaggagagtgaaaggaagaggaaaacttcctacaggggttgaatgcctccagcctaagaaggaaggcatagaggtatcttaccactgggaaacatatctgagtcacatgkcaccaaagtatgtatctgctccccagggagcctataacttcctaaataaaataagatttttttatatattgagtaaagcatttagcaactttattttataatataaccttttatcataggagaatgataaagaataatctggtccctgccagatttcctttttcttgccaactcttatacttggtctagcatgaggccctgagatgctcttattgccccaactttcagcttttgtaatggaaaacatacatagttatttagctaagtaatggttcgttatactacctctgacacttcaat

SEQ ID NO: 153222 - DNA, 601 bp, Human
ggagggggagcagagccactgtggccaagaggaatagttctgggggttggttagtaagcaggagagtgaaaggaagaggaaaacttcctacaggggttgaatgcctccagcctaagaaggaaggcatagaggtatcttaccactgggaaacatatctgagtcacatgtcaccaaagtatgtatctgctccccagggagcctataacttcctaaataaaataagatttttttatatattgagtaaagcatttagcaactttattttataatataaccttttatcataggagaatgataaagwataatctggtccctgccagatttcctttttcttgccaactcttatacttggtctagcatgaggccctgagatgctcttattgccccaactttcagcttttgtaatggaaaacatacatagttatttagctaagtaatggttcgttatactacctctgacacttcaatagtgctatcatcttcgcttcctccagtgtatagattgtgccttgcatgtggttggtgcttaatgaatactttactgagtagatgaagctctgttgaaaaaaaacttgctttgtatttaattatttggttccat

SEQ ID NO: 153223 - DNA, 601 bp, Human
aaccttgagctagacacagagtgctgattggtgtgtttacaaaccttgagctagatacagagtgctgattggtgtatttacaatcccctagctagacgtaaaggttgtctaagtccccaccagactcaggagccctgctggcttcacccagtggatttcgcaccagggctgcaggtggagctgcctgccagtcccgtgccatgcgcccgcactcctcagcccttgggcagtcgatgggaccgggtgccatggagcagggggcggtgcttgttggggagactcaggccgtgcaggagcccaygggggttgggggagactcaggctgtgcaggagcccacggctgggtgggggtagactcaggcatggtggactgcagatcctgagccctgcctcgcggggaggcagctaaggcctggcgagaaatcgagcgcagcgccagtgggccagtactgctgggggacccggcgcatcctccgcagctgctgacccaggtgttaagcccctcactgccgggggccagcagggccggccggcaggccagccgctccaagtgcagggcccgccaagcccacacccacccggaactctagctggcctgcaa

SEQ ID NO: 153224 - DNA, 601 bp, Human
tacttaatacatttgcagtttgttttactggagttaacattcctcttgagtgtttatcatattccagacattatgctaagacgtgtgctatatacactatttcagtcaactcccacagctcccaggtcctcaaaggaagaaactgcagggagaatcagaactcagaaacaggtctgcttgacccaaaagttctactttcggctctactaaactgttgcgcctgttcagtaactcaatattggttcacagattgtacataacccatagtatgttgatagtcctggaagtcattggctaatgkggttcaccttcatttaagagatacagaaggtactcggttatttcttaatattttcatttatagttcatctacaggaaaacatgtcattgaagctcttccataaggcaaagaagtattttgtaattaataagcataattttcaaatctaggattttttttttttttaccaccagtgtaccatggaatctctctagtcatatgtctgtcaaaactgtcacagcctattcccaaatgtatgtagctctcttttcaaaggctttaattcagtcatatagtttctgtttttgtggagactcatgt

SEQ ID NO: 153225 - DNA, 601 bp, Human
tctactattctgctttttcagacttttcttagctgatttttcacatgtcaaattagcagactttcatggaaaagtttcgaattaaatttgtgattgcattcacttcctagaataattttggaagaattgacacatttagtttaatgattcttcctatccaagaacatatatttctctcttttgaggtcttgttttatatcctttattaaatcttcctcaagatcttgcatattactaattagattgatttctcagatatttgtggttattgttgctattatgaatggaattttttttttttctttttcaattgtttgttgctgatatggttgggaactgttgcttttttatgttgctcttgtatttggccatctcgctgatgtacagatgtcatattataataatttgttgatttttctatagttttctaagtaatataattatatcttttgtaaatcatgacagtttcgttacttccttttaagtctttatttcttatatagatctgttatttcttgccttactacattggcttagaccttaaggaaatgtacagtattagaggtgagagcagtaatcacttctattagaaactacagtg

SEQ ID NO: 153226 - DNA, 601 bp, Human
gtcatcttaaatattattgcgacctttaaagtaatgactgttatataaatgttatgagaaaagtagtcagagaatcacggccaaaaatacctgtgtcttcaggggatgtaaagggtacttaccaacttaaaatacctgcagctccatagggaccatgctgtagattttgtatagtgcttgttcagacagtactctcatttctagaaatgcattttttgcagtaaacaaagtgtgtgtatcactgtgcttcttggtacacaagtagtttgaatagattttgtagccaaggtcatccttaagscatctagttttactgaatacatgttcaaaaacactgaaacaaaataattataccttttgtttatgtattgctttataatttatatagcctttacccctggaaaatcaacttgatcctcaggaacagctctttaaagtagatagggagcagaaattttatggaagtcagtgttactattttagagttgaggaaactgaggatctctgagtgcacagtcataaatttacaactctcacttcacttgcattgctttacttaccacaccatgctaattcaaaggtgtacaaaaatgtaaatttt

SEQ ID NO: 153227 - DNA, 601 bp, Human
gtggttttctttttgtattgtttttatctgattttggtaatgataatactggcttcatagaatgaattggaaagtattccctccaaactggtattaattctttaaatgttttgtggaatttaccagtgaagctgtctgttcttgggcttttcttatgggtagttttaattacgaattcagtctagttgcttgttgtaggtgtattctgattgattatttgttcttgagtcagttttagtattttggtccgtatttttctaggaatttgtccatctcctctgagttacccaagtaattgccrtagaattgttcatggtattcctttgtaatcctttttgtttctataaggttggtagtgatatctcctctttgatttctgattctaataatttgagtcctactttcttggtcagtctagctaaaagtttgttagttttgtttacttttcccaagaatctcaatatttgacattttttctgaccctaagaaggttcttcacagcctctttgctcacttctttctggcaaactagccaacctgtagttaagcctttatttccagtgaatctcttagtcttctcccaattaactgccttttgaaa

SEQ ID NO: 153228 - DNA, 601 bp, Human
ctctaatgttcctgtgtggaaacgggaggaagtagggaaggggagagtcttggttcaaataccacagactcttactgttcttaccaatttctgtgagattttcttgaataaatgtttctttatttgctgttatttgcttttagaaccatttccagagactttaaatggtattttttgctttttttagaattttcactgggaaacagatccatggaactcctcacactgccctgctagaaacgaaactctgcatcttacacttttaactggatttagccatccttttgaaattttagagaartttcaagtgttttgaaaggcttagagagatttttttcccaagggaagagcccactatgaccaggaacgtgagtccataatagagcataaactctttgagattaacacattttcatagcaatttggtacacagacctgttttattttgtctttaactgaaaattttctgatttgaactacagttatggcatcatgatcaaacctattcagagaagcatcatttaattaccttgattctttttaatttttctataattgtaaacctactatttggcagtgtaattaatgttcggtttttgtt

SEQ ID NO: 153229 - DNA, 601 bp, Human
catttatggctttgttttttaattctggttctcattttttctttcagaagttttccttatttatatgatttatatgttatacttttccctttcaataaaggactagtgctagtcttttatctttgtcataccttttgtcatatggaagtcttacatttttatttagtcaaatataaatcttttcttttgtcttttgctttttgtttataaatttttcttctgtcccaaggtcataaagtctcaaaaaacaatttcttctaatagctttaaagttttatttttgtaagtttgatcttttatycgctcaagattctttttgttgatggaatgaaatgagaatacaattttatttttctttcatatggaaagccctttcttaaacagcccattctgtctctattgattgtcctcttttacataatgtctcctttaagtgtggttcaatttctggtttctctgttttgaagtttttatctatttgccagttcctacaccaatgctcttactatattaatgactgtggttttatattaagccttgacttctttttgggcaattttccttctttctttatttttttttctttttttgcccagaacac

SEQ ID NO: 153230 - DNA, 601 bp, Human
tatttatatgatttatatgttatacttttccctttcaataaaggactagtgctagtcttttatctttgtcataccttttgtcatatggaagtcttacatttttatttagtcaaatataaatcttttcttttgtcttttgctttttgtttataaatttttcttctgtcccaaggtcataaagtctcaaaaaacaatttcttctaatagctttaaagttttatttttgtaagtttgatcttttattcgctcaagattctttttgttgatggaatgaaatgagaatacaattttatttttcttycatatggaaagccctttcttaaacagcccattctgtctctattgattgtcctcttttacataatgtctcctttaagtgtggttcaatttctggtttctctgttttgaagtttttatctatttgccagttcctacaccaatgctcttactatattaatgactgtggttttatattaagccttgacttctttttgggcaattttccttctttctttatttttttttctttttttgcccagaacacctacccttttcagaatatttagaatttgggactcagtatttcattattgaataaatt

SEQ ID NO: 153231 - DNA, 601 bp, Human
ggaagccaagaaaattttctactttgtttgatttggaacctcacattatgattgcttcattttgtctaagaaatgatgagttggtaaagtccctctctcttacacatccacacacttgcagatacacaaaacaaatttatttaagaatttatatatacatatacttcaaaaccaaatattatgatttggggcatatctttaaaaaaaagattcacaccattattatctactggattgacaattcataatccaatatactttaagcttactttcagtggttcaaacatcttaaatatatcayacataaaattgtttaattaaaacaggttgacactaaaaaatattaatatcagtatacttaaaattgttacttttaaagatttaacagagtaactcctgtttgttaaatttgtctaaaagaatatgaaaaaatatattttgaaataagtattgattaagcatttaatatgttaagttgaaagccttaaccattcgtagcaacaactatgctttatttgatgtctaaccactactacaaatagaaacttattgacttggctatgaatgaatggagttatttgtattcactgctgaaaatagt

SEQ ID NO: 153232 - DNA, 601 bp, Human
gaagtgaaaacttgaatttgaataacagtgtatcatatgtgttcatttcatagagatctttttccctcctttgtctcccaggtttaaccctgcgggcactgcatagcaggtgcaggtagcaaacaatctaagagaaacctcttgtatctaaccagaaaagcaagaaaaggggccttttgctccaaaaccagttccatttgcagattacactgaaatagtagcagcttaggcaccaaaaaatctctagaaaatacccatatctctggctaggggaactagaaaatagagtctgttttccaasaaatctgaggtaaatcaacatcatttttctgtcttgccacttctactctgaaggtggtcccagtcgtggtgtaagtgcagaacattatgggagcccccagtaacttggcttttctagccggaggaactagaaggtgagacaactggaggttggaaaggcataggggaaattttgagagcgatataaaagatgcttcctaattctgtgtgtagatcaaaagaagtcctgggttcaaccttgcactgggctcaaccttgagcattgcatgcacagcacagacacaaagaaccacagcaaagg

SEQ ID NO: 153233 - DNA, 601 bp, Human
aacagtgtatcatatgtgttcatttcatagagatctttttccctcctttgtctcccaggtttaaccctgcgggcactgcatagcaggtgcaggtagcaaacaatctaagagaaacctcttgtatctaaccagaaaagcaagaaaaggggccttttgctccaaaaccagttccatttgcagattacactgaaatagtagcagcttaggcaccaaaaaatctctagaaaatacccatatctctggctaggggaactagaaaatagagtctgttttccaagaaatctgaggtaaatcaacatcrtttttctgtcttgccacttctactctgaaggtggtcccagtcgtggtgtaagtgcagaacattatgggagcccccagtaacttggcttttctagccggaggaactagaaggtgagacaactggaggttggaaaggcataggggaaattttgagagcgatataaaagatgcttcctaattctgtgtgtagatcaaaagaagtcctgggttcaaccttgcactgggctcaaccttgagcattgcatgcacagcacagacacaaagaaccacagcaaaggcctcaagaactaaacatcttaaa

SEQ ID NO: 153234 - DNA, 601 bp, Human
agaaatttgaaattgaataatgaaggaagggcaaaaaataaaaataaatcgtcttttctgttttctcagccacttgccaaaagaaatgctaaatacctgggtaaatagagcagactgtttttcctctgctgaaattctttaacatatgtctatttacagttaaaaaaaattaacattgtcttgtagatagtcattgtatgttgatgtaatacatatggccaatataacagaaagggagggtaaggaagccaatagttaaaaagctgctttgttttactctgataatatagaagttgttatrtatattttgaaaagttagatatataccaaccactacagagagggtgggtggagatactcccctaaatgtctcctatatataggactgataattattatagactttaataattttgtaaattaaatgagaatactaaacaacattcaaatataggttgataatctctaattcacagcgctccaaaatctgaaactttttcagcaccagcaggacgctcaaaagaaatagtcattggagtgtgttgtttttcagtttaggatgctcagtcagtatgtattctgcaaatattcaaaaatctgg

SEQ ID NO: 153235 - DNA, 601 bp, Human
ttttctcagccacttgccaaaagaaatgctaaatacctgggtaaatagagcagactgtttttcctctgctgaaattctttaacatatgtctatttacagttaaaaaaaattaacattgtcttgtagatagtcattgtatgttgatgtaatacatatggccaatataacagaaagggagggtaaggaagccaatagttaaaaagctgctttgttttactctgataatatagaagttgttatatatattttgaaaagttagatatataccaaccactacagagagggtgggtggagatactcmcctaaatgtctcctatatataggactgataattattatagactttaataattttgtaaattaaatgagaatactaaacaacattcaaatataggttgataatctctaattcacagcgctccaaaatctgaaactttttcagcaccagcaggacgctcaaaagaaatagtcattggagtgtgttgtttttcagtttaggatgctcagtcagtatgtattctgcaaatattcaaaaatctgggaaaaaaatccaaaatctgaaacacttataggcccaagcatttcagataagggatacttg

SEQ ID NO: 153236 - DNA, 601 bp, Human
ctgtatactctggataaagagagtatctgaataacactccactttaaagaatatcccagcagaatgtgtattttattcaagagcacatggaacattcacagaggtagaccatattctggaccatgaaacactccttaacaaatttgaaataagaatcagactggcatggtggctcatgcctgtaatcccagcactttgggaggccaagacaggtggatcacctgagatcaggagtttgagaccagcctggccaacatggtgaaaccccacctctactaaaaatacaaaaattagctaggcrtggtggcatgtgcctgtagttccagctaattggaaggctgagacaggagaatttctggaaccctggaggtggaggttgcggtgagctgagattgcaccattgcactccagcctggacgacagagtgagattccatgtgaaaaaaaaaaaaatcatacgaagtatgttctcacatcattaagctagaaatcaaataacaaaaatatctaggaaatccctaaatatctagaaatcaaacaacacatgggccaagaaaaagtttcaagggaaattagaaaatatttccaattaaatgaaaata

SEQ ID NO: 153237 - DNA, 601 bp, Human
aaaaatatctaggaaatccctaaatatctagaaatcaaacaacacatgggccaagaaaaagtttcaagggaaattagaaaatatttccaattaaatgaaaatacaccataaaatttgtgggatgcaggtaaagcagtgcttagaggaaattcgtagcattaaatgcttttactggtaaaaaaagaaaggtcctcagtcaatagtctaaacttccaccttaggaaactacaaaatgaagagccaattaaattcaaaataagaagttgggaaataataaagagtagaaataaaaagaatgctrtgcataactctacaacctaaatttgaggacttagataaaatggaacaactccttgaaagatacaagctaccaacactggctcaagaagagatagatagcatgaatgctcctatatctgttaaagaaattggatttgtaattttaaacttttgacaaaagaaaactctgggcccgtatggtttcattgacaaattctaccatttaaggaataaataataccaaattctacaatttctttcagaaaataaggaacacttctcaacttattctatgaggctcacattatcatgataccaaaga

SEQ ID NO: 153238 - DNA, 601 bp, Human
attcagccaactagagattgaaaatttttgaaaaaataaaaactgtaaaaaataatacaaattaaaaataatataacaactatttatattagtcataaaagtaatctagagatgatttaaagtatatgggaggatgtgtgtaggttatatgcaaatactgtatgcaccattttatataagagacttgagcatcaaatgatttggggatctacggggtcctgggaccaatcctagtgtataccaagggcaactatctacttttacccccaggtaaatgatactggaaaatgtagggtactcrtgaaaagactttagatattctaggccgcgtaggtaagaaagagtgtaggagggactgatagactgggagtaaggtaggggtgtttcaggaactacatggctctcagtttgaataacttgagtccttacattcaaaaatgattacagttaacccttgaacaacacagaggtgaggcaagtcaaccctcaagcatttgaaaatttgcgtgtaacttttgactcccctaaaacttaactactaatagcctgctgttgactagaagccttaatgatcatagtcaattaacacgtattttgcatg

SEQ ID NO: 153239 - DNA, 601 bp, Human
atatttactattcattatgtggaagtgggttttcataaaggtcttcatctttgtattcaaattacgtaggaatttgaggaggaagagaaaggatcggtcttacggtctctaaatgccacacatttaaaaatgtccctttagtgggttgaattgtttcttccaaaaagatatgtttaaatcctaatcctagtatctgtgaatgtgaccttatttggaaatagggtctttgcagatgaaatgaagttaaaatgaagccatactggattagggtgggccctaaactcaatagctgatgtccttrtaagaggagaagacacaggggaaaagtccaggcaaagacaaaggcagggattgaagcagtgcagctacaaaccaaggaatgccaaggattgccagcagtcagcagaagctagggtgaggcaagaaaggactcttctctagagtccttggagggagcaaggctgggctgagatcttaattttggacttctggcctccagaactgtgagaaaataaatttatgttgttttaagccacccagtttgtggtattttcttatagaagcccgaggaaactaatatattaccttaatttgctcttga

SEQ ID NO: 153240 - DNA, 601 bp, Human
taggcagaactctgacagttagataactgactcttgataggtgcttcagatacagaaagcttaaaagatctggtttattccactcatccattccaatctatcattccatttgaaatctcagcaaattttttccaagggaaattactgttaagaatattaaaatagtaagtagtcgaatgtagtttctggaacattgtatttaaatccttttaaaagactacattttcttaatgtgataaagcatggtattctcttagataatctaggcaaaaggagcattttttttcctatactcagtttrttaaaaatttcttgggatacattgagattttcatgaagaaatgaaatttgaaatttgttcttgacgtactttggatatttgtaatgaagatgttttacatatcttgagccatatattaggtcagctataatttattgggctttaaattttttataaggttatatcatatgtaactagattagttttctattgctgccacaacaaattaccacaaatttagccgcttaaaataacacacacttattacctcatagtttctctaggtcaggagttcaaggggcctcagctgggtgctctgct

SEQ ID NO: 153241 - DNA, 601 bp, Human
cagaactctgacagttagataactgactcttgataggtgcttcagatacagaaagcttaaaagatctggtttattccactcatccattccaatctatcattccatttgaaatctcagcaaattttttccaagggaaattactgttaagaatattaaaatagtaagtagtcgaatgtagtttctggaacattgtatttaaatccttttaaaagactacattttcttaatgtgataaagcatggtattctcttagataatctaggcaaaaggagcattttttttcctatactcagtttattaraaatttcttgggatacattgagattttcatgaagaaatgaaatttgaaatttgttcttgacgtactttggatatttgtaatgaagatgttttacatatcttgagccatatattaggtcagctataatttattgggctttaaattttttataaggttatatcatatgtaactagattagttttctattgctgccacaacaaattaccacaaatttagccgcttaaaataacacacacttattacctcatagtttctctaggtcaggagttcaaggggcctcagctgggtgctctgctcagt

SEQ ID NO: 153242 - DNA, 601 bp, Human
acaatttccacatgcttgtttagcaagggtataaatccctatacacccataattcctaagtattgtatcacacaaagcctggggtccccattgactccatttgtgtaatgtagatactagttttctcattaggggtttacttatttcaggaagtacccatttgccatcttcagtctgagtgacccctgtcctgtctaattcttcctcctcctctctggtaaactggggccttaatactagcttagggatgtttgggagcaggctacatagtctaatttcttcgtccagggaggcttgcttrgcagcttcatctgcaagcctgtttcctgtagcttctatagtgttccctttctgatgaccatttacatgaactatggctacctctgctggaaggaggaggctttctaaaacctgtttgaccagttccccaggtaccaattattttcccctgctatttattagaccctgctctgtccagattttttcaaaagtgtgttccaacccattaagcatatttagaatcagtatatatagtgccttctttggctttaaggagctttatggccgggttaagaccatataatttacagatttgggctga

SEQ ID NO: 153243 - DNA, 601 bp, Human
ccagccattaggtaatctacctttctcacatagggagtgtttatctccatcagtgacagcattgccatctctcgttcgtcacaactcatccacaaagagccttatcccatcatgtagtggagcttccctaaggtttggtcctactttggtttgttattctatgatatctaagcagttctggtctgatgtctttgatctcctctcctttccataggaaactggctgcatttaggcaaatatttgttgttacaagcaaataattttttttcttaataatatggcttcatattttatgaagaaygtgttcaaactatctcccggcttttggtttaatatattcctgacctggtgtggagcgcttactattagggccccaacaaaggttagctttctactctcctaccagcagggctgtggcagcactgcttgcacgtatttgggccacccctgagagacaggatcgagaagcttggaggcaaaagcaacagattccctcttccctccccaggtttgagtgagcaccccaagggtgatccactgttaccaacagatggaatggtttctctaaagatgagaggaccaggaccggggctgtaatgag

SEQ ID NO: 153244 - DNA, 601 bp, Human
gggagaattggagtattgtaacatgcagggttttaattgtccatcgttaatcaatccctctattaccagttggagaccttttctcccttcagtggaaatgggatattgttctctgcaaactacttctggttgttttaggttaatctgtaagggtgtgatttttaaccctctgttgccttccctaaccctcacaaggggatttaatttttctttcctcctcctctgtcaggaggcccatcattacttttatttgtccttcctctattcctaatcctaaacccaatctcacaatcaggtctcracacaggaggttagttcctacttcaggaacaagtgacgcctcaatttgttttgctcctgatgtaattaaaattttcttaaatattggaacctgaaatccctccccttttacccctgatactttcaatttttccttagagagttctgtagcccttggttggtgaattagggaggagtgagctgccccagtatcaaccaaaaatgtcacttctccctcaggtcccaccttcaaatttattaagggttcctggtgggatctactcagaaggtgctcctgcccccgactagtcttcatcaatag

SEQ ID NO: 153245 - DNA, 601 bp, Human; identical to SEQ ID NO: 23820

SEQ ID NO: 153246 - DNA, 601 bp, Human
cttggaacaggtactttagtttcaaaggattaaccatgttccctaacttccttttgaagtcttaatttgccttataaaaaaatccactttctatctttcttgggacttgtggaagaaggtgcttttgttgctataattaagcataaaataagcacattgcatttactgggttgtttcctagccaaggccattgggtttgggggactcagcgcacagctgactactgcaggactactactgtggttatgaccatagtaagtttcaagcgcaaagttactagagggataattctgggggtggsgttagggagggaagagtagccagggtggtatcctagttacacacagctcattcctgctttattttggggttgtgtgaaattttctattgctatctttgttgacattatgcctctgcaacagcctctatcacatgtaatgtagcctctctcacttcatgcaacaagcttctgaggagtggagggaaaacgagatcacatcacagctgatatgccctaattgacttgcttctaaaacatgttaatttttgagaggtaaatcacagacttattttctaataagaataacctgggtttttttct

SEQ ID NO: 153247 - DNA, 601 bp, Human
tatctggaaagaagtcaatttggcttagaatgcagctcagtttctctttgggaacgtttctttttcaggtttcctctgggatctattgggtcttcccacagacaaaacacaatggggtgtgttttgctgttcaaatgtaaatagagtagtgagaatcttgttcactgatgacacagcatcaattttggaaaagggaagcaatccctcttccctacaacatgcccttatccctgcaatctgtgttaactcgcttgctttgtgactacttgtaccttatatgagccaaagattttcttgggtrttatcaagccatggtgattcaagtctggttgcacattagactcatctggggaacacctaaaaactcagatgcctgggccacaccccaaaccaactaaatcagaatctcctggggtgagacctagcatcagtagtctttaaagttccccaggtgactccaatctcttcttaggagattcttcccaaaggactttaggacaaacataaaggccaaggggcaaatctcatagccactgggattgtggagtagaaaggcttctctttatggtacagttcattgagctctaaagtaacttgcctg

SEQ ID NO: 153248 - DNA, 601 bp, Human
ttgagtgttcaaagtctgcatactgtcattattttgccttccctgcacttgacagcttgctaccgaatcaaacatatctggaaagaagtcaatttggcttagaatgcagctcagtttctctttgggaacgtttctttttcaggtttcctctgggatctattgggtcttcccacagacaaaacacaatggggtgtgttttgctgttcaaatgtaaatagagtagtgagaatcttgttcactgatgacacagcatcaattttggaaaagggaagcaatccctcttccctacaacatgcccttrtccctgcaatctgtgttaactcgcttgctttgtgactacttgtaccttatatgagccaaagattttcttgggtattatcaagccatggtgattcaagtctggttgcacattagactcatctggggaacacctaaaaactcagatgcctgggccacaccccaaaccaactaaatcagaatctcctggggtgagacctagcatcagtagtctttaaagttccccaggtgactccaatctcttcttaggagattcttcccaaaggactttaggacaaacataaaggccaaggggcaaatctca

SEQ ID NO: 153249 - DNA, 601 bp, Human
tgaaacttcttaaattaaatgtccagctgggatggatcatttacaaagatacgctccatctccatacaggtagcctccaactcacaaccctcttgtcacttccatagaaagatcctaccctgccttggttccctccttcccatgacggaagaggtctccctaacataaccataggagtttggtgagaaaaaaattccactggaaatatatgggcttggaaactggggaagggtcggagctgtgaaacctgggaagagccaggggcagctgacccaggggcagaatcccaggcaagcctggmctgcctacgtgctgaccaaccaacagtggggcccaaaatagcctgcccacaaggcctgcatttctctcactcgctgtactctgttgtgctgctgaaatcccactatttagagcagcatcctggcagatgtcgtagcggaagaagtgaattcactgggtgcccagggaggggccattgcaagcaggagggtggcaaatgacaactatgatccctatttatggagcagaggctttacaaagcaatatctaagttaaccctcacatcaacccatgagacagatttactcttatgcctatttta

SEQ ID NO: 153250 - DNA, 601 bp, Human
aggtgctatggtccatgagtgttaaataaacaaagatcaaagagatattaggaggggaaaatatcagggagctttaatttttatatctgttgaagaagaacctgttgagtacattgctcacgccctgggtcagcctaaggtcctgactggccaaatcaatttaagccttaaatagatttctctaagcagtaacagtttgaaatggttttccagactggggccagaatgagaatattggtctcagatctcaagtaaagaatcagtgcctcctacaagagtctgatgtgcagtttcttgattccaagagacccatcccaagtggcagagctcctttccagcttaggtagttactttgttaaagtattgttcattcatacagtccctaagcgataagacacaacagatagatggtgtttgttcattctaaattctgtatttcataacattagatttgaaagcttaacatttacccagcttgttgcactagaagcttccttagctctatagaggtggtctcacagtttactaagtattttttgctagggttatgaaacttcttaaattaaatgtccagctgggatggatcatttacaaagatacg

SEQ ID NO: 153251 - DNA, 601 bp, Human
aaggtgctatggtccatgagtgttaaataaacaaagatcaaagagatattaggaggggaaaatatcagggagctttaatttttatatctgttgaagaagaacctgttgagtacattgctcacgccctgggtcagcctaaggtcctgactggccaaatcaatttaagccttaaatagatttctctaagcagtaacagtttgaaatggttttccagactggggccagaatgagaatattggtctcagatctcaagtaaagaatcagtgcctcctacaagagtctgatgtgcagtttcttgatyccaagagacccatcccaagtggcagagctcctttccagcttaggtagttactttgttaaagtattgttcattcatacagtccctaagcgataagacacaacagatagatggtgtttgttcattctaaattctgtatttcataacattagatttgaaagcttaacatttacccagcttgttgcactagaagcttccttagctctatagaggtggtctcacagtttactaagtattttttgctagggttatgaaacttcttaaattaaatgtccagctgggatggatcatttacaaagatac

SEQ ID NO: 153252 - DNA, 601 bp, Human
aggaaatttgatagtctctgcttctcttttctctttgcttgcttaattttcctggaaatctgtgtttcagggttagtgagtgcatttttaagcaagccaaagtctatattttcttaattcactaatatgcacacacagtctgtgtaaagtcaagaaatattggctttcggaccaacatgctgaggtttaaattctggcttcaccacttactaggtttgtgacccggaacaactctctaggtctcctttcttcacctgtaaaatggggataataatatctcctcttctattgtagagctcaracttacttgatttcaggacaagaactgtgttcatcatgtggatagttaaaaggtgctaggtcattaactttaatattaagtgtttatttgcagatattcacttacttggggctaatagtttggttcaattgtgcctatgtctagaagatttttaaaaataaaagcacaacacctcaaaataaaagacatgcttacggcataggccccactcaaaagcagtctgggtatttaggtaacttctcctgcaagacagctttgaagcaagatcccgccttgtagtcacctgcctgctccatgggt

SEQ ID NO: 153253 - DNA, 601 bp, Human
caggcaaaaaaattggaaggccatattgttttaaaaccatgcttctctacttcaattttgttattaaagttatgcaaaagtgggttttgcctctactgagctaaccagttgtttcccagtggtgacccaagtctgcttacgcatactcctattcccactgaggccatcgctctggcactcgtgcagtcacactaggttcctatgtggatgccatcccctcgctgggcagaatgggagagatctgagaaccagagtctcccacaaggcctcccgaatgctgtctgcctaccaagcacttgargagaccttgctttgttgcaaagagttagggagccttctctcattgcaaaaagcatcaatattataggaatacttagagaaattcatgtttctcttcttaaaaacatcctgatctggactttgaagtagtcattagtaatactggcttaagcctaccgcagcccaaatggagattttaaaagggccaaaaggaaatttgatagtctctgcttctcttttctctttgcttgcttaattttcctggaaatctgtgtttcagggttagtgagtgcatttttaagcaagccaaagtctatatttt

SEQ ID NO: 153254 - DNA, 601 bp, Human
tgggttgtgggcagaagccacaggcccgtcttgggaggctgtgtgagctcttccgtgttcctcaaaatgcctgacaactaaacatgcaaatgtcagcagaccccagagcccatgagggttatctttgtgtccactatggcttagagcagtgtcttcagactgaggcacctggccctctgggggcacaggaagactttctgcagtgcctatgggtggttgaaagggaatccatgtccatttcctcaatttccacatgtgccatgtcctaaaatgtctggtctgcctgcggatgctcctgctstggttctccttgcccatgtccccttttccaatccctctttatccttactgagagacggtgtgcttctcacctatctagccattctattgtggggcctgtcccagggataaacaccttcaggcgccatacaaaggcattcatgcatgaatggctccttggaacaaactgatattgggcgcttcctgatgtgaggacatagtgccatgaatatgatattccaaggatgtttccctacatctaatcatgtggaaataatcagacagatctaaactgaagggtagtctgggaaacagctagcaa

SEQ ID NO: 153255 - DNA, 601 bp, Human
gaattgcccactgcaagtggtacaaaatggatcaggagagccaagcagcttgtccttgaagccaatctctgggctgtcaactcttgttcttatttgaccttcaggaacctctaaaatgtgcagtccatgagaatggactctaaatgtgagtttatgagaatgttctagttctctgaaaaacttctgtaaagttttgttatctgctcctatttcaaagtgatgactttgacacttatttgaactactttttaaaaaaggcccatagatcagtaagcactgaatgctgatgcatcttacattwtgtaatgaccttccgtgctttcctattttggacacagaattcatctagtgtttggtagaccgtcctgatcataggctgctgttgggttaactttcagaagtgtccacagcatctattttcctaaaaacaattaccagctgaggcaatttactaagtcattgtgaccatttccagagctaccagtgcattctcttcaggaccagtggtttgttgacagtaaggcatgacatcgatttatttgaaaagtatttgcgttgtaaaaacaccactgttttgttgttttaaaaaagcatttctgga

SEQ ID NO: 153256 - DNA, 601 bp, Human
tgctggcaccaaatgaccaggctcttgctgcagagttggagacaagagaggcccggattccagtcttgggtcagtccctgatcagctgcgtgaccttggaagtagtcacttaacccttctgaggtcaactcagtgctctctggggccttttccagctccaaaatgctaaagtgtggagagtctaagtcttggctggaaagtgtggccagacacgggtttttcagtcacctctgcaagggagtagaccacctctggctgacgccccagcagcattcagctcagccagtaccatcaggggccscataaaaccccacaggaggtattttagaactctgcagtgcttgacctcttcagtttacctcttggctgaatgtctcggctacatttgaaatgaccgtcatcaatcttctcttaaatcatcaagtcatcttcctgtgccctatttaagagaggtaaaagatgtgtagaaagggccctgtatctgcatatgaaagcatccagattctactgtaaggcattcttaaacttcagtttccatctgtaaaaatagagatgggccccatgacccctgagaggacacactacagcctcacgctacaat

SEQ ID NO: 153257 - DNA, 601 bp, Human
agctgaaatgcccacagctgcctccattttccaggaattcactgagctgagggaaaagaagaggggtctgggtttggattcgttccctaaattaagacttactggcgcatctctgtcttcatcctttaaaaggcttggcagaatgtcagatatgcaaatgaccctcatttattaactttaatagtgaaatacttgcaaaccacaaaagaggagcatcattaaaaaaataataggtcatatctttgctcatttcccagacctgcttggaggatatatcttggaaaacatgtccatctaaaakataaagtttttggaaatccaaagtgctcaaatgcatttaagctatccttcagagtgcaaccaaatgttttggtgttattctatttaaaatattttaactttgatgtgttctttgtataaatagtgttacttaaagaaatgaaaccttgtaccggggcacaactctgggaacaaacagttcaccgcaaagactttgctgccctcgattatggggaaaaaaaatagtaatgtcatcccaggaacaaaggactgagatagtgactattttgtaaagtcaactgagttttaataggaacaatgg

SEQ ID NO: 153258 - DNA, 601 bp, Human
gatgggaaatctccttcacattttgttgctaatgtggaaatattatttaaaccccaagttcaggccataggcaactcttattaagctgaaggcttttttttccttcatagtcatgaaaaatagaagaaacaacaaaatttttgctgaaaaatttacatggatatgaattctggaagccaggaaagggcaacattgtatttttcaaaccacagggcaaataggcctgcatgttccgactaaatgagttcattcttagagccagcctcaatttatcgatgcgaggcacctgggggcattaggmgccatactcctctgcagaggatgctgggcagcctcactgagcctgtccttaattcttctgcagaggcctctcacccagcccagacaagaaactcctggtgatgagctgaaatgcccacagctgcctccattttccaggaattcactgagctgagggaaaagaagaggggtctgggtttggattcgttccctaaattaagacttactggcgcatctctgtcttcatcctttaaaaggcttggcagaatgtcagatatgcaaatgaccctcatttattaactttaatagtgaaatacttgca

SEQ ID NO: 153259 - DNA, 601 bp, Human
tttcaaaaaaaaacatgcttgtatataaatcggaacttatgaaacagatctattaggagtgattaatcaaaatacagaagagtcttcaaattaaaaaacagagactctgttttacaaaaggactcacatcataggctctattcaagaattctaaataagtcattaatttaggaacctgggcatatagaaagttaagttcaattaacaatcaactgaagattaatcagaaatgagggtaaaacattactaaaattttaatataagctaataggaaaacattagagtcacagaagtttaaatyatgctggtttagagactcattaatctatatgatatataactttttattactagagttacaatcataaggatttgaatcagcacttatagtgttcttttttagcccttgatacttggaagaacttgaaaaacatttttctcccctttttaagacattttgaccacatggctttgtcacaggctttgtttgccaggtaaaatacagaaagcctggttgtatttgaatttcaggtaaatagtgaatacacgtcatagcaaatttgtccaaacccatgggatgtatagcaccaagagtgaaccc

SEQ ID NO: 153260 - DNA, 601 bp, Human
tttcaaaacaaaacaaaacaacaacattaaatcactttggttgacagaaacaattgacttaaaaaaaaatgagctgctttagctattggtgatttctttcaataataagctattaaagaggaaataaatacagatgtgcccagtttcaaaaaaaaacatgcttgtatataaatcggaacttatgaaacagatctattaggagtgattaatcaaaatacagaagagtcttcaaattaaaaaacagagactctgttttacaaaaggactcacatcataggctctattcaagaattctaaatargtcattaatttaggaacctgggcatatagaaagttaagttcaattaacaatcaactgaagattaatcagaaatgagggtaaaacattactaaaattttaatataagctaataggaaaacattagagtcacagaagtttaaatcatgctggtttagagactcattaatctatatgatatataactttttattactagagttacaatcataaggatttgaatcagcacttatagtgttcttttttagcccttgatacttggaagaacttgaaaaacatttttctcccctttttaagacattt

SEQ ID NO: 153261 - DNA, 601 bp, Human
aactttctttaggaagttttctttcaaaacaaaacaaaacaacaacattaaatcactttggttgacagaaacaattgacttaaaaaaaaatgagctgctttagctattggtgatttctttcaataataagctattaaagaggaaataaatacagatgtgcccagtttcaaaaaaaaacatgcttgtatataaatcggaacttatgaaacagatctattaggagtgattaatcaaaatacagaagagtcttcaaattaaaaaacagagactctgttttacaaaaggactcacatcataggcyctattcaagaattctaaataagtcattaatttaggaacctgggcatatagaaagttaagttcaattaacaatcaactgaagattaatcagaaatgagggtaaaacattactaaaattttaatataagctaataggaaaacattagagtcacagaagtttaaatcatgctggtttagagactcattaatctatatgatatataactttttattactagagttacaatcataaggatttgaatcagcacttatagtgttcttttttagcccttgatacttggaagaacttgaaaaacatttt

SEQ ID NO: 153262 - DNA, 601 bp, Human
aaggccctacctgacctggctgcccctctcctccagcctttattacctctgacctcctctcttgtttctcttcttgttccctcccgtctagctaccctggcttccttaccattcctcaaacacggggctcagtgtcagcaccactgaccttttcggctgggtcattcttcattgtgggaggctgtcctgtgcactgtaggatgtttggcagcatccctggcttccatccaggagaggcctgatatggtatggctgtgtccccacccaaatatcatcttgaattttagctgccataatcccyacatgttgtgggagggggcccagtgagaggtaattgaatcgcaggggcaggtttttcctgtgctattctggtaataatgaataagtctcatgagacctgattgttttataaagtgcagttcccctgcctgcctatgccctcttgcctgccgccatgtaagatgtgactttgctcctcctttgccttctgccatgattgtgaggcctctccagccatgtggaactgtgagtccatgaaacctctttcctttataaattacccagtctcaggtatttcttcatagcagtaagaaaacagact

SEQ ID NO: 153263 - DNA, 601 bp, Human
aacaatccaaacacctgtttcttgggtagtaggcctcttatgcccccctcacctcatttttcaggtcatttagtatgtttaggattctaagtggcttagagaaataaaccaaagaagagttgtcagcaagagtaaatgttttttgccaagattgtattaaagcatagaaagattacattatgtctaacccatgtcaaattgttttgtcataaacctaacctatttaattgttaaaatatatcaggtatccctcctatagaacaaaatctagcaaaagcaacttaaccacgtgtgtgtagagtgtgtgtgtgtgtgtgtgtgtgtgtaatatataaaacatatgatatataataatgaaaagactggtgattggaatccgtagaatgcctagttgctatctgaaatttagcattggcaggatcagctgcacggaaatcacaaagctgtttccacactggctgaagccctgtcacctcttgcctggataaccacagtggcccctgaactgggcttcctcattctacccttacccaccttcgatctattttctacccagcacccagagggatactttaaacgcagaacataacctcctctgctc

SEQ ID NO: 153264 - DNA, 601 bp, Human
gcatgactttaacaaaaaagtccagtgatagagtaaaatggcatttatgtatcacagcaataaatgaaatgagatgctgttcgtgcatagaagcagccctgcccccaagggtgaggtccagcctcagctgcaagctgtcacatggctcccactgtctggctgcaagcaggacaagaggctcattagggagatcacatggaggaaggatgcagggacactaagatgtctgagacctttggtgaaagtataaatcagcagtctcttagtgctttctgccggatttcagtgtttgctttggccratcaagtcagcagagaaaaataactaatggaacaatgtaataaatttctaaacggggggaaaaacaatccaaacacctgtttcttgggtagtaggcctcttatgcccccctcacctcatttttcaggtcatttagtatgtttaggattctaagtggcttagagaaataaaccaaagaagagttgtcagcaagagtaaatgttttttgccaagattgtattaaagcatagaaagattacattatgtctaacccatgtcaaattgttttgtcataaacctaacctatttaattgttaaaata

SEQ ID NO: 153265 - DNA, 601 bp, Human
tgacttctatccagctccccgatactctaggggcgggtcgcacttcatgcactcagtccagcccacctatccctacggccacagctcgccccaccccccaacccccggccgaggcggcggaactcacgatcatcttcttatagagaccgtaatgcaggaccaggctatgggtcaatgccaggcgatggggcttcatagggtgtccagctcctgggggtggggagaagagagttcgtcagctctcacccctggagttgcaaccccgcctcaaaacctccgtgtcccaacccctcatgcatakccctgtttcctcaccgtagtggaagttgcccacgtcggggtcgtagaaataggccacggtcttggccatggtgccggcgggagcaggccccgcacctccgccgcccgccgcccgcggccgccgccagcccctccccggccgtgcgtgctgcgcaagcacgtagccggcctctgcggaactgggcgttgcggccccgcctccatccacacccaggccacgcccccaggggagctccgcccctcgcccggctcagctctcccggtatctggggctttgagcgtcccgggttgggcagggaac

SEQ ID NO: 153266 - DNA, 601 bp, Human
aaaaatagacctgactttattcaagcattcaagtctatattaggggaatgatgaacaccctaatccaggcagaactctgggaagggatgggggcaaaaatgaacatttttttttttacaaacacttgtaaactaaaaagcagtttgtaattgctaacaagaaatatcatagccaaagataaagttaaaacttccatggcacagaaacatcttactggccttatatggacctgtcctaatagctgttattacccaattctggcatttgcttcttacttcctcctgacattgtccgccttgcmgattttcataagaaggttcaggcagttgcttccctgtgggatatacaacaattttccaattctatgactcagaaaatggcaagagaaggaagcgttcttctcttctaaccctaaataaaatcagaaactgtttatttagctctggaagagtaaggctcagttgagttaccgtacagactttggcaaactttttttctttcaagtcaaatatttaccaagaacttagtatatgcaagtcagtctattatttatccaaagccaatgcatgaattatttttatcagttccaaacttcctttct

SEQ ID NO: 153267 - DNA, 601 bp, Human
gggtgggtcatactcctccaagggcaatgccatcccccttgctaatgcctgcttaggaatacaagcataagccaactggcacatggcattcctagccagagggactggatgagccaatgagactcataagagatatgctggccttccctgctggaaggacttatctgtggaaagagaaccacagataagttctttactaggcaaagctagattttctattacttgtggcaaaaagcatcccaactgttaacttaaaaaatgaacaggttaaagattctgatcaacatcaacaaatgtgatyatgaacaaatttaaccatatctatgaaacctatgatccttggactaatattggcctttgtacatttggagagtttgttgactttaacagaatatggtactccaagagaagttagtgtgggtggggaagtgaaggttaagaaacagcaaagtcactggagacattcgtgtcacagccatatcacagatcaaatccagaagatgaaaaatctcttcctgctttactacctgccatgccaaaaaccacttagcaaatacgaaaacagacctggccgggcacagtggctcacgcctgtaatccc

SEQ ID NO: 153268 - DNA, 601 bp, Human
tcccagcccagcacggtggttcaggcctgtaatcccagcactttgggaggccgaggcgggtgggatcacctgaggtcaggagttcaagaccagcctggccaacatgatgaaaccccatctctactaaaaatacaaaaattagcaggacgtggtggcacacgtctgtaatcccagctactagggaagttgaggcagaagaatcacttgaacctgggaggcagaggttgcaatgagctgagattgcgccaatgcactccagcctgggtgacaagagcaaaactgtctccaaaaaaaaaaaaaagtgttccctgttcaccacatgcacactaaaatctatctactgctttttgattttttgatgatggccattcttgcaggagtgaggtggtatcacattgtggttctgatttgcatttccctgatcattagggatgctgagcattttttcatgtttgctggccatttgtatatcttcttttgagaactgtctattcatatccttagcccactttttgatgggactatttgttttttcttacttatttgtttgagttcattgtggattctggatattagtactttttcagatgtattgattagg

SEQ ID NO: 153269 - DNA, 601 bp, Human
catgtccccctttctctctcctaacaacatccatttatgtgtaggtgtctaccctgtccccccacactatccaagtacttagaagatgtctcccagcccagcacggtggttcaggcctgtaatcccagcactttgggaggccgaggcgggtgggatcacctgaggtcaggagttcaagaccagcctggccaacatgatgaaaccccatctctactaaaaatacaaaaattagcaggacgtggtggcacacgtctgtaatcccagctactagggaagttgaggcagaagaatcacttgaacstgggaggcagaggttgcaatgagctgagattgcgccaatgcactccagcctgggtgacaagagcaaaactgtctccaaaaaaaaaaaaaagtgttccctgttcaccacatgcacactaaaatctatctactgctttttgattttttgatgatggccattcttgcaggagtgaggtggtatcacattgtggttctgatttgcatttccctgatcattagggatgctgagcattttttcatgtttgctggccatttgtatatcttcttttgagaactgtctattcatatccttagcccactt

SEQ ID NO: 153270 - DNA, 601 bp, Human
taagcatggaatatcatacttagactttttctgcatatcaatatcatatattttattagatccctcttcatgttaaatttaccaatatgtataagtaatttttaaagctttctttactccaaattgtctaaacatatggttaaccctattatttgcaagaattcttgcataattaaggctgttggtgtttaattaccaacatcaccacaatagtggccatttctgtgtgttcactgagtatccatgtccccctttctctctcctaacaacatccatttatgtgtaggtgtctaccctgtcyccccacactatccaagtacttagaagatgtctcccagcccagcacggtggttcaggcctgtaatcccagcactttgggaggccgaggcgggtgggatcacctgaggtcaggagttcaagaccagcctggccaacatgatgaaaccccatctctactaaaaatacaaaaattagcaggacgtggtggcacacgtctgtaatcccagctactagggaagttgaggcagaagaatcacttgaacctgggaggcagaggttgcaatgagctgagattgcgccaatgcactccagcctgggtgac

SEQ ID NO: 153271 - DNA, 601 bp, Human
accaagggcattccaaatacccatgagccaccatcagcttaagcaataaaacattacaaatacaactcaagccctgcatgactcctcccagattcccttatccttcatctgtcctcagaagtaaccactatcctgaatttggtgtttgtgtttcccacgtttaaatatttttacatgggtaggaatccataaaaaatatagtaacattatttttcatatttatttttacaaatgtcattgcatatattttgataacacaatacctgcactatacacacagttcaaaagtacaaaagcatcwatggtgcaacacaatgtcctcctttacctagtcccctatactgagcaactaacgtaaccagtcttgtgtgtatctttaaagagacatactctatatataaaagcagtcacatttaagatacagatttgcccctgccttttatacataagtggtaggcatattgaacacactgttctactttttcctcttaaaaatacaccttggaaattgttctctaaaatatacaaagttcctccctttttcttccttaatgtttgcaaggtatttcactatatggataaaccataactattactatta

SEQ ID NO: 153272 - DNA, 601 bp, Human
acatgtccaccaatggaataggatggatagcccagaataaatgcatatatctataatcaatggatttttgacaaaggtgccaagactacacaatgtggaaaggacagtctcttcaataatgtcatttggaaaactggatagccacatacagaagaatggaaatggacccttatctcaccccttaacaagtatcaacttaaaatggattaaatttaggacctgaaattacaaatctactagaagaaaacttaggcgagaagctccatgacacaggtttgggcaatcatttcttgtatatgaycccctaatgcacaggcaacaaaagcaataataaacaaatgggatgacatcaaactaaaaagcttctgaacagcaaaaaacaaacaaacaggccagacgcgtaatcccaacactttggcaggccgaggcaggcggatcacaaggtcaggagttcgagaccagcctgaccaacatggtgaagccctatctctactaaaaatacaaaattagctgagcgtagtggtgcacacctgtagtcccagctactcatgaggctgaggcaaaagaatcgcttgaacccgggaggcggacgctgcagtga

SEQ ID NO: 153273 - DNA, 601 bp, Human
ccaaaacacactaatactgtaatggtggtaagtaaatgaattatatatctagtataaaggttaaaagataaaactattaaaaatagttaaagctagccaggcgcggtggctcacacctgtaatcctagcactttgggaggccgaagcgggcatatcacctgaggttgggagtttgagaccagcctgaccaacatggagaaaccccgtctctactaaaaatacaaaattagccgggcgtggtggcgcatgcctgtaatcccagctactcacgaggctgaggcaggagaatagcttgaacccrggaggtggaggttggggtgagccaagatcacgccactgcactccagtcccggcaacaagagtgaaactccatctcaaaataataataataataataataataataaagctacaataatttgttaaagatacaaattattttttaaatgtatatcgtgacatcatgaacataaaacatggaagagggggagtaaaaatgtagaatgtgtgtatgtgatcaaagttaacttgttatcagcttatataccagttataagatgttttgtgtaagccacagggtaactacaaagcaaaagccttt

SEQ ID NO: 153274 - DNA, 601 bp, Human
aaaagtaagtatactgtcaaccccaaaacacactaatactgtaatggtggtaagtaaatgaattatatatctagtataaaggttaaaagataaaactattaaaaatagttaaagctagccaggcgcggtggctcacacctgtaatcctagcactttgggaggccgaagcgggcatatcacctgaggttgggagtttgagaccagcctgaccaacatggagaaaccccgtctctactaaaaatacaaaattagccgggcgtggtggcgcatgcctgtaatcccagctactcacgaggctgargcaggagaatagcttgaacccaggaggtggaggttggggtgagccaagatcacgccactgcactccagtcccggcaacaagagtgaaactccatctcaaaataataataataataataataataataaagctacaataatttgttaaagatacaaattattttttaaatgtatatcgtgacatcatgaacataaaacatggaagagggggagtaaaaatgtagaatgtgtgtatgtgatcaaagttaacttgttatcagcttatataccagttataagatgttttgtgtaagccacaggg

SEQ ID NO: 153275 - DNA, 601 bp, Human
ctgctttgtattcttatcagttagaaaaaaaatttccaaggccgagtgcggtggctcaagcctgtaatcccagcactttggaggacgaggtgggtggatcacaaggtcaggagttcgagaccagtttggccaacatgctgaaaccccatctctactaaaaatacaaaaaaaattaaccaggcgtgttggcacgcacctgtaatcccagctacttaggaggctgaggcaggagaatcgcttgaacccgagaggcggaggttacagtgagcggagatcatgccactgcactccagcctgggcracagagcgagactccatctcaaaaaaaaaaatttccaaaggggaaaaaaacaattggaagtagtattagcagattcaccttttttggaagtagagttgaatagggttgaacccctaattccaattgcacatgtgaaagcagtatgtatacaaagcatagattttatagtcgcacagacctcggttttattcctgtttgaaggtacttactagatgtttgacttgggcaagttaaagaaactacaaccttctatttactcatctttaaaataagaataccacatactccataagggtgact

SEQ ID NO: 153276 - DNA, 601 bp, Human
tgccaagagatcattcaaattcataaacacacacacaaattacatgatcaggatcttttcttttttaatctgtagttttccttctaagaatttgatttaaaagttgatgaaaaaaatgtgcataaatatgttcattacagtgtattatgtaagaacaaaaggctgaccaatttcagagaacagtttaatacattgttattccaacctaacagactctcataggaaaactatagaaaatgttcttacaaacataaaaaaaaattatatatgcattttacattttttagctacacaaaaaaatcatataaaaatgttaatatgctaaaatgaaaagttattccactgtgatactttttgaattttacttgctgctttgtattcttatcagttagaaaaaaaatttccaaggccgagtgcggtggctcaagcctgtaatcccagcactttggaggacgaggtgggtggatcacaaggtcaggagttcgagaccagtttggccaacatgctgaaaccccatctctactaaaaatacaaaaaaaattaaccaggcgtgttggcacgcacctgtaatcccagctacttaggaggctgaggcaggaga

SEQ ID NO: 153277 - DNA, 601 bp, Human
acaaaagtatgatcgtatcacagtggcaggaatagaggcagtgccctgacagccatgccaagagatcattcaaattcataaacacacacacaaattacatgatcaggatcttttcttttttaatctgtagttttccttctaagaatttgatttaaaagttgatgaaaaaaatgtgcataaatatgttcattacagtgtattatgtaagaacaaaaggctgaccaatttcagagaacagtttaatacattgttattccaacctaacagactctcataggaaaactatagaaaatgttcttayaaacataaaaaaaaattatatatgcattttacattttttagctacacaaaaaaatcatataaaaatgttaatatgctaaaatgaaaagttattccactgtgatactttttgaattttacttgctgctttgtattcttatcagttagaaaaaaaatttccaaggccgagtgcggtggctcaagcctgtaatcccagcactttggaggacgaggtgggtggatcacaaggtcaggagttcgagaccagtttggccaacatgctgaaaccccatctctactaaaaatacaaaaaaaattaacc

SEQ ID NO: 153278 - DNA, 601 bp, Human
aaacaaaaaaatgaatagacattaaactcatccatgaaatgcatgattgtattagcaaaatttattaactattttcagagtgataagaaaatataggaggtatgaaattagagcagagcaagaagaattttacaatacaattaaaatcatttagaaaacagtaggtagtagcaataataatgtgatgggaaattttatagaacacacaacaaaaaatgaggaggaaattagcaaaaataggagggaaggtggtaactacggaatagggaattgagtataatttaactcatgagtaatacgragcagaatattaatccacctgtaaataacagaagccccccaaccacccaaaagaaggcataataagcagaacaaaatccataaccaatcaagatataccataaaacttttttctaatacttgagcatttcatcaaattataaattaattgttttaaagtatggtggtataacttcttcccttttgaagtaatagaagaaatcacaaaagtatgatcgtatcacagtggcaggaatagaggcagtgccctgacagccatgccaagagatcattcaaattcataaacacacacacaaattac

SEQ ID NO: 153279 - DNA, 601 bp, Human
aattaactttaagaaatgactggagcttatccaaaactctggacatatatcctgtcatttaataaggaactggaataggaattcaaagcattctctcaaattcattattttggcattatgtactgagcatctcctacatgccagttaatgctgctggggaaaacagtattgaccaaaagcaacctgggctatgggaccttcccggcctgtaatgatgacaaaaataacagtaaagtgagaaaaagcaaaaagtcttataatacaaaagaataaaacaaaaaaatgaatagacattaaactyatccatgaaatgcatgattgtattagcaaaatttattaactattttcagagtgataagaaaatataggaggtatgaaattagagcagagcaagaagaattttacaatacaattaaaatcatttagaaaacagtaggtagtagcaataataatgtgatgggaaattttatagaacacacaacaaaaaatgaggaggaaattagcaaaaataggagggaaggtggtaactacggaatagggaattgagtataatttaactcatgagtaatacggagcagaatattaatccacctgtaaataa

SEQ ID NO: 153280 - DNA, 601 bp, Human
ctataatcacagctgaaatcaactgtggaaatgaagcacattctaatttctaataaggctttctccaatctccagtactaattagatgtgattaagagcagccaacttgactgttaaagcttgcttcaggaagtatcttttttcttagaacaagtatgttgaaacctaagcatggtgctaaacacatcctccaagaatctccaagctctggcttggcacagactttctcttgacagctgctcagctgaaacaggactgggaaatagccacaatactggataatactggtggactcaagacytggaaagaatactaagacagaatccaatttgggcctgaactcccaaaccatcacaaaccaaccaaactcctatgataccctgctcaactgaacttcaaccccaattaactttaagaaatgactggagcttatccaaaactctggacatatatcctgtcatttaataaggaactggaataggaattcaaagcattctctcaaattcattattttggcattatgtactgagcatctcctacatgccagttaatgctgctggggaaaacagtattgaccaaaagcaacctgggctatgggacc

SEQ ID NO: 153281 - DNA, 601 bp, Human
aaatgaaaaaaatgagataattcatgaatgccagtaaaattaaagttctgtaagaaataaaacatagtcatagatactgacttagcaaatagtatttacacagccacaattatgaaaaaaccaaatataggttttattaaaagtacgatataactatattaggaggatgggggtgtagtatgaaatgtataagagaaagaaggaaggcaaccctataatcacagctgaaatcaactgtggaaatgaagcacattctaatttctaataaggctttctccaatctccagtactaattagatgkgattaagagcagccaacttgactgttaaagcttgcttcaggaagtatcttttttcttagaacaagtatgttgaaacctaagcatggtgctaaacacatcctccaagaatctccaagctctggcttggcacagactttctcttgacagctgctcagctgaaacaggactgggaaatagccacaatactggataatactggtggactcaagacctggaaagaatactaagacagaatccaatttgggcctgaactcccaaaccatcacaaaccaaccaaactcctatgataccctgctcaac

SEQ ID NO: 153282 - DNA, 601 bp, Human
cagattcataactgcggtcatctgaaataccagacaacctgaatcttctgacaagatcgatcaaaaactgcaatgggtcactaccgtttgcacaaaaactgcaatagagtcacccaaagagccaagatcttgagaaattttatctttcacaaatacagatgaacaaaacggacatctcttcatttactgagcaagtttcaacatttttatgtacatgcacaatgcttacacattacgtcacattgtgataatgcactttcatggagtcaaatatgcaaaaaaaaagtgcataaaatgaattagaattctctaaaagcctttacagaatttatacctgcagtattagaaatgatgcaaagataaaatacatagcatagcaaattggcactatgtgtgaaagggcagaagtcatacctgattgaataatttggcaggggagctttcttatatttttcacctgcatattcacttctatgatcttcaaaacattcacttgtgtttagactagagcggttgtggtctaaatattttgtaagtatatgctgaccatttagaaatctggttattgcttggccattgcaattaagtgattttctgtctt

SEQ ID NO: 153283 - DNA, 601 bp, Human
actctgcctcaacaaaataaaaataataatatatttagacatattataagagtagtcatctagcatcctcagaaaatagctaagcaaatataagttattttctcttttgccagattcatcccaaatgttcagatgtttaagagtgattacataggagaatacataagaaattggtaacagtggtttcttccagaagagaaagctagaagactaaaggaagaggggaaggagacttttttgctgtataccttttcgtatttttaaattcttttaatttttcaccttttaacctatcatacayacagactaaaatttttcttttagtatcatttatatggatattaaaacatatagaaattggtgtaaccagcattatatagtcagatacagaacagttccatcatcccaaaagactctctcatgtcatagatacatttccccatccataacctcttatacctttgaaattctggttcatgtgcatgtggtttctagtttttttggtttctctgtgttttaaattttttttcctgttttttaatttttttttttttttttttttttttgagacagggtgtcactctatcacccagggtggagt

SEQ ID NO: 153284 - DNA, 601 bp, Human
gaaggtacagaacaagacggaacagaggaagactttttttaaaatgccatcctcagactaggttattatatctgtgaggcaaataacagcagactaaaaaaatgaaaatttcagaaaataagaaacttttgaaatagaaaatacgggtgctgaaattttaatattcaactggtaaaactgaagaaatacccacaaggtaaaaccaagaaataaacaacaacagaaaagataagaaaaatatatatcaattgtgcctgtttcccatttctccaggcagaatttttttttttttttttttttkggtaaggagaagcaggagtaaaggggagtacctgaaatagaaatgaatcatgttaagaaatagtaaaatcaaaattaacttggttaataagtttgattttgataaaagtaaatagacatgctatatagaacaaatgaatgagtaatgtaaataacttaaaattgagagaaaagctctcttttcagggctagctacagctctcccacaaaggggcttttgcataccacataacctgggtatgagaaaaagtatgggcagagggcagtgttgagtttttgtatctgtaacttaaggtagtgt

SEQ ID NO: 153285 - DNA, 601 bp, Human
aaaatgaatgcagagagcacagaaggtacagaacaagacggaacagaggaagactttttttaaaatgccatcctcagactaggttattatatctgtgaggcaaataacagcagactaaaaaaatgaaaatttcagaaaataagaaacttttgaaatagaaaatacgggtgctgaaattttaatattcaactggtaaaactgaagaaatacccacaaggtaaaaccaagaaataaacaacaacagaaaagataagaaaaatatatatcaattgtgcctgtttcccatttctccaggcagaaytttttttttttttttttttttggtaaggagaagcaggagtaaaggggagtacctgaaatagaaatgaatcatgttaagaaatagtaaaatcaaaattaacttggttaataagtttgattttgataaaagtaaatagacatgctatatagaacaaatgaatgagtaatgtaaataacttaaaattgagagaaaagctctcttttcagggctagctacagctctcccacaaaggggcttttgcataccacataacctgggtatgagaaaaagtatgggcagagggcagtgttgagtttttgt

SEQ ID NO: 153286 - DNA, 601 bp, Human
gttcaaatatgaaaaaataggagaaaacttgattaaacaaaatataaaaagtaaaatagacaggctacaaaaatgaaaattatactgtattagtaacaagtacaattacaaaggatggagaaagggatgtctataaaggaaggttagaaaagtcaaaatacatttccaattaaatgtaacagattaaatcttttgtctccaactcttgaaacatcactaaaatgacatcagcaataaaacaggcatataaagacaaaaagaacaaaagagacagcagtaatcaagaggagtcaccaaggaygacaatagataaacagtaataaagactaagcctacaagagaaagctaaaacctaagcctataggggtagaaaccagtaaaaaataaacatctgcatacaaagcctgggaagccttagaaattggaaacacagggaactgctcaaggtagaagtgagagatgagctgaaaacaggacaagtgcttgaagtaagaagcttttaaactcacccatattggggaataagacctataatttactctagtaaggctgaaccagctctgctctcaaggacaccaaggcagggataaggcatcctaag

SEQ ID NO: 153287 - DNA, 601 bp, Human
ccaccatatgcctgtgacaataatccacaccagaaaggatctgttggaacagacgccgactttctttttcatccagctaagaaaagttagagaggctttttaaaggtgtgtctttcaaagtaaattgtcctatctataattctccaacctataaaattgtcaaaatacatgaaaatcttccgaatgaacttcacttatgagatacttttgacatgaggaggagatacctgcagcacaaaacagaaatgctaagatggtcttggaacccaaatcagtaactcaagtttctaatattatcatytgcatatgactacattgtaacagcttgccttcctctatatctcatgagttatttcaaataatttcaatatctacttgaaatttggcatatttccttttataagcggcaaatgtttactctttcattcttttaacaaattactgaataccttcaacgtgctacacattgctttagacactcattacacagcaatgaataaaacaaaggctaatctagttgatgaaaatagactaataaatatagtcagaaggagtgatactgttttgaagaaaaataaagcaaaatataggtgcagtgagt

SEQ ID NO: 153288 - DNA, 601 bp, Human
ctcctgacctcaggtgatccgcccgcctcggcctcccaaaatgctgggattacaggtataagccaccacgcccagccaaaataaattcatttttaacaatcaaaatgttctttaaacaaattataatttactatcatttaaaacatttttaaatttttaaataaatttttttaattaaaaaattgttttaaataattttaaataattaaattcacatagttcacttctggtttttaaggttttaaataattccatcccactcactttccttcttctccatacttgattcttttgaacataytggaaataaagctgctaccttctctttcacaaataatactcttttcaaatagtctctctaatactaccaacttaagttgtttaaaatttaattttaaagatatttaaagagccaggtgcagtggtgcacacctgtaatcccaatactttgggaagctgtggtaggaagatcacttgaggccaggagttcaagagcagcctggacaacatagtgagaacttgtctctacaaaaagacaaaacagcctggcatggtagtgcacgcctgcagtcccagctactcaggaggctgaggcaggagg

SEQ ID NO: 153289 - DNA, 601 bp, Human
tgtcaaggttacagcggcagaagataaaagctttcaacatctggcctgagcccaggagttccgagattatcctgggtaacatgacaatatcccattctctacaataaatacaaaaattagctgggcatgtggcagcgcacacctgtagtcccgggtactcgggcggctgagatgagattacctgaggctggggagactgaggctgcactgagccgtgatcgtgccactacactcaagcctgggcaacatagtgaaaccctgcctcaaaaacaacaataaataaaaagcttccaacatctcrtccccagtaaccatcagggtactgttatctttttacaagtaaacacgagggtttcattcaagcccactggaccaattatgatcgaacatacaaactgtacctgaatctgcggtatacaatttttaggtgcctcattcgaccagttccggtggtatttcgtcttttagccttggcactccagttatctaaaacataagttcagaaaagatttcaaacggtgttctcccacacaccttgtaggtgttgttaacacacgagttttatgccacctcatcggcatacagatgtacgagttttaag

SEQ ID NO: 153290 - DNA, 601 bp, Human
taactcctatattgtactaacagaccactcaacattaagcccacaaaaacgttatgaccctaaatgcaaagaaagttgcttcagcacatgaacacacctatgggtgtctacaaagccctgaactgtcttgctatctttaaaactggacactccggagactgagtgggtagaggctagggattctgcaaaatattcaattttgcactggacaatcccaccacaaagaattatccagcccaaagtatcaatagctgagaattgctgaaatagaacatagtaacggaaggagcaccagctttawagttaagtctgcatcattctgaatcttagctgagatcttagatgggttaatctcttagaaactactctttaatatgcaggttctctcagctaagtctacggcggagctgagattctgcatttataactctaaggccaagacttgagtaacaagagcccaaggcaacagcagcaaccagggcaattttctacagcactcttgcccacagccactatactaaaggttgaaccaagcctgactccagaccttattcactactgtcttgacaaattttgacaccaattaaacctaataaatatc

SEQ ID NO: 153291 - DNA, 601 bp, Human
aaatgcaataaaaacggtaaaaaagacacatttctggtcaacaacaaaagaaataatttctaaattaaaaaaaaaagatggctgctgtagtactttttaaaattttagaagatcaaatgggagaaacacttgaacaattagaaatgagaatcctaagtggagggtaacacgaaagaaaaactaacaggaattctagaaaggaaaaagaaatcgatgaagaacaagtattcacccaacaggtaatacatcaatgtcttcagctaaagaaaaacgagtgttcagacagaaaaggcttactgartcactggcagaatttttgaaaacgacaaatagaaatacgtgaaaaacaaacaaacaaaaaaactgtgagtgttctgttatttagtagctaatcttttctctttttgaagtttagttctctggttgaatccaatttccttgatcttaatgtaatgataacattagactacagaaaattaattagttacagaaaattaatacattatattgagaatatgtagtgtatattgtctcagatagtgaacaccattataattatgtaaaattccaacctgttccatttggccacatttactgcaaa

SEQ ID NO: 153292 - DNA, 601 bp, Human
tcctgtacacataaatggcaaggcaatgttaacagtttatctagaggatagtatagcttgaaagagagttaccaagctaaaaaagttcacatggccatcattggaagggcatattaaaaatgggttagtaaaaatgcaataaaaacggtaaaaaagacacatttctggtcaacaacaaaagaaataatttctaaattaaaaaaaaaagatggctgctgtagtactttttaaaattttagaagatcaaatgggagaaacacttgaacaattagaaatgagaatcctaagtggagggtaacaygaaagaaaaactaacaggaattctagaaaggaaaaagaaatcgatgaagaacaagtattcacccaacaggtaatacatcaatgtcttcagctaaagaaaaacgagtgttcagacagaaaaggcttactgaatcactggcagaatttttgaaaacgacaaatagaaatacgtgaaaaacaaacaaacaaaaaaactgtgagtgttctgttatttagtagctaatcttttctctttttgaagtttagttctctggttgaatccaatttccttgatcttaatgtaatgataacattagactac

SEQ ID NO: 153293 - DNA, 601 bp, Human
gcacccataccaaagaaatacccaggccaaaatgtcaacagggctatcttcccttgcctgttaatttgagacctgacatccacaggttgttgtgggattcccctcctgtacacataaatggcaaggcaatgttaacagtttatctagaggatagtatagcttgaaagagagttaccaagctaaaaaagttcacatggccatcattggaagggcatattaaaaatgggttagtaaaaatgcaataaaaacggtaaaaaagacacatttctggtcaacaacaaaagaaataatttctaaattaaaaaaaaaagatggctgctgtagtactttttaaaattttagaagatcaaatgggagaaacacttgaacaattagaaatgagaatcctaagtggagggtaacacgaaagaaaaactaacaggaattctagaaaggaaaaagaaatcgatgaagaacaagtattcacccaacaggtaatacatcaatgtcttcagctaaagaaaaacgagtgttcagacagaaaaggcttactgaatcactggcagaatttttgaaaacgacaaatagaaatacgtgaaaaacaaacaaacaaaaaaactgt

SEQ ID NO: 153294 - DNA, 601 bp, Human
ctttaactaaaataaaagggacaagttaaataggaaggtctagacacaaataaggtgaaatgtcattaacgcagtctcaaaggagacaacctaaaaaccattggcttaggcaatgcttgcttctccagcaaattaagataaaaacacacatccatagttgtctagaggttccaggccaaacgacctgagtacagccctatgaatcactatagatgatttattcctgacccccaattttggatgcaactctgggagaggtggacactcttatcagtgtctttcctgtgtacacttgagaacwgaggtctattcccacaccaaaagaggtctcatcttgctattttgacaataccaatctactatagcagaagttctcaaccaagggcagttttgtcccctagggcacatctggcaatataatacatggaggcatttctggttgtcagagcaagggggtttgttactggcatttggtgagtaaaggccatagttgttggtaaacattctataacacacagaaaagcacccacaccaaagcaaagaaaagcacccataccaaagaaatacccaggccaaaatgtcaacagggctatcttccctt

SEQ ID NO: 153295 - DNA, 601 bp, Human
gagcaatttttccactttaactaaaataaaagggacaagttaaataggaaggtctagacacaaataaggtgaaatgtcattaacgcagtctcaaaggagacaacctaaaaaccattggcttaggcaatgcttgcttctccagcaaattaagataaaaacacacatccatagttgtctagaggttccaggccaaacgacctgagtacagccctatgaatcactatagatgatttattcctgacccccaattttggatgcaactctgggagaggtggacactcttatcagtgtctttcctgtrtacacttgagaacagaggtctattcccacaccaaaagaggtctcatcttgctattttgacaataccaatctactatagcagaagttctcaaccaagggcagttttgtcccctagggcacatctggcaatataatacatggaggcatttctggttgtcagagcaagggggtttgttactggcatttggtgagtaaaggccatagttgttggtaaacattctataacacacagaaaagcacccacaccaaagcaaagaaaagcacccataccaaagaaatacccaggccaaaatgtcaacag

SEQ ID NO: 153296 - DNA, 601 bp, Human
agtcacgatagtaaggaagaagcatgattcagggacagcttccaagtttcttttatttctggctggacggtttagtcattcattgagagaaaaaaagagaattaaagagtatcagtcttggagatgatcctaaatttagtttttagtatacttgagtgtacattgtctctgggatagctacataaagatatagctgctggatatatgagtctggagaaagaggcttgggatagatgtaagtttgtgagctgactacacagaggttgttagtgaagctatacacaggtcagagatcacctayagagaaattataaacacagaacgggggctcagattgagccttgaagtaatcttggaaattgaaacagcatattcaggagtcagcgaagtttttgtaaagaaacagagtaattactaaatattttaggcttattggccaccaagatctctgttgcttatttttaaacaaacctgtaagtgtaaaaacactcttagcttgtgggcagtgcaaaaacaggccacttgttggatgtggcctgtgggccttgtgatccctggcatttatcaacaactttttattagtttcactctgaaaaggaga

SEQ ID NO: 153297 - DNA, 601 bp, Human
atggagcaataggtagatttaagagatttcatggttaaaacgtattgggtttagtcacgatagtaaggaagaagcatgattcagggacagcttccaagtttcttttatttctggctggacggtttagtcattcattgagagaaaaaaagagaattaaagagtatcagtcttggagatgatcctaaatttagtttttagtatacttgagtgtacattgtctctgggatagctacataaagatatagctgctggatatatgagtctggagaaagaggcttgggatagatgtaagtttgtgagytgactacacagaggttgttagtgaagctatacacaggtcagagatcacctatagagaaattataaacacagaacgggggctcagattgagccttgaagtaatcttggaaattgaaacagcatattcaggagtcagcgaagtttttgtaaagaaacagagtaattactaaatattttaggcttattggccaccaagatctctgttgcttatttttaaacaaacctgtaagtgtaaaaacactcttagcttgtgggcagtgcaaaaacaggccacttgttggatgtggcctgtgggccttgt

SEQ ID NO: 153298 - DNA, 601 bp, Human
agaaacaaacaaacaaaataaaacaaagtaatccttgcaagattaacaggagccagaccatgcaaagcctggtggatcaaattaaaaaaatatatacttcaagaccagggaagtcattactgtgtgtgaacaggatgtaaagcaattagacttgtatttcaaaactatcattctagccgtgatacggaaagtggactggagatgttaaagaggggatctagagacactagttagtcaatcagtaattcaagcaagagttaatgaaagcttgtaggaggataaactggtagatatggagcartaggtagatttaagagatttcatggttaaaacgtattgggtttagtcacgatagtaaggaagaagcatgattcagggacagcttccaagtttcttttatttctggctggacggtttagtcattcattgagagaaaaaaagagaattaaagagtatcagtcttggagatgatcctaaatttagtttttagtatacttgagtgtacattgtctctgggatagctacataaagatatagctgctggatatatgagtctggagaaagaggcttgggatagatgtaagtttgtgagctgactaca

SEQ ID NO: 153299 - DNA, 601 bp, Human
aaaccaaactttccacttgaagtaatatgagaattggtttactgtaacatttaagtgcaaaagaggaggtaagaatgggatcactgtgtaagtttcataaagtaatcaactaatcttaatcctcccattttcacttggaaaggaccaagaaacctttttcaattttgataagtcaatctgataaaaagtgaactataaataagagacagcattgttttagcagttaaaacacttgtttaaaaaaaactatctggactctgacaagccggttagattgacaagatctgtgaaatcagttttrgagtttttaagccctggtatcttattcacaaaagactgtataacatggtcaatatttaaagaccttaaactatcttctctttcctacatttttgataaacattaataacagtaaagaaaccaggcgcagtgggattacagtcctgaggccgaggcgggaggatcacttgaggcaaggagtttgagaccagcctggccaacatggtgaaaccccgcctctactaaaaatacaaaattagctgggcatggtggggcgcctgtaatcccagctacttggaaagctgagacacgagaattgctt

SEQ ID NO: 153300 - DNA, 601 bp, Human
actttcatgatttccaaaaatagtaacaaaactagaacaaaatttaacactctgtatcttttttaaaacattacttgtaacttttatgattagtaaaaactgtagttttgatagaaaacagtcttggtgttatattgtcatagggctcaggtacataattttatatgcaaaccaccattctcctaggttttctatacacatggcctttatgatactaatcattctttgaaattattaaaattaatgtccacaactggaaaatatgttcacttatactatttgggtaaacagtctacataaygaaaaggaattgatggaccctcagacatcactggggaacttacaagagattcaagaaactgctaaatgagcaaagatagagggaattattattcgatgcttgttaaatcttcatgtacatcaccacaccagcatatcaagataggaaaaatattactcaggaaagttaattccacataaaagtatcctttctatggagaagaacttaaaccaaactttccacttgaagtaatatgagaattggtttactgtaacatttaagtgcaaaagaggaggtaagaatgggatcactgtgtaagtt

SEQ ID NO: 153301 - DNA, 601 bp, Human
aataaaaatatatatataataaaaaataaataaaaaataaacaaaaaaattctgatgttcatgaagcttctaatgaacaattacgtagcctagttttgccttcatgacattcttactgctcagacgccgcacccaactttaatactaaactttttttttgagacgtagtctcactgttgcccaggctggagtgcagcagcgcgatctcagctcactgcaacctccgcctcccgggttcaagtgattctcctgcctcagcctcccgagtagctgggattacagttgtgcaccaccatgccccgctaatttttgtatttttagaagagacgaggtctcaccatgttggttaggctggtctcgaactcctgacctcgtgatccacgtgcctcagcctcccaaagtgctaggattacaggcatgagccaccatgcctggccaatactaaatattttaacaaaatgttttactttcatgatttccaaaaatagtaacaaaactagaacaaaatttaacactctgtatcttttttaaaacattacttgtaacttttatgattagtaaaaactgtagttttgatagaaaacagtcttggtgttatatt

SEQ ID NO: 153302 - DNA, 601 bp, Human
agtataataaaaatatatatataataaaaaataaataaaaaataaacaaaaaaattctgatgttcatgaagcttctaatgaacaattacgtagcctagttttgccttcatgacattcttactgctcagacgccgcacccaactttaatactaaactttttttttgagacgtagtctcactgttgcccaggctggagtgcagcagcgcgatctcagctcactgcaacctccgcctcccgggttcaagtgattctcctgcctcagcctcccgagtagctgggattacagttgtgcaccaccaygcccagctaatttttgtatttttagaagagacgaggtctcaccatgttggttaggctggtctcgaactcctgacctcgtgatccacgtgcctcagcctcccaaagtgctaggattacaggcatgagccaccatgcctggccaatactaaatattttaacaaaatgttttactttcatgatttccaaaaatagtaacaaaactagaacaaaatttaacactctgtatcttttttaaaacattacttgtaacttttatgattagtaaaaactgtagttttgatagaaaacagtcttggtgtt

SEQ ID NO: 153303 - DNA, 601 bp, Human
tttacatttatcctgcttgctcggcacagggcttttttaaattattataataattttaaaccaaccgaaaatatttctgatcaaaccttgtaacttaaacatataccatagagataattctgatgttcatgagaacacttggacacagaaaggggaacatcacacacccacaccggggcctattgtgggcgggggggaggggggagggatagcattaggagatacagctaatgtaaatattgagttaatgggtgcagcacaccaacatggcaccatgtatacatatgtaacaaacctgcaygttgtgcacacataccctagaacttaaagtataataaaaatatatatataataaaaaataaataaaaaataaacaaaaaaattctgatgttcatgaagcttctaatgaacaattacgtagcctagttttgccttcatgacattcttactgctcagacgccgcacccaactttaatactaaactttttttttgagacgtagtctcactgttgcccaggctggagtgcagcagcgcgatctcagctcactgcaacctccgcctcccgggttcaagtgattctcctgcctcagcctcccgagt

SEQ ID NO: 153304 - DNA, 601 bp, Human
agtttttgatctagttctttctcagcagccaaaatgaacttaagagttaaacagataaggaaccaagagaaatcaccaggagcagcacaggccacgggtaaacaggtaaccctgatctaagatcccaaaagtgaacattagctccagagagacttgactttaaaaaatgaatggcatgaaaagatgcaatcaatatccagtcagctcctctggaaggagtttcatctcaaatttatttatttacatttatcctgcttgctcggcacagggcttttttaaattattataataattttaaacmaaccgaaaatatttctgatcaaaccttgtaacttaaacatataccatagagataattctgatgttcatgagaacacttggacacagaaaggggaacatcacacacccacaccggggcctattgtgggcgggggggaggggggagggatagcattaggagatacagctaatgtaaatattgagttaatgggtgcagcacaccaacatggcaccatgtatacatatgtaacaaacctgcatgttgtgcacacataccctagaacttaaagtataataaaaatatatatataataaaaaataa

SEQ ID NO: 153305 - DNA, 601 bp, Human
tccgtctctactaaaaatacaaaaattagccaggcgtggtggcacatgcctctaatcccagctactctggaggctgagggaagagaatcagttgaacccaggaagcagaggttgcagtgagctgagatcacgccacggcactccagcctggacaacaaagcgagactccatctccggggagaaaaaaaaaaacccaaaaaactagtgtccaaagaaatgaagccaggagtataattccttgcaattaatcaattgatgatatgtttacatattatgtaaactaactaaactgaaagactgsgtctaagaagcacttaaagcaaaggtcttaggagccctaatttttaaaaaacagatgcatttgtgaaattttagaatagtatgaaggttatatgaataaaatgtatttcaggaatgaatctatgctgtaaaagcactgttatatttttaccattttgaacttctaagtcattaaaagaagaaagccggactgcctgcctgtaactagcctgatcacctatgtaggccttccaaggagaactggatattagataaggaaatcagggtttgctgaatgccaatgaattgctcagtggcttgc

SEQ ID NO: 153306 - DNA, 601 bp, Human
ttcccttgacaaacaccaataaaatggaaagttaaattgtgtgctcaagttgcccaagaataactccagtgatgtcttgagtgagttaaagtgagcaggtggcattggcctcccatgagttcacattgaaggtcagaggagagtatgctcttttaccaaattgttccattgggcattccatgaataacacttgaaaagttctatcccttccaagacaaggcttgatttccccacctcactgcagtttcactccatcatgccaaactcttttacacccctaagtatttatttgctgttgttrcctctctgtatgatggcttccctcctttgtcccatacaaagaatgccagctaagtaacctcaatttccccttctgtgaaacaaaaatagtaatacctatttccaaaactatgttatgaggactaaataatgcacacaaaagacttggcaatgcatctattatatcaataaatcttagatccatttcccattgcgctcatgtttaacaatacttggcacatagtgaaaatgcaaaagcctcatgcattcatgaatgcatgcatggatgaaaaagagaacagttaagaactagtgtcccacc

SEQ ID NO: 153307 - DNA, 601 bp, Human
tacaaacacatcagaggtcagagacatgctctcaacccccaatcctaacccttgctctaatcccaactcagaaaaagtgaatgatatagttcaaagcgttaaactcgaactggcctattgcttacttttgtgtaatttcctttccttttcatgctccatcttacttgtttttgcttctttccatttgtctatccatcctaccacctttgacctgtttcttaaaatcaaatgcaagggaaaaaaaacatcactggagaacagactaagttgtttgcatcgtggtagaaaagaaggttttgayaacaaagtgaagatttgtaaaatgatttaaatttttgttgtgtatttctttaatgctctgtgtttaatgttgtgtctctttaccagtgtaagaatgacttcccttgacaaacaccaataaaatggaaagttaaattgtgtgctcaagttgcccaagaataactccagtgatgtcttgagtgagttaaagtgagcaggtggcattggcctcccatgagttcacattgaaggtcagaggagagtatgctcttttaccaaattgttccattgggcattccatgaataacacttgaaaagttct

SEQ ID NO: 153308 - DNA, 601 bp, Human
ttatgctttgagctgtaaagcaaaataattatcagggaaaaaattaggacctccaagaagactgaggagtacaaacacatcagaggtcagagacatgctctcaacccccaatcctaacccttgctctaatcccaactcagaaaaagtgaatgatatagttcaaagcgttaaactcgaactggcctattgcttacttttgtgtaatttcctttccttttcatgctccatcttacttgtttttgcttctttccatttgtctatccatcctaccacctttgacctgtttcttaaaatcaaatgyaagggaaaaaaaacatcactggagaacagactaagttgtttgcatcgtggtagaaaagaaggttttgataacaaagtgaagatttgtaaaatgatttaaatttttgttgtgtatttctttaatgctctgtgtttaatgttgtgtctctttaccagtgtaagaatgacttcccttgacaaacaccaataaaatggaaagttaaattgtgtgctcaagttgcccaagaataactccagtgatgtcttgagtgagttaaagtgagcaggtggcattggcctcccatgagttcacattgaaggt

SEQ ID NO: 153309 - DNA, 601 bp, Human
atatccattctttaggtctataattttgctggctttttttttctctaaatgaaaaagttctttacccgcaaggactaggtatgccaaaaaaaaatgaataagaccaaccaaacaacaagggaagggtagcttttctagacacagaacttagacataaataacaatttcaagtttaaagatgagaaagtattcacctgtctggaacattttaaataaagccttcctgaagacacagaaaaggactaaactctctttgttctccagttccatataatcaatatttactcaaataccgcaccctcccccacctccagcattccacgtaatattaactaggagctggaaatcatgaagcaaaccacaagctgagcaactgctaagccgctatgcagtgatttttaagggtggttcttctgaggcaggtttccaaagaccttggagccactccaaaaaacagtaagctgggaagacaattgcctccccactccatgtacgtacactagggccctaccttatgtacgtattagaggcccgttaatatttcctgcaataatggttcccgctaatgagaaaataaattatttatcactgtactaagaaa

SEQ ID NO: 153310 - DNA, 601 bp, Human
attcaagagggcttcccctgtttcctggagtccccacactttacccagattaatgccaactcttaagtaggtactgttccctcacccattcacccatcctcagttcatcctcaattccctttatctgctaccaccaatgccttacgaagataattataatatattcttagataatacttggccaaaatatacaattcactcttttaattctcaccttcaaaaatatccattctttaggtctataattttgctggctttttttttctctaaatgaaaaagttctttacccgcaaggactagrtatgccaaaaaaaaatgaataagaccaaccaaacaacaagggaagggtagcttttctagacacagaacttagacataaataacaatttcaagtttaaagatgagaaagtattcacctgtctggaacattttaaataaagccttcctgaagacacagaaaaggactaaactctctttgttctccagttccatataatcaatatttactcaaataccgcacccccccccacctccagcattccacgtaatattaactaggagctggaaatcatgaagcaaaccacaagctgagcaactgcta

SEQ ID NO: 153311 - DNA, 601 bp, Human
cccatcactgcccacccaaaactgtctgcaaatgtgactttaaatgactcattcaagagggcttcccctgtttcctggagtccccacactttacccagattaatgccaactcttaagtaggtactgttccctcacccattcacccatcctcagttcatcctcaattccctttatctgctaccaccaatgccttacgaagataattataatatattcttagataatacttggccaaaatatacaattcactcttttaattctcaccttcaaaaatatccattctttaggtctataattttgytggctttttttttctctaaatgaaaaagttctttacccgcaaggactaggtatgccaaaaaaaaatgaataagaccaaccaaacaacaagggaagggtagcttttctagacacagaacttagacataaataacaatttcaagtttaaagatgagaaagtattcacctgtctggaacattttaaataaagccttcctgaagacacagaaaaggactaaactctctttgttctccagttccatataatcaatatttactcaaataccgcacccccccccacctccagcattccacgtaatat

SEQ ID NO: 153312 - DNA, 601 bp, Human
aaagccacgtagcggtattaagagaccagatgtgaatcagagaaatgagtaagaagggcagaacccttgtttggacatcctgtgcaaaccccatcactgcccacccaaaactgtctgcaaatgtgactttaaatgactcattcaagagggcttcccctgtttcctggagtccccacactttacccagattaatgccaactcttaagtaggtactgttccctcacccattcacccatcctcagttcatcctcaattccctttatctgctaccaccaatgccttacgaagataattataatayattcttagataatacttggccaaaatatacaattcactcttttaattctcaccttcaaaaatatccattctttaggtctataattttgctggctttttttttctctaaatgaaaaagttctttacccgcaaggactaggtatgccaaaaaaaaatgaataagaccaaccaaacaacaagggaagggtagcttttctagacacagaacttagacataaataacaatttcaagtttaaagatgagaaagtattcacctgtctggaacattttaaataaagccttcctgaagacacagaaaag

SEQ ID NO: 153313 - DNA, 601 bp, Human
gaggggaagggcacaaaagccatgctaaaatgtgcggacctcatcctgtaggcaacaggaagccactggaggacactcaggcagggaagaacaatgtcaactctgcacagcaagatggaaccgactgtgcaagagtgacaagaagactgcttagaaactaacaacacaaagaaggaaaggaagacctaaacaaaggcagggacagaaacaggccccaggtagacaggaactacttagggtgattctgttttttggatgagaaagaggatggctgactttgcatttctccatagtaggcttggtgagttgtcagcatacgccggtagtagctggagggggccaccacgcaagacaatattaatggggtggaaagagccagaggagaaggaaagggaaggtgacctacaatcagagtggcagctagtatctgctgagtgcagcaatgcaccaggcaccgtgcacagagcttcacatagatcatctcagggaaatcccatcttacagacaaagaaacatactggctcagaaaggttttagcaagtgagtcacccaaatgaccatcaaacaagcaagtagcagagatgggacttgaagccacagg

SEQ ID NO: 153314 - DNA, 601 bp, Human
tcagttcagtggccttctctctttagtggcactaaattaggcttcctgaaaaagtggcactcatggatccaggagatagtgacaaagactctccctttgaccacactttgaagaggctcccctgagccctcttctcaactagtccttgtcattgggcctcctttgcctgcctagcaagaagcttgctaagtcagtttaaggaggatacccctacttttggtatctgatcaccctctgttatgaaccgaatatctgtgtcccctcaaaattcatatgttgaaaccctaccccaccacatgayggtaaataggaggtagagcctttgcgagataattagaattagatgaagtcatgaaagcagggcccccaaaatgagatcagcatccttgtaagaatccagagacagcttgcctctctctgctctgtcacgttaggctacaataatgtctagaagagagccctcaccacacccaaccatgctggcaccctgagacttccagtcaccaaaactttgagaaatgaatttccttctttataagccacccagtctatagtattctgttacagcagcccaatgaactaaggcaccctctatatctga

SEQ ID NO: 153315 - DNA, 601 bp, Human
ggaggcggagcttgcagtgagccaagatcgcgccactgcactccagccaaggtgacagagcgagactctgtctcacaaaaaaaaaaaaaaaaaagttagtgatatcattagatcctgagagtcataaggctttattaatactgagccataaatgtttatcttacgctaaatggaggctcccagaatttactttaccaataaatgtttttacattccctcaaaactcctgcttaggtaccatctaaactgagaaacaaacagctaaaaggactgtaaagctagcctcgtttacaatcttacrtgtcttattataaatgcacaaaagcacagtcaccaaaaaggaggaaagtttcttttccatcttagcctccaattgttgctatgccaacaataacataatactaatcaaattttaaaagatgacaacagagagagatagccatggtgaagaacttccccagggcatagtgtcaaaggtcagttcagtggccttctctctttagtggcactaaattaggcttcctgaaaaagtggcactcatggatccaggagatagtgacaaagactctccctttgaccacactttgaagaggctcccctg

SEQ ID NO: 153316 - DNA, 601 bp, Human
agaggaatacaaatctttgaatttagaactttataaaggtgtattggaagacattcttcataaagcttcctgttacacattactttatcatatatatacactgcttttaataaccaaaatatcttcgtatttcaaaaaaaattagtgatatcggctgggcgcagtggctcacgcctgtaatcccaacactttgggaggctgaggcaggcggatcacaaggtcaggagatccgagaccatcctggctaacacgttgaaaccccatctctactaaaaaaattaaccgggtgtggtggcaggcrcctgtagtcccagctgcttgggaggctgaggcaggagaatggtgtgaacctgggaggcggagcttgcagtgagccaagatcgcgccactgcactccagccaaggtgacagagcgagactctgtctcacaaaaaaaaaaaaaaaaaagttagtgatatcattagatcctgagagtcataaggctttattaatactgagccataaatgtttatcttacgctaaatggaggctcccagaatttactttaccaataaatgtttttacattccctcaaaactcctgcttaggtaccatctaaact

SEQ ID NO: 153317 - DNA, 601 bp, Human
gacttgtttggaaaaacaaatatcacatttgctttagaaagaggaagctaaatttacccaagcctttcatagccttccgaagagtttctgcatcagcccgctcatcaaatccagggaagtcagtcacagtgcctctgagaacctaattcacgaaacacagtggtattattcatatcatgactaatatgacaaagtaaataacacaaacaggaagccgcttgctatatatcatattcagtcattaaataaatttaccatttgataagatttgtgaccccttttgaactgggaagggaaccayttacaatgggaattggcatggccgattcagcacagaagctatcctgatcacctgtaataccatcagtgggaaggctggctccctcttctctgtgacgaaaccccaccaacacctcctggttcacagagggcacatctttgcaggttcccttcccattaagtctcacaccattttgatctacaagcatactgagcccgcactaaatcttaataccctatcctgagtactcaattttaagcagtgctcttgttacgtgccttttgatctaagtcctgtttctgtatacttacttagggactt

SEQ ID NO: 153318 - DNA, 601 bp, Human
agtggggaaatacagggctttcataaacagcagataagccaggatggttgggtctgagaacacattaaacagtaatgggagatgagtctgaaaaggtgggctggatacaatggaaggacttacagggccagaaagcacatgaacagtagtacaaaaggagcctgagcacaggagatcagtgacacatggaaatccttgagatgagaggtttttaaatgactagaaaagaggctggggaaagagaagagtctagcagaatgagaatgggatatctgattgggaacagagctgcacagctgcycacctgcagggatggctgccttatcgactcgggcctctaccacacaggtgagggtgacaagctcaaaagcacagaggctgaatttaactgcctgttcagttctagagactgaatattagggatggtttatagcaagcttgtccaacccatggcctgcaagccacatgtggcccaggacagctctgaatgcagcctaacacaaactcataaactttctgaaaacattatgaaatttttttgcttttttttttttttttttagctcatcagctatcattattgttagtgtattttatgtgtg

SEQ ID NO: 153319 - DNA, 601 bp, Human
ataacattcaaacacataatagattatagtcattgttatgactcctgaccactgggagatatctgttcctatggggaaattgtgtatgtaattatgaaaaaattatgtaattgtgaaaaaaaaaacacagtatttcctacctataagtttcagcataccacacaactaaaaatggtgtttagaatactttcttttttgctttgcacttgtttccttagttaagtgacatacgttttcagaataacaagactacatttaagttttccatgcatgcactaattcatttaaatttaaataattcaaataattcatttaaataattcaaataaatttttttgaattattaatcaaataaaagcatttaaatcaactaattaaaaacccattagttaaaatcatgacaaaaggaaccaagactgtgactgtgttaaaacaaaacatattttaatacaggcttacacctagaaaacggatagtaagacatccatgtgaatgctgagtgggaaacacagaggaaaagaagagagacagttctcactacaggatcttttggcacctctacagcattaggcaaggaaaaacaattatgtgaggataagct

SEQ ID NO: 153320 - DNA, 601 bp, Human
agataaaatagctcatctgtaatattttttaaacatcctcaaaatcagaagacaggcatgaaaataaaatacaaaaagctataaaaatatgaaaattttaaacagcccagtattattgagtttaaatctacaaaaagatgaaatgacacacgtgtaattttctccctcctttactgcttattgcctcccagttttgtctgccaagcaactctcactgaaataatcagataaaattttttaaatataacaaataagaggaagtaattaccaaaacaaaataatactatctatgcaagaatgytcctttcactcatcctttttaccttcaaggcatgtttcagttcataagcatcataaagccgagagggtttcatcagagccacaattaatttttcaaattttccagttagttctgatttcaggtcatccagaagatcctaacccacagaaaatacaaatttgttaaccagcagaaattgtaataagattcttcttaaatatgaatgacagtcctttgctctaatgaattctttatgttgctgtctccaagtagaaggcccatgagctaaacaaaaccctataaccttgaataacatacttt

SEQ ID NO: 153321 - DNA, 601 bp, Human
tatccagtataacatggatttctttgtatatgagttctattagttatagaaataacaagttttaaatgattttctctccaaagaccattttattctttttgcctaatggaaaacaatgtttatcatgtgtatgtgtgtatatatgtgtacgtatacataaccagttacataaatttgtaacttttaatttgatcagttaattctagcttaaaagtaaaacattttcatgaaacatgaagtaattttttaaaaaccgaaagagtaaaaatgaaaacttcacgtaaatgtacatggaagagcrctgatacttaataagcacctcaaaagataaacccctgacccccaagttaagtgctgtgcagtcacaggaaaattctacatcaaaggtaacaataaatatagcaatacttaattattaggaattagaacagtataaaggaattgggacttgctttctggatttttgaaaaatcattttagttggctttcctttttctgcttttaaaaatcacatctatatgattaaactaagagatgcaacgatatagctggacttaattttttttaaaagatagtatattgaagccttattttctttata

SEQ ID NO: 153322 - DNA, 601 bp, Human
aagaaagttatagatgttacccaaattgcatagttatataaatattatccagtataacatggatttctttgtatatgagttctattagttatagaaataacaagttttaaatgattttctctccaaagaccattttattctttttgcctaatggaaaacaatgtttatcatgtgtatgtgtgtatatatgtgtacgtatacataaccagttacataaatttgtaacttttaatttgatcagttaattctagcttaaaagtaaaacattttcatgaaacatgaagtaattttttaaaaaccraaagagtaaaaatgaaaacttcacgtaaatgtacatggaagagcactgatacttaataagcacctcaaaagataaacccctgacccccaagttaagtgctgtgcagtcacaggaaaattctacatcaaaggtaacaataaatatagcaatacttaattattaggaattagaacagtataaaggaattgggacttgctttctggatttttgaaaaatcattttagttggctttcctttttctgcttttaaaaatcacatctatatgattaaactaagagatgcaacgatatagctggactt

SEQ ID NO: 153323 - DNA, 601 bp, Human
aagagagattcagccctttagaaaggtaattatacagttgctctaaacaattttttgctgttttgacttgctgggttaacaaagccatttctaagattaacaaactaatggcaagatacagcccctagcaaaagacactaggcttggagtctgttgactgagctgagaaactggatagtctgaccctcctcagtcaggcaggagaaagagttggctacaagaaatctggtaagaaaaggactctctacctctactttttacttcattttcttgattctattcatgagacatattttaggcygaaatgcagatttctgttcatataaaagacacactaaaaagaaaaatcaaaatgcagaatattttattcaagcactgccattagctaagacaacatacatttactcaaatgtactttatcaactctgatgtgggaaagggtttaggtttctcttccaaagttccaaaagtactttttatataactcctaaattttgctagcataaagctaaatatttttaaaggaggaaaaaccatttttaccttaatgttaacataaagacaacctgtatatccctacactaattgcaaatcctatgca

SEQ ID NO: 153324 - DNA, 601 bp, Human
tttgaccaatatttcaccagtcccttctcccattcaccccacccctacaccctagcaaacactgttttactatctgtttctatgagttcaatttttttagattcaacataagaagtgagatcatgcatagcttatgccttgtgcctagcttatttcactttgcattatgtcctccacgtttatccatgatgttgaaatgacaggatttcccctctttaagactgaacagtactcctgtgtgtgtgtgtctgtgtttgtgtgtgtgtgtgtacgtattctttatctattcatctgtcaatgracactttgtaaacccacctagtcttgaaactctgctgcatgtgtgatttgtaccatgaagcctccctaacatccaaagctatgatgacctctctcttctgaatgcattattgcatttaacatcattggtattttactttagtttgaatttcattatcctttaaatattgcagtcattctgtcatgtcacccactgaggagactgcacacaaactgcttgaggacaggagctgtgttatgcacaccttttgtcactcatgacagcctgttaacacactgccagacacatagccagtgctca

SEQ ID NO: 153325 - DNA, 601 bp, Human
tgttccatttacctcccacaatggacatgcacacatcctccacagcagccaggccctctccgtccctcaatacactctccacagtccagtctccatgccattaaagacaggcagtacctcacccaaaaatatcttttctacctactcaaaatgcacctagtctttttttcccagctttattgagttatgatggacaaataaaaattgtatatatttaaggtatacaccatgatgttttcatatatgtgtacgttgtgaaatgattaccacaatcaagttaatcagcatatccatcacttcrtatagtctatatttttgtgtgtggtgaggacatttaaaatatactgtattcacaaatttcaagcatataatagttatactttcactatagtcaccacgctgttcatgagatccccagaacttattcatcctgcctaactaaaatcgtgtatgctttgaccaatatttcaccagtcccttctcccattcaccccacccctacaccctagcaaacactgttttactatctgtttctatgagttcaatttttttagattcaacataagaagtgagatcatgcatagcttatgccttgtgccta

SEQ ID NO: 153326 - DNA, 601 bp, Human
gttacgtgtttatttcaacaagttacccaaatacaaaaccttgtaggaatctttaattctttcttctacaccaacacctgtaaatattaaccattaaatcctatcacttttctcctgtccctgatttatcctcctcacacctctcactcacctaggttaggccacaattcctaaatacctagcttacctcccacacacataactatccaattagcctctcaattcaaatctccttcctccctcaattgttccttcagcactccactgctcattcaggaatttacagtgcctgtgaattaartccaaattcctaatccagtcatgcaaaaccatctatatctgagcctaacctcgcttgttccatttacctcccacaatggacatgcacacatcctccacagcagccaggccctctccgtccctcaatacactctccacagtccagtctccatgccattaaagacaggcagtacctcacccaaaaatatcttttctacctactcaaaatgcacctagtctttttttcccagctttattgagttatgatggacaaataaaaattgtatatatttaaggtatacaccatgatgttttcatatat

SEQ ID NO: 153327 - DNA, 601 bp, Human
ctacaagtctttctcactactctcaaacagatgctattaaaggaaaggaggccttactctaaggtatttaaatatttaattattatgcaaaagcaaacgaactttaaaagcctgaaacttctattttaaaaggcccagaagagttacgtgtttatttcaacaagttacccaaatacaaaaccttgtaggaatctttaattctttcttctacaccaacacctgtaaatattaaccattaaatcctatcacttttctcctgtccctgatttatcctcctcacacctctcactcacctaggttrggccacaattcctaaatacctagcttacctcccacacacataactatccaattagcctctcaattcaaatctccttcctccctcaattgttccttcagcactccactgctcattcaggaatttacagtgcctgtgaattaaatccaaattcctaatccagtcatgcaaaaccatctatatctgagcctaacctcgcttgttccatttacctcccacaatggacatgcacacatcctccacagcagccaggccctctccgtccctcaatacactctccacagtccagtctccatgccatta

SEQ ID NO: 153328 - DNA, 601 bp, Human
gctgctcaatgtaagcccatataaaaggggagaactgggatctacaagagtctacaagtctttctcactactctcaaacagatgctattaaaggaaaggaggccttactctaaggtatttaaatatttaattattatgcaaaagcaaacgaactttaaaagcctgaaacttctattttaaaaggcccagaagagttacgtgtttatttcaacaagttacccaaatacaaaaccttgtaggaatctttaattctttcttctacaccaacacctgtaaatattaaccattaaatcctatcacktttctcctgtccctgatttatcctcctcacacctctcactcacctaggttaggccacaattcctaaatacctagcttacctcccacacacataactatccaattagcctctcaattcaaatctccttcctccctcaattgttccttcagcactccactgctcattcaggaatttacagtgcctgtgaattaaatccaaattcctaatccagtcatgcaaaaccatctatatctgagcctaacctcgcttgttccatttacctcccacaatggacatgcacacatcctccacagcagccag

SEQ ID NO: 153329 - DNA, 601 bp, Human
aatcagcaagtaccacaaattattaaaagaattttaagtgaccttacttaactagattcagcccagtccaacttcaggctttttaatcaaactgtaattaatctccacgcaatacctgaaggagaaccaccaacatccgctggtagtaccctgaagtgtcccccaccacgtcatcttccaggcttgagccatattctgcaacaaaataatttcatacttatttacatcttctttcaactagaaaagtaatcttgccccattaatcaaatgaaagcgatgtaaaagaagaaataattatatytggttaacataaattccctctattccatctctgaatgctctaagcaaatgctttcagtgagtggttggacaaaaatgaattaaagtctcccaaaggcactcaattcaaacttaaatcaagactcagccatttagaaattctctcgaccaatgtagtcattaatctatagatacatgatggtactggaaagtctccaaaacacaatcaatcataagcttaaactctgttatgctttctttcaaatcttttatatggttagcttccaaatgtcttctatctctaatattctgagatttattt

SEQ ID NO: 153330 - DNA, 601 bp, Human
caaccaagaattgtatattctcttaattgaaacatgtgaccagaaagaggtctatgattggtggttctaggaacccaagtaattcctttattaccaatttccagttttcagctctcatgtttcaaatttcctttcctatattttaataactgttttattaaccagactgagactttataggggtttataagtcacttaagaggaaattttcatttggagtcactaaaaagctgctgacagaagaccaatcctacttaaaattctgtcgaaggaaatgcagagaaatttcctaataccaaartaacttgtcatctcttatgtaattaaacaccacttactgttaaatactttattctttcttctttatcttctcctgctaagagacccactgcataattggcagtggaagtaataacactgttttttggtaaaattctctattttgtgaatgttcaataatcacaaaaaaaaacatgtctagttggaactcactatataatttattttatttcgtttcagctttaaggtaaaatattttgctgaccaggtcagaataagaaaaagctacttatgtaggtcttatgctatgtaaataacccat

SEQ ID NO: 153331 - DNA, 601 bp, Human
aaaccattataaaatcaacctacccaaaagaataaccgctctcctctttcctgttagcaaagtgagatcgcatatccatgggttgttccactggaggaatgaatatggctcttcctttttcaatgatacatgacaaacaaccaagaattgtatattctcttaattgaaacatgtgaccagaaagaggtctatgattggtggttctaggaacccaagtaattcctttattaccaatttccagttttcagctctcatgtttcaaatttcctttcctatattttaataactgttttattaaccmgactgagactttataggggtttataagtcacttaagaggaaattttcatttggagtcactaaaaagctgctgacagaagaccaatcctacttaaaattctgtcgaaggaaatgcagagaaatttcctaataccaaaataacttgtcatctcttatgtaattaaacaccacttactgttaaatactttattctttcttctttatcttctcctgctaagagacccactgcataattggcagtggaagtaataacactgttttttggtaaaattctctattttgtgaatgttcaataatcaca

SEQ ID NO: 153332 - DNA, 601 bp, Human
ctctttcctctaagagttcaactctccctccagagaaagaataaaacaaggatttactggggaagaaggtaaatctgttttaatgcattaaaagtattaaatcaatttaacacattaaaaatgttaaaaagtggattatctacaaaacgttcagttcccaagtgaatgactcactatggcttatcaaacctctcaaataatagaaatcttcttagtgccaggtatcagtagagacaaaaatgcaaaagcttataaaagagccctttagctgtctcagcttactctcaattaagaaatctcraattctcactagtgataacagtccagctgcccttgctacgaggtacaagttggtgtgttcctttttataatgccaaaagattatttgttttcaacaggtttattaattaataataatacatttgaaagaatcaaaaataatagccagtgtaacatgttctgtattgctcctagtcactggaaggctaagaaaagcttggattccattcaagggatactttaaagtaactccataaagcagttttcacatgtacagtctcacatgtactctcagggttctgaatggttatatccactgcat

SEQ ID NO: 153333 - DNA, 601 bp, Human
aataaacaatacaatggtcaaatgctattttgatatgtaaaggattaagtaattaaaaatcaagtgctgcttcctgcttatagctctacttctataaaaacacaaaagtaccagaggctaaagagctgtaagctaatctgatttcctcactcaccaagtattttcttagacactggctcaggttttccttggagttctgaggtctgcatagaaaggcatggagaataagggcacaggtttttctatgcgccttggttctgtgaagactttttggatactgcagtttgggcagcctggattrttatcataataccacaacattcttcatcaccaataaattacacaaatcccttggaagttttcattccaagacattaaagcaaataatacaagattactacctaatttttttaaactcttgggtgatcttcctatactctctacatattctttaatatcaatgattcacacagagcagcatgagatttatccatttcagtacaaaaacagataaatcaatatcagaaaggatctcttctctgaacatgtacatgttgaatgtaggttggggctgctcagacctcagtctgcttagcttcag

SEQ ID NO: 153334 - DNA, 601 bp, Human
gaataataattagaaagagaaatgtattagatagaaggttcatggtctccacttaccttcatagcataatagagggtctctgcaaggtaggcaggtatacttcgaatagatttcactaagaaaataaacaatacaatggtcaaatgctattttgatatgtaaaggattaagtaattaaaaatcaagtgctgcttcctgcttatagctctacttctataaaaacacaaaagtaccagaggctaaagagctgtaagctaatctgatttcctcactcaccaagtattttcttagacactggctyaggttttccttggagttctgaggtctgcatagaaaggcatggagaataagggcacaggtttttctatgcgccttggttctgtgaagactttttggatactgcagtttgggcagcctggattattatcataataccacaacattcttcatcaccaataaattacacaaatcccttggaagttttcattccaagacattaaagcaaataatacaagattactacctaatttttttaaactcttgggtgatcttcctatactctctacatattctttaatatcaatgattcacacagagcagc

SEQ ID NO: 153335 - DNA, 601 bp, Human
tcaggaaacattatgctaagctttttaactcattgctctaatcgtgtcactaaaattttaaacttaacacaagaatcaggttctcttatccttgtctttcatgcaacataccagtctgctttggattcccaaacgtaatttaaagaaaggttctactaccttaatcatggaataaagagaggtggcaaaattcttcctaaactccttcctgatgttaaacagatcaatctcactcctggaaaccatgactctgatgagggtatgatcatctgtcccagctccctttaaaaaaaaaaaaaaagagagaagcaaaatgcttaaaaacttcaaacataggatcaaatgctcccgggtgcgggtgaatcaataaggtataacaatttagtagaactgggttgaatgttataagggaaaaattcccaaggtctatcatctaaaacataaacaaaagtgaagaataataattagaaagagaaatgtattagatagaaggttcatggtctccacttaccttcatagcataatagagggtctctgcaaggtaggcaggtatacttcgaatagatttcactaagaaaataaacaatacaatggtcaaatg

SEQ ID NO: 153336 - DNA, 601 bp, Human
cttctagacagaatagtttctatcacttggtatatatcagctaacacgggcagtgctggggctgcagggctgtcatggctctccctccgagacagaagggcagaacatgctttgcatctgcttgtctcacatgcagacatgcatgataaattaatgtttcaagctaaaagtgcatgggtaaactctctagtgtcctttgggccagccaaaccacaaacatgctaaactaaaagcttctgctcaattgaaatcttgctttgcacatggtccacattaacctttactggaaaaaaaaaaaaaagtcaaaagactttaagctaaatgtaattataggccacagagcaccttgttttaaaaagaacaaaaatgatactaatacctaggggctctttactcccaatatgacctggttggctctttcctgaattagaaaccagcatcagagataaggtgataacagacgataaagaaaggaaaagctgatatgaaataaaagaaggactaataaagagagctggaattgataaaagacagaaagaacacattattatcataggcaaggggtttggtttgttgagtcatctgttaccactactaaata

SEQ ID NO: 153337 - DNA, 601 bp, Human; identical to SEQ ID NO: 121019

SEQ ID NO: 153338 - DNA, 601 bp, Human
tgtaaacagcaggggtcctgaagccaggatttgaatcagcagctgcctcatagggtggtcttgagcgttaaataagattcacaaaaggcactccacaagtcctttttcttgtcctcccacttctttaggcaatgcctgaggtgaaggctcagattccactcggctatggggcattcttgccctgacggatccccaaatcacacagcctatccctccatccagtgacttctccccatgtcctgtgcttgaaatgaccctcaatagttccaccaaataggagttatttatgtggctatgcgcytaacactgaccacattgtcatttgctccttgtaaaactaaaaactttgagatgagtgctatctttgggtccatttcacagatagtggaactgaggcttacacatatccaaggccacacagtgaacagaaggcagagctgggatcaaacttgaccctgtctgacccctggcctctatatgacaccgtctaccacaaacagcaaaccctccagccatgcctaaaggatctgaaagcagttacctgctgagcccctgtgggagtatcttcagtcccctcgtgtcacccggagctgctcctgca

SEQ ID NO: 153339 - DNA, 601 bp, Human
tggtaacagcgaaaacaagaaccacagcttagagttactaagtgcacaggtatttacgggcagtagagtcctctcagccctttgatctcagtactgttattaggttcactttacagatgaggaaactgaggcccagagggctgagggaacctgctccagggcacccagccagcccagggtggagctggggctggcatctggcggtatggctgcagcgcacccgcattctaatcgcaatcactctttcaggcaggaaactggttcagagggagatgtaaacagcaggggtcctgaagccagratttgaatcagcagctgcctcatagggtggtcttgagcgttaaataagattcacaaaaggcactccacaagtcctttttcttgtcctcccacttctttaggcaatgcctgaggtgaaggctcagattccactcggctatggggcattcttgccctgacggatccccaaatcacacagcctatccctccatccagtgacttctccccatgtcctgtgcttgaaatgaccctcaatagttccaccaaataggagttatttatgtggctatgcgcctaacactgaccacattgtcatttgctc

SEQ ID NO: 153340 - DNA, 601 bp, Human
agatgcagctccctcttcacccagcttcatgttcctagttgtaaaatggagacgatggtaacagcgaaaacaagaaccacagcttagagttactaagtgcacaggtatttacgggcagtagagtcctctcagccctttgatctcagtactgttattaggttcactttacagatgaggaaactgaggcccagagggctgagggaacctgctccagggcacccagccagcccagggtggagctggggctggcatctggcggtatggctgcagcgcacccgcattctaatcgcaatcactcttycaggcaggaaactggttcagagggagatgtaaacagcaggggtcctgaagccaggatttgaatcagcagctgcctcatagggtggtcttgagcgttaaataagattcacaaaaggcactccacaagtcctttttcttgtcctcccacttctttaggcaatgcctgaggtgaaggctcagattccactcggctatggggcattcttgccctgacggatccccaaatcacacagcctatccctccatccagtgacttctccccatgtcctgtgcttgaaatgaccctcaatagttccaccaa

SEQ ID NO: 153341 - DNA, 601 bp, Human
tggaaccagatgcagctccctcttcacccagcttcatgttcctagttgtaaaatggagacgatggtaacagcgaaaacaagaaccacagcttagagttactaagtgcacaggtatttacgggcagtagagtcctctcagccctttgatctcagtactgttattaggttcactttacagatgaggaaactgaggcccagagggctgagggaacctgctccagggcacccagccagcccagggtggagctggggctggcatctggcggtatggctgcagcgcacccgcattctaatcgcaatsactctttcaggcaggaaactggttcagagggagatgtaaacagcaggggtcctgaagccaggatttgaatcagcagctgcctcatagggtggtcttgagcgttaaataagattcacaaaaggcactccacaagtcctttttcttgtcctcccacttctttaggcaatgcctgaggtgaaggctcagattccactcggctatggggcattcttgccctgacggatccccaaatcacacagcctatccctccatccagtgacttctccccatgtcctgtgcttgaaatgaccctcaatagtt

SEQ ID NO: 153342 - DNA, 601 bp, Human
actccagttccacagcatcctttccatgagacctggaaccagatgcagctccctcttcacccagcttcatgttcctagttgtaaaatggagacgatggtaacagcgaaaacaagaaccacagcttagagttactaagtgcacaggtatttacgggcagtagagtcctctcagccctttgatctcagtactgttattaggttcactttacagatgaggaaactgaggcccagagggctgagggaacctgctccagggcacccagccagcccagggtggagctggggctggcatctggcggtrtggctgcagcgcacccgcattctaatcgcaatcactctttcaggcaggaaactggttcagagggagatgtaaacagcaggggtcctgaagccaggatttgaatcagcagctgcctcatagggtggtcttgagcgttaaataagattcacaaaaggcactccacaagtcctttttcttgtcctcccacttctttaggcaatgcctgaggtgaaggctcagattccactcggctatggggcattcttgccctgacggatccccaaatcacacagcctatccctccatccagtgacttctccc

SEQ ID NO: 153343 - DNA, 601 bp, Human
gcctttttcaattcctctccctccacatctcttgtcatggtaaagcaggcagaatccatgggctttaacgggcccattgcttttcccaaagctcatgcctttttcctaaaaacaaaacccttctgggttccagaactctttggaaaaaaagaatcttctgtgatttgggacattggtttgttcccccaccctcacttaaatgagaaactactttagcatgccccgccccgtctgttgtctttatttaggaggaagcaccctctacataccctgagtatatacacccagggcctgaagctgctgtgatcagctcaggatccccaggaggctgaggcggatcaggccctggactccgggggaacaatgtaagggacaccaaaaagctcagccatggagatgaatagtattttaacatgaaatttgtgaaaatcaaaattaccgctgttcctgatcttatctttctgtaacatgttcatagtttgttcatcacgggtgtcttgccattaattctgacttttaaaaatgttgtgttaacataccgtttatctccatgactgagttttttggcatcccttacatttcgtgcccaaggtgagagtct

SEQ ID NO: 153344 - DNA, 601 bp, Human
ccaacccaaagcctttttcaattcctctccctccacatctcttgtcatggtaaagcaggcagaatccatgggctttaacgggcccattgcttttcccaaagctcatgcctttttcctaaaaacaaaacccttctgggttccagaactctttggaaaaaaagaatcttctgtgatttgggacattggtttgttcccccaccctcacttaaatgagaaactactttagcatgccccgccccgtctgttgtctttatttaggaggaagcaccctctacataccctgagtatatacacccagggcctgaagctgctgtgatcagctcaggatccccaggaggctgaggcggatcaggccctggactccgggggaacaatgtaagggacaccaaaaagctcagccatggagatgaatagtattttaacatgaaatttgtgaaaatcaaaattaccgctgttcctgatcttatctttctgtaacatgttcatagtttgttcatcacgggtgtcttgccattaattctgacttttaaaaatgttgtgttaacataccgtttatctccatgactgagttttttggcatcccttacatttcgtgcccaag

SEQ ID NO: 153345 - DNA, 601 bp, Human
gcatggtgcaaaggtacccccgcccccaacccaaagcctttttcaattcctctccctccacatctcttgtcatggtaaagcaggcagaatccatgggctttaacgggcccattgcttttcccaaagctcatgcctttttcctaaaaacaaaacccttctgggttccagaactctttggaaaaaaagaatcttctgtgatttgggacattggtttgttcccccaccctcacttaaatgagaaactactttagcatgccccgccccgtctgttgtctttatttaggaggaagcaccctctacmtaccctgagtatatacacccagggcctgaagctgctgtgatcagctcaggatccccaggaggctgaggcggatcaggccctggactccgggggaacaatgtaagggacaccaaaaagctcagccatggagatgaatagtattttaacatgaaatttgtgaaaatcaaaattaccgctgttcctgatcttatctttctgtaacatgttcatagtttgttcatcacgggtgtcttgccattaattctgacttttaaaaatgttgtgttaacataccgtttatctccatgactgagttttttg

SEQ ID NO: 153346 - DNA, 601 bp, Human
cttgcagagtcccattattccctgattgcacagataaagaaaccaaggctgagcaatgccatcccctcatctcacgaacgtcacctccatgagggtaggcaccttactagttctacttgcccaagagtagcagtcagaaagctatggggaggcacacctggggtttgaacctgggtccacgtgactcaggcactcaaatcctgaactgcttcagggcagggcacttggcttgaagagaagctgcagacacagagacaatcaagtcacatctaatactccagcaggacagatgagcctgcawggtgcaaaggtacccccgcccccaacccaaagcctttttcaattcctctccctccacatctcttgtcatggtaaagcaggcagaatccatgggctttaacgggcccattgcttttcccaaagctcatgcctttttcctaaaaacaaaacccttctgggttccagaactctttggaaaaaaagaatcttctgtgatttgggacattggtttgttcccccaccctcacttaaatgagaaactactttagcatgccccgccccgtctgttgtctttatttaggaggaagcaccctctacatac

SEQ ID NO: 153347 - DNA, 601 bp, Human
ttgccctgaccctggtgccaggcacttcacacacatcgtctccttttcccttgcagagtcccattattccctgattgcacagataaagaaaccaaggctgagcaatgccatcccctcatctcacgaacgtcacctccatgagggtaggcaccttactagttctacttgcccaagagtagcagtcagaaagctatggggaggcacacctggggtttgaacctgggtccacgtgactcaggcactcaaatcctgaactgcttcagggcagggcacttggcttgaagagaagctgcagacacaragacaatcaagtcacatctaatactccagcaggacagatgagcctgcatggtgcaaaggtacccccgcccccaacccaaagcctttttcaattcctctccctccacatctcttgtcatggtaaagcaggcagaatccatgggctttaacgggcccattgcttttcccaaagctcatgcctttttcctaaaaacaaaacccttctgggttccagaactctttggaaaaaaagaatcttctgtgatttgggacattggtttgttcccccaccctcacttaaatgagaaactactttagcatg

SEQ ID NO: 153348 - DNA, 601 bp, Human
tagcaggacacaaaatataggaaggcaaccatctctggtgcagaatcggcagcagagagtgagcgcctccctgcattttatcccccaggtgctcactggcttcacccttgccctgaccctggtgccaggcacttcacacacatcgtctccttttcccttgcagagtcccattattccctgattgcacagataaagaaaccaaggctgagcaatgccatcccctcatctcacgaacgtcacctccatgagggtaggcaccttactagttctacttgcccaagagtagcagtcagaaagctayggggaggcacacctggggtttgaacctgggtccacgtgactcaggcactcaaatcctgaactgcttcagggcagggcacttggcttgaagagaagctgcagacacagagacaatcaagtcacatctaatactccagcaggacagatgagcctgcatggtgcaaaggtacccccgcccccaacccaaagcctttttcaattcctctccctccacatctcttgtcatggtaaagcaggcagaatccatgggctttaacgggcccattgcttttcccaaagctcatgcctttttcctaaaaac

SEQ ID NO: 153349 - DNA, 601 bp, Human
cttactatgtgccaggaagcaccagggtgagcatagcaggacacaaaatataggaaggcaaccatctctggtgcagaatcggcagcagagagtgagcgcctccctgcattttatcccccaggtgctcactggcttcacccttgccctgaccctggtgccaggcacttcacacacatcgtctccttttcccttgcagagtcccattattccctgattgcacagataaagaaaccaaggctgagcaatgccatcccctcatctcacgaacgtcacctccatgagggtaggcaccttactagtyctacttgcccaagagtagcagtcagaaagctatggggaggcacacctggggtttgaacctgggtccacgtgactcaggcactcaaatcctgaactgcttcagggcagggcacttggcttgaagagaagctgcagacacagagacaatcaagtcacatctaatactccagcaggacagatgagcctgcatggtgcaaaggtacccccgcccccaacccaaagcctttttcaattcctctccctccacatctcttgtcatggtaaagcaggcagaatccatgggctttaacgggcccattgc

SEQ ID NO: 153350 - DNA, 601 bp, Human
gtacttaattatgtttgcacaaacggatggtaatcctaaaaatcttagagctcgctctcatagtcttattattgcaccaaacattgttaagtgcatgataatcgcaggtaattttaattggaggcttactatgtgccaggaagcaccagggtgagcatagcaggacacaaaatataggaaggcaaccatctctggtgcagaatcggcagcagagagtgagcgcctccctgcattttatcccccaggtgctcactggcttcacccttgccctgaccctggtgccaggcacttcacacacatygtctccttttcccttgcagagtcccattattccctgattgcacagataaagaaaccaaggctgagcaatgccatcccctcatctcacgaacgtcacctccatgagggtaggcaccttactagttctacttgcccaagagtagcagtcagaaagctatggggaggcacacctggggtttgaacctgggtccacgtgactcaggcactcaaatcctgaactgcttcagggcagggcacttggcttgaagagaagctgcagacacagagacaatcaagtcacatctaatactccagcaggaca

SEQ ID NO: 153351 - DNA, 601 bp, Human
ctgcacaaggggacacaggaaactgaaatccagtcctcactgaactgcccaagccctgattcctggtatgggactttgtgggtccaggggcaggggtgccttgatcaaaatcaccttggatgttttagggctgcttggtgattgatgttttgctttcggagtacttaattatgtttgcacaaacggatggtaatcctaaaaatcttagagctcgctctcatagtcttattattgcaccaaacattgttaagtgcatgataatcgcaggtaattttaattggaggcttactatgtgccaggmagcaccagggtgagcatagcaggacacaaaatataggaaggcaaccatctctggtgcagaatcggcagcagagagtgagcgcctccctgcattttatcccccaggtgctcactggcttcacccttgccctgaccctggtgccaggcacttcacacacatcgtctccttttcccttgcagagtcccattattccctgattgcacagataaagaaaccaaggctgagcaatgccatcccctcatctcacgaacgtcacctccatgagggtaggcaccttactagttctacttgcccaagagt

SEQ ID NO: 153352 - DNA, 601 bp, Human
tatatggtacaatctaaagtgaggattaggccgggcgctgtggctcatgcctgtaatcccagcagtttgggaggctgaggtgggtggatcacttgaggtcaggtgtttgagaccatcctggccaacatggcgcaaccctgtctctactaaaaatacaaaaattagccagatgtggaggcacaatgcctgtaatcccaggtacttgggaggctgaggcaggagaatcgcttgaacccaggaagcggaggttgcagtgagccgagatcacactgctgcactccagcctgagcgacagaatgaractctgtctcaataagtaaataaataaatcaaataaagtgaggattgaacaattgaagggtcactgataatcactgtaaggatttagcgccagggcttggcagtactcaggtgagtaaacgttagttattgctaatattattcatttatcttattattgttataattgagttagttctgtgttctgatccatgagtgaattggcctcctggaagctgccctcaaatccctcctcttttacacagtgattgatggtccatgtcgcctccttgtagttacagattaataataggccctcctc

SEQ ID NO: 153353 - DNA, 601 bp, Human
aatgagaaaattataactaggcaaggaatatatatggtacaatctaaagtgaggattaggccgggcgctgtggctcatgcctgtaatcccagcagtttgggaggctgaggtgggtggatcacttgaggtcaggtgtttgagaccatcctggccaacatggcgcaaccctgtctctactaaaaatacaaaaattagccagatgtggaggcacaatgcctgtaatcccaggtacttgggaggctgaggcaggagaatcgcttgaacccaggaagcggaggttgcagtgagccgagatcacacygctgcactccagcctgagcgacagaatgagactctgtctcaataagtaaataaataaatcaaataaagtgaggattgaacaattgaagggtcactgataatcactgtaaggatttagcgccagggcttggcagtactcaggtgagtaaacgttagttattgctaatattattcatttatcttattattgttataattgagttagttctgtgttctgatccatgagtgaattggcctcctggaagctgccctcaaatccctcctcttttacacagtgattgatggtccatgtcgcctcctt

SEQ ID NO: 153354 - DNA, 601 bp, Human
gttttatgaaatatttatatgtaatataatagaacatggaatagaaaatatttcctgcatattcattcttgcaatgagaaaattataactaggcaaggaatatatatggtacaatctaaagtgaggattaggccgggcgctgtggctcatgcctgtaatcccagcagtttgggaggctgaggtgggtggatcacttgaggtcaggtgtttgagaccatcctggccaacatggcgcaaccctgtctctactaaaaatacaaaaattagccagatgtggaggcacaatgcctgtaatcccagstacttgggaggctgaggcaggagaatcgcttgaacccaggaagcggaggttgcagtgagccgagatcacactgctgcactccagcctgagcgacagaatgagactctgtctcaataagtaaataaataaatcaaataaagtgaggattgaacaattgaagggtcactgataatcactgtaaggatttagcgccagggcttggcagtactcaggtgagtaaacgttagttattgctaatattattcatttatcttattattgttataattgagttagttctgtgttctgatccatgagtga

SEQ ID NO: 153355 - DNA, 601 bp, Human
acgatcgtgaggctttgggcaaagcacttgacccttctgaaagtatctttcttgtggaaaatgacagtattcataatggtggcaataataaacacatttagagtgttttctctgtgctgagcagttctgatttgcatatatttgcctctcttggtcctcccaacaactctctgagttaggtacttttattttcccagttgtcttatgagaagccggagcacagagaggttgagtggcatgtcctgatacatcgtggtaccgtgcgaaggggtaaatgtgatgggaaagtgcctggcagggygagcacctagtagctattagtgatatagatgtcccaaactcaactcatgatggttcgactgacaatatttcaactttatgatgagtatctatctatcatctatctatctatctatctatctatctatctatctatctatctatctatcatctactttatctatctatctcacacacactatatatataacatatttacaatgtttagggtattttattttggtaccaattttccaggactatatatctatatttcatattttggatatcttgtcctattcctcgatgacttacattgctt

SEQ ID NO: 153356 - DNA, 601 bp, Human
tcctgcatctctggggttcccctctctcctcttgagaacaagagatctggagtgagacaggcatccgtaaaatcccacgatcgtgaggctttgggcaaagcacttgacccttctgaaagtatctttcttgtggaaaatgacagtattcataatggtggcaataataaacacatttagagtgttttctctgtgctgagcagttctgatttgcatatatttgcctctcttggtcctcccaacaactctctgagttaggtacttttattttcccagttgtcttatgagaagccggagcacagaraggttgagtggcatgtcctgatacatcgtggtaccgtgcgaaggggtaaatgtgatgggaaagtgcctggcagggcgagcacctagtagctattagtgatatagatgtcccaaactcaactcatgatggttcgactgacaatatttcaactttatgatgagtatctatctatcatctatctatctatctatctatctatctatctatctatctatctatctatcatctactttatctatctatctcacacacactatatatataacatatttacaatgtttagggtattttattttggta

SEQ ID NO: 153357 - DNA, 601 bp, Human
gggtggaggctgccctccgcagtctcgctctcctgcatctctggggttcccctctctcctcttgagaacaagagatctggagtgagacaggcatccgtaaaatcccacgatcgtgaggctttgggcaaagcacttgacccttctgaaagtatctttcttgtggaaaatgacagtattcataatggtggcaataataaacacatttagagtgttttctctgtgctgagcagttctgatttgcatatatttgcctctcttggtcctcccaacaactctctgagttaggtacttttattttcccagttgtcttatgagaagccggagcacagagaggttgagtggcatgtcctgatacatcgtggtaccgtgcgaaggggtaaatgtgatgggaaagtgcctggcagggcgagcacctagtagctattagtgatatagatgtcccaaactcaactcatgatggttcgactgacaatatttcaactttatgatgagtatctatctatcatctatctatctatctatctatctatctatctatctatctatctatctatcatctactttatctatctatctcacacacactatatatataacatat

SEQ ID NO: 153358 - DNA, 601 bp, Human
accaccatcacccaggcacctgaatacactcacaacccttctaggggcactgctttgctgacgcactgtttcgtgagcttgcaaatcaagagaactgtcctgggcctccagcttcccttcccccagaactggcgggcagggcaggctttccagctggttattcagaagcaagcccagatgccccaccggaggtgggtggaggctgccctccgcagtctcgctctcctgcatctctggggttcccctctctcctcttgagaacaagagatctggagtgagacaggcatccgtaaaatcccaygatcgtgaggctttgggcaaagcacttgacccttctgaaagtatctttcttgtggaaaatgacagtattcataatggtggcaataataaacacatttagagtgttttctctgtgctgagcagttctgatttgcatatatttgcctctcttggtcctcccaacaactctctgagttaggtacttttattttcccagttgtcttatgagaagccggagcacagagaggttgagtggcatgtcctgatacatcgtggtaccgtgcgaaggggtaaatgtgatgggaaagtgcctggcagggcg

SEQ ID NO: 153359 - DNA, 601 bp, Human
acggaggaatagctcaggcttcggagtccacagaccaccatcacccaggcacctgaatacactcacaacccttctaggggcactgctttgctgacgcactgtttcgtgagcttgcaaatcaagagaactgtcctgggcctccagcttcccttcccccagaactggcgggcagggcaggctttccagctggttattcagaagcaagcccagatgccccaccggaggtgggtggaggctgccctccgcagtctcgctctcctgcatctctggggttcccctctctcctcttgagaacaagagmtctggagtgagacaggcatccgtaaaatcccacgatcgtgaggctttgggcaaagcacttgacccttctgaaagtatctttcttgtggaaaatgacagtattcataatggtggcaataataaacacatttagagtgttttctctgtgctgagcagttctgatttgcatatatttgcctctcttggtcctcccaacaactctctgagttaggtacttttattttcccagttgtcttatgagaagccggagcacagagaggttgagtggcatgtcctgatacatcgtggtaccgtgcgaagg

SEQ ID NO: 153360 - DNA, 601 bp, Human
accaaacccacggattctcagacggaggaatagctcaggcttcggagtccacagaccaccatcacccaggcacctgaatacactcacaacccttctaggggcactgctttgctgacgcactgtttcgtgagcttgcaaatcaagagaactgtcctgggcctccagcttcccttcccccagaactggcgggcagggcaggctttccagctggttattcagaagcaagcccagatgccccaccggaggtgggtggaggctgccctccgcagtctcgctctcctgcatctctggggttcccctmtctcctcttgagaacaagagatctggagtgagacaggcatccgtaaaatcccacgatcgtgaggctttgggcaaagcacttgacccttctgaaagtatctttcttgtggaaaatgacagtattcataatggtggcaataataaacacatttagagtgttttctctgtgctgagcagttctgatttgcatatatttgcctctcttggtcctcccaacaactctctgagttaggtacttttattttcccagttgtcttatgagaagccggagcacagagaggttgagtggcatgtcctgata

SEQ ID NO: 153361 - DNA, 601 bp, Human
aactctcctggctgctgcctaccctgacctagacaaccaaacccacggattctcagacggaggaatagctcaggcttcggagtccacagaccaccatcacccaggcacctgaatacactcacaacccttctaggggcactgctttgctgacgcactgtttcgtgagcttgcaaatcaagagaactgtcctgggcctccagcttcccttcccccagaactggcgggcagggcaggctttccagctggttattcagaagcaagcccagatgccccaccggaggtgggtggaggctgccctccrcagtctcgctctcctgcatctctggggttcccctctctcctcttgagaacaagagatctggagtgagacaggcatccgtaaaatcccacgatcgtgaggctttgggcaaagcacttgacccttctgaaagtatctttcttgtggaaaatgacagtattcataatggtggcaataataaacacatttagagtgttttctctgtgctgagcagttctgatttgcatatatttgcctctcttggtcctcccaacaactctctgagttaggtacttttattttcccagttgtcttatgagaagc

SEQ ID NO: 153362 - DNA, 601 bp, Human
caagatctctaggtgatttccatggctgagagcccctgttttggatatttctggggtgagtgagtgagtgtctcctggggtcagaactctcctggctgctgcctaccctgacctagacaaccaaacccacggattctcagacggaggaatagctcaggcttcggagtccacagaccaccatcacccaggcacctgaatacactcacaacccttctaggggcactgctttgctgacgcactgtttcgtgagcttgcaaatcaagagaactgtcctgggcctccagcttcccttcccccagarctggcgggcagggcaggctttccagctggttattcagaagcaagcccagatgccccaccggaggtgggtggaggctgccctccgcagtctcgctctcctgcatctctggggttcccctctctcctcttgagaacaagagatctggagtgagacaggcatccgtaaaatcccacgatcgtgaggctttgggcaaagcacttgacccttctgaaagtatctttcttgtggaaaatgacagtattcataatggtggcaataataaacacatttagagtgttttctctgtgctgagcagttctg

SEQ ID NO: 153363 - DNA, 601 bp, Human
aatccctgagcatcactgagcctcgctgggcctcagtttcctcatctgtaaaaatggggataattatagcctccatctcaaggggctggtatggagtcaaaccagtgaatataagcaaagtgccctgaacagggcctggcacataaagaggactgcgcaagagttagcatgagtaggactctcacgggtatgatccttgctctttgaagccagtttctcccacaggtgcccggtagtgagactctaccgaggaatccagcaacatttctgattcctgtgatcctctcaccgaaaagtcaakttggggccctggaatttgtatttttagcaaatgccccagtgattctcatgatcagacacctatagaaaatagtgtgatggtgaccatcttcaagctttttccaggagtgaggatgctctaggacacaggactcttatgttaaaattggaaaaccctgggcaaaccagaatgacttgggtggagacttttttttaaatccccgtttaatagatgggaaaactgaggctcaaggcagttcagacagtaattcttgtctgtaatagttttctcccatttctcaaaaaggagaaaaataaatca

SEQ ID NO: 153364 - DNA, 601 bp, Human
tcagtgtagcacataggataggaatgtgggctctggagtttggaatccctgagcatcactgagcctcgctgggcctcagtttcctcatctgtaaaaatggggataattatagcctccatctcaaggggctggtatggagtcaaaccagtgaatataagcaaagtgccctgaacagggcctggcacataaagaggactgcgcaagagttagcatgagtaggactctcacgggtatgatccttgctctttgaagccagtttctcccacaggtgcccggtagtgagactctaccgaggaatccrgcaacatttctgattcctgtgatcctctcaccgaaaagtcaatttggggccctggaatttgtatttttagcaaatgccccagtgattctcatgatcagacacctatagaaaatagtgtgatggtgaccatcttcaagctttttccaggagtgaggatgctctaggacacaggactcttatgttaaaattggaaaaccctgggcaaaccagaatgacttgggtggagacttttttttaaatccccgtttaatagatgggaaaactgaggctcaaggcagttcagacagtaattcttgtctg

SEQ ID NO: 153365 - DNA, 601 bp, Human
aatgataaccatatatgacttgtatggagagcttgccgtatgccagcccagtgctgaagctctatgtagacatcagtgtagcacataggataggaatgtgggctctggagtttggaatccctgagcatcactgagcctcgctgggcctcagtttcctcatctgtaaaaatggggataattatagcctccatctcaaggggctggtatggagtcaaaccagtgaatataagcaaagtgccctgaacagggcctggcacataaagaggactgcgcaagagttagcatgagtaggactctcacrggtatgatccttgctctttgaagccagtttctcccacaggtgcccggtagtgagactctaccgaggaatccagcaacatttctgattcctgtgatcctctcaccgaaaagtcaatttggggccctggaatttgtatttttagcaaatgccccagtgattctcatgatcagacacctatagaaaatagtgtgatggtgaccatcttcaagctttttccaggagtgaggatgctctaggacacaggactcttatgttaaaattggaaaaccctgggcaaaccagaatgacttgggtggagac

SEQ ID NO: 153366 - DNA, 601 bp, Human
aataatgataaccatatatgacttgtatggagagcttgccgtatgccagcccagtgctgaagctctatgtagacatcagtgtagcacataggataggaatgtgggctctggagtttggaatccctgagcatcactgagcctcgctgggcctcagtttcctcatctgtaaaaatggggataattatagcctccatctcaaggggctggtatggagtcaaaccagtgaatataagcaaagtgccctgaacagggcctggcacataaagaggactgcgcaagagttagcatgagtaggactctyacgggtatgatccttgctctttgaagccagtttctcccacaggtgcccggtagtgagactctaccgaggaatccagcaacatttctgattcctgtgatcctctcaccgaaaagtcaatttggggccctggaatttgtatttttagcaaatgccccagtgattctcatgatcagacacctatagaaaatagtgtgatggtgaccatcttcaagctttttccaggagtgaggatgctctaggacacaggactcttatgttaaaattggaaaaccctgggcaaaccagaatgacttgggtgga

SEQ ID NO: 153367 - DNA, 601 bp, Human
agtgccccaaaggtcctggaactcgtaataatgataaccatatatgacttgtatggagagcttgccgtatgccagcccagtgctgaagctctatgtagacatcagtgtagcacataggataggaatgtgggctctggagtttggaatccctgagcatcactgagcctcgctgggcctcagtttcctcatctgtaaaaatggggataattatagcctccatctcaaggggctggtatggagtcaaaccagtgaatataagcaaagtgccctgaacagggcctggcacataaagaggactgcrcaagagttagcatgagtaggactctcacgggtatgatccttgctctttgaagccagtttctcccacaggtgcccggtagtgagactctaccgaggaatccagcaacatttctgattcctgtgatcctctcaccgaaaagtcaatttggggccctggaatttgtatttttagcaaatgccccagtgattctcatgatcagacacctatagaaaatagtgtgatggtgaccatcttcaagctttttccaggagtgaggatgctctaggacacaggactcttatgttaaaattggaaaaccct

SEQ ID NO: 153368 - DNA, 601 bp, Human
atggtgtacagaagtaggagagaagatttttcttcccacagagttggggttacattattctgatcattgcacaccctaagtagcctctcggccacttcaaggtgaagggccctgaaagaaggaaaatctaatggcgtgtctttttcagtgataacctggattcagatattgtcactctccaccagcagatataatgcatgtgtcgtgaaattgctcctgcctgtccatcaaccttttaaagaacaggattcatctgggtgggacaaaagcaaaaggttactgccatctattggctgatgtsaatattagcagaaatgaattcagcctacaggactaggtccaaacaactgggaaggctgaaagaagcattttgatgttttgcaatgaagccttctgttcacagttggcaagaagatggcaactccttcagtgccccaaaggtcctggaactcgtaataatgataaccatatatgacttgtatggagagcttgccgtatgccagcccagtgctgaagctctatgtagacatcagtgtagcacataggataggaatgtgggctctggagtttggaatccctgagcatcactgagcctcgctgg

SEQ ID NO: 153369 - DNA, 601 bp, Human
atctctatctaaattcagcttttaacaagttttaaaattattttaacagtaggattacaagctttattttaaagctcttactatttaatgtaaattcaatcctaacaaagctactttgaatcaacacttgaggttatgaaaaaccttggtgctggaagacgcatggtgtacagaagtaggagagaagatttttcttcccacagagttggggttacattattctgatcattgcacaccctaagtagcctctcggccacttcaaggtgaagggccctgaaagaaggaaaatctaatggcgtgyctttttcagtgataacctggattcagatattgtcactctccaccagcagatataatgcatgtgtcgtgaaattgctcctgcctgtccatcaaccttttaaagaacaggattcatctgggtgggacaaaagcaaaaggttactgccatctattggctgatgtcaatattagcagaaatgaattcagcctacaggactaggtccaaacaactgggaaggctgaaagaagcattttgatgttttgcaatgaagccttctgttcacagttggcaagaagatggcaactccttcagtgccccaaa

SEQ ID NO: 153370 - DNA, 601 bp, Human
agtatctctatctaaattcagcttttaacaagttttaaaattattttaacagtaggattacaagctttattttaaagctcttactatttaatgtaaattcaatcctaacaaagctactttgaatcaacacttgaggttatgaaaaaccttggtgctggaagacgcatggtgtacagaagtaggagagaagatttttcttcccacagagttggggttacattattctgatcattgcacaccctaagtagcctctcggccacttcaaggtgaagggccctgaaagaaggaaaatctaatggcrtgtctttttcagtgataacctggattcagatattgtcactctccaccagcagatataatgcatgtgtcgtgaaattgctcctgcctgtccatcaaccttttaaagaacaggattcatctgggtgggacaaaagcaaaaggttactgccatctattggctgatgtcaatattagcagaaatgaattcagcctacaggactaggtccaaacaactgggaaggctgaaagaagcattttgatgttttgcaatgaagccttctgttcacagttggcaagaagatggcaactccttcagtgcccc

SEQ ID NO: 153371 - DNA, 601 bp, Human
gctctttgcagcaattcaacaagacagaggtattattatttcaattttgctggtgtggaaactgaggcacgcaggttaaatgtctcagtcaaggatacgcgcaaacacatacgttcatatatacacatgcaagaatatatacacacaaagtatctctatctaaattcagcttttaacaagttttaaaattattttaacagtaggattacaagctttattttaaagctcttactatttaatgtaaattcaatcctaacaaagctactttgaatcaacacttgaggttatgaaaaaccttggwgctggaagacgcatggtgtacagaagtaggagagaagatttttcttcccacagagttggggttacattattctgatcattgcacaccctaagtagcctctcggccacttcaaggtgaagggccctgaaagaaggaaaatctaatggcgtgtctttttcagtgataacctggattcagatattgtcactctccaccagcagatataatgcatgtgtcgtgaaattgctcctgcctgtccatcaaccttttaaagaacaggattcatctgggtgggacaaaagcaaaaggttactgccatct

SEQ ID NO: 153372 - DNA, 601 bp, Human
ctttatttgcagtaaaactaatttgctctttgcagcaattcaacaagacagaggtattattatttcaattttgctggtgtggaaactgaggcacgcaggttaaatgtctcagtcaaggatacgcgcaaacacatacgttcatatatacacatgcaagaatatatacacacaaagtatctctatctaaattcagcttttaacaagttttaaaattattttaacagtaggattacaagctttattttaaagctcttactatttaatgtaaattcaatcctaacaaagctactttgaatcaacrcttgaggttatgaaaaaccttggtgctggaagacgcatggtgtacagaagtaggagagaagatttttcttcccacagagttggggttacattattctgatcattgcacaccctaagtagcctctcggccacttcaaggtgaagggccctgaaagaaggaaaatctaatggcgtgtctttttcagtgataacctggattcagatattgtcactctccaccagcagatataatgcatgtgtcgtgaaattgctcctgcctgtccatcaaccttttaaagaacaggattcatctgggtgggac

SEQ ID NO: 153373 - DNA, 601 bp, Human
ttgagaaacttctaggagctttatttgcagtaaaactaatttgctctttgcagcaattcaacaagacagaggtattattatttcaattttgctggtgtggaaactgaggcacgcaggttaaatgtctcagtcaaggatacgcgcaaacacatacgttcatatatacacatgcaagaatatatacacacaaagtatctctatctaaattcagcttttaacaagttttaaaattattttaacagtaggattacaagctttattttaaagctcttactatttaatgtaaattcaatcctaacaragctactttgaatcaacacttgaggttatgaaaaaccttggtgctggaagacgcatggtgtacagaagtaggagagaagatttttcttcccacagagttggggttacattattctgatcattgcacaccctaagtagcctctcggccacttcaaggtgaagggccctgaaagaaggaaaatctaatggcgtgtctttttcagtgataacctggattcagatattgtcactctccaccagcagatataatgcatgtgtcgtgaaattgctcctgcctgtccatcaaccttttaaagaacag

SEQ ID NO: 153374 - DNA, 601 bp, Human
tggctctttacagaaagtttaccaggatttgagcctactgtgtataaaaacaatgacaacaactctaaaaaatcatagaaatgatagagtaataacaataacaacatttggtgagtgcttaccatctgttgagaaacttctaggagctttatttgcagtaaaactaatttgctctttgcagcaattcaacaagacagaggtattattatttcaattttgctggtgtggaaactgaggcacgcaggttaaatgtctcagtcaaggatacgcgcaaacacatacgttcatatatacacatgcragaatatatacacacaaagtatctctatctaaattcagcttttaacaagttttaaaattattttaacagtaggattacaagctttattttaaagctcttactatttaatgtaaattcaatcctaacaaagctactttgaatcaacacttgaggttatgaaaaaccttggtgctggaagacgcatggtgtacagaagtaggagagaagatttttcttcccacagagttggggttacattattctgatcattgcacaccctaagtagcctctcggccacttcaaggtgaagggccctgaaag

SEQ ID NO: 153375 - DNA, 601 bp, Human
atagaggtatcatgatttcattcttcatatgaggtagccgaaactcgagggggttaaatcattttccaaaggtcacccagttaatgagcaagattcaaacacagtctggctgtgctcctaaccaccggaatgttctgcatattactagcttcccttaaaaaggaggaatggaacctccaagacccaccaagggcaaacatccagtgaggaattgactcctagtatatctgatccctacacaaggactcttgcagccactccaaaggcctgctgtcttgccacctaaagttcttttgcacaygtaattccaatgtagcccatctccaaagacctagcttctggcttatctgctctagtggctctcggaataaaaattaggacttttgatttctggctgaaaggagtcaatgagtcaccagggattcttgtggatctctcgccattggtgtgagtttttattccctggtagtagacgcattgagcaattagatattgaggaggccaaaaaaagggtcatggatctcaccatgtgttctcttgcaggaatttaatacataaccaaatctggggattttgtatgtcttctgatcataccacataa

SEQ ID NO: 153376 - DNA, 601 bp, Human
ttctgagaaatgcatcattagatgatttcatggttgtatgaacatcatagatagtatagcctactacactcctaggctgtatggtataacctatcgttcctaggccactaacttgcacagcacgcaaccacattgaacactctgggaaattgtgacacactgggaagtatttgtgtacctaaacatatcgaaacagaaaaagtccagtaaatacatagtattataatgtcatgtgaccactaagtatatgtggtccatcattgactaaggtatcattatgcagtgtatgactgtgtctatkgagcacagctctgcacctgttgctgggctgggcactagggttacagctgtaaattaaacaggcaaggccctctgacttcatggagctgaagtatggtgcacagggagagagttaacataggaacaataaatccacaaacgaggttgtttctgatagttcaaggcagcatggcacagtggttatgaccacagactctagagcaagactgcctgggcatgaatcctctctctgccccttgtagctgtgtgtccttgggagagttaattagcctctctgtgcctcataagactgctataagga

SEQ ID NO: 153377 - DNA, 601 bp, Human
attaattcccctattaaaaccttttacactacggccttttttttttcatagcatttagcagggcttgtaattatatacttacttgggtatatattcatgctttcactgatttagcacatatggtcatgtgtcacttaagggcgagaaaatgttctgagaaatgcatcattagatgatttcatggttgtatgaacatcatagatagtatagcctactacactcctaggctgtatggtataacctatcgttcctaggccactaacttgcacagcacgcaaccacattgaacactctgggaaaytgtgacacactgggaagtatttgtgtacctaaacatatcgaaacagaaaaagtccagtaaatacatagtattataatgtcatgtgaccactaagtatatgtggtccatcattgactaaggtatcattatgcagtgtatgactgtgtctatggagcacagctctgcacctgttgctgggctgggcactagggttacagctgtaaattaaacaggcaaggccctctgacttcatggagctgaagtatggtgcacagggagagagttaacataggaacaataaatccacaaacgaggttgttt

SEQ ID NO: 153378 - DNA, 601 bp, Human
atatcattgcttatatttattttgggaaatagaaaggagattttggactcatgtattcaacagaattaaagttaaatgcagtcataattttcagttgcatttcattgctaggggaaaatatttatcatcatgaaaagtgtattcagtgtagatagcatttttttctcttttagttaaagtcacagctattaggattttagaatgagggtaattgaaataataatatttttttctgattctcaaactaaattaattcccctattaaaaccttttacactacggccttttttttttcatagcrtttagcagggcttgtaattatatacttacttgggtatatattcatgctttcactgatttagcacatatggtcatgtgtcacttaagggcgagaaaatgttctgagaaatgcatcattagatgatttcatggttgtatgaacatcatagatagtatagcctactacactcctaggctgtatggtataacctatcgttcctaggccactaacttgcacagcacgcaaccacattgaacactctgggaaattgtgacacactgggaagtatttgtgtacctaaacatatcgaaacagaaaaag

SEQ ID NO: 153379 - DNA, 601 bp, Human
ccaaactatatcattgcttatatttattttgggaaatagaaaggagattttggactcatgtattcaacagaattaaagttaaatgcagtcataattttcagttgcatttcattgctaggggaaaatatttatcatcatgaaaagtgtattcagtgtagatagcatttttttctcttttagttaaagtcacagctattaggattttagaatgagggtaattgaaataataatatttttttctgattctcaaactaaattaattcccctattaaaaccttttacactacggccttttttttttcatagcatttagcagggcttgtaattatatacttacttgggtatatattcatgctttcactgatttagcacatatggtcatgtgtcacttaagggcgagaaaatgttctgagaaatgcatcattagatgatttcatggttgtatgaacatcatagatagtatagcctactacactcctaggctgtatggtataacctatcgttcctaggccactaacttgcacagcacgcaaccacattgaacactctgggaaattgtgacacactgggaagtatttgtgtacctaaacatatcgaaaca

SEQ ID NO: 153380 - DNA, 601 bp, Human
tgcagggaggagatggccatctacaagccaatgagaggggcgtggaacacgttctccctgatgacccgcagaaggaaccaattctgctgacaactttattttgaacttttggccttcagcactgtgagacaatacatttctgttgcttaagccaccagggcatggtagcccaaggaacaaacgcaagtattttcaaactgagcctgcggcttcgaccctttcatttttttttttttttcaccgtaaacagcatctgcagaccccccttccccacgagagggtagatgcccttcccagagtrgcactgaccttcctctaagtgctgaactgtgtgggtcgacaccaccactggaaccccgttcagagcagacgcgttgtcctgaaacagagcacgtggcattgtgagacaaatcttcgggggaaaatcagaagaactcaaggaagaacctctaagatacaagggtgtctcacaaaaaattaaacttaacttaaaggctgtgtttctagaaactccccagttttctatcatgccttggagaaccaaaataactcactccaagagtggactccagttattatgagagcacaccatggtgcctca

SEQ ID NO: 153381 - DNA, 601 bp, Human
atccgtcacatagtagagcctgaccaccctggaagcattgaatatacagtcttatactccaggataaagtcaaataggtaagtatatgcctcagttttaacactgccctcatgtggacacaattctgttgtcttttataatttatcagcttctgaggaattcctaagtgctgataatggcagaggctgtgcacatttggggaaaaggaatatatgaaatatcgctggagactatgttaaatgtttaataaacaacctcctttaatcctgatagcaattctgtgaggtaggtacttttatcyccattttacagatgagaaaactgaggctgagaaaagcagatgccttgttccaggtcacacagccagtaatctgcagggcagagattgcaacctaggtctgccaagcttcatgttttcactctattgcttttatcttatctgctgtaactcctcagtctcctccagctgtcacacacactcagaagagatctgttgttatggctgaatcatattgcccccaaagatgctgaagtcctaaccccctgtgaatgtgaccttatttggaaacaggatctttgcagatgatcaagttaagatgag

SEQ ID NO: 153382 - DNA, 601 bp, Human
cacagctagtacgtggcaaagctagcaatctgattgcagaattcttaccctcaactactgggctatactacctcttcttacataatttatatgtatccgtcacatagtagagcctgaccaccctggaagcattgaatatacagtcttatactccaggataaagtcaaataggtaagtatatgcctcagttttaacactgccctcatgtggacacaattctgttgtcttttataatttatcagcttctgaggaattcctaagtgctgataatggcagaggctgtgcacatttggggaaaagraatatatgaaatatcgctggagactatgttaaatgtttaataaacaacctcctttaatcctgatagcaattctgtgaggtaggtacttttatccccattttacagatgagaaaactgaggctgagaaaagcagatgccttgttccaggtcacacagccagtaatctgcagggcagagattgcaacctaggtctgccaagcttcatgttttcactctattgcttttatcttatctgctgtaactcctcagtctcctccagctgtcacacacactcagaagagatctgttgttatggctgaa

SEQ ID NO: 153383 - DNA, 601 bp, Human
agccccaggttcattgcagcattattcacaatagccaagatatgggaatgacctatgtgtccatcagtggatgaatggaaaaaggaaatatatatatggacacacacatatacatatacatgtgtgtaaatacacacacacaacagaatagttattcaatcatacaaaagaaggaaatattggcatttgaaacaacatggatgaacctggaggactttaggataagtgaaataagctagacacagaaagacaaatactatatgatctcacttttatgtggaatctaaaaaagttgaattcwtagaagcagagagtaaaatggtgattatcaggggctaaggtccagggaaaattttggtcaaaaggtacatactttcactcataagatgaataagttgcatggtaaatataagttaataatactgttttgcttacttgaaatttgctaagagtagattgtaagggtcctcaccacaccctacaacaaaaacaaaaaagtagctatgtatggtggtggatgtgttgaatatatatatacacatacacacacacacacacaccatggaatactactcaaccataaaaataacaaaataatgtc

SEQ ID NO: 153384 - DNA, 601 bp, Human
gtcaaataattctctctgaaggacaagaaagggtcacccagaatttcacttttataccccttaaaactgcactgaaaattataacttagctaataaccttaggaaaactgcatgaggacaacaataagcttaaaaggggtaatcactctaaagcaagtttcacaggttgaagatgtcaatgaataacaggcaaaattgctacctcgggattaactgggactctttacaaactctccagcagtagctgaggatgttgacagcaagactgccaggtgtgagggcgaggtacaaataacccatractcagaaatgtgtgtttcttttccctcgtcatgtgcaggtgttcacacggcaactgctgtctcagactgttgtcctacgtttcaagagaaacctatttccctccttttgggaacatctttgtaatatacatacatatatatgaaatatgcatatatatatgtatatctcaaatatgtgcatacatgtatgtgagacatacacatatatgagatatacctatgcatatgtgtatctcatatatgttaacacacatgcataatatataaaaaacataaatatattacaggtgagagaggaa

SEQ ID NO: 153385 - DNA, 601 bp, Human
tggaagtagagaacagggccctcaccagacactgaacctgctggtgctttgatcctggacttcccagcctctagaactaagagaaaaaaatttctactttttataaattaccagatctatggcattttgttatagcagtacaaacagattacgagaccattgtacggatataccctaattggattatccgttcttctaatgatagatattttgctctaataattctcaagatatttttgggttcaaataaaacaactatttgaaaaggatggagacaaattgaggatactaatttaaacamttgcattttggcagaacaagcacataagcctctcacccaaagtttgcaagcaaatgtgtttgtcttagtggcattgcaggtaaatcacatggtatgttgttttaacatcattagcaacctactccaaaacgggacactcaaataacatctaaaattggtgagttaagctagaaatataacataagcaaaaactgagacattttgattttttaatatattgttacttaagatgaataataataccaaacttttgagaaagatctccaatccacatggattgtattacttaatgtttgtttg

SEQ ID NO: 153386 - DNA, 601 bp, Human
caaaaatcagatttatctgattgaagtataattcacatacaataaaatccaccaactttaatagcacaattcagtgcattttgacaaaatatgcagtcatgtagcctccaccatgatgaaggtataaagcttctccatcattgcaaagtttctcgatgcccctctgcagtgagtgtctcaaccagccccagcccctagcaaccactgatctactttctgtcactacatttgtgccctttctagaattttatataagtggaatcatgtagtatgttgccttttgtgtctggcttctttttcktagtataataatgttgagattcatccatgctgttgcattgatcagtagttccttcttatttattgctaaggagtataccatctgctatagcctgaatgtgtcccccaaaattcatatgttgaaacttagttaccatgtgatcatattaagaggtgaggccttaaggaggtgattgagtttagagggcaaagaccacataaatggaattatagactttataaacggacttgagggaactagttagtccctttcctgcccttctgtcgtgtctgccatctgaggacacagcattcctcccct

SEQ ID NO: 153387 - DNA, 601 bp, Human
ttccttcttttctctggtatccagaggtcacctacattccttggcttgtggctccattctccagcttccagtccagcagtgtagcatctttaagcctctctctctttgtgacatctgctcccataatcacaccttttcctactccaacccttctgcctccctctcatgaagacccttgtgatcacactgggtccacctggataatccaggataatatcatcatctcacattccttagtcacatctgccaagtccttttgccatgtaaggtcacatactcataggtgctgaagattagatgygagcatttgatgggaggaagggcaccgtgccttgtgctggactcttagctataatactctgtggtctcatacatgaagaaattgcataagtaagttgcactccctagtgtatgcactctcagtggggatggtattaatcccaagagggcgaaaatggttctatgggagaggatgaacaaaactcattctttttacgtatagagcacagatacagtacatacacagatacacgtcagtgatattacaatttcatgaatgggatgcgcttagctcttaatgcattacctcgtctagtcctgg

SEQ ID NO: 153388 - DNA, 601 bp, Human
ttagaattttcaatccaataaaatgattccacttacatcttttttttaagaaaagcaaaattagtctattctttttaggaacaatgactaggagcaaaaaaggaaaatactaattttagaaaccttttatccaggtcaaacattccttctgtttctggaaaatgacgtgtcctggcagggaaggcatgtcttagtctctgccatacgttagcagtgaggcctgagaactaatgtcataaatttgctagaaaggaatcaaagaaggccaaaaatcaggcatttttatttctccaaagatctrtgaagttttaggcataaataatatgcaggtgggaaaatctggtcaggtgatatgtcagggaaagccaatggtaaagaataagtatgaaaatagcctctactttttttttttttttaaatagagatggggtctctatgttgcccaggctgaactcaaactcctggactcaagcaatcctcccacctcagcctcccagagtgctgggattttaggcgtgagccactgcacccatcccaatagcctctacttttagttttgcccggactcctttatttcagcacttttatcttgtgccagctg

SEQ ID NO: 153389 - DNA, 601 bp, Human
ttgagtttggaaacagataaaaaataagatcaattggagggaaatagtggacactaggagaacacatgtatttgctcccttccagacaagtgctgttgcctatattttttactacatcagggagctatgctttttggcatcaggtctcccattccactttgactaggcattgatattggcaaatgcttctcttctcactcattatgttattggcaggagcacttttctcaagttagaattttcaatccaataaaatgattccacttacatcttttttttaagaaaagcaaaattagtctaktctttttaggaacaatgactaggagcaaaaaaggaaaatactaattttagaaaccttttatccaggtcaaacattccttctgtttctggaaaatgacgtgtcctggcagggaaggcatgtcttagtctctgccatacgttagcagtgaggcctgagaactaatgtcataaatttgctagaaaggaatcaaagaaggccaaaaatcaggcatttttatttctccaaagatctatgaagttttaggcataaataatatgcaggtgggaaaatctggtcaggtgatatgtcagggaaagccaa

SEQ ID NO: 153390 - DNA, 601 bp, Human
agatctccttaatgtcttttgaaaggccagagtgaggatatgaactactttcctttgctcaattctaataattctttggaatcacctctggcagacactgtttgtggcctgcccaatagccaatcgtctccagccccaaccatgtattattattattcacttgcatctcaaagagatgcttgattcccagtatcccatgcagctggtatgggccatgtgatgtagctctggccaataagaggatgcctacatggtggcagaggcttcagggaaggatcctccttcctcgcataatacaagragaaaaaaaaatggtggcaaagtttggcctttcctctcctgcttttggatcccatgatgtagagatgtgatgtttggttctgtgacagccatcttgtgagcaggagtgacacaattggctcatgtacttggtgttttgatgaggctgtcagactgctgtaccaaatttagaactgccacctccagacttcttgctcaaattaaaagtgctatttacttatccagggttgcattccttgaagctgagtgcagcagagtctgggaacttgcccttcggccttattattttattcctctgcta

SEQ ID NO: 153391 - DNA, 601 bp, Human
ctattagctgaaatgcccatgatgtcttctttaatcacaggtctggttcctggactgggatggctggaatatttgggaactggctgggtacctctctcttgcctcatggcttcttcatgtgactagcttgggctctctcacagcatggcaatctcagggtagaacttctgatattgtgtctagcctttctcagagctagtgttgcaagagacaaggcagaagctccgagtcttcttaaaaggcttcttgaaagtcctgtgtcatcccttctactacatactgttggttatataggaccagyccagaggggactacacaggggtgtgaataccaggaagcatgggttattgcgtggtgggttgtatgtgtgcatctttggagactatcaaccacaataatgcaatagggaagataattttatctaacaggaattctccactagactttttggtgagaaaaagcactgagtttgagaaggatgagatttccccagggctcttgctcactcccaaggaagacagaggcacaaggagctgttgggccatctgggagagccagtgttcagaactctctgttattactttagactcagtggtgatac

SEQ ID NO: 153392 - DNA, 601 bp, Human
cacagctggggtgccttgaaaggatgaagatggctgggacggctcacacagggacatatgtctggagctttagttctggctatgggctggttcctatggtccttcctcatacggcatctattagctgaaatgcccatgatgtcttctttaatcacaggtctggttcctggactgggatggctggaatatttgggaactggctgggtacctctctcttgcctcatggcttcttcatgtgactagcttgggctctctcacagcatggcaatctcagggtagaacttctgatattgtgtctagsctttctcagagctagtgttgcaagagacaaggcagaagctccgagtcttcttaaaaggcttcttgaaagtcctgtgtcatcccttctactacatactgttggttatataggaccagcccagaggggactacacaggggtgtgaataccaggaagcatgggttattgcgtggtgggttgtatgtgtgcatctttggagactatcaaccacaataatgcaatagggaagataattttatctaacaggaattctccactagactttttggtgagaaaaagcactgagtttgagaaggatgaga

SEQ ID NO: 153393 - DNA, 601 bp, Human
cagatgccaggtgcagtggctcatacctgtaattctagcactttgggaggctgagatgggcagatcacctgaagtcaaggagttccagaccagcctggccaacatggtgaaaaccagtctgtactaaaaatacaaaaattagccagacatggtggcacgtgcctgtaatcccagctatacaagaggctgaggcaggagaatcacttgatctgggacgtggaggttgcagcaagccaagatcgtgccactgcactccagcctgggtgacagagtgagactctgtctcaaaaaaaaaaaaaaagaattcaggcagagagaggataggatcagcttatttctgctctatgatgtctggagccacagctggggtgccttgaaaggatgaagatggctgggacggctcacacagggacatatgtctggagctttagttctggctatgggctggttcctatggtccttcctcatacggcatctattagctgaaatgcccatgatgtcttctttaatcacaggtctggttcctggactgggatggctggaatatttgggaactggctgggtacctctctcttgcctcatggcttcttcatgtgactag

SEQ ID NO: 153394 - DNA, 601 bp, Human
gagccaagatcatgccactgcactccagcctggtggacagcgcgagactccatctcaaaaaaaaaaaaaaaaaaaagaattcaggcagatgccaggtgcagtggctcatacctgtaattctagcactttgggaggctgagatgggcagatcacctgaagtcaaggagttccagaccagcctggccaacatggtgaaaaccagtctgtactaaaaatacaaaaattagccagacatggtggcacgtgcctgtaatcccagctatacaagaggctgaggcaggagaatcacttgatctgggasgtggaggttgcagcaagccaagatcgtgccactgcactccagcctgggtgacagagtgagactctgtctcaaaaaaaaaaaaaaagaattcaggcagagagaggataggatcagcttatttctgctctatgatgtctggagccacagctggggtgccttgaaaggatgaagatggctgggacggctcacacagggacatatgtctggagctttagttctggctatgggctggttcctatggtccttcctcatacggcatctattagctgaaatgcccatgatgtcttctttaatcacagg

SEQ ID NO: 153395 - DNA, 601 bp, Human
ggccgggtgcggtggctcatgcctgtaatcccagcactttgggaggccaaggtgggtggatcacgaggtcaggagtttgagaccagcctgcccaacatagtggaaccccgtctgtactaaaaatacagaagattagctgggtgtggtggcgggcacctgtaatcccagctacttgggaggctgaggcaggagaatcacttgaagctggaaggcagaggttgcagtgagccaagatcatgccactgcactccagcctggtggacagcgcgagactccatctcaaaaaaaaaaaaaaaaaaaagaattcaggcagatgccaggtgcagtggctcatacctgtaattctagcactttgggaggctgagatgggcagatcacctgaagtcaaggagttccagaccagcctggccaacatggtgaaaaccagtctgtactaaaaatacaaaaattagccagacatggtggcacgtgcctgtaatcccagctatacaagaggctgaggcaggagaatcacttgatctgggacgtggaggttgcagcaagccaagatcgtgccactgcactccagcctgggtgacagagtgagactctgtctcaaaaa

SEQ ID NO: 153396 - DNA, 601 bp, Human
tatctatggctgtgtaacaagcatccccaaaatgattgacttaaccaccattttattaggtcatgattccatgcattaagaattcagggccgggtgcggtggctcatgcctgtaatcccagcactttgggaggccaaggtgggtggatcacgaggtcaggagtttgagaccagcctgcccaacatagtggaaccccgtctgtactaaaaatacagaagattagctgggtgtggtggcgggcacctgtaatcccagctacttgggaggctgaggcaggagaatcacttgaagctggaaggcrgaggttgcagtgagccaagatcatgccactgcactccagcctggtggacagcgcgagactccatctcaaaaaaaaaaaaaaaaaaaagaattcaggcagatgccaggtgcagtggctcatacctgtaattctagcactttgggaggctgagatgggcagatcacctgaagtcaaggagttccagaccagcctggccaacatggtgaaaaccagtctgtactaaaaatacaaaaattagccagacatggtggcacgtgcctgtaatcccagctatacaagaggctgaggcaggagaatcac

SEQ ID NO: 153397 - DNA, 601 bp, Human
tactaatagttatttcagttatctatggctgtgtaacaagcatccccaaaatgattgacttaaccaccattttattaggtcatgattccatgcattaagaattcagggccgggtgcggtggctcatgcctgtaatcccagcactttgggaggccaaggtgggtggatcacgaggtcaggagtttgagaccagcctgcccaacatagtggaaccccgtctgtactaaaaatacagaagattagctgggtgtggtggcgggcacctgtaatcccagctacttgggaggctgaggcaggagaawcacttgaagctggaaggcagaggttgcagtgagccaagatcatgccactgcactccagcctggtggacagcgcgagactccatctcaaaaaaaaaaaaaaaaaaaagaattcaggcagatgccaggtgcagtggctcatacctgtaattctagcactttgggaggctgagatgggcagatcacctgaagtcaaggagttccagaccagcctggccaacatggtgaaaaccagtctgtactaaaaatacaaaaattagccagacatggtggcacgtgcctgtaatcccagctatacaagag

SEQ ID NO: 153398 - DNA, 601 bp, Human
aaaatatgattgcatttattcatatatgttaattggtatgtatgtaagtatatatgcatgtaaaaataaaatacaaagaattaaaatgcatactaatagttatttcagttatctatggctgtgtaacaagcatccccaaaatgattgacttaaccaccattttattaggtcatgattccatgcattaagaattcagggccgggtgcggtggctcatgcctgtaatcccagcactttgggaggccaaggtgggtggatcacgaggtcaggagtttgagaccagcctgcccaacatagtggarccccgtctgtactaaaaatacagaagattagctgggtgtggtggcgggcacctgtaatcccagctacttgggaggctgaggcaggagaatcacttgaagctggaaggcagaggttgcagtgagccaagatcatgccactgcactccagcctggtggacagcgcgagactccatctcaaaaaaaaaaaaaaaaaaaagaattcaggcagatgccaggtgcagtggctcatacctgtaattctagcactttgggaggctgagatgggcagatcacctgaagtcaaggagttccagaccagcc

SEQ ID NO: 153399 - DNA, 601 bp, Human
gccagaggagtgctgtgactcgtgcctctaatcccagcaatgtgggaggccaaggagggacagtcacttgagcccaggagtttgagaccagcctggataacaaagggagacctcatctttacaaaaaaactaaaaaattagccaggtgtggtggtgtgtgcctgtgatcccagctacacaggaggctgaggcaagaggattccttgagccctggaggtcaaggctgcagtgagtgatgatcatgccattgcactccagctgggtgacagagcaagacctcatctcaaaaaaaaaaaaaaaacaaaacaaaacaaaaaacttacgcccaggtaaaaattgtcagagaaaaataagaaaaaaactgaatgcccaaaattagcataatggctgaatgaattatagtatgtctataccttgaagtacattgtagctttaaaaaaaatgaattaaagttataccagttgaatttggagttgagatggggaagattattacaattaaaaaaaaacaaacactattaatggatgtgctgggaaatgtctgtatggggctagttaaagtaaattaaaataaagaccagacctgaagaatccctgagcgg

SEQ ID NO: 153400 - DNA, 601 bp, Human
cttatgccagaggagtgctgtgactcgtgcctctaatcccagcaatgtgggaggccaaggagggacagtcacttgagcccaggagtttgagaccagcctggataacaaagggagacctcatctttacaaaaaaactaaaaaattagccaggtgtggtggtgtgtgcctgtgatcccagctacacaggaggctgaggcaagaggattccttgagccctggaggtcaaggctgcagtgagtgatgatcatgccattgcactccagctgggtgacagagcaagacctcatctcaaaaaaaaaamaaaaacaaaacaaaacaaaaaacttacgcccaggtaaaaattgtcagagaaaaataagaaaaaaactgaatgcccaaaattagcataatggctgaatgaattatagtatgtctataccttgaagtacattgtagctttaaaaaaaatgaattaaagttataccagttgaatttggagttgagatggggaagattattacaattaaaaaaaaacaaacactattaatggatgtgctgggaaatgtctgtatggggctagttaaagtaaattaaaataaagaccagacctgaagaatccctg

SEQ ID NO: 153401 - DNA, 601 bp, Human
aaatacttatgccagaggagtgctgtgactcgtgcctctaatcccagcaatgtgggaggccaaggagggacagtcacttgagcccaggagtttgagaccagcctggataacaaagggagacctcatctttacaaaaaaactaaaaaattagccaggtgtggtggtgtgtgcctgtgatcccagctacacaggaggctgaggcaagaggattccttgagccctggaggtcaaggctgcagtgagtgatgatcatgccattgcactccagctgggtgacagagcaagacctcatctcaaaaamaaaaaaaaaacaaaacaaaacaaaaaacttacgcccaggtaaaaattgtcagagaaaaataagaaaaaaactgaatgcccaaaattagcataatggctgaatgaattatagtatgtctataccttgaagtacattgtagctttaaaaaaaatgaattaaagttataccagttgaatttggagttgagatggggaagattattacaattaaaaaaaaacaaacactattaatggatgtgctgggaaatgtctgtatggggctagttaaagtaaattaaaataaagaccagacctgaagaat

SEQ ID NO: 153402 - DNA, 601 bp, Human
aattttctaagtgtattccaaataacttttaatattggataaacattacgagtttaaaaatacttatgccagaggagtgctgtgactcgtgcctctaatcccagcaatgtgggaggccaaggagggacagtcacttgagcccaggagtttgagaccagcctggataacaaagggagacctcatctttacaaaaaaactaaaaaattagccaggtgtggtggtgtgtgcctgtgatcccagctacacaggaggctgaggcaagaggattccttgagccctggaggtcaaggctgcagtgagygatgatcatgccattgcactccagctgggtgacagagcaagacctcatctcaaaaaaaaaaaaaaaacaaaacaaaacaaaaaacttacgcccaggtaaaaattgtcagagaaaaataagaaaaaaactgaatgcccaaaattagcataatggctgaatgaattatagtatgtctataccttgaagtacattgtagctttaaaaaaaatgaattaaagttataccagttgaatttggagttgagatggggaagattattacaattaaaaaaaaacaaacactattaatggatgtgctggg

SEQ ID NO: 153403 - DNA, 601 bp, Human
tgcttgaagctatgataacttgatgatgatgatgatgatgatgatgatgacgatgattttttttatagccatctttttagagggatttgaggtagggaaaaaaataaacctcacactatcggaggttgccaactatgaggtctgctgatggtttggccaacacagtgtttatatttttttgaattgggaaatttcatttaaaagtcctaaaatcaggctgttattgaaatatcttattattggctcagggtttcccagggcagccatccttgaagctgtgtggagccctataaacaaggasgctttccagttccctgcaaactccatttcattcagagccttgagccagttcttacatggtcctcagacttgagctagtgcaagaatacccgggaggggttgtgggaacagatagctgggccccacccccagggaagggggtgtttctgactcaggaggtctgggctccggctacagaaactgcacatctaaccggtacccaggtgatgtgatgctgctggcccagggacaactctgcgagtcactgctattgggcactgctattgcacccacacaaggaggcaggctctgcttacatttt

SEQ ID NO: 153404 - DNA, 601 bp, Human
atcacctggagctgatgtaactctcagaaggcatttttaagaggactcatgaattaaccacatagccaacttactggcttaagactacgtgacagaaagctgcaaagggggccagccactggtaacatcccaccactgtccctctctgtggaaaacacagatgggatgcacattgtgacgggcaggatgcctggagagcccacaaatctgcaagcacagctgaaattggttacaggatttcaatgtttcattgcttgaagctatgataacttgatgatgatgatgatgatgatgatgatgtcgatgattttttttatagccatctttttagagggatttgaggtagggaaaaaaataaacctcacactatcggaggttgccaactatgaggtctgctgatggtttggccaacacagtgtttatatttttttgaattgggaaatttcatttaaaagtcctaaaatcaggctgttattgaaatatcttattattggctcagggtttcccagggcagccatccttgaagctgtgtggagccctataaacaaggacgctttccagttccctgcaaactccatttcattcagagccttgagccagt

SEQ ID NO: 153405 - DNA, 601 bp, Human
tggggcttggggagccatcagagttagggtggggattttttctctgccttatcttattatgtatatcgctcagaatgtttgctatgtgtatgcacctaccccatccattaagaaatgaagaaataatgaaaagaaaaaatgaaagtagggaactagaaatgagaggtgggattcaaagtggactgaacacttgacctatttcccaatttgcctggggctggcccagcagcgaggcaggttctaaccaatgagcatcagctttgaatggaggggctgataggccaggtgggccctgcttgcygagagtgtcatggccttagggacatctccatgttgcagagtctgagcctctgcttggcaaattcagaaaatccagcttttctttttatatcacctggagctgatgtaactctcagaaggcatttttaagaggactcatgaattaaccacatagccaacttactggcttaagactacgtgacagaaagctgcaaagggggccagccactggtaacatcccaccactgtccctctctgtggaaaacacagatgggatgcacattgtgacgggcaggatgcctggagagcccacaaatctgca

SEQ ID NO: 153406 - DNA, 601 bp, Human
taaggaaggaaatttgggatggggcttggggagccatcagagttagggtggggattttttctctgccttatcttattatgtatatcgctcagaatgtttgctatgtgtatgcacctaccccatccattaagaaatgaagaaataatgaaaagaaaaaatgaaagtagggaactagaaatgagaggtgggattcaaagtggactgaacacttgacctatttcccaatttgcctggggctggcccagcagcgaggcaggttctaaccaatgagcatcagctttgaatggaggggctgataggmcaggtgggccctgcttgctgagagtgtcatggccttagggacatctccatgttgcagagtctgagcctctgcttggcaaattcagaaaatccagcttttctttttatatcacctggagctgatgtaactctcagaaggcatttttaagaggactcatgaattaaccacatagccaacttactggcttaagactacgtgacagaaagctgcaaagggggccagccactggtaacatcccaccactgtccctctctgtggaaaacacagatgggatgcacattgtgacgggcaggatgcctg

SEQ ID NO: 153407 - DNA, 601 bp, Human
ataagaaactgtaaagtatttacttctaaggaaggaaatttgggatggggcttggggagccatcagagttagggtggggattttttctctgccttatcttattatgtatatcgctcagaatgtttgctatgtgtatgcacctaccccatccattaagaaatgaagaaataatgaaaagaaaaaatgaaagtagggaactagaaatgagaggtgggattcaaagtggactgaacacttgacctatttcccaatttgcctggggctggcccagcagcgaggcaggttctaaccaatgagcatyagctttgaatggaggggctgataggccaggtgggccctgcttgctgagagtgtcatggccttagggacatctccatgttgcagagtctgagcctctgcttggcaaattcagaaaatccagcttttctttttatatcacctggagctgatgtaactctcagaaggcatttttaagaggactcatgaattaaccacatagccaacttactggcttaagactacgtgacagaaagctgcaaagggggccagccactggtaacatcccaccactgtccctctctgtggaaaacacagatgggat

SEQ ID NO: 153408 - DNA, 601 bp, Human
ggagacaacttataaatagacatgcctgggatacctctggatataagaaactgtaaagtatttacttctaaggaaggaaatttgggatggggcttggggagccatcagagttagggtggggattttttctctgccttatcttattatgtatatcgctcagaatgtttgctatgtgtatgcacctaccccatccattaagaaatgaagaaataatgaaaagaaaaaatgaaagtagggaactagaaatgagaggtgggattcaaagtggactgaacacttgacctatttcccaatttgcctrgggctggcccagcagcgaggcaggttctaaccaatgagcatcagctttgaatggaggggctgataggccaggtgggccctgcttgctgagagtgtcatggccttagggacatctccatgttgcagagtctgagcctctgcttggcaaattcagaaaatccagcttttctttttatatcacctggagctgatgtaactctcagaaggcatttttaagaggactcatgaattaaccacatagccaacttactggcttaagactacgtgacagaaagctgcaaagggggccagccactggtaa

SEQ ID NO: 153409 - DNA, 601 bp, Human
ctgggcgtagtggcgggcgcctgtaatctcagctacttgggaggcggtggcaggagaatcatttgaacctgggaggcagaggttgcagtgagccgagattgtgccactgcactctaacctgggcaacagagttcagagtgagactctgtctcccccaaaaaaaaaaaaaaaaaaaaaagaacagccatatagatcgtcggtgggagtgtaatttggccacttctttggaaaatagctcagtaatatctattaatacttaaaatttcacaaacactgtaagtctaacttccacttctaaaaygttatcctagaaataaaattgcataggggtacaaaggcttacgtatggaactatttgctggactactgtagttgtggcaaaaaactggaaatgacctaaacgcttattagtagaaacctggttaaataaattatcatatgtccttgaggacacagggacacaaagaggggaatgacaggcactgagcctacttgagggtgggaggaggaagtcgatcagaaaaaataactagtgggtactaggcttagtacccgggtgaaaaaataatctgtacaacaaacccccatgacatgagtttac

SEQ ID NO: 153410 - DNA, 601 bp, Human
aaaacaaaacaaaacaaaacaccaaaaaatagctgggcgtagtggcgggcgcctgtaatctcagctacttgggaggcggtggcaggagaatcatttgaacctgggaggcagaggttgcagtgagccgagattgtgccactgcactctaacctgggcaacagagttcagagtgagactctgtctcccccaaaaaaaaaaaaaaaaaaaaaagaacagccatatagatcgtcggtgggagtgtaatttggccacttctttggaaaatagctcagtaatatctattaatacttaaaatttcacmaacactgtaagtctaacttccacttctaaaatgttatcctagaaataaaattgcataggggtacaaaggcttacgtatggaactatttgctggactactgtagttgtggcaaaaaactggaaatgacctaaacgcttattagtagaaacctggttaaataaattatcatatgtccttgaggacacagggacacaaagaggggaatgacaggcactgagcctacttgagggtgggaggaggaagtcgatcagaaaaaataactagtgggtactaggcttagtacccgggtgaaaaaataat

SEQ ID NO: 153411 - DNA, 601 bp, Human
aatctagcatttgcatataatagagtattaatcagccataagaagaaacaaagcaccgatccatgttatatcatgctttatacttggaagcatggtactaagtgaaagacgccagacacaaaaagcaaaatattgtatgattccatttatataaagtgtctagaataggcaaatccatagaggcagaaaacagattagtggttgccagtggctgggaatagggaaaaaactcagcgctaaagggtagggagttttgttttggagtaatgacgatgttctggaattagacgtggaacgattrcacacatggtgcaaatatccttaaaatcacggaattgtcactctaaaaggtgaattttatggtaggtgaattgtacctcaatttgtaaaaagaagaattagataaataaacagcaacacagcaccaaggggtgggggtaggaaacagacaacaaataggagtgaagagttcacaggaaaagacatgcagccagcttttaagcagaagaaaagatgtttggcctcataaatagtaaaataaaagcacaataaaattatgacacttggctttcccttgccaaattggttaaaaaggagacaa

SEQ ID NO: 153412 - DNA, 601 bp, Human
tgtacacaaatgtccatagcagcattttcataatagctgaaaagtggaaacaacccaaatatccatcaattggaaaaaggaaatctagcatttgcatataatagagtattaatcagccataagaagaaacaaagcaccgatccatgttatatcatgctttatacttggaagcatggtactaagtgaaagacgccagacacaaaaagcaaaatattgtatgattccatttatataaagtgtctagaataggcaaatccatagaggcagaaaacagattagtggttgccagtggctgggaatcgggaaaaaactcagcgctaaagggtagggagttttgttttggagtaatgacgatgttctggaattagacgtggaacgattgcacacatggtgcaaatatccttaaaatcacggaattgtcactctaaaaggtgaattttatggtaggtgaattgtacctcaatttgtaaaaagaagaattagataaataaacagcaacacagcaccaaggggtgggggtaggaaacagacaacaaataggagtgaagagttcacaggaaaagacatgcagccagcttttaagcagaagaaaagatgtttg

SEQ ID NO: 153413 - DNA, 601 bp, Human
aaaacagacactgccatattattttcttaaaaaggctctacagattcacatttccagcagcaatgagtgtctcaagcaccttttaagtggtaagcagcttaccaggggaggtggcctattattctatcagtggcttcagttgttaggacaccacgggtcagctgtggagatacggttgtggggcaggttgagttcaggacacatagaagattgccaaagggtgactattattactttgagactctggaaaaattagccaggaaacagagacaagaggctcagggtgcagcaaagcagccawatcaggatgatagtgttttctttggagcagatatactaatggccaaggaactcataaaaagatgcctaatgtcatctcattagggaagtgcagtcaaagccacagcatgatacgtcttcacacccacgaggatggccataatcagagagacaataaccagtggtagggaagatgtgaaaaaatcggaatgctcatgcattgctggtaggaatgtgacatggtgcagctgctttggaaagcagtttaacagttcctggaaaagttaaacatggagttaccctaagacccagcaattccatt

SEQ ID NO: 153414 - DNA, 601 bp, Human
caaaagatatttaaaccattgcctaatcaatgaatatcctggtagtttccacattgttttttccatttccactatagtggaataaactttcgtgttcaaaaatcctaaactggtgctatatttctatagaatagaggcacagatgtagaagtgttaccctcaaatcaatatgcatttagttttgaaaaacagacactgccatattattttcttaaaaaggctctacagattcacatttccagcagcaatgagtgtctcaagcaccttttaagtggtaagcagcttaccaggggaggtggcctattattctatcagtggcttcagttgttaggacaccacgggtcagctgtggagatacggttgtggggcaggttgagttcaggacacatagaagattgccaaagggtgactattattactttgagactctggaaaaattagccaggaaacagagacaagaggctcagggtgcagcaaagcagccaaatcaggatgatagtgttttctttggagcagatatactaatggccaaggaactcataaaaagatgcctaatgtcatctcattagggaagtgcagtcaaagccacagcatgatacgt

SEQ ID NO: 153415 - DNA, 601 bp, Human
tcacagtcaatagctccaaagctatcttatcttctaaaatagctgcataatattcctcagtatggatataccaaaagatatttaaaccattgcctaatcaatgaatatcctggtagtttccacattgttttttccatttccactatagtggaataaactttcgtgttcaaaaatcctaaactggtgctatatttctatagaatagaggcacagatgtagaagtgttaccctcaaatcaatatgcatttagttttgaaaaacagacactgccatattattttcttaaaaaggctctacagaktcacatttccagcagcaatgagtgtctcaagcaccttttaagtggtaagcagcttaccaggggaggtggcctattattctatcagtggcttcagttgttaggacaccacgggtcagctgtggagatacggttgtggggcaggttgagttcaggacacatagaagattgccaaagggtgactattattactttgagactctggaaaaattagccaggaaacagagacaagaggctcagggtgcagcaaagcagccaaatcaggatgatagtgttttctttggagcagatatactaatggcc

SEQ ID NO: 153416 - DNA, 601 bp, Human
ataaatctgataataatgtacatttaacccgtgtttacaaccaaaataattaatctctctgaaccctttgtttttcctgtctctatcctccaccctcattgccagataaataacatctgcaacctgatgtggcatattgaactttgtttatactcacacaaacacgtataagcatcccagatacacatatacagggactgtatctgtccttgttgtttttatagaaattggatcacattagacatattttctgatgacttttgtacattatagttggtcttcacagtcaatagctccaaakctatcttatcttctaaaatagctgcataatattcctcagtatggatataccaaaagatatttaaaccattgcctaatcaatgaatatcctggtagtttccacattgttttttccatttccactatagtggaataaactttcgtgttcaaaaatcctaaactggtgctatatttctatagaatagaggcacagatgtagaagtgttaccctcaaatcaatatgcatttagttttgaaaaacagacactgccatattattttcttaaaaaggctctacagattcacatttccagcagcaatg

SEQ ID NO: 153417 - DNA, 601 bp, Human
aagacctcaaaaaattatgcaaaaatgacccttcaatggtcatgctgcaagagtcaaatgacacttcaaacaactgcggctttctatgttgtgcaaatgcatttgttgttttaaaggtcgtaaagtcagggtacacgtggcagatacttatgacttggaggaagacgttagattagatttgaaactttcactgaatgatcgcatttcatgcttttcatctgtacattaaaaagccagaatgtctttgccaagaaattctagcataaataaaagaaaaggatgggattttggaacatcatgstagaattcttgactatcagctttatacaacatgtctggacatttagtgatggaaatgctggattccaaaggaatgtaggcaaaggtactactacccccatgctcttcagaaaacatcctctaaaagcaacagtgatgatcagatactgtggggcaagactgacagtgacactcaagatttccactcttctctttaatcatatatttcctgtcattcatgtgctacaaaactctggaatatgcaaagctcattcaaatgcaaaaccagcctttgctccaacatgagcatatattttcattt

SEQ ID NO: 153418 - DNA, 601 bp, Human
atgaagacctcaaaaaattatgcaaaaatgacccttcaatggtcatgctgcaagagtcaaatgacacttcaaacaactgcggctttctatgttgtgcaaatgcatttgttgttttaaaggtcgtaaagtcagggtacacgtggcagatacttatgacttggaggaagacgttagattagatttgaaactttcactgaatgatcgcatttcatgcttttcatctgtacattaaaaagccagaatgtctttgccaagaaattctagcataaataaaagaaaaggatgggattttggaacatcrtggtagaattcttgactatcagctttatacaacatgtctggacatttagtgatggaaatgctggattccaaaggaatgtaggcaaaggtactactacccccatgctcttcagaaaacatcctctaaaagcaacagtgatgatcagatactgtggggcaagactgacagtgacactcaagatttccactcttctctttaatcatatatttcctgtcattcatgtgctacaaaactctggaatatgcaaagctcattcaaatgcaaaaccagcctttgctccaacatgagcatatattttca

SEQ ID NO: 153419 - DNA, 601 bp, Human
ggaaacatgggtgaagcagcaagcacagagcttggggcacagcctagcaaacactccacaaaggaccatgattgtaactgtagtagggcacaccaatgaacaggttgggaaactgagtctctgagaagagactaatgttgtgctggatgaaatttctttttctgacaatacattatccaaatcctccaagctttcagtttaaaggggaaagcaggaactatcattataattttatttacaaagtgtccatgtatgaacattattcaccgccgaatcatctcttcctatgcaagcaacaccrtcctatgcatcaatatcctgatctgtcaggattcaggataaagtggacatatacacactaattgcaaagggaaattgtacatcttgcaaaagatgcaggggtttatagagtcttgtaacattggtgagctgctcagatcacacacatgaccgtggttggacaaggatctggcaaagttaacacagatcaccgaagaaggaaaagtggacaacacaacacagtaagttcttcaaaagagttatattagaatatcaaaagattatgttaggcctttgggaaaactcaaaactttatgaagac

SEQ ID NO: 153420 - DNA, 601 bp, Human
acatgtttccacctgcagccctcaccactagttattctttcaatctggaaatattttcgctaagatcttcctatggttaccttcttatcattcaagacttaggttatgtcaggccttccctgactcctccatctgaagtaacccctcctgcttactcctgtttattctctagactccacagaggattcatcactctctgaaatgatcccattaatttcttcttcacttgtttcctctccacgacctgtaagccccaagtggacccggacttggtctgctctgcttacagctggattccagytcccatagtgctagacactaggattaagccaggaaacatgggtgaagcagcaagcacagagcttggggcacagcctagcaaacactccacaaaggaccatgattgtaactgtagtagggcacaccaatgaacaggttgggaaactgagtctctgagaagagactaatgttgtgctggatgaaatttctttttctgacaatacattatccaaatcctccaagctttcagtttaaaggggaaagcaggaactatcattataattttatttacaaagtgtccatgtatgaacattattcaccg

SEQ ID NO: 153421 - DNA, 601 bp, Human
ccaggcaagtttcagaaatgtttatcattttcaaagtaccaaatattctcgtcaaaacaagctgcttcatcagagttctaattatatatttaaacatacatgcacacacacacgtttgtattacaatattcaaaacttctgaggaagaattatcttttttttttcatgtgccaaagctaaaactttcacttgctacagctgtgtattagtctatttccatactgctataaagagctgcccaagactgggtgatttataaaggaaagaggtttaattgactcacagttcagcatggcagggraggcctcaggaaacttacaatcatggtggaagtcaaagggggagcaaggacctttcttcacaaggcagcagaaagaagtgccaaatgaacagggaagagctccttatgaaaccatcaggtcttgtgagaactcacttacttttatgagaacagcatggaggaaactgtccccatgatccaatcacctccacctggtctctcccttgacacgtggggattatggggattaaattccagatgagatttgggtggggacaaaaagcctaacgacatcaagctgtaaaaacaatagctaacatt

SEQ ID NO: 153422 - DNA, 601 bp, Human
ttttgtatttttaaatgtaagccataaggaaaggaattattccaatagtttaatttacaaacttgagttttctagaaagacttttaaaaacagtagtgatataaatcaatttatcttaagaaacataagtatctgggccaggcaagtttcagaaatgtttatcattttcaaagtaccaaatattctcgtcaaaacaagctgcttcatcagagttctaattatatatttaaacatacatgcacacacacacgtttgtattacaatattcaaaacttctgaggaagaattatcttttttttttcatgtgccaaagctaaaactttcacttgctacagctgtgtattagtctatttccatactgctataaagagctgcccaagactgggtgatttataaaggaaagaggtttaattgactcacagttcagcatggcagggaaggcctcaggaaacttacaatcatggtggaagtcaaagggggagcaaggacctttcttcacaaggcagcagaaagaagtgccaaatgaacagggaagagctccttatgaaaccatcaggtcttgtgagaactcacttacttttatgagaacagcatggaggaa

SEQ ID NO: 153423 - DNA, 601 bp, Human
gaggattaaatgaaatattgcccatacagtgcttaccacaggctggtagatgattggtattcggtaaacagtagttatttttgttatactaatatgttattaatataattaccattttgtatttttaaatgtaagccataaggaaaggaattattccaatagtttaatttacaaacttgagttttctagaaagacttttaaaaacagtagtgatataaatcaatttatcttaagaaacataagtatctgggccaggcaagtttcagaaatgtttatcattttcaaagtaccaaatattctmgtcaaaacaagctgcttcatcagagttctaattatatatttaaacatacatgcacacacacacgtttgtattacaatattcaaaacttctgaggaagaattatcttttttttttcatgtgccaaagctaaaactttcacttgctacagctgtgtattagtctatttccatactgctataaagagctgcccaagactgggtgatttataaaggaaagaggtttaattgactcacagttcagcatggcagggaaggcctcaggaaacttacaatcatggtggaagtcaaagggggagcaagg

SEQ ID NO: 153424 - DNA, 601 bp, Human
tccaaataggaagagaggaagtcaaactatccttgtttgcagattacatgacattatatctagaaaaccccatagtctcagccccaaagcttcttaagctgataaacaacttcagcaaagtctcaggatacaaaataaatgtgcaaaaattactggcatttccatgcaccaacaacagtcaagccaggagccaaaccaggaatgcactcccactcacaatcgccacaaaaagagtaaaatacctaggaaaacagctaattagggaggtgaaagatctctacaaggagaataatgaaccagygctcaaagaaattagagatgacacaaacaaatggaaaaacattccatgttcattgataggaagaatcaatatcattaaaatggccatattgcccagagcaatttatagattcaatgctatacctattaaactactgttgagattcttcacagaaccagagaaaactattttaaaattcatatagaacccagaaaagagcctgaattgctaaggcaatcctaagcaaaaagcataaagctgaaggcatcatgctacctgacttcaaactatactacaaggctacagtaaccaaaacagcat

SEQ ID NO: 153425 - DNA, 601 bp, Human
tgacacacataggttcaagataaagggatggggaaaaatctaccaagcaaatagaaaacagaataaaacaggggttgcaatcctagttgccgtcaaaacagactttaaaccaacaaaggttaaaagaaaaaaatatgggcattgcataaggataaagtgttaaattaaacaagaagatctaactatcctaagtatatatgcaccaaacacaggaacacccagattcataaagcaagtttatggagaccttcaaacagacttagactcccacacaatagtagtgggagactttaataccccrtgacaatattagacagatcattgagacaggaaattaacaaagatattcaagatctaactcagcactaaatcaaatggccctgatagatatctacaggactgtcctacttgaaaccatacaattacatggtaattgaatgacctgctcctgaatgacttttgggtaaataataaaattaaggcagaaatcaagaagttttttgaactaatgagaacaaagatacaacataccagaatctttgggacacagctaaggcagtgttaagagggaaatttatagcactaaatcccacatcaaaaa

SEQ ID NO: 153426 - DNA, 601 bp, Human
actaaatgatcccattaaaagacataaagtggcaggctggataaagaaccaagaaccattggtatactgtcttcaagagacccatctcctatgcagtgacacacataggttcaagataaagggatggggaaaaatctaccaagcaaatagaaaacagaataaaacaggggttgcaatcctagttgccgtcaaaacagactttaaaccaacaaaggttaaaagaaaaaaatatgggcattgcataaggataaagtgttaaattaaacaagaagatctaactatcctaagtatatatgcaccmaacacaggaacacccagattcataaagcaagtttatggagaccttcaaacagacttagactcccacacaatagtagtgggagactttaataccccatgacaatattagacagatcattgagacaggaaattaacaaagatattcaagatctaactcagcactaaatcaaatggccctgatagatatctacaggactgtcctacttgaaaccatacaattacatggtaattgaatgacctgctcctgaatgacttttgggtaaataataaaattaaggcagaaatcaagaagttttttgaa

SEQ ID NO: 153427 - DNA, 601 bp, Human
agaccagtgacattgtaaagcaactacataacaagtctgcaaaataaccagccaacatcatgatgacggtatcaaatcgacacatagcaacactaaccttaaatgtaaatggactaaatgatcccattaaaagacataaagtggcaggctggataaagaaccaagaaccattggtatactgtcttcaagagacccatctcctatgcagtgacacacataggttcaagataaagggatggggaaaaatctaccaagcaaatagaaaacagaataaaacaggggttgcaatcctagttgccgwcaaaacagactttaaaccaacaaaggttaaaagaaaaaaatatgggcattgcataaggataaagtgttaaattaaacaagaagatctaactatcctaagtatatatgcaccaaacacaggaacacccagattcataaagcaagtttatggagaccttcaaacagacttagactcccacacaatagtagtgggagactttaataccccatgacaatattagacagatcattgagacaggaaattaacaaagatattcaagatctaactcagcactaaatcaaatggccctgatagatatct

SEQ ID NO: 153428 - DNA, 601 bp, Human
gaagagattgaggaccaatattcaacattcttaaacaaaaagaattccaacccagaattttatatctgactaaactaagcttcataagcaaaagagaaataagatcattttcagacaagcaaatgctaagggaatttgtgaccattagaccttccttgcaacagttcctaaaggaagcactaaatatggaaagaccattaccagacactacaaaacacactgaagtacacagaccagtgacattgtaaagcaactacataacaagtctgcaaaataaccagccaacatcatgatgacggtrtcaaatcgacacatagcaacactaaccttaaatgtaaatggactaaatgatcccattaaaagacataaagtggcaggctggataaagaaccaagaaccattggtatactgtcttcaagagacccatctcctatgcagtgacacacataggttcaagataaagggatggggaaaaatctaccaagcaaatagaaaacagaataaaacaggggttgcaatcctagttgccgtcaaaacagactttaaaccaacaaaggttaaaagaaaaaaatatgggcattgcataaggataaagtgttaa

SEQ ID NO: 153429 - DNA, 601 bp, Human
agactaataaaaataagtcctgtaacttttgatactcctattaaaaaagagttgcaaaccaataggaggtacacttgagaatcagcacaaatgaaagtagaacctggaaatccaggaagcagatacccaatcatgtcatttaaacatttagatccagctgtgcctgaagctgaactttagcattacataagccaataaatcactcttccccaacttacgccagttgaaattgaatacatactcagtgactttgagagaattccagggaattggtcagtccctgtttcacttgtaaatacayagcaatcaagcctaccaaatctatgattgattggggtgtctgaaagagatggagggaatggaatcaacctgaaaaacatatttcaggagttcatccctgaaaacttccccaacctagctagaggggccaacattcaaattcaggaaatgcagagaaccccagtaagatactccacaaaaagatcttccccaagacatcatcatcagattctccaaagttgaaatgtaagaaaaaatgctaaaggcaactagagtgaaaggcccggtcacctaaaaagggaagcacagacttacagtggac

SEQ ID NO: 153430 - DNA, 601 bp, Human
ttgtgggaatggtccatgccaggagaagagggtatggttgacaaaaagggaaatgctaagattcaaaacagggaagggcttttcaaaatgccaagagcaccaacttatatctttcagtttaattcctctcttccttacccactggctggaaagcaaaggagctagtggtaagtaagagtgttatagccagagaaaaagtcttcaaaaaacacaaagtactttccatggacaaccttttttattttaaagtgccaatatgttgctttgaaaaagaataaattccttacatccaggtatctgractagacttcagtgcatttagtgattatagcaaatccaaacagtagcttttgatatcagagaatgggtaaagtgtttttgacaatttctaagaacttagagttcttcggtgatacgttccatgcaactgaagctctgctctccaaatttaggtgggtacatacccaagtccatcacctggggcttctatttcctttgctcagatgctcacctcctaggtgggcacctgacataagatagactaataaaaataagtcctgtaacttttgatactcctattaaaaaagagttgcaaaccaat

SEQ ID NO: 153431 - DNA, 601 bp, Human
aaatgaattgtgggaatggtccatgccaggagaagagggtatggttgacaaaaagggaaatgctaagattcaaaacagggaagggcttttcaaaatgccaagagcaccaacttatatctttcagtttaattcctctcttccttacccactggctggaaagcaaaggagctagtggtaagtaagagtgttatagccagagaaaaagtcttcaaaaaacacaaagtactttccatggacaaccttttttattttaaagtgccaatatgttgctttgaaaaagaataaattccttacatccagktatctggactagacttcagtgcatttagtgattatagcaaatccaaacagtagcttttgatatcagagaatgggtaaagtgtttttgacaatttctaagaacttagagttcttcggtgatacgttccatgcaactgaagctctgctctccaaatttaggtgggtacatacccaagtccatcacctggggcttctatttcctttgctcagatgctcacctcctaggtgggcacctgacataagatagactaataaaaataagtcctgtaacttttgatactcctattaaaaaagagttgca

SEQ ID NO: 153432 - DNA, 601 bp, Human
tgtcagagtgaatataaatgaattgtgggaatggtccatgccaggagaagagggtatggttgacaaaaagggaaatgctaagattcaaaacagggaagggcttttcaaaatgccaagagcaccaacttatatctttcagtttaattcctctcttccttacccactggctggaaagcaaaggagctagtggtaagtaagagtgttatagccagagaaaaagtcttcaaaaaacacaaagtactttccatggacaaccttttttattttaaagtgccaatatgttgctttgaaaaagaataamttccttacatccaggtatctggactagacttcagtgcatttagtgattatagcaaatccaaacagtagcttttgatatcagagaatgggtaaagtgtttttgacaatttctaagaacttagagttcttcggtgatacgttccatgcaactgaagctctgctctccaaatttaggtgggtacatacccaagtccatcacctggggcttctatttcctttgctcagatgctcacctcctaggtgggcacctgacataagatagactaataaaaataagtcctgtaacttttgatactcctat

SEQ ID NO: 153433 - DNA, 601 bp, Human
aagaattgagatttctttgatctattcatactgctcattaatatgtagtgagaaatacatacacacacacatacacacacatgcatccattagcaattgtttttgcccaactctagtgtctcgcagtgtctagactaaacaacaaacaaaaaaggggggagagtgagctggattaagcattgaggcacagtgaagaaatggtctggggcaagcccagggatgaatgttaggggtttctcataaacctgaacctgaagaaaatcaccctgccagcatattgatcttctagctcttcttaacstttttttctgtgattcaggaattcataatgatagaaaatattatactaaagaagaaaaaaagagggagaataagtaagtgatagatggatgcatcagggtgtaaagttagcaagtaaggctgttgaagtgtcagagtgaatataaatgaattgtgggaatggtccatgccaggagaagagggtatggttgacaaaaagggaaatgctaagattcaaaacagggaagggcttttcaaaatgccaagagcaccaacttatatctttcagtttaattcctctcttccttacccactggctgga

SEQ ID NO: 153434 - DNA, 601 bp, Human
actgtttccaacatccaccctttctcctttgacctctaccttgacctaaattaactataaaaggtccttcttttctaggaccctactataaatcagtgaaatattcaggaaaaaaagaacaccaagaatgttgggatcccagttaaagatcaagattctctactgataagctgtgtgatatggagtaaatcactaaagatctttgaatctcttcatttgtaaaatgggaatattggtagtcctactgcagggttgttgtaatgcttaaagaagaaaagtcatgcaaaggatctggcacaaygccttttccataataagtgcttagtaattgacagatactgtgataacttttcaggtttctctcatgcctttgacaacattgcattttgcttgctctatctgtagtcagacacttcttaatatctgtttgcaggaagacagaaaaataaagggaagaattgagatttctttgatctattcatactgctcattaatatgtagtgagaaatacatacacacacacatacacacacatgcatccattagcaattgtttttgcccaactctagtgtctcgcagtgtctagactaaacaacaaaca

SEQ ID NO: 153435 - DNA, 601 bp, Human
aagtgtccagctctcacttgggtctttgttcgctggagctttattggagctgacatcaagcttcactgatccaagggatgaatctgcggcttggtctccggtacgtcctggtacaggccgagagagcatcaagaaaaaacgagatttagcagctggtgcctcgggtttggcctctttcccaagattctttccgttggcatccgcaacagcacttatctccgttgtctcgggggaagaagtggccacattatccgtcttgacacttattcccaagtcgactgtaaacacaaacataaacagyggttattcagccaagccgggaaattcaggcactaataatggactccagacattttttatacaaaagccatactgcatactggaactgtgttgttctctggtcattctgaaaggcagaagttagctctctacatctccttggaccctgcttttcttgggagaggagaaggcaaggttggtgaggagggaaagctacttaatggaaagtcactagctgccaggtgtggaatgagtgatattcaatgttaattaatcttcttttatctgtgtaagaactccgtgagcagcatattgtcatgat

SEQ ID NO: 153436 - DNA, 601 bp, Human
ctctcaaggttaaaagcaaatgctctttttagtgtcaaaaagagcttgcctttcttcgctcaggaaaaaaagcaactgattccaggataccttctttgaaaaccaacacaaaaaaaccccccaaaaaacaaaaaaaaaacccaaaacccctagtttttacaaaggtttattactcctacttgttggaaaagaattactacataaaagagtctgcccagagctgtaaaatctccttattcaaacacacaccttagagcaaaagatggttaaatatcaattcaggctattaacagtaagggaygaaatgtgttccaacaaaactctgcatgtcaacaaactacagagactaggtaacatcttttaggaatcatttttattccactaatgccttttcctccagaatccactgatcgtaaacgcaacctgtctacttccgcctttgaaaaatggatggacaaattcatctgcatgtaactcacctcctcttttcttttacataaaacagatgccacagctgttattgttcttcacacagaagtttctacccagagaaacatcaggatgacactctgctgcaatgtgctatttgttctagaggggt

SEQ ID NO: 153437 - DNA, 601 bp, Human
ctctctcaaggttaaaagcaaatgctctttttagtgtcaaaaagagcttgcctttcttcgctcaggaaaaaaagcaactgattccaggataccttctttgaaaaccaacacaaaaaaaccccccaaaaaacaaaaaaaaaacccaaaacccctagtttttacaaaggtttattactcctacttgttggaaaagaattactacataaaagagtctgcccagagctgtaaaatctccttattcaaacacacaccttagagcaaaagatggttaaatatcaattcaggctattaacagtaaggracgaaatgtgttccaacaaaactctgcatgtcaacaaactacagagactaggtaacatcttttaggaatcatttttattccactaatgccttttcctccagaatccactgatcgtaaacgcaacctgtctacttccgcctttgaaaaatggatggacaaattcatctgcatgtaactcacctcctcttttcttttacataaaacagatgccacagctgttattgttcttcacacagaagtttctacccagagaaacatcaggatgacactctgctgcaatgtgctatttgttctagaggg

SEQ ID NO: 153438 - DNA, 601 bp, Human
acagcaaactccaccagggccgagactctgtgtctcgcccttcactgtggtccctgtgcctcacctgttcctagtacagtgtcacactcagtaaagagcagatgcctggtgcatttggagacttattttaaattatacggaaagttattcaaccggcttcttgaactggtgaattttggaaagtgggtgtttgaagggaaaatgtttaaactctgaaagaaatgttggaaataagctctttgaatcaaaatgtatagaaaacacaagaatgctgacagtaagagcctaaaacacatgatgmctattatcttttcccaattttaactctccagagtgttcagcggtgcccagccttcataatgtaattcttcgtagcaccctggatgcattaaaaccatagattaacgtgatacttattttcattaaggaaaataatttacgtacagtgctcagagtagagcctggcacattgaacattttcaataaatgacagcaagtgtaattattagcacttcggaagtgcaaagttgcattgtattaagacaaatatatttggagctcatccaattttttcctggctctgaagtctgctagtggcact

SEQ ID NO: 153439 - DNA, 601 bp, Human
attgacgactagtttaccgcctctgggcacgtaactttcaggtcctggttcatgcatttgctggaatgttccctgggccatggagcccagttctcctggcatctggcatctcccccacactctgctcccccagcacagcacttggcatcttgcattgcaattgcaggtttatttattcacttctctcactggacagcaaactccaccagggccgagactctgtgtctcgcccttcactgtggtccctgtgcctcacctgttcctagtacagtgtcacactcagtaaagagcagatgcctgatgcatttggagacttattttaaattatacggaaagttattcaaccggcttcttgaactggtgaattttggaaagtgggtgtttgaagggaaaatgtttaaactctgaaagaaatgttggaaataagctctttgaatcaaaatgtatagaaaacacaagaatgctgacagtaagagcctaaaacacatgatgactattatcttttcccaattttaactctccagagtgttcagcggtgcccagccttcataatgtaattcttcgtagcaccctggatgcattaaaaccatagattaacgtg

SEQ ID NO: 153440 - DNA, 601 bp, Human
ctacccctaagagttctttttcaataaagaaagctgagttaataaatcacaactccaaaacttttcctcacttttcttagactagaaatagattgagtgtgtcgaggttttatggctgagtacattggagggctggctattctatgctgaactggtttacttgattaagatggggatttggatgagtcaccggacacctgtccaaagatgagtaaaacacattccttcattgtcttcccataaataactcaatcttctcctaactgagccaatggataggctttggatgcccaagcaaaasaaacacatgactgttaaaaaatcacaacctcaaaatggccttagaagcctatgaccaataatgagaatggtttctccactcaggcgcaagtagtaaacagtttctcccatatgcaggaatattgacgactagtttaccgcctctgggcacgtaactttcaggtcctggttcatgcatttgctggaatgttccctgggccatggagcccagttctcctggcatctggcatctcccccacactctgctcccccagcacagcacttggcatcttgcattgcaattgcaggtttatttattcac

SEQ ID NO: 153441 - DNA, 601 bp, Human
aatattacacaagggctttgctatattagatacctgccatgttcctaacacaagctcccattttctgactcaaatctcattttggaacacattccactcaaattgaggttctacccctaagagttctttttcaataaagaaagctgagttaataaatcacaactccaaaacttttcctcacttttcttagactagaaatagattgagtgtgtcgaggttttatggctgagtacattggagggctggctattctatgctgaactggtttacttgattaagatggggatttggatgagtcacyggacacctgtccaaagatgagtaaaacacattccttcattgtcttcccataaataactcaatcttctcctaactgagccaatggataggctttggatgcccaagcaaaagaaacacatgactgttaaaaaatcacaacctcaaaatggccttagaagcctatgaccaataatgagaatggtttctccactcaggcgcaagtagtaaacagtttctcccatatgcaggaatattgacgactagtttaccgcctctgggcacgtaactttcaggtcctggttcatgcatttgctggaatgtt

SEQ ID NO: 153442 - DNA, 601 bp, Human
ggaagggtggaaaatgcagttggaaaataggcagaggaaacattgtggaaacccttaaatgtcagacaaagaaactgaggcttatgggcatggacactaacatttctattgtttcaaaaataattttacaacttttatacctttctcacccaagttaggacttgtgcctttggttatacaactcttaaattagagtcaactgtgctatctctgtgagtttgggttgaggactatggaagggaaaggcaaaaaataaaagtaaaatgtgaagtagaagacagggagaaaacccataatactrgtaatagctaatttctctttttcttctttcaaaatgcaatttgtgctaagtactttatatggcctatctcatttaacttctaaaagtgtgaacaatgtgagaatgtgctagatactattattatccccattttacagatgaggaaactgaggctcaggaggtgaagtagcttgcccaagatcacacagccagtaggtgacagaggtagagaggaaacctaggctacttgactatgatgcttatgtttaattcactactaaataccatgtaggaaaggactctggagaccttagttcttta

SEQ ID NO: 153443 - DNA, 601 bp, Human
ggactcatacctaggtcacccaggctcctaacacttccacatcacctctgccactgcaaacatctcatattaagcgtttcttactgctaaatgcatcaaaatcccagtggtatagctgaggaccttgtttactccaaaacttgcataatgtaagatggattttccctttgcactgacaaagtcttttgggtggctagttctctttaccagttgaaaaggcatggccttgtggacataaggcagaaacaacacaaaataaaaaacagttaataattcacttggccttctaatgttgaaattsggtaattctttttatttgtttttatttttcacttgggattttgggtatttacaactttgcatatgctaacatctttgaatttcattgcctcaagttgtaacttcattgaacaagtttcaaataattggcaaaaatagaaacgttgactatttaagactatgggctttggagatggacaattttggctgtgccaccttttagctgtgtgtcaggagtgatatgctttctctgaactgttgacttcttcatctgtaaaatggtgaaaatacaggaattccctggtaagatttgatggctcaa

SEQ ID NO: 153444 - DNA, 601 bp, Human
atataattaattaattaaaatattatttaaaacactatgtaggccaagtaagatgcatctctggctagaggccttctacagatggctagttttcaacttctggtttatgttttttattttattttacttcttcaaacccacagccaacatcatacaacttctggtctaaatgcctagctcaacgttctctagaagaaccattccttggaaaattgagctaccttgttagaggcccaacagctacatggatgattaagtttgagaaacacttggttaaacaaagtgaaacaggcgtgcttgytgcaggacttctcagagcctttagtaggtggatgtccattgtgaatcttcagtagagactataaagcaaatagattttctgaaactattccatagcagagccctatttctaggcccatcttattggactaacgttccacagaccaacttggaaagtactatcacgctggttaacattaggtgtcaacttgattggattgaaggatgcctagatggctggtaaagtattgtttctgggtgtgtctatgagggtgttgccagaggagattaacatttgagtcagcggactgggagaagaaga

SEQ ID NO: 153445 - DNA, 601 bp, Human
gcccagcctcccaccccttttatatattgcttaacactggctgcctgattgactctcaggctggaatgacagatggtcatctaagtagcttcaaattctgataagtgctatgaaggatgaaggaagtaaagtggtccatgatgggtgtatttacttgattctcaactgtacccaagaaaaataccaatgcaagtgttatgacgaaggacaacctacatggctgcgctgctgggaatcatttggtgaactggagagtgggtgccccatcttaagggacagtcacaactcacattctgtctgsaaatatagggcaaaactacccattatggggaagtctgaaatatagaattgtattgacatattattgctttaaaatatcatcaactttgttaattcaaaaatataattaattaattaaaatattatttaaaacactatgtaggccaagtaagatgcatctctggctagaggccttctacagatggctagttttcaacttctggtttatgttttttattttattttacttcttcaaacccacagccaacatcatacaacttctggtctaaatgcctagctcaacgttctctagaagaaccat

SEQ ID NO: 153446 - DNA, 601 bp, Human
agaatttgtcccccaatttgcctagaaaggaaagcaaattaatatgcaagcaggaaggaatgtgaagaccaatactaaaaatattttgcagaatctcagaatttcctaagcagactatgattttttttttttttgagatgttgcccaggctggagtgcaatggtgcaatctcgtctcactgcaacctccgcctcccaggttcaagtgattctcctgcctcagcctccgagtaactgggattacaggcatgtgccaccatgcccggctaatttttgtattttcagtagagatggggtttcascatgttggccaggctgatctcaaactcctgacctcaggtgatccaccccccttggcctcccaaagtgttgggattacaggcatgagccaccatgcccaaactctttttttttttaagtttgttttactacagtgctcaaagccactgaaggaaggtcaataaatatatattaatgtaggtaattctgtacttttattttttccactactcctacccaattcacatcaactgataaaaattcaatgagtagttttttttttataatgcattcacatctttcaagcccatggcaaaaacagg

SEQ ID NO: 153447 - DNA, 601 bp, Human
ttttgaagatagaatttgtcccccaatttgcctagaaaggaaagcaaattaatatgcaagcaggaaggaatgtgaagaccaatactaaaaatattttgcagaatctcagaatttcctaagcagactatgattttttttttttttgagatgttgcccaggctggagtgcaatggtgcaatctcgtctcactgcaacctccgcctcccaggttcaagtgattctcctgcctcagcctccgagtaactgggattacaggcatgtgccaccatgcccggctaatttttgtattttcagtagagayggggtttcaccatgttggccaggctgatctcaaactcctgacctcaggtgatccaccccccttggcctcccaaagtgttgggattacaggcatgagccaccatgcccaaactctttttttttttaagtttgttttactacagtgctcaaagccactgaaggaaggtcaataaatatatattaatgtaggtaattctgtacttttattttttccactactcctacccaattcacatcaactgataaaaattcaatgagtagttttttttttataatgcattcacatctttcaagcccatgg

SEQ ID NO: 153448 - DNA, 601 bp, Human
ttgctggacaacaatagtctctggacaatcacgaagtcttcatttttcttcttctgaaaacactgtcacctgcgtgtagccattgtcagattcaggaagaaaaatagggtttggttaatttttgaagatagaatttgtcccccaatttgcctagaaaggaaagcaaattaatatgcaagcaggaaggaatgtgaagaccaatactaaaaatattttgcagaatctcagaatttcctaagcagactatgattttttttttttttgagatgttgcccaggctggagtgcaatggtgcaatctygtctcactgcaacctccgcctcccaggttcaagtgattctcctgcctcagcctccgagtaactgggattacaggcatgtgccaccatgcccggctaatttttgtattttcagtagagatggggtttcaccatgttggccaggctgatctcaaactcctgacctcaggtgatccaccccccttggcctcccaaagtgttgggattacaggcatgagccaccatgcccaaactctttttttttttaagtttgttttactacagtgctcaaagccactgaaggaaggtcaataaatatatatt

SEQ ID NO: 153449 - DNA, 601 bp, Human
ctccccagagaatatcacgcgagcacagagggttcgatttgctggacaacaatagtctctggacaatcacgaagtcttcatttttcttcttctgaaaacactgtcacctgcgtgtagccattgtcagattcaggaagaaaaatagggtttggttaatttttgaagatagaatttgtcccccaatttgcctagaaaggaaagcaaattaatatgcaagcaggaaggaatgtgaagaccaatactaaaaatattttgcagaatctcagaatttcctaagcagactatgattttttttttttttgagatgttgcccaggctggagtgcaatggtgcaatctcgtctcactgcaacctccgcctcccaggttcaagtgattctcctgcctcagcctccgagtaactgggattacaggcatgtgccaccatgcccggctaatttttgtattttcagtagagatggggtttcaccatgttggccaggctgatctcaaactcctgacctcaggtgatccaccccccttggcctcccaaagtgttgggattacaggcatgagccaccatgcccaaactctttttttttttaagtttgttttactacagt

SEQ ID NO: 153450 - DNA, 601 bp, Human
agagcaaacagataggaacactgctaaagtgattacaatttgtcatgttgaaaaataatgccgccttatcataatttgattgtctgtaataaggcccatatggaacttctggcactttctttcaactattgtcagctggacttcagactcctttaagcagatctacattgttaaagtgaaaatataagataaggcttaaaaagccttgtctggaatgatctgtgatgcctctactccatctagatttcctcattgtgtagcactgattttactcttagtcttaacaccacgaatcagtacygaaagtacaggtgaacacaagaaaatttgtgtgaaaaatgttgaatggtacagaaactcatgactccactcctttccatctgtcagaaatttgagccccatgctgcctgggataaaagggaaggctctgcttcctctccccagagaatatcacgcgagcacagagggttcgatttgctggacaacaatagtctctggacaatcacgaagtcttcatttttcttcttctgaaaacactgtcacctgcgtgtagccattgtcagattcaggaagaaaaatagggtttggttaatttttgaag

SEQ ID NO: 153451 - DNA, 601 bp, Human
ttcttgaaataataaagctatagcaatggagaacagactagtggttgcaggaggtaagaaaaggatgggggtgagagggaagtggatgcacctgaacagtcagtatgcagtatccttgtggggataaaaatgttctctatttgattgtatcattgtcaatatcctggttgtgatattgcactacaggtctgaagatgttaccgttgagtgacgctggataaagggataactgttgtatttcttacagctgcatgtgaatctacaataatttcaaagttaaaaagtaaaaaaaaaaaaaaaagcttgataggataattctggaagagcaacaatgaagaaccacttaaaaagttgaacttttgggatctgcagttaaataaattcgcatgtggttttaacatgtgaaattaacccataacaatgtgtgatggaatattttgcagccatgaattatttaaggagtgtgtaatgacaaaataagtgtccatgataaccgtaaaaatgatcagcctttatgtgtcaggcccagtgctaagcttgttaaaaagatcccgtttaattcttacaacgatcccatgaagcatgcactgtttgtaattcc

SEQ ID NO: 153452 - DNA, 601 bp, Human
taatgtttatagcaaagttatttacaatagcctcaaagttggaacaaccaaacatcaaactggtacttccacagcatgggatactacttggcagtcgaaaaggaccaatatctaccaagacactcagtgattcggattaatttccagagatttatgctgaaggggaaaaaagcctatgtaaaaaagggtacccactgtatgatactatttagatagcattcttgaaataataaagctatagcaatggagaacagactagtggttgcaggaggtaagaaaaggatgggggtgagagggaagyggatgcacctgaacagtcagtatgcagtatccttgtggggataaaaatgttctctatttgattgtatcattgtcaatatcctggttgtgatattgcactacaggtctgaagatgttaccgttgagtgacgctggataaagggataactgttgtatttcttacagctgcatgtgaatctacaataatttcaaagttaaaaagtaaaaaaaaaaaaaaaagcttgataggataattctggaagagcaacaatgaagaaccacttaaaaagttgaacttttgggatctgcagttaaataaatt

SEQ ID NO: 153453 - DNA, 601 bp, Human
aaacaaacaaaacaatccaattagaaaatgggcaaaagacgtgagggggcatttcattgcagaggatatgcagatggcaaataagcacataaagatgttcaatctcattaaccattagaaaagtgcaaattaaaaccataacgagacatcactatgcacccatcaaagtggttaaagcaaaaaatagtgactattaaatgctgggaaggatgcaagaaactcgattactcactttacaatgtaatcactttacattgctggtagaaatgtaaagggatacaggcagaatagaaaacagttwgacagtttcttaaataattaaacatgcaggcagggcgtggtggcaagtgtctgtaatcccagctactctgggggctgagacgggaagatcacttgaccctgggtggctgagccaagatggcaccactgcacttgcctgggcaacagagcaagatccaatctcaaaaacttaaaataaataaataaataaaacatgcaactatagtgattgcactcctggtcatttctcctagagaaatgaagaattatattcacacaaaaacctatgcattaatgtttatagcaaagttatttacaatag

SEQ ID NO: 153454 - DNA, 601 bp, Human
gaccaaagaccaaaagcaaaatccataaaaagaaaacataataaattggaattcatcaaaactaaaaaattttgccctgtaaaagatcctgttaaaaagatgaaaagagaaactagagagtgggagaaaatatttgcaaaccacgtatctgacgagagactagtatttagaatacatttaaaagaaaaaaattcttaaaactcaacattaaaaacaaacaaaacaatccaattagaaaatgggcaaaagacgtgagggggcatttcattgcagaggatatgcagatggcaaataagcacagaaagatgttcaatctcattaaccattagaaaagtgcaaattaaaaccataacgagacatcactatgcacccatcaaagtggttaaagcaaaaaatagtgactattaaatgctgggaaggatgcaagaaactcgattactcactttacaatgtaatcactttacattgctggtagaaatgtaaagggatacaggcagaatagaaaacagttagacagtttcttaaataattaaacatgcaggcagggcgtggtggcaagtgtctgtaatcccagctactctgggggctgagacgggaagat

SEQ ID NO: 153455 - DNA, 601 bp, Human
attctacatagtagtggaagttctaggaagtatattaaggcaagaaaataaatatagggaatacacattgaaaaggaagaaataaaactgtccccagagaagatggcaaaattagacaatttcattattttcaaaattagaaaatcccaaggaatcaacagaataacacctagaattaataattgagttcagcaaggctgaagaatacaagataaacatgtaaaaatgatctagatttctatatactaggaatgaacccatgggcactgaaattaaaaatacaataccataataatcatamgaaaatgaaatactaaggtttacatctcacaaaacatgtgcaaaacttgtatgctgaaagctatataatgctaatgaaagaaatcataggagacctaaataaatggagagacacacaatgttcatggattggaagactcacatagtaaagatgtcaatctgccccaaattgatatacaggtttaatgcaattcctgtcaaaattccagcacttgtagcaagacattttgtagagatagatgaggttattctaacatttatatggaaagacaaaggatttagaataattttttaaaatata

SEQ ID NO: 153456 - DNA, 601 bp, Human
cagcctctgcctaccgggttcaagcaattctcctgcctcagcctcctgagcaactggtattacaggtgtgcaccaccacgcccagctaatttttgcatttttagtagagatgggtttcaccatgttggccaggctggtctcaaattcctaaactcaagtgatctgcccgccttggcctcccaaagttctgggattacaggcgtgagccactgtgcccggcctctgacaaagattttaaagtagtcacaataaaatgcttcaattaacaattgtaacagtgcttgaaacaaatgaaaaaatrgaaagccccagcaaagaaatagaagatataaaaataactaaaatggaaattttagaattgaaaggtataataatgaaaacaaaaagcccagtgagtgaaatcaacagcataatgggagagacagagagaagcagcagcaaaaacctctattagtagagacaacagatgacaacaaaaaagagagagcaagagagtcaaggtacagattaccagtatcaggtacaaaactggataggagaatgccataaccaatgctacctacataaatttgataacgggcaaaatggaacatttgctcaa

SEQ ID NO: 153457 - DNA, 601 bp, Human
gtaataagccctccccaccatggtgtccgcggggaccacatggggagcctggacttccaaccccacccaggagcaatgagatgctcctccctctccccactggggtggtgtgagaagagacccagtggagttagcgtcagccagtggtaatgagacctccactgtggtatcagtgaaggtcatgtgagcagaaaactcccgcctccacccagtagtaataaggagtatacccccgccccccaacaatggaggctggtgagaaacctggatgtttgcctccacctgacagtaatgaggtagyagccccagtactgctggaatggtgtccgggacagccagctaaaatagaaagtttaagcaagatgcagtctcataatatgaaaatggtcagatttcaattgaagataacttgtcataccataccaagaactaagaaggcctcaaacataataaaacaaggcaatcaacagatgtcaacctggaaatgagatgacagagatgctagaattatctaacaaagatttttttttttttttgagacggagtcttgctctgtcacccaggctggagtgtaatggcacaatggcacaatcttggctca

SEQ ID NO: 153458 - DNA, 601 bp, Human
ctgaggaagtgttgactgacatttaaggagtaggtgccatggaaggtgtttgggctcaggcagcctcactctaccttaccaggatggtgggcacagggcaaaggggctaaacagcagcagaagcagcagagggttccatcacataattttgaagtggagaagtccccacctattccctgaagagaaacatcatgtggatgcccacaacggagaagatatggagagtcagagagaacaatctgcaaggcaaaaagcctagagccctttccccttaacccctcctccctaaactcacatgcaytaggggaggacgagaagaggaaaaaaagcaagtcccccttcttccagactgcaaggacctcaggccatggtcaaggcagagcttggttctagcaggaattgggatgaatgttataatgaatgtgtgattaaagttttaaagttggattgggctgggcatggtggctcacgcctgtaatcctagcactttgggagaccgaggcaggcagatcacccgaggtcaggtgttcaagaccagcctggccaacatggtgaaaccccgcctctattaaaaatacaaaaattagctaggcgtggtggt

SEQ ID NO: 153459 - DNA, 601 bp, Human
attatggatatttttgtgtaggtgaagttcaatataaagtaaactttaaataaagctattacatgaataactgaacaggtgtcttgaagatgagtcattatgaaagtggcacaagacataaatctagactgagaaattccccacaggcctaagtaaggtgttgcccaggagcaccattcatgaattcatcctcactcagtaactatgtgggggtagttacattacatacaagctgtgcagaggccacacagcattagcatgggctctgaagttatgctttcactgtgtattgtggacttamagtttgtgtctccccaaatcctaaccctcaatgtgactacatacaagctgtgcagaggccagctgcccaggtccaatccctgctctgccatctacacctctgcagtactgcactttccctaactctaggttgcaatttgctcatttgtaaaagtggggtgatgagtagcacctgccttttagggttgttgagggagtaaatgggataatccatataaaggacttaggagaatgtgcagtacagaggaagcattcagtaatggttagctattattattgtgtttaatttaattactgagca

SEQ ID NO: 153460 - DNA, 601 bp, Human
tagtgctcttataaaagagaccccagcgagcgttctagtcctctttccatcattccagggtgcaatgagaagctggccatctgcaacccagaagagggtcctcacaagaacccaaccatgctggcatcttgatttcagacttatagcctccaaaactgtgagatatcaatttctgttgtttataagccatccagtctatggtactttgatagcagcctgaactaagacaatgtgcactagaaaaatatgtccagcatcaaccttttcatattatggatatttttgtgtaggtgaagttcartataaagtaaactttaaataaagctattacatgaataactgaacaggtgtcttgaagatgagtcattatgaaagtggcacaagacataaatctagactgagaaattccccacaggcctaagtaaggtgttgcccaggagcaccattcatgaattcatcctcactcagtaactatgtgggggtagttacattacatacaagctgtgcagaggccacacagcattagcatgggctctgaagttatgctttcactgtgtattgtggacttaaagtttgtgtctccccaaatcctaaccctcaa

SEQ ID NO: 153461 - DNA, 601 bp, Human
tgtgtctcattcacaacaagatcaagtggttgataaaagttccagtgcctgacaaagactccatattcacctcccagctccactcacaggttgaggaaccccagctggggtcttagcctctctgagacaaggtcgtctcatggaacacaagattaataataaaccttgcctggtataattcgttgtgagtttccataagaaataatgcatgtaaattccttagcataatgcctagtatagaagtgtccaataaatgttagccaaacagacaaaaaaaaaaaaaaaaaaaagcaatgaaaaygccatacaatttgcaaagttcctgacacagagtagattcaggagaaacatttgttaaaggatgaaaggatatggagtaaattcttttttctatgcctttgtacactgtgctctccagcttctgtcttcccttttgaaatctattcttcacgattggaatcaagtctccctctcccaccgacgtttttctgggtcaggccacccatggactctgtccccttctctgaatttctataccacagttctcagcactcagttggtacttagattatgcacttagaccagcctaacaccaaaggcc

SEQ ID NO: 153462 - DNA, 601 bp, Human
ttaactttccaaacatatgagacacatttatgctaatcctttttatttttttgccaattctaacacctgtgtcagttctgggtaggttttggttgatttctcttcacatcatgagttacattttcctgcttctttgcttccctggtaatttttgtttgcatgtcagacattgtgaatcttacctgtttgggtggctggatattttttgttcctataaatatttttgaactttgtttttggaggtagttaagatacttaaaatcagtttgatccttttagttctggcttttaagatttgttygtgaaactgactttgcaaaaattatgagtgaaaaaattatgactgtgaaagagatctgacctaaccaacaccatcttgcctttaacttccaagctgcccttgttcattcctgggggtaggccacactaacttcgggaggaatttagttatagtttaactttgaaacaaagataataacagtcccttccccaaacaagccccctttattcttggggaccagtccacctttgtaaaactagcaaattagacacaacattagaaattatggctcaggagtcatacagccagaggccacaagat

SEQ ID NO: 153463 - DNA, 601 bp, Human
ccttttctctcctttcatggactccaattacctgcctactagcctacttgaagttatcctgtagctcattaatgttcctttcttccttctttttgaaaaagccctcttccttttcacccactgccctgtggttccttttggatagtttctattgctgtgtatttaaattcacaatttttttttctgcattgtctaatctgttgttaatgtcatccagtgtattttttacctcacacactgtagtttttatctctagaaatttgatttggattttaaaaatatatcttctatgtctctactyaactttccaaacatatgagacacatttatgctaatcctttttatttttttgccaattctaacacctgtgtcagttctgggtaggttttggttgatttctcttcacatcatgagttacattttcctgcttctttgcttccctggtaatttttgtttgcatgtcagacattgtgaatcttacctgtttgggtggctggatattttttgttcctataaatatttttgaactttgtttttggaggtagttaagatacttaaaatcagtttgatccttttagttctggcttttaagatttgttcg

SEQ ID NO: 153464 - DNA, 601 bp, Human
tgagagtatcagtcatcaatttttagccattatgatttcaaatattttttcttctctccttttctctcctttcatggactccaattacctgcctactagcctacttgaagttatcctgtagctcattaatgttcctttcttccttctttttgaaaaagccctcttccttttcacccactgccctgtggttccttttggatagtttctattgctgtgtatttaaattcacaatttttttttctgcattgtctaatctgttgttaatgtcatccagtgtattttttacctcacacactgtagyttttatctctagaaatttgatttggattttaaaaatatatcttctatgtctctacttaactttccaaacatatgagacacatttatgctaatcctttttatttttttgccaattctaacacctgtgtcagttctgggtaggttttggttgatttctcttcacatcatgagttacattttcctgcttctttgcttccctggtaatttttgtttgcatgtcagacattgtgaatcttacctgtttgggtggctggatattttttgttcctataaatatttttgaactttgtttttggaggta

SEQ ID NO: 153465 - DNA, 601 bp, Human
gtgcacatggtacaatctcaaaaattactagtgaatgaatgaacaaatgatttaatccaagtgagagtatcagtcatcaatttttagccattatgatttcaaatattttttcttctctccttttctctcctttcatggactccaattacctgcctactagcctacttgaagttatcctgtagctcattaatgttcctttcttccttctttttgaaaaagccctcttccttttcacccactgccctgtggttccttttggatagtttctattgctgtgtatttaaattcacaatttttttttctgcattgtctaatctgttgttaatgtcatccagtgtattttttacctcacacactgtagtttttatctctagaaatttgatttggattttaaaaatatatcttctatgtctctacttaactttccaaacatatgagacacatttatgctaatcctttttatttttttgccaattctaacacctgtgtcagttctgggtaggttttggttgatttctcttcacatcatgagttacattttcctgcttctttgcttccctggtaatttttgtttgcatgtcagacattgtgaatcttacct

SEQ ID NO: 153466 - DNA, 601 bp, Human
ccccctaaggacatctggtaatgtctggagacatttttttgattgtcacgagtagcgggttagtgatttaccactggtatctggaggatagatgccaggcatgctgctaaaattcctgcaatgcccaggacaaagagttatctggctctcagtggcaagactgagaattatattaaaactctcacttgtcattttgtgttttgttcctctcccttcactggaatagaaaccaatgaaggttctttttctcccttatgtttccccagcacccagacttgtgcacatggtacaatctcaaaarttactagtgaatgaatgaacaaatgatttaatccaagtgagagtatcagtcatcaatttttagccattatgatttcaaatattttttcttctctccttttctctcctttcatggactccaattacctgcctactagcctacttgaagttatcctgtagctcattaatgttcctttcttccttctttttgaaaaagccctcttccttttcacccactgccctgtggttccttttggatagtttctattgctgtgtatttaaattcacaatttttttttctgcattgtctaatctgttgtta

SEQ ID NO: 153467 - DNA, 601 bp, Human
ccaggctggtcttgaactcctgacctcaggtaatcccctcacctcggcctcccaaagtgctaggattacaggcatgagccactgcgcctgagccaatggccacgttttcatcgaggtctttctttaccactctactttaagttgctataatatatcccggcatatctgatgctgctaattgctttatttttctcctagtagatttcacttctaatatattactggctcctcttccccctaaggacatctggtaatgtctggagacatttttttgattgtcacgagtagcgggttagtgatytaccactggtatctggaggatagatgccaggcatgctgctaaaattcctgcaatgcccaggacaaagagttatctggctctcagtggcaagactgagaattatattaaaactctcacttgtcattttgtgttttgttcctctcccttcactggaatagaaaccaatgaaggttctttttctcccttatgtttccccagcacccagacttgtgcacatggtacaatctcaaaaattactagtgaatgaatgaacaaatgatttaatccaagtgagagtatcagtcatcaatttttagccat

SEQ ID NO: 153468 - DNA, 601 bp, Human
gccaggctggtcttgaactcctgacctcaggtaatcccctcacctcggcctcccaaagtgctaggattacaggcatgagccactgcgcctgagccaatggccacgttttcatcgaggtctttctttaccactctactttaagttgctataatatatcccggcatatctgatgctgctaattgctttatttttctcctagtagatttcacttctaatatattactggctcctcttccccctaaggacatctggtaatgtctggagacatttttttgattgtcacgagtagcgggttagtgakttaccactggtatctggaggatagatgccaggcatgctgctaaaattcctgcaatgcccaggacaaagagttatctggctctcagtggcaagactgagaattatattaaaactctcacttgtcattttgtgttttgttcctctcccttcactggaatagaaaccaatgaaggttctttttctcccttatgtttccccagcacccagacttgtgcacatggtacaatctcaaaaattactagtgaatgaatgaacaaatgatttaatccaagtgagagtatcagtcatcaatttttagcca

SEQ ID NO: 153469 - DNA, 601 bp, Human
tctttcaagtctttttcaattgtcacttttttctttttttttgagacagagtctcactctgtcacccaggctggagtgcagtggcatgatcttgactcactgcaacctctgtctccctggctcaagccattttcctgcctcagcctcccaagtagctgggattacagtgtgtgccaccatgcctgtctaatttttgtattttcagtagagatggggtttcaccgtgttggccaggctggtcttgaactcctgacctcaggtaatcccctcacctcggcctcccaaagtgctaggattacargcatgagccactgcgcctgagccaatggccacgttttcatcgaggtctttctttaccactctactttaagttgctataatatatcccggcatatctgatgctgctaattgctttatttttctcctagtagatttcacttctaatatattactggctcctcttccccctaaggacatctggtaatgtctggagacatttttttgattgtcacgagtagcgggttagtgatttaccactggtatctggaggatagatgccaggcatgctgctaaaattcctgcaatgcccaggacaaagagt

SEQ ID NO: 153470 - DNA, 601 bp, Human
tccattctcattgctttcctgcccgtttttttttgttttattttccccctgggtcactcttttgtaaccccagtgacctgcttgctcttctttgaacatgtcaagtaggctgttgcctcaggacctttgcatctgggctgagcttctgcctgccaggagcatgtgaccttacttctttcaagtctttttcaattgtcacttttttctttttttttgagacagagtctcactctgtcacccaggctggagtgcagtggcatgatcttgactcactgcaacctctgtctccctggctcaagcyattttcctgcctcagcctcccaagtagctgggattacagtgtgtgccaccatgcctgtctaatttttgtattttcagtagagatggggtttcaccgtgttggccaggctggtcttgaactcctgacctcaggtaatcccctcacctcggcctcccaaagtgctaggattacaggcatgagccactgcgcctgagccaatggccacgttttcatcgaggtctttctttaccactctactttaagttgctataatatatcccggcatatctgatgctgctaattgctttatttttctcctag

SEQ ID NO: 153471 - DNA, 601 bp, Human
ttcttgtccttctttttccttgccgtcaactatgtcctaggggcaaaacagttgtcacagttgccacttgctgaatgtgaactctcaaagtcatacttttgcttcacacccctttctctcttaccccctaattccagccatacttcttctgcccacaggcgtgcagaacaatcatgagattataagagtcactcttccttccctccccctctttctaacatattcagcatttgctgttggttggagggacattgtttggagccaaagggtaacaaacacagcagtgcacgttgcatttcaracaaaaacccttttcttccaattctgcaaagaagttgtgtaaggtatcgatattttccatctttatagtctccttatctatgatgtgtacattatccccagagatggcgtttcccacaatttccacagagttggattatatcaactaaaaaaaaaaaaaaaaaaaaagaaaaagaaaaagaaaaagtactggtgtttaaaaataactattttgcttttgagatatgaggttcatctgtgcaaggggtgtgataggggaactgattttctccccgacctcctcaggagggtaggatgcgtt

SEQ ID NO: 153472 - DNA, 601 bp, Human
ctgctgcctgggaatcgtcctttgcagtctccagtccttctgggtccccagggacagagcaatccgcagttccaagttcttgtccttctttttccttgccgtcaactatgtcctaggggcaaaacagttgtcacagttgccacttgctgaatgtgaactctcaaagtcatacttttgcttcacacccctttctctcttaccccctaattccagccatacttcttctgcccacaggcgtgcagaacaatcatgagattataagagtcactcttccttccctccccctctttctaacatattyagcatttgctgttggttggagggacattgtttggagccaaagggtaacaaacacagcagtgcacgttgcatttcaaacaaaaacccttttcttccaattctgcaaagaagttgtgtaaggtatcgatattttccatctttatagtctccttatctatgatgtgtacattatccccagagatggcgtttcccacaatttccacagagttggattatatcaactaaaaaaaaaaaaaaaaaaaaagaaaaagaaaaagaaaaagtactggtgtttaaaaataactattttgcttttgagata

SEQ ID NO: 153473 - DNA, 601 bp, Human; identical to SEQ ID NO: 28349

SEQ ID NO: 153474 - DNA, 601 bp, Human; identical to SEQ ID NO: 28350

SEQ ID NO: 153475 - DNA, 601 bp, Human; identical to SEQ ID NO: 28351

SEQ ID NO: 153476 - DNA, 601 bp, Human; identical to SEQ ID NO: 28352

SEQ ID NO: 153477 - DNA, 601 bp, Human; identical to SEQ ID NO: 28353

SEQ ID NO: 153478 - DNA, 601 bp, Human; identical to SEQ ID NO: 28354

SEQ ID NO: 153479 - DNA, 601 bp, Human; identical to SEQ ID NO: 28355

SEQ ID NO: 153480 - DNA, 601 bp, Human; identical to SEQ ID NO: 28356

SEQ ID NO: 153481 - DNA, 601 bp, Human; identical to SEQ ID NO: 28357

SEQ ID NO: 153482 - DNA, 601 bp, Human; identical to SEQ ID NO: 28358

SEQ ID NO: 153483 - DNA, 601 bp, Human; identical to SEQ ID NO: 28359

SEQ ID NO: 153484 - DNA, 601 bp, Human; identical to SEQ ID NO: 28360

SEQ ID NO: 153485 - DNA, 601 bp, Human; identical to SEQ ID NO: 28361

SEQ ID NO: 153486 - DNA, 601 bp, Human; identical to SEQ ID NO: 28362

SEQ ID NO: 153487 - DNA, 601 bp, Human; identical to SEQ ID NO: 28363

SEQ ID NO: 153488 - DNA, 601 bp, Human; identical to SEQ ID NO: 28364

SEQ ID NO: 153489 - DNA, 601 bp, Human; identical to SEQ ID NO: 28365

SEQ ID NO: 153490 - DNA, 601 bp, Human; identical to SEQ ID NO: 28366

SEQ ID NO: 153491 - DNA, 601 bp, Human; identical to SEQ ID NO: 28367

SEQ ID NO: 153492 - DNA, 601 bp, Human; identical to SEQ ID NO: 28368

SEQ ID NO: 153493 - DNA, 601 bp, Human; identical to SEQ ID NO: 28369

SEQ ID NO: 153494 - DNA, 601 bp, Human; identical to SEQ ID NO: 28370

SEQ ID NO: 153495 - DNA, 601 bp, Human; identical to SEQ ID NO: 28371

SEQ ID NO: 153496 - DNA, 601 bp, Human; identical to SEQ ID NO: 28372

SEQ ID NO: 153497 - DNA, 601 bp, Human; identical to SEQ ID NO: 28373

SEQ ID NO: 153498 - DNA, 601 bp, Human; identical to SEQ ID NO: 28374

SEQ ID NO: 153499 - DNA, 601 bp, Human; identical to SEQ ID NO: 28375

SEQ ID NO: 153500 - DNA, 601 bp, Human; identical to SEQ ID NO: 28376

SEQ ID NO: 153501 - DNA, 601 bp, Human; identical to SEQ ID NO: 28377

SEQ ID NO: 153502 - DNA, 601 bp, Human; identical to SEQ ID NO: 28378

SEQ ID NO: 153503 - DNA, 601 bp, Human; identical to SEQ ID NO: 28379

SEQ ID NO: 153504 - DNA, 601 bp, Human; identical to SEQ ID NO: 28380

SEQ ID NO: 153505 - DNA, 601 bp, Human; identical to SEQ ID NO: 28381

SEQ ID NO: 153506 - DNA, 601 bp, Human; identical to SEQ ID NO: 28382

SEQ ID NO: 153507 - DNA, 601 bp, Human; identical to SEQ ID NO: 28383

SEQ ID NO: 153508 - DNA, 601 bp, Human; identical to SEQ ID NO: 28384

SEQ ID NO: 153509 - DNA, 601 bp, Human; identical to SEQ ID NO: 28385

SEQ ID NO: 153510 - DNA, 601 bp, Human; identical to SEQ ID NO: 28386

SEQ ID NO: 153511 - DNA, 601 bp, Human; identical to SEQ ID NO: 28387

SEQ ID NO: 153512 - DNA, 601 bp, Human; identical to SEQ ID NO: 28388

SEQ ID NO: 153513 - DNA, 601 bp, Human; identical to SEQ ID NO: 28389

SEQ ID NO: 153514 - DNA, 601 bp, Human; identical to SEQ ID NO: 28390

SEQ ID NO: 153515 - DNA, 601 bp, Human; identical to SEQ ID NO: 28391

SEQ ID NO: 153516 - DNA, 601 bp, Human; identical to SEQ ID NO: 28392

SEQ ID NO: 153517 - DNA, 601 bp, Human; identical to SEQ ID NO: 28393

SEQ ID NO: 153518 - DNA, 601 bp, Human; identical to SEQ ID NO: 28394

SEQ ID NO: 153519 - DNA, 601 bp, Human; identical to SEQ ID NO: 28395

SEQ ID NO: 153520 - DNA, 601 bp, Human; identical to SEQ ID NO: 28396

SEQ ID NO: 153521 - DNA, 601 bp, Human; identical to SEQ ID NO: 25443

SEQ ID NO: 153522 - DNA, 601 bp, Human; identical to SEQ ID NO: 25444

SEQ ID NO: 153523 - DNA, 601 bp, Human; identical to SEQ ID NO: 25445

SEQ ID NO: 153524 - DNA, 601 bp, Human; identical to SEQ ID NO: 25446

SEQ ID NO: 153525 - DNA, 601 bp, Human; identical to SEQ ID NO: 25447

SEQ ID NO: 153526 - DNA, 601 bp, Human; identical to SEQ ID NO: 25448

SEQ ID NO: 153527 - DNA, 601 bp, Human; identical to SEQ ID NO: 25449

SEQ ID NO: 153528 - DNA, 601 bp, Human; identical to SEQ ID NO: 25450

SEQ ID NO: 153529 - DNA, 601 bp, Human; identical to SEQ ID NO: 25451

SEQ ID NO: 153530 - DNA, 601 bp, Human; identical to SEQ ID NO: 25452

SEQ ID NO: 153531 - DNA, 601 bp, Human; identical to SEQ ID NO: 25453

SEQ ID NO: 153532 - DNA, 601 bp, Human; identical to SEQ ID NO: 25454

SEQ ID NO: 153533 - DNA, 601 bp, Human; identical to SEQ ID NO: 25455

SEQ ID NO: 153534 - DNA, 601 bp, Human; identical to SEQ ID NO: 25456

SEQ ID NO: 153535 - DNA, 601 bp, Human
aggacctgttcaccagcactgtctccaccctagaggtgagaccgcgtcgctgcgggtgctgcgctgcgtagctgccgcgcgtctcacctttcccctgccccgacttgtccctccccatcccccgtgtttgcaaggaccgtcttggggtgacacctgtgacgcgagccccacctccggtgcctgtcagagggatgtgcttgggctgagcgcagggcctcctcaggagagcagcctgcggcccgcgggtgccgacctaatcctcagaggggccagaaccgaaccgagcattgcagcggcgctktcccagctcagctggccttcctcggtgtctcttgcacctcctcctcttcaagccggagaagggcttgctctgcatcccagtaaacctccaccgagctcttttgaaggggtgctcgcttttcctttccagagggagggtgtgccgctgccaggggagcgcaatgaagtgagcgctgaggggccgagggtctgtggggaacgaatgggtgcactttcccaggaatggcccttcacggactgctggttcctcttgagggagctgcttctgatttggactgttaaataggtaaatgcatttgcc

SEQ ID NO: 153536 - DNA, 601 bp, Human
agaccgcgtcgctgcgggtgctgcgctgcgtagctgccgcgcgtctcacctttcccctgccccgacttgtccctccccatcccccgtgtttgcaaggaccgtcttggggtgacacctgtgacgcgagccccacctccggtgcctgtcagagggatgtgcttgggctgagcgcagggcctcctcaggagagcagcctgcggcccgcgggtgccgacctaatcctcagaggggccagaaccgaaccgagcattgcagcggcgctttcccagctcagctggccttcctcggtgtctcttgcacstcctcctcttcaagccggagaagggcttgctctgcatcccagtaaacctccaccgagctcttttgaaggggtgctcgcttttcctttccagagggagggtgtgccgctgccaggggagcgcaatgaagtgagcgctgaggggccgagggtctgtggggaacgaatgggtgcactttcccaggaatggcccttcacggactgctggttcctcttgagggagctgcttctgatttggactgttaaataggtaaatgcatttgcctctttttgtttgtctttagttcctagacttttaaaagg

SEQ ID NO: 153537 - DNA, 601 bp, Human
tgtgtacaatgtgtaatgatcaaatcaggataattagcttatccattacctcaaacgtttatcagttctttgtgttggaacattcaaaatctgctcatctagccctttgaaaatatacaataaattgttaattttagtcaatgtatggtgttctagaacactagaatttattcctcctatttggctgtaatattgtatgttaacccatttttgactattggcctcttcccagactcttgtaatcactagtctactttctacttctgttagatgaacttttttaacttttacatatgagtargaacatgcagtatttgtctttctgtgcctggcttattttacttaacataatgtcctccaagctcatccatgttgttgcaaatgacaggatttcattcctttttatagttgaatagtattccatcatgcatatataccacatgctcttgattcattcatctgttggtggatatctagattgcttccaaatcttgtctattgtgaatagtgctgcagtaaacatgggggcacagatatcgccaacatatttatttcctttcctttggatatttacccagtagtgggattgctgaatcatccg

SEQ ID NO: 153538 - DNA, 601 bp, Human
tatcaatacttcattcctttttatgaccaaataatattctatagtatggctgtaccacagtttgtttaaccatttgttgatggacatttaggtggttatgaatatgaccatgagtattcagctattgtgaataatgccgttaacattcgtgtacaagtggaattgctgggttatgtggtaactccatgtttaatcatttgaagagttgccagactggtttcccaaaatgggatgagttggaggcacttttttaaaaaattattttattttttcaagttctggggtacatgtggaggattcrcaggtttgttaataggtaaatgtgtgccatggtggtttgctgctcctatcaacccatcacctaggtattaagcccagcatgcattaggtcttttccctaatgctctcctgtcctccccttacaggccccagtttgtgttgtttcaagttggaggcactttaaacagtctgaggttaaaggcctaaagaaagaaagtgcaaataataaaggagaaaagacaacttatgtaataacagattaaaagataatattcagaagtcttataatgcctcccttcagatgattcttaggggagggaat

SEQ ID NO: 153539 - DNA, 601 bp, Human
tggagtgtatgaaccaacagaagtgaatataataaatacaatcgtgtgaataaatacctgccataccaggtgatatatgtgtaattaaaaatctgcacaaggtacagaaacaggtgatatatgtgtaattaaaatagaaatagtatagaagactggggtgacttgattgcatagagatgatctttgaggccctgaaagtggttgagaattatcaagagaaagtagaataagacaggagacacttttgataaagaggaactgcgagcaagtttagtatctgctgttctaacataacaggtartaaaagtatatataacttgttttcttttcttttcttttttttttttttttttgagacagagtcttgcgctgtcccaggctggagtgcagtggcgcaacctcagctcactgcagcctctgcctcccaggttcaagcgattctcctgcctcagccttccacgtagctgggattacaggtgcacgccaccatgcccggctaatttttgtatttttagtggagacgaggtttcaccatgttgaccaagcaggtctcgaactcctgaccttgtgatctgtccacctcggccccctagagtgctgg

SEQ ID NO: 153540 - DNA, 601 bp, Human
aaatacaatcgtgtgaataaatacctgccataccaggtgatatatgtgtaattaaaaatctgcacaaggtacagaaacaggtgatatatgtgtaattaaaatagaaatagtatagaagactggggtgacttgattgcatagagatgatctttgaggccctgaaagtggttgagaattatcaagagaaagtagaataagacaggagacacttttgataaagaggaactgcgagcaagtttagtatctgctgttctaacataacaggtagtaaaagtatatataacttgttttcttttctttwcttttttttttttttttttgagacagagtcttgcgctgtcccaggctggagtgcagtggcgcaacctcagctcactgcagcctctgcctcccaggttcaagcgattctcctgcctcagccttccacgtagctgggattacaggtgcacgccaccatgcccggctaatttttgtatttttagtggagacgaggtttcaccatgttgaccaagcaggtctcgaactcctgaccttgtgatctgtccacctcggccccctagagtgctgggattacaggcctgagccaccacgcacagccttg

SEQ ID NO: 153541 - DNA, 601 bp, Human
aatcgtgtgaataaatacctgccataccaggtgatatatgtgtaattaaaaatctgcacaaggtacagaaacaggtgatatatgtgtaattaaaatagaaatagtatagaagactggggtgacttgattgcatagagatgatctttgaggccctgaaagtggttgagaattatcaagagaaagtagaataagacaggagacacttttgataaagaggaactgcgagcaagtttagtatctgctgttctaacataacaggtagtaaaagtatatataacttgttttcttttcttttcttttytttttttttttttgagacagagtcttgcgctgtcccaggctggagtgcagtggcgcaacctcagctcactgcagcctctgcctcccaggttcaagcgattctcctgcctcagccttccacgtagctgggattacaggtgcacgccaccatgcccggctaatttttgtatttttagtggagacgaggtttcaccatgttgaccaagcaggtctcgaactcctgaccttgtgatctgtccacctcggccccctagagtgctgggattacaggcctgagccaccacgcacagccttgttttct

SEQ ID NO: 153542 - DNA, 601 bp, Human
aggtgcacgccaccatgcccggctaatttttgtatttttagtggagacgaggtttcaccatgttgaccaagcaggtctcgaactcctgaccttgtgatctgtccacctcggccccctagagtgctgggattacaggcctgagccaccacgcacagccttgttttcttaattctgttttctaatccttgggcctccaactttaaatgtgtgaattttttgaaaatttcattacgaattatctatgtttcagagggaaaaatttgtgaacaggtatttaaatgcattaagcatggaaaattastagaaagagatttatgaagaagcgtgattcaagttgaccactttctcttgaaaccattaaatttaaggagttttgaatgaattatttttagatcctataaaaataagttattttatgaagttgcttgcgacagggatgctcagcttttcttgaagagattttcttagcctcttcccagcctctggcaaccactgatctgttttctgcctaaagttttgtcttttctagaatgtcatataggtggaatcatagattatgaaacttttagagtttgactttctttaacttaacataaagcat

SEQ ID NO: 153543 - DNA, 601 bp, Human
ccattttgcattgcatcaataatgactaagaatgacagtttttccatatccttgtcagcacttgttattatcaattttaattttaggcagtggtgagctgaaggctggtcttgctagcaagaactgtatgttacatttttaggaattttatgaactagttaataaacagccattattaaaaattaaatgcaatgaatttaaaattaaatatatacctatgtaaagattatacataattttataaaatttttattaatgttataaatatgtaaaaataataaatatataaagctccttgctytctaattcctttactacatttcactattacctatgctcttgagattaattatgtctgttgtgtctgtatggtggaaggtacgtgtcttcgcaactctaccacagaaatcagcaaaagctaaaaatctggatcttctcctctgcagatctgattgctaaacatttaccagcacaacactgatttttagccattctaagaggtgtttagtgttacctcatccctttaatatatattcactaatgcctaatgttgctgagtatctttttatgtacataccatctgaatattatcttttttggt

SEQ ID NO: 153544 - DNA, 601 bp, Human
tttgcttatttttttattttattttatttgagacagagtcttgctctgttgcccaggcttggagtgcggtggtgtgatctcggttcactgcaacctccacctcccgggttcaaaagattctcctgcctcggcctcctgaatagctgggattacaggcacctacccccacgcccagctaatttttgtatttttagtagagacaaggtttcaccatgttatccaggttgttctcgaactcctaacctcaggcagttcgcccttctcagcctcccaaagtgctgagattacaggcgtgagccaycacgcccggcctattttattttatttgagatggagtctcactctgctgcccaggctagagagcagttggcacaatctctgctcactgcaacctccacctccccagttcaagcgattctcctgcctcagcctccctagtagctgggattacaggtgcccaccaccatgcccagctaatttttgtatttttagtagagatagggtttcgccatgttagccaggctggtcttgaactcctgacctgaagtgatctgcctgccttggcctcccaaagtgttgggattacaggcgtgagctattg

SEQ ID NO: 153545 - DNA, 601 bp, Human
ttttgctcatttaaaatattgaattttgagaattatttatgttgtgaatattttttttcccagtcggtgacttgtgttttttgttttgtttctttgtttttgttttttgtttttgttgagatggagtctcgctctgtcactaggttggagtgcagtggcgtgatctcggctcactgcaacctccacctccccagttcaagcgattctcctgcctcaacctcctgaatagctgggactacacacacgtgccaccatgcccagctaatttttttttttttttgtatttttagcagagacaagrtttcataatgttagccaggatggtctcgatctcttgacctcgtgatccacccatctcggcctcccagactgctgggattataggcgtgagccaccgcgcctgcccagtgacttgtttttttgtttgattaaccgtatctttctcagagcagatgtttaacattaacatttaaaggaaagctatcttttctttttttattgatagtattttagatgtcacatatatgaaatcctttgctaactttaacccatggtcacaaagattttgcttatagtttcttccaaaagaatttggaatttt

SEQ ID NO: 153546 - DNA, 601 bp, Human
cccagtcggtgacttgtgttttttgttttgtttctttgtttttgttttttgtttttgttgagatggagtctcgctctgtcactaggttggagtgcagtggcgtgatctcggctcactgcaacctccacctccccagttcaagcgattctcctgcctcaacctcctgaatagctgggactacacacacgtgccaccatgcccagctaatttttttttttttttgtatttttagcagagacaaggtttcataatgttagccaggatggtctcgatctcttgacctcgtgatccacccatctcrgcctcccagactgctgggattataggcgtgagccaccgcgcctgcccagtgacttgtttttttgtttgattaaccgtatctttctcagagcagatgtttaacattaacatttaaaggaaagctatcttttctttttttattgatagtattttagatgtcacatatatgaaatcctttgctaactttaacccatggtcacaaagattttgcttatagtttcttccaaaagaatttggaattttacattgtacatttaggattcatgttgagttaatttttgtgtgagatatgggttgacat

SEQ ID NO: 153547 - DNA, 601 bp, Human
attatttaatctgaatcttgaaatcaagtcgaatgactcctctaactttgttattttaaaaattgccttggctattctagttcttttgctttttcttataattttagaatcaatttgttgatttctactgaaaaatcctgctgagattttaattgggattgtgttgaattcagaaattagtttcaggagaattaacccattaacaatattgagccttcaagctataagcataatctctctatttatttagttagatcttgattttctttcactaatgtttgtagctttcagcatacagatstagcacatattttgttatgtgctagatctgtatgctgagtatttcatagtttttagtgcttttatttcttttattactttttatatttcccctttggttgcatgttgaccctgtatgatagcaactgttctaaacacttactaggtttagtaggtttttgtagagtccgatgattttctgtgtagataatcatattgtttgtgattggagttttatttccttctctcagtctttataccttttttttttttctcttgtcctaatggctgggtaggaccaccagtataatattgaataaaa

SEQ ID NO: 153548 - DNA, 601 bp, Human
tgtgaatttcattgatttctgctctgttttctttcttctgcttgctttgtgtttaatttgctcttctagtttttttttgttgttgttgttaattttagtttttatttttatttttattttttttgtagagacagggagtcacactatgttgcccaggctgctcttgaactcctggccccaagtgagccacttaccttggcctcccaaaatgctggaattacaagtgtgagccactgcaccgagcctggttttctagtttcttattaaagtagaagcttggatcattgatttgagacttttytccctactcttgctgtttagctatgtatttccctctaagcacgactttggctgcattccacaaattttgataaatgtggttttgttttcattcaatttaaaataatttctagtttctcttgtgacctcttatttgatctatgagttatttagaagtacattatttaatttccaaaatttgaggatattccagatagctattactgatttctggtttcatttggtaatggtaagagaatgttttatgctttccatttttttaatttgttaaagtttgttttatggcccagaacatgttcta

SEQ ID NO: 153549 - DNA, 601 bp, Human
tgctttgtgtttaatttgctcttctagtttttttttgttgttgttgttaattttagtttttatttttatttttattttttttgtagagacagggagtcacactatgttgcccaggctgctcttgaactcctggccccaagtgagccacttaccttggcctcccaaaatgctggaattacaagtgtgagccactgcaccgagcctggttttctagtttcttattaaagtagaagcttggatcattgatttgagacttttttccctactcttgctgtttagctatgtatttccctctaagcaygactttggctgcattccacaaattttgataaatgtggttttgttttcattcaatttaaaataatttctagtttctcttgtgacctcttatttgatctatgagttatttagaagtacattatttaatttccaaaatttgaggatattccagatagctattactgatttctggtttcatttggtaatggtaagagaatgttttatgctttccatttttttaatttgttaaagtttgttttatggcccagaacatgttctattatggtaagtgttctgtgtgcacttttgaaaagaatgtata

SEQ ID NO: 153550 - DNA, 601 bp, Human
actcttgctgtttagctatgtatttccctctaagcacgactttggctgcattccacaaattttgataaatgtggttttgttttcattcaatttaaaataatttctagtttctcttgtgacctcttatttgatctatgagttatttagaagtacattatttaatttccaaaatttgaggatattccagatagctattactgatttctggtttcatttggtaatggtaagagaatgttttatgctttccatttttttaatttgttaaagtttgttttatggcccagaacatgttctattatgstaagtgttctgtgtgcacttttgaaaagaatgtatatatagtctgttttgttgggtggagtgtcgtacaaatgttaggtcaagttggttgatatttttctgtctttccctgttacctatttacttgttttatcaattactgagagaaaagtgttgaagtctccaagataattgtatatttttaatttttatttcttgttttagttcacttaggttttcctttatgtattttgaagctattttgttacatagatgcttaggattgttttgtcttcttggtaaattgacccttttatcatat

SEQ ID NO: 153551 - DNA, 601 bp, Human
ttccacaaattttgataaatgtggttttgttttcattcaatttaaaataatttctagtttctcttgtgacctcttatttgatctatgagttatttagaagtacattatttaatttccaaaatttgaggatattccagatagctattactgatttctggtttcatttggtaatggtaagagaatgttttatgctttccatttttttaatttgttaaagtttgttttatggcccagaacatgttctattatggtaagtgttctgtgtgcacttttgaaaagaatgtatatatagtctgttttrttgggtggagtgtcgtacaaatgttaggtcaagttggttgatatttttctgtctttccctgttacctatttacttgttttatcaattactgagagaaaagtgttgaagtctccaagataattgtatatttttaatttttatttcttgttttagttcacttaggttttcctttatgtattttgaagctattttgttacatagatgcttaggattgttttgtcttcttggtaaattgacccttttatcatataatgtccctttttattgatgataatatttcttattctgaagtttacaccc

SEQ ID NO: 153552 - DNA, 601 bp, Human
ttccatttttttaatttgttaaagtttgttttatggcccagaacatgttctattatggtaagtgttctgtgtgcacttttgaaaagaatgtatatatagtctgttttgttgggtggagtgtcgtacaaatgttaggtcaagttggttgatatttttctgtctttccctgttacctatttacttgttttatcaattactgagagaaaagtgttgaagtctccaagataattgtatatttttaatttttatttcttgttttagttcacttaggttttcctttatgtattttgaagctattttrttacatagatgcttaggattgttttgtcttcttggtaaattgacccttttatcatataatgtccctttttattgatgataatatttcttattctgaagtttacaccctctgatgtttagcacaacagctttcttgtagattgtctgcatgacatatcttttttattgttttacttttaactaatttgtctttcaagcaggttttttttaggcaacatgtgtgtagttatttttatatccagtctagccatctctgtttcctaatgggtatatttaggctatttatttaattattgatgtg

SEQ ID NO: 153553 - DNA, 601 bp, Human
atgtttagcacaacagctttcttgtagattgtctgcatgacatatcttttttattgttttacttttaactaatttgtctttcaagcaggttttttttaggcaacatgtgtgtagttatttttatatccagtctagccatctctgtttcctaatgggtatatttaggctatttatttaattattgatgtggctagattagatctaccgttttatttgcttactgtttttctcttcagtttttttccttttctcctttcttgtggattactttatgtttattagtatttcattttatctactrggtatttgtttaatatcattatatttaaatatatattttagtggttgctctgcagcttaaaatatacatacctgagttaatattatacttcacgtaaaatgccaagctttacaaccacataggttcatttaccttccctcctttacgcttggaagtcattgctgcgcacaccaatagcatagttttgcagttggcaccatcctcaggaaaagttaagacagaataaaaaaaaaaatggcaaaatggatccttgtaaggacgggccattttttacattttggctccctccttagtcggcct

SEQ ID NO: 153554 - DNA, 601 bp, Human
tgtttagcacaacagctttcttgtagattgtctgcatgacatatcttttttattgttttacttttaactaatttgtctttcaagcaggttttttttaggcaacatgtgtgtagttatttttatatccagtctagccatctctgtttcctaatgggtatatttaggctatttatttaattattgatgtggctagattagatctaccgttttatttgcttactgtttttctcttcagtttttttccttttctcctttcttgtggattactttatgtttattagtatttcattttatctactgkgtatttgtttaatatcattatatttaaatatatattttagtggttgctctgcagcttaaaatatacatacctgagttaatattatacttcacgtaaaatgccaagctttacaaccacataggttcatttaccttccctcctttacgcttggaagtcattgctgcgcacaccaatagcatagttttgcagttggcaccatcctcaggaaaagttaagacagaataaaaaaaaaaatggcaaaatggatccttgtaaggacgggccattttttacattttggctccctccttagtcggcctg

SEQ ID NO: 153555 - DNA, 601 bp, Human
aaaaagaaagaaagaaaaagagtgatagctccctggcagttgagcggggtactccaagctgctgatggttggacacctgaaggaagtggattcctcatagcctctccatagtgatatgactgctccccagcagcctctacttgagttgcccactgccccacatcattcccattgtgcggtccactcttgggctctggactatgaggtgaaaaggttgtttttgttatataaacatgtttgtttttctttccttgtttctggtgttaaaactacgagtacccaaggtattagcaatatgaamtttcagttatgataagaatacattatatgttgcaaatagtttacatgtattatagctgtatactgtattataatctttacttcaacagtcatgtctattttaaagaacttaagaggaaaaaataatctgttttatttattcagatatttaccatttttgttgcttttcctttacccaaggtttgctcttgtaatttttctttttagcataaagaatttccttcagcatttctttttgagcagatctgttggtgatgaatattcttaatttgtacttcatctgaaaactttatttcacctt

SEQ ID NO: 153556 - DNA, 601 bp, Human
tcttcaatagcaataacaacccattattctctttggtaacagctcattctgttattgagcttatgtgaatgttttgtttcaggtaatttttttttcagttctaacattttgttttctttcttctttttgtagcagctttctttttttgcagcagcttctgtttctttgctgagagctgtcatttcattcacttcaaatatgtttacctttacttcatacaacatagttagaaatgcttttaaaagttttaaaaaataatgcattcaacatctgggttatttctaggttgacatctgttgaytgtcttttctcttatttggtcacattttttggactctttatgacaaataattttggactatatcttaaacatcccaaatgttatattgtgtaggctctgcatcctgttataatcctctggagactattgggattttttgtttatttttttgtttggtcaggcaatcaatttgcttaggttcagattccaaatttctgttttgccttctgtgggcagtggttctaatctcagttcagttttcaaagcttttgcctcttcaggtctgtctcatgcaggcaccactcaggtcttagtctggga

SEQ ID NO: 153557 - DNA, 601 bp, Human
tttgcctcttcaggtctgtctcatgcaggcaccactcaggtcttagtctgggactttgacagtgacctaagtatcaattgagttttccagtctgtgagaattgctgtgctgtttggctacacatgtgctgctcagggttgaccctgagatttgcacacattcattcacagaattaggggatccccttctccagttttttctctgggattttccccacattcttcagtttacaagaccgccccaccttccccaccacacacacacatacacacacacacacacacacacagacacacacggccacacacacacacacacacacacacacactcttcctctagcccgaaagatgaggtttcttttggcgttttatctacccgtgctgtagctcctgtagtgcagctccatgcctgggacttgctttcagcaaatctgcaagagaaaagagggggaaaaaaacagggatttattcatatacacatactccttagctcatatgacccctttgtctgattcatctggccataaagatgagatttctaccagagtttagctgtctctgtctctataccattgcacaggtctgtgactgaggcccact

SEQ ID NO: 153558 - DNA, 601 bp, Human
cacttgtatgagttatctgttgctgtgtaacgcattagcaacttaaaataataaacattatatcacagtttttaagggttggaaatccaagagcagcttagctagctaggtattctcatccaaggtctctcatacaattgtagtcaggatttcagccagtgctgcagtcatctgacagctgaggaggatccactttttctttttctcaaagagtcttactctgttgcccaggttggagtgcagtggtgcgatctcagctcactgcaacctccgcctcctgggttcaagctatcctcctgcytcagcctcccaagtagctgggactacaggtatgcgccactatgcctggctaatttttttgtatatttaatagagacggggtttctccatgttggccaggctggtcttgaacttctgacctcaggtgatccacccacctcagcctcccaaagtgctgagattacaggcgtgagccaccgtgcctggccgaggaggatccacttctaagctcactctcatggccattaagaggaaccttcatatccttgccacgtgacctctctatagactgctcagcatctgacaacccatttttcccaat

SEQ ID NO: 153559 - DNA, 601 bp, Human
caggctggtcttgaacttctgacctcaggtgatccacccacctcagcctcccaaagtgctgagattacaggcgtgagccaccgtgcctggccgaggaggatccacttctaagctcactctcatggccattaagaggaaccttcatatccttgccacgtgacctctctatagactgctcagcatctgacaacccatttttcccaatgagtggtcaaagagaaagggtaagcacaagaccaaccaagatggaagccacagtcatttataacctaatgtcagaagtgggggaggaagatagtargacagttcactttggttgggcagaaaaaaaatggttttgggttgtcgcagcagaaatacatataagtgagagaaagggtagaagataggggaattggctagttatggaagatttgggtggtaagagagaagtaggactttgggaaaatatctggatttctgaattgggtcacctaccaagaaaagcagttgttccttcttcccagtctttctgccttttacttccttttcttgtctttttgcatgcagctagaactttcagtatgatgttgaaaagaagtggtaaaaggggacaaccttg

SEQ ID NO: 153560 - DNA, 601 bp, Human
gttccttcttcccagtctttctgccttttacttccttttcttgtctttttgcatgcagctagaactttcagtatgatgttgaaaagaagtggtaaaaggggacaaccttgtcttgttcctgatcttactggggaagcttcaaatttctcaccattaagtatgatgttagttgtaggctttttgtagatattctttatcaagatatcctctattactagcttactgaaagttttttatcattaatagatattggagccactctgccatatttttaggtggatgcactataggctatttcaattttttttttttttttttttttgagaggagttttgttcttgttgcccaggctagagtgcgatggcatgatcttggctcaccacaacctctgcctcccaggttcaagcaattctcttgcctcagcctcctgaatagctgggattacagacatgcgccaccatgcccggctactttttttttgagatggagtcttgccctgtcgcccaggctggagtgtagtggtgcagtatcagctcactgcagcctctgcctcccgggttccaaagattctcctgcctcagcctcctgggtagctgggatt

SEQ ID NO: 153561 - DNA, 601 bp, Human
ccttttcttgtctttttgcatgcagctagaactttcagtatgatgttgaaaagaagtggtaaaaggggacaaccttgtcttgttcctgatcttactggggaagcttcaaatttctcaccattaagtatgatgttagttgtaggctttttgtagatattctttatcaagatatcctctattactagcttactgaaagttttttatcattaatagatattggagccactctgccatatttttaggtggatgcactataggctatttcaattttttttttttttttttttttgagaggagtttygttcttgttgcccaggctagagtgcgatggcatgatcttggctcaccacaacctctgcctcccaggttcaagcaattctcttgcctcagcctcctgaatagctgggattacagacatgcgccaccatgcccggctactttttttttgagatggagtcttgccctgtcgcccaggctggagtgtagtggtgcagtatcagctcactgcagcctctgcctcccgggttccaaagattctcctgcctcagcctcctgggtagctgggattacaggcgcctgccaccacgcccggctaattttt

SEQ ID NO: 153562 - DNA, 601 bp, Human
tggtaaaaggggacaaccttgtcttgttcctgatcttactggggaagcttcaaatttctcaccattaagtatgatgttagttgtaggctttttgtagatattctttatcaagatatcctctattactagcttactgaaagttttttatcattaatagatattggagccactctgccatatttttaggtggatgcactataggctatttcaattttttttttttttttttttttgagaggagttttgttcttgttgcccaggctagagtgcgatggcatgatcttggctcaccacaacctcygcctcccaggttcaagcaattctcttgcctcagcctcctgaatagctgggattacagacatgcgccaccatgcccggctactttttttttgagatggagtcttgccctgtcgcccaggctggagtgtagtggtgcagtatcagctcactgcagcctctgcctcccgggttccaaagattctcctgcctcagcctcctgggtagctgggattacaggcgcctgccaccacgcccggctaatttttgtatttttagtagagacggggtttcaccacattggccaggctggtctcgaactctt

SEQ ID NO: 153563 - DNA, 601 bp, Human
tcaccaacatggtgaaaccccttctctactaaaaatacaaaaaaaattagctgggtgtggtggcgggtgcctgtggtcccggctacttgggaggctgaggcaggagaatcgcttgaacccgggaggtggaggttacagtgagccgagatcgtgccattgcaccccagcctgggcaacaagagtgaaacttcatctcaaaaaaaaaaaaaaaaaattgcttagtaactatacaagaaaatattgatacaatttgcctttaattaagaaattccattgcaaaatctaccattaagaaagtaaraaggtaagccaaagattgggagactgaattattaatacatatctgacaaagaatttttatccagaatatataaggaacttctgcaaatcaataggaacaatagaaaaatgaacaaaatatttgaagagactcttcacaaaaggatatctaaattccctttaaacatatgaaaaattgctcaccatcattacttatcatggaaatgcaaattcagaacacaatgatacatactctacatgctagagtagcgaaagtgaaaaaaatggaatatatcaaaatgttggcaaagaattggagcaa

SEQ ID NO: 153564 - DNA, 601 bp, Human
caacatggtgaaaccccttctctactaaaaatacaaaaaaaattagctgggtgtggtggcgggtgcctgtggtcccggctacttgggaggctgaggcaggagaatcgcttgaacccgggaggtggaggttacagtgagccgagatcgtgccattgcaccccagcctgggcaacaagagtgaaacttcatctcaaaaaaaaaaaaaaaaaattgcttagtaactatacaagaaaatattgatacaatttgcctttaattaagaaattccattgcaaaatctaccattaagaaagtaaaaagrtaagccaaagattgggagactgaattattaatacatatctgacaaagaatttttatccagaatatataaggaacttctgcaaatcaataggaacaatagaaaaatgaacaaaatatttgaagagactcttcacaaaaggatatctaaattccctttaaacatatgaaaaattgctcaccatcattacttatcatggaaatgcaaattcagaacacaatgatacatactctacatgctagagtagcgaaagtgaaaaaaatggaatatatcaaaatgttggcaaagaattggagcaacaaa

SEQ ID NO: 153565 - DNA, 601 bp, Human
ttgggagactgaattattaatacatatctgacaaagaatttttatccagaatatataaggaacttctgcaaatcaataggaacaatagaaaaatgaacaaaatatttgaagagactcttcacaaaaggatatctaaattccctttaaacatatgaaaaattgctcaccatcattacttatcatggaaatgcaaattcagaacacaatgatacatactctacatgctagagtagcgaaagtgaaaaaaatggaatatatcaaaatgttggcaaagaattggagcaacaaagtttcatatgcygctggtgggagtgtaaaattatacaaccactttagaagatagtttactaataacttctaaagctgaacattcatctaccctgtgagccagctattccattcttaggtttatacaaacatttgtttacatgttcactaaaagatgaactagaaaattcatagcagcactattgatagtattaatagtaaaaaattgataaacatctaagtgcttattaacactagagtggttcaagtatggtattcacacaatgaaatattatacacttatgataatgagtggtctactactacacagaac

SEQ ID NO: 153566 - DNA, 601 bp, Human
taggtttgatggtaatggtctttcatgatccaagtgcatttgcataggtatgttgagtttttgaaactatctagctgtacacttttgatatatacagtttttttgtgttatacttcaataaaaaggtttttaaaagacctagttttggccaggcacagtggctcacgcctataatcccagcactttgggaggccaaggcgggcggatcacctgaggtcaggagttcgagaccagcctggccaacatggtgaaccccatctctactaaaaatacaaaaaaaaattagctgggcgtgatggcrgacacctgtaatcccagctattcaggaggctgaggcagaagaatcgcttgaacccgggaagcagaggttgcagtgagctgagatcacgccattgcactccagcctgggcaagaagagcaaaattctgtccccccaaaaaaaaaaaaaaagacctggttttaactattgtaatacgaaaaccataataaagataaaagctacacaatctaggtttcattgtgttactcattatacgttagggttaaagaagtacaagagtggctcattcctgtgatcccagcactttgggaggctgaggcg

SEQ ID NO: 153567 - DNA, 601 bp, Human
tttcattgagttaaaacttaatatggatggattcttttgtggctcataagcttgggattttcacactaaacatttttaactcatgaggttgggacttcacattaatctctaatctttgagattgcctccctcaaaccttgctacagtattggcacattacccatctcacatgaaaaaggaaaaagaaaaaaagataaaaaatgaataattatgttctcatctttcatagtggttcaatattcaaaccattctgtgtttttgtacaaacatgtttgaagacagcaatcctccatcacaaaamtccatataatttacaccttgattcattccatgagaagttgtcactggagatgaattcacatattttattatgtcacaaaattaaaaatatgataccaaataccaatcatcttctctttaaaattttaagccacctaacaacttagagtcaaaatcaccgttaaccaaagttgtaatatttcagtatttgttattgtgtcctttcatggacttttttccaggcaatctttcaaagttgtttcatggtatttgtatcttatgctaaaagatgacacaagttctttctctacttaacaagtac

SEQ ID NO: 153568 - DNA, 601 bp, Human
tgagttaaaacttaatatggatggattcttttgtggctcataagcttgggattttcacactaaacatttttaactcatgaggttgggacttcacattaatctctaatctttgagattgcctccctcaaaccttgctacagtattggcacattacccatctcacatgaaaaaggaaaaagaaaaaaagataaaaaatgaataattatgttctcatctttcatagtggttcaatattcaaaccattctgtgtttttgtacaaacatgtttgaagacagcaatcctccatcacaaaactccatwtaatttacaccttgattcattccatgagaagttgtcactggagatgaattcacatattttattatgtcacaaaattaaaaatatgataccaaataccaatcatcttctctttaaaattttaagccacctaacaacttagagtcaaaatcaccgttaaccaaagttgtaatatttcagtatttgttattgtgtcctttcatggacttttttccaggcaatctttcaaagttgtttcatggtatttgtatcttatgctaaaagatgacacaagttctttctctacttaacaagtactaatct

SEQ ID NO: 153569 - DNA, 601 bp, Human
tgagattgcctccctcaaaccttgctacagtattggcacattacccatctcacatgaaaaaggaaaaagaaaaaaagataaaaaatgaataattatgttctcatctttcatagtggttcaatattcaaaccattctgtgtttttgtacaaacatgtttgaagacagcaatcctccatcacaaaactccatataatttacaccttgattcattccatgagaagttgtcactggagatgaattcacatattttattatgtcacaaaattaaaaatatgataccaaataccaatcatcttctctttaaaattttaagccacctaacaacttagagtcaaaatcaccgttaaccaaagttgtaatatttcagtatttgttattgtgtcctttcatggacttttttccaggcaatctttcaaagttgtttcatggtatttgtatcttatgctaaaagatgacacaagttctttctctacttaacaagtactaatctaaaattctgtgtattcctttaatggtatagggtcatacatagaggttttaaattatccatttttttaaagactccttcaccctatagtctcagatttctatgtagatgag

SEQ ID NO: 153570 - DNA, 601 bp, Human
gtgaatatcagtgtttgttttaaaaaaagagagagatgggaactaaagaacaataaacatagtcatctgtctcctttgttaacccaaaaatagaaacattttttatgctttagctttcatcttaaactcagctgtatttcataatgacatcattaagtgactgaagacctaatctgatcatttttgtatgaatgaatgagtattacacttggttcttatttataatacattttaacaggtgtagcattcctccttctatggaggagtatggttctaggaaactataatagggagcagcgtrtgttactgggatggtgaaaactattgtccagtaatgagaaacctatactcgatttgtccctcctataccagaggagagaatatagatattgctgtagtgacattgacataatcagttcatacatgtctcaaagtatgtctccaaggaaaaattaatctttacagttagcacctatgaagcatcttcctgaacctttaggtctgctttaaattaaaccttatgaatttgtaatatattggtttacttaagctaaaaggtgtcatgaagaaaatttaagacagattatatatatatgttgaa

SEQ ID NO: 153571 - DNA, 601 bp, Human
atattttgcctgtgagtctgttgccaaagaacagtgcctctttcagattctggggtttttgttttgtttggtgcttgttgttttgcttattgttgtaaatatctcacacttgtagctttgatatactgctttttttttactttatcatattactcattggtttcatttctttacaaaaagagtaataaataccagcaatcatcacagcctgaattgcatataagcttttattttgttacggtaggcttatctatagcctgtttcaacatatatagtccattttccttcctctggttaccayagtttgaaagatttttagttattgatcattttcgcttttaatatgaaaaagtgaagagatcatctataccaagtaaggatctcatcaacatgagataaccagtaagaatagcttgataaaatgttgacgtgtataaccttatttcaggtaaatatgctattactgctataccttgaggtattaaaattaaaatggttcactgactatcattaccaccatcttgaacctctaagaatctaaggacctcaggttagaaaccactggcctggtcctgtgttttccttgaggtcctgccttcct

SEQ ID NO: 153572 - DNA, 601 bp, Human
ctcattggtttcatttctttacaaaaagagtaataaataccagcaatcatcacagcctgaattgcatataagcttttattttgttacggtaggcttatctatagcctgtttcaacatatatagtccattttccttcctctggttaccacagtttgaaagatttttagttattgatcattttcgcttttaatatgaaaaagtgaagagatcatctataccaagtaaggatctcatcaacatgagataaccagtaagaatagcttgataaaatgttgacgtgtataaccttatttcaggtaawtatgctattactgctataccttgaggtattaaaattaaaatggttcactgactatcattaccaccatcttgaacctctaagaatctaaggacctcaggttagaaaccactggcctggtcctgtgttttccttgaggtcctgccttcctttcctagtatcagttctacagactagcaaagttgtagtttacattatggccaccacttgtgattttccctttcctggctctgctttttgcatatgctattattccattatcatggaattctttcttcattttttctctacccatttcagtct

SEQ ID NO: 153573 - DNA, 601 bp, Human
taatatccagtaatctttaccaattaattgctttatattactaactttgtagcttttcctaaccagtttttaatccaagttaaaatagttgtggacagacttccaccataaaatttgtctttatatgtataaaataatcataatattagtgtaaataaatatttgaaaggtaagttaccacaagtataagttgttacaaatccaaacatgaatgtggaatcatctgcatcattgcttttctttcagcctgatccctaccactagtataattaagctaacttaataggattctttctaaaaycaacaaagttacagttagttttaaagttgtgataaataaggatgcataaaattcctttgtgataattatttttaaatgacattatttttatatttgtgggtaatataaaaatattttttataatccattaactgctatgtagaatattgggggtttgcttgccagtgttcttaactaacttgtttaatctatgtctagaagccacagaagaagtttctttggacagccctgaaagggaacctatcctatcctcggaaccttctcctgcagtcacacctgtcactcctactacactcattg

SEQ ID NO: 153574 - DNA, 601 bp, Human
attaacatgagattttgggctgggcgcagtggttcacgcctgtaatcccagcactttgggagaccgaggtgggcagatcacctgaggtcaggagttcaaaaccagcctggccaacatggtgaaaccccgtctctagtaaaaatacaaaaatcacctgggtgtggtggcagacacctgtaatcccagctacttgagaggccaaggcatgagaattgcttgaacccaggaggtggaggttgcagtgagctgagattgagccactgcactcctgcctgggcagcagagcaagactctatctttaaaaaaaaaaaaaaaaaaaattgttacttctccaaatggtctttttcgtgtgtgtgtgtgtgtgtgtgtgtgtgtgtgtgtgtgttttatttataaagtcaggaaatgtgaaagtttttattgtttttcaaaaatgaagtgctgggtggctaaattatttgttgtgacagtgactcttacagaaaatagatgataaaaattagtgtcatgacaataatttaaattataatttttaatgccaaaaaataatttatactttctagattgaagaagaagcaaatggagacatttttgacataga

SEQ ID NO: 153575 - DNA, 601 bp, Human
gtgaaagtttttattgtttttcaaaaatgaagtgctgggtggctaaattatttgttgtgacagtgactcttacagaaaatagatgataaaaattagtgtcatgacaataatttaaattataatttttaatgccaaaaaataatttatactttctagattgaagaagaagcaaatggagacatttttgacatagaaattggtgtatcagatccagaaaaagttggtgagtcaatacttattatattttgtatttactttttattagtttgttggttttgtatggtttttcttcatacatcartatagtattaaatgagttttatttttatgcatgtgattttaatagtagtgtttgactttttttgcaggtgatggcatgaatgcctatatggcatatagagtaacaacaaaggtgagctttttgtgcttttaaaaaaactatcgagccctcattatgtgtagtatgaggatatggctatgattaaggtagaagtgatccctgtctttataaaggttaccacctaataaagattgccaagaagtaggtgcaatgagttgtgagtggtttgatatgtagtgttcagtgagagtatgcaggatg

SEQ ID NO: 153576 - DNA, 601 bp, Human
aggaatttgcttgtgcaaaagccaaaagtgaagaaagcatcgtgctttctagaatctccaagaagtgatgcatgattgaaacgtttggcagtaagcctttgtgtattatgagcagccacattttaaggagtttggcttcatgctgagtataatggagagccattaaagaagttcaaagaagagtgtggcacaagtaggtttttgttttagaaatatttctttggcctcagtatgaattgggagggtcaaagtagaggtcaggatttccagttaaagggacactgcaatgattaaaggattstatgcctttaaatattaaaagagcatgtctgtcacagcagttctagctgtaagcagtaatactttatactaagaaaatggttctggagatgagcaaaataagtggcttcttgagttatgtaggcggtagaattgacaggacttggatgtaatgggtgaggaaggagaaggatgcctaggttattgactagagggactttgcagctgtgagagtgatccatggagaaaggcaacacgggcaggaacacagtgaggatgaggatgacagttgttaattcattggataaatattcattaaaca

SEQ ID NO: 153577 - DNA, 601 bp, Human
gtgatccatggagaaaggcaacacgggcaggaacacagtgaggatgaggatgacagttgttaattcattggataaatattcattaaacacctaccatggtgtcaagctttgttgcaagccctggggtatagtagtaaacaatacagacaagggtggcatcttatagaacttatgttccagcagggggaaatagggtaagtttgaagtgctggtgagatttaagtggaggggtatttggatatattggactgaagctttgtaagatatctgggccagatgtaaagatttaagaattattagsgtaaatagagtgaataagaccagttaagatagaataatgcaaatacttttttgtcctattaagattctgtaaaatacatctatggtttaggttttttttttagttagaaacctatataccacattagttagatactctgcattcttttgcaaagtagatacatgtatgtgttcacaattatgtataacattaacttgtggaataattgcttgctattcaaaatttgaaacacctcttcttcacttgtagacatctctttccatgttcagtaagagtgaattttcagtgaaaagaagattc

SEQ ID NO: 153578 - DNA, 601 bp, Human
accatggtgtcaagctttgttgcaagccctggggtatagtagtaaacaatacagacaagggtggcatcttatagaacttatgttccagcagggggaaatagggtaagtttgaagtgctggtgagatttaagtggaggggtatttggatatattggactgaagctttgtaagatatctgggccagatgtaaagatttaagaattattagcgtaaatagagtgaataagaccagttaagatagaataatgcaaatacttttttgtcctattaagattctgtaaaatacatctatggtttaggttttttttttagttagaaacctatataccacattagttagatactctgcattcttttgcaaagtagatacatgtatgtgttcacaattatgtataacattaacttgtggaataattgcttgctattcaaaatttgaaacacctcttcttcacttgtagacatctctttccatgttcagtaagagtgaattttcagtgaaaagaagattcagcgactttcttggtttgcacagcaaattagcaagcaaatatttacatgttggttatattgtgccaccagctccagaaaagagtatagtagg

SEQ ID NO: 153579 - DNA, 601 bp, Human
aaataaaacattaataggtgattaataagttaattaatgtgccaaactgaagatgtaccaaactgaagaattgtatggttttacataatccatttttaaaaggctttattggaatataatttacataccatataattcatccatttaaagtgtctaggtcgggtgtggtagcacatgcctgtaatcctagcactttgggaggctgaggcagttggattgcttgagctcaggggtttgagaccagcctgggcaacacagcaaaatcttgtctctacaaaaaattagctgggtgtggtggtgygtgctggtggtcccagctactcaggattgcttgagcctgggatataggggctgcagtgaaccgtgatcatgccactgcactccagcctaggtgacagagtgagaccgtgtttcgaaaaagaaaaaaaaaagggtatccagttcactggcttttaatatattaagagttgtgcatacattaccacagtcaattttagaatatttttattaccccaaaatggaatctgggatcccttagccatcatcccctaatgtcctcattttccccagccctaggcagtcactaatttactttctttct

SEQ ID NO: 153580 - DNA, 601 bp, Human
gtggtcccagctactcaggattgcttgagcctgggatataggggctgcagtgaaccgtgatcatgccactgcactccagcctaggtgacagagtgagaccgtgtttcgaaaaagaaaaaaaaaagggtatccagttcactggcttttaatatattaagagttgtgcatacattaccacagtcaattttagaatatttttattaccccaaaatggaatctgggatcccttagccatcatcccctaatgtcctcattttccccagccctaggcagtcactaatttactttctttctctaagtrtttacctattctggacatttcatgtaaaaaggatcatgcagtagatgatttttttgtgtgtgacaaattccttccacttagcatcatatgttcaaggttatttcatgttgtagcatatatcaataccttgtttccacagaatacatttttgaaaggaaaaagaacaggagaataaaagagaaaaatctgcagcctgaaattaaattgcccttacagaagtaattaacatgacttattttttaaatctgaagttataaatgactctgtgaaagagctttttctttcaatcattgtaaaacc

SEQ ID NO: 153581 - DNA, 601 bp, Human
tttccccagccctaggcagtcactaatttactttctttctctaagtatttacctattctggacatttcatgtaaaaaggatcatgcagtagatgatttttttgtgtgtgacaaattccttccacttagcatcatatgttcaaggttatttcatgttgtagcatatatcaataccttgtttccacagaatacatttttgaaaggaaaaagaacaggagaataaaagagaaaaatctgcagcctgaaattaaattgcccttacagaagtaattaacatgacttattttttaaatctgaagttrtaaatgactctgtgaaagagctttttctttcaatcattgtaaaaccagctgtgataagtaaataagaacatgctcttagaatctgcaggagggaaaacataacaaattcatggattacatttacttttatttttgtcatcccaaagtaaagaattttaattattgctcatgagaaatgaaaatgttaattgagcttaaatttattgatttgaaattccattatgtatatcgggttagaaacacattttaatttaccaggagtataaaatacaacagataagggatctttttgatgtaagc

SEQ ID NO: 153582 - DNA, 601 bp, Human
accagctgtgataagtaaataagaacatgctcttagaatctgcaggagggaaaacataacaaattcatggattacatttacttttatttttgtcatcccaaagtaaagaattttaattattgctcatgagaaatgaaaatgttaattgagcttaaatttattgatttgaaattccattatgtatatcgggttagaaacacattttaatttaccaggagtataaaatacaacagataagggatctttttgatgtaagcttttctgtaaacaaaagcagtatgggtcagaaaactataaacattttatctgttctctcatgttttaagtatttaccaagtaaagatgttaacatatcatgagatttaattcctcaaaacgtttttgctttttagataagataccagttacaagtttagggctgttaagttcaaattttgagtgtattttaaattatgaagaaatgattatgaaagactttcacagcaatataaagtcatcatgaatctcattcaacttcttcaaagggatgaccaaggtcaaagtgggtaaagaagactcatcatccactgagtttgtagaaaaacggagagcagctcttgaa

SEQ ID NO: 153583 - DNA, 601 bp, Human
aaaacataacaaattcatggattacatttacttttatttttgtcatcccaaagtaaagaattttaattattgctcatgagaaatgaaaatgttaattgagcttaaatttattgatttgaaattccattatgtatatcgggttagaaacacattttaatttaccaggagtataaaatacaacagataagggatctttttgatgtaagcttttctgtaaacaaaagcagtatgggtcagaaaactataaacattttatctgttctctcatgttttaagtatttaccaagtaaagatgttaacrtatcatgagatttaattcctcaaaacgtttttgctttttagataagataccagttacaagtttagggctgttaagttcaaattttgagtgtattttaaattatgaagaaatgattatgaaagactttcacagcaatataaagtcatcatgaatctcattcaacttcttcaaagggatgaccaaggtcaaagtgggtaaagaagactcatcatccactgagtttgtagaaaaacggagagcagctcttgaaaggtaattctagacagctatattttattactctcatgtttgtaccttaat

SEQ ID NO: 153584 - DNA, 601 bp, Human
aagtacagtttgtgccccccttgtgtttgtataattgatttttacttgaatgtacaaaagtattagtctttgcttgagttgactatatacagttgaccctccatatctgtgggtgccttatttgtggattcaactaactatggatggaaaatatttgaaaaaaataattacatctatactaaacatgtgcagacatttttggtcattattgtctaaacaatacagcttaacaactgttttcatagtatttccattatattaggtattataagtctagagatgacttaaagtatatgagagrctgtccataggttattatgcaaacactacgccattttctatcagggatttgaacatttgcagattttggtatccataggatgtcctggaaccagtcccccactggtactgagggacagctatacttaaagactaatatatatgctctgttttcctttagagtacttgactctacacatttcctatagctttgaagacttgtcttccttgaagcagactaaaagggggacagatgggaggatgggaagaaccacacttccataatcttagaattattccttccttgctatgctgacaaagt

SEQ ID NO: 153585 - DNA, 601 bp, Human
tcagtggttagggtgaatagcacaggtcttgggggtggtatctatttctctaggtcacaaatttttttttaaactatttcaaggcaacttatttctagttttcagtagtaaattgtttaaatttcaagaaaaatggtacagtgaagttagatttgaacaatttaagaaaagctaaagaatatgtagtttaaaatcttagagaaggcttaaagatgggattatgtctgagaatctgcagttacccagaaaaaggatttaaattgcatcaagagaagtttaggttaggcatttgaattgattytattgtaggagaggtcatagactgaatatttttaagaataaaggtaaatcggatggttgccgggtctgtgtggatagaagtagacatgggagacttttcattttgttctgtactaagaaaaattcttctgccttgggatcctgtcgatctgtgaccttatccccaaccctgtgctctctgaaacatgtgctgtgtccactcagggttaaatggattaagggcggtgcaagatgtgctttgttaaacagatgcttgaaggcagcatgctcgttaagagtcatcaccactccctcatcttaa

SEQ ID NO: 153586 - DNA, 601 bp, Human
gttagatttgaacaatttaagaaaagctaaagaatatgtagtttaaaatcttagagaaggcttaaagatgggattatgtctgagaatctgcagttacccagaaaaaggatttaaattgcatcaagagaagtttaggttaggcatttgaattgattttattgtaggagaggtcatagactgaatatttttaagaataaaggtaaatcggatggttgccgggtctgtgtggatagaagtagacatgggagacttttcattttgttctgtactaagaaaaattcttctgccttgggatcctgtygatctgtgaccttatccccaaccctgtgctctctgaaacatgtgctgtgtccactcagggttaaatggattaagggcggtgcaagatgtgctttgttaaacagatgcttgaaggcagcatgctcgttaagagtcatcaccactccctcatcttaagtacccagggacacaaacactgcggaaggccgcagggtcctctgcctaggaaaaccagagacctttgttcacttgtttatctactgaccttccctccactattgtcctatgaccctgccaaatccccctctgcgagaaacaccca

SEQ ID NO: 153587 - DNA, 601 bp, Human
tttttcttgccctttcatatagccagcttttctaaagtgatttttctgtgatatttcttaaactttaaacatcaaacaggtaccatctgtgggatacccaacccagttggatctggtgggttagggaagcatttttcttcgtattattttatttaatagtatgatatttacgtattcgttcaaacttagataatccagatgactaccttgaatgaaaggataaatatctggtattaaaggttaggaagagaaaaggagtggttaaatacccaagtattcccctgtgccacactcagtaaastaagcagagactgcttctattaagagtagccctaacatcacttgcttggttttcttgagagtgcttcagatctttagatcatattgagtgtattttataggtaaggatacacatctgcaaatacaaaatgagaaatttagagcataataataagtgtataagatttataattccttttcagttgaaacctgtgctaatactacacactttctgtgtgaccttaggtaaattacttacatgcatttgtctttaaagtgtaagtgtgaggctgggcgcggtggctcacacctgtaatcccag

SEQ ID NO: 153588 - DNA, 601 bp, Human
gctgggcgcggtggctcacacctgtaatcccagcactttgggaggctgaggtgggtggatcacgaggtcaagagatcaagaccatcctggccaacatggtgaaaccctgtctctactaaaaatacaaaaaattggctgggtgtggtggcgcgtgcctgtagtcacagctacttgggaggctgaggcaagaggcttgaacccaggaggcagaggttgcagtgagccaagattgtgccactgcgttccagcctgtcgacagagtgagactccgtctctaaataaataaataaataaataaataaataaataaaatgtagtgtgtcaggattgtgttcatttcaagcatctaaaaatccaactggcctaaacagttaatgtagattaattaatccactctttcaaatcaaagagtttggagtaggcagctgttcaggattatctaattcattaggaaattctattgcttctttctgatatctgataatacaaccttttctcaccagtctactgactgagtccaaaggtgttaattaactgcagtagcctcctaattggtgtccctgattccattcttggcacttctactttaatacagaacttt

SEQ ID NO: 153589 - DNA, 601 bp, Human
aaatccaactggcctaaacagttaatgtagattaattaatccactctttcaaatcaaagagtttggagtaggcagctgttcaggattatctaattcattaggaaattctattgcttctttctgatatctgataatacaaccttttctcaccagtctactgactgagtccaaaggtgttaattaactgcagtagcctcctaattggtgtccctgattccattcttggcacttctactttaatacagaactttacagtagtcattctaaaatataaatcagatcattttaacccctccccacsctggccccatgcccccattttactcaataaaagccagagtccttttaatggactacaagactttatatgacctgcacgcctcactctgttacccatttgatctcatatcctccgtgatcactcactctgctttaggccagactaaccttttgctgcttctcaaacaccctaggcattttcctaccttagtcttttcaactgcctgctccctctgcctagaatgctttgttcctaggtatctgcatagctaactcatttccttgttcaagttcgtatgttcaaataacatctttcaagtga

SEQ ID NO: 153590 - DNA, 601 bp, Human
accttttgctgcttctcaaacaccctaggcattttcctaccttagtcttttcaactgcctgctccctctgcctagaatgctttgttcctaggtatctgcatagctaactcatttccttgttcaagttcgtatgttcaaataacatctttcaagtgaagcctattccagtcattggctttcttctgacctattctatttatattgccaccaaccacatcttaaatacttggtcccatttaccccattgttctgtctttttttcccatagcttttgccaccttgtcacatgctttatcatttktatgtttattatgtttatagtttattgtctatcttgtactaaaatgtaagcttcaccagggaaagaatcttagtcccttttgctcactgatgtgttccaagtactcaaaacagtgcttaataggtagtaagagctcagtaagtatttgctgaatgaacaagtgaatgttatccaagacccaggctctttctacctttttattctcccattatgtgcatttgtgttttagtttcaagcaagataaatatttgtaactctgttgctctcaagcgttttatataacctgctttattttgtttt

SEQ ID NO: 153591 - DNA, 601 bp, Human
caattccattgtcttttatttctgacttttttcagtgtttctatttctccccatacctcttttcctgtcttcttcctacactcatttaccctttttgtcccgtgtctttcctttgtattacaaccatctctggtcttaattccgaattggcatatgtttataaatatttattgttttaaaatccattttatgtttctgttcttaatttcaacattatgtaaacatatatataaaagcatataagcttatatatgagaaacatatatataaactaaaaaatgcatacatgtattttttagtrtatgtatttagtatatgtattagctttattttatgttgcccttgagaaggaaagttttattccctttttctggaatatcatttttcaaaattgattcttcagaatgctaatatgtagtagaatgaaaaagatctatagtcaattgagttttgtcaacataggatttaacaaagttaaactagggttattttctgtaggagttctcacaacacttaataaaatgctgtttgatatgaattttaaaagacaggaatatatatatatttcaaactttcttgatatggaatcagtctttttcat

SEQ ID NO: 153592 - DNA, 601 bp, Human
aacacttaataaaatgctgtttgatatgaattttaaaagacaggaatatatatatatttcaaactttcttgatatggaatcagtctttttcatggaatagtacgtgagactagtattctacagaactcactttggaaagctgttttagaatataaattatacaaggtatttccacttaggtttgaaatattagaatatttccttttttttttttttttttttttctgagacggagtctcgctctgtcacccaggctagagtgcaatggtgcaatctcggctcactgcaacctccgtctccygggttcaagcaattctcctgcctcagcttcctgagtagctgggactacaggtgcatgccaccacccccagctaatttttgtatttttagtggagatggggtttcaccatgttggtcaggctggtctcgaactcctgacctcgtgatctgcctgccaaagtgcagggattacaggcatgagccacctcaccctgccagaatatttcttagaggttaagtactagatgttttgtccttcttgggtttttgtttgttttttacaagtatctgagtgcctgctattacctagctgttgtatgca

SEQ ID NO: 153593 - DNA, 601 bp, Human
ggaaaatactgaagaaaatttagttcttgtcaagtgaggactaaagctaattgtgatcatttaaatatgctgacacgcaaaaaagtattggtagactcttccccattctgatgataatagcagtttaaaacttggttgagtggaatatatatagtaatattaatatgtttcttagaactctaaaattatagttgagaacatgactccacccaaagataaaatgatgcaacaaactcacatacccctttgcaacataatactttgcaatgagaagtttggtaagttatttaacctctccccwctcccaccccttgccatttctctttttacgtaattatgaaaactggatagtatatcaattttcaaaagatgaacaaaaacctttttaattattaaattgctgtaagattctaagtaattacagtgagagtagtctaatacgaggtagtgaggacacttttttttcctagtatttctatttttttatcattttgttgaactgtaattcaagatgctactgataaaggagcaattttactcttaaatctaggtatcttcaaagaacagtaaaacatccaactttactacaggatcctgattt

SEQ ID NO: 153594 - DNA, 601 bp, Human
attgcagaagagagaaaacaatcatttaagacaatgttttctagttcaactttattatgtaaatttttttgttctattttgctttactatctagtttagaagtagaaaaataacgagcttagaaaattatttgttaactggtacagatgtgagctaaaaaaaagaacaaagaaaactatatttgaattttggattaaaacttggtcacttgattaactttttgttaagtatagttacagttaaatggatgaagaggtcttatcaattagtaactttgattataataaaaaaacttgagatwtgaaaattgctttttgaaaattttttggaaagtatttgttttgtgtgtctatttcctgtaaaaccctttgaagtattttcttcatttttgaactgcaatattgaaaaacctggaggttttgctaaaaattcatagaaaatttgagttgtaatattttaatccacagtgaaattatagttttttggttttttaaagaatccaacaatgtaaatatcaattgtctaagacatttaataagcaaataatatgtaacattaccagcaatacattttattaaaataattatagaaacttattaat

SEQ ID NO: 153595 - DNA, 601 bp, Human
ataacgagcttagaaaattatttgttaactggtacagatgtgagctaaaaaaaagaacaaagaaaactatatttgaattttggattaaaacttggtcacttgattaactttttgttaagtatagttacagttaaatggatgaagaggtcttatcaattagtaactttgattataataaaaaaacttgagatttgaaaattgctttttgaaaattttttggaaagtatttgttttgtgtgtctatttcctgtaaaaccctttgaagtattttcttcatttttgaactgcaatattgaaaaayctggaggttttgctaaaaattcatagaaaatttgagttgtaatattttaatccacagtgaaattatagttttttggttttttaaagaatccaacaatgtaaatatcaattgtctaagacatttaataagcaaataatatgtaacattaccagcaatacattttattaaaataattatagaaacttattaatacatttattattgaaagtagtttgtaacagcttttgccatttgaattatatatatctcttagggaatgggcttttttggagaactttacataatgtagagcaacggagc

SEQ ID NO: 153596 - DNA, 601 bp, Human
aatacattttattaaaataattatagaaacttattaatacatttattattgaaagtagtttgtaacagcttttgccatttgaattatatatatctcttagggaatgggcttttttggagaactttacataatgtagagcaacggagcagtttccacgcagtgtaattgttagtcattgacagtattcagcctgtaaacatctacttttctttatttgaaatatctgaaatgatcacattctaaatctttttagaaattctaatattttactgagattgttgtacaacaaagaaactaacartaaaatttatgttaattgtgtatataattttacctttgctcctgttagctaaataatattctcattaaaattatagacattattttcaatgacaaatgtttaaaggccagaaatgtggtataaatcaattgtgagtattaccagttcttctcatattaaaaatatatttcatttttaggaatgggcagagaaacagtgaacactgtgggagaaaaaacaggaggcagatttttatattaaatgatttaaacatagttcatccctttggaatataagcagtgatttgtctgtgttttcagt

SEQ ID NO: 153597 - DNA, 601 bp, Human
aatgattcattgactaaaagagttaaagagctgtggtgaagttgccttcaggtaaattaagctctttaagattagtttctactgaaacctagcccagatcaactacacaaaggaattaagatattatggaaggaggtgacaggtaatttttatggtttttgtttttgtcctattctttattttaaactaattcacttgtatttgaaaaaataatgcacatacatgatagttctaatagctcagcaaggtaaatttgcctgcagaactaagacctgtagtctctgacctcagtcataaactrttaggttcttgtgtgtctttacagaattagctatgcatgtacatgaagctaattctccctctgtccatttattccttccatccccttctctccctcccttcctttctcaaaaaggaatatactgtgtgtagtgttctttgtctgctttttacacccactccacttaatagggcggtctccctatcaacataagtagatgtcctttttttttttttttcgcagacggagactcgctctgtcgcccaggctggagtgcagtggcgtgatttcggctcattgcaggctccgcctccgggttca

SEQ ID NO: 153598 - DNA, 601 bp, Human
tgaaaaaataatgcacatacatgatagttctaatagctcagcaaggtaaatttgcctgcagaactaagacctgtagtctctgacctcagtcataaactgttaggttcttgtgtgtctttacagaattagctatgcatgtacatgaagctaattctccctctgtccatttattccttccatccccttctctccctcccttcctttctcaaaaaggaatatactgtgtgtagtgttctttgtctgctttttacacccactccacttaatagggcggtctccctatcaacataagtagatgtcytttttttttttttttcgcagacggagactcgctctgtcgcccaggctggagtgcagtggcgtgatttcggctcattgcaggctccgcctccgggttcatgccattctcctgcctcagccttccgagtagctgggactacaggcgcccaccatcatgcctggctaatttttttgtatttttagtagagacgaggtttcaccgtgttagccaggatggtcttgatctcctgacctcatgatccgcctgcctcagcctcccaaagtgctgggattacaggcgtgagccattgcgcctggccgg

SEQ ID NO: 153599 - DNA, 601 bp, Human
attactgttcaaaaagattttactttgtaccctaacctacctaaacctacatgtttctttttactagcacccaagaatgaaggttttttgttttgtaagttgccatttacttagtgtgaatcaagacatctttacaaatgataaaccatttgcatttctttttctttcttttttattgagatggagtcttgctttgtcgccaggctagagtgcagtggtgcaatcttggctcactacaacctccgcctcctaggttcaagcaattctgcctcagcctcccgagtagctgggactataggcrtgtgccaccacagccagctaatttttgtatttttagtagagacggggtttcaccttgccaggatggcctatctcttgacctcgtgatctactcacctcggcgtcccaaagcgctgggattacaggcatgagccaccgcacccagccctacatttctttttctgtgaatgaactcttcatgtcctttgcccagtttttgtttggttattatctatttcgaataggtgcttaatattaattaacctttggttttatccatatcgagcgtacttttctgatgatagttcttcaaattaggaat

SEQ ID NO: 153600 - DNA, 601 bp, Human
aactccatgaagctgggcagcatattttcagattaactgaattacaatatgataataattaaaattgtagcatcaaatttcctgatgggccaaaaaaactgttagacatctgcaatcttgtctaactgagagcagcttgcatacaaatgtatgccataaattagcagagtaatggaggtcctaaatggatgatccgtgtaaacttatccctcttataatggttctactagagtggattagtatcttgacatacaaagggacacattgttacgatttaattgatttaatatagcattgttakaagtttgactggtgctggttcttttttattttctgttattttgttacaaaggaaagaaaacaaacgaagaaaaagttaatttgtatatttaagattaatttttttttcctgaaataacctgactttagtagtcttacctttatcatagctcctacatctgtaccacaataaacatgtcctggttctagaatactatgagataataaattggacagggaccaaattagtttagatttagcatatcaatggaaaagccggttgatgtatacattgagaacttaagcaaatattgaattaaag

SEQ ID NO: 153601 - DNA, 601 bp, Human
ttgtttgtgttaagctttccaacatgcggccggggacagctttgaatgcagcccaactcaaattcacaaactttattaaaatgtcatggccgggcgcggtggctcatgcctgtaatcccagcactttgggaggccgaggcaggcagatcatgagatcaggagatcgagaccatcctggctaacacagtgaaaccccgtctcttctaaaaataaaaataaattagctgggcatggtggcgggtgcctgtagtcccagctactcaggaggctgaggcaggagaatggcgtgaacctgggagtyggagctcgcagtgagctgagatcgcgccactgcactccagcctgggcaacagagcgagactctgtctcaaaaaaaaaaaaaaaaaagaaaattgtaaaaaacactgatgacattttttttttaaagctcatcacttagtgttagtgttagtatgttttatgtgtggcccaagacaattcttcttccattgtggcccagggaagccaaagcattgaacactgctgttttaaatgatagtgactttttctgaatctatttgtgttagatatgttacttttggattttaataagggatgtttt

SEQ ID NO: 153602 - DNA, 601 bp, Human
agacatgtttctaatacttaatatgcttctaatattatttagcgggaaaatttccagtgtaggtatgacactagcattttcctattaaagacatcttcaaagcataaaacgctgttataaatcttataaaccatatttaaagccctaaaggctagtgatgaaatgggttttgaatgtagtttttattctgaacatgtttcatccagtgacagggtttttttgttttaagcaaatgaatatggagattattttctttgatattggcatacttactttcagtatcttagtatattagaatagmacttaaatacttggttttattgttttcagtattataacacttctagtgttaagaaagtattttaaatgttactcttacttaatagcattatgtcattcacttatagggtgtgtttgaccatcgaatgaagtgctggcagaaatgggaagatgctcaaattactttgctcaaaaaacgtgaagctgaagcaaaaatgatggttgctaacaaaccagataaaatacagcaagctaaaaatgaaataagagaggtgattactaaatgctttaatctctttacttaagttttgcatgagtcatt

SEQ ID NO: 153603 - DNA, 601 bp, Human
tttcagtattataacacttctagtgttaagaaagtattttaaatgttactcttacttaatagcattatgtcattcacttatagggtgtgtttgaccatcgaatgaagtgctggcagaaatgggaagatgctcaaattactttgctcaaaaaacgtgaagctgaagcaaaaatgatggttgctaacaaaccagataaaatacagcaagctaaaaatgaaataagagaggtgattactaaatgctttaatctctttacttaagttttgcatgagtcattcatatatacataatttttcataattttttgtaaaccattcaacacgtagctatttttgcatatttttatgaactgtgttagaattactttaacattttgatcattattattaaaatctccagagcccttcattacttatggaatggataaagaagcatacaaggaaaacagctaaaattaacctttacattaataattacacatttttattagatggttaattttatttcagattattattttgtgtctaaaaatggttttagagctagatctctcccacatttagctgtccaggcaacattatcccccatatatatgtattat

SEQ ID NO: 153604 - DNA, 601 bp, Human
caataaggaaattgaagaggtaggacaacctttatgttactaaaaataaatgtacctgccctttgaagagtatgtaccagtgttttggttacatagtgggaaaaatatcatttcattgcttaaatcttcagttattttagttgtttcattgttcactaatcacaacattttgttgtttctgtactgaatttaatatttattgatggtcttcagtagaccataattccacatttttttccaatctggtcattttaccattacaaaaatatttttaaaatgtttatcatgtaattttcctaawttaaaatatttccatcagcatataaattttgaagaacacatatccttggatttaacagtattgatatattctgaaataattattgatataaaaaagtaattaagaaaattacactatagcactgataatttattttgtggtgaattttatgcccaaaatctttcctcttagttatatttaattaagctttggacattgtagtttattaagtacagtattgaaatatcttaatattgagcaaatctgtggaatattaaaggaaattaagctaacatgcatttctattggttgacagttaaa

SEQ ID NO: 153605 - DNA, 601 bp, Human
ttttttccaatctggtcattttaccattacaaaaatatttttaaaatgtttatcatgtaattttcctaatttaaaatatttccatcagcatataaattttgaagaacacatatccttggatttaacagtattgatatattctgaaataattattgatataaaaaagtaattaagaaaattacactatagcactgataatttattttgtggtgaattttatgcccaaaatctttcctcttagttatatttaattaagctttggacattgtagtttattaagtacagtattgaaatatcttamtattgagcaaatctgtggaatattaaaggaaattaagctaacatgcatttctattggttgacagttaaatgcaatttctgttgatgctaaattgtgcattgccaatattgagctttctcaggattttcaggcattgtgattaaattaagtgagtggtcttgacagtactatacttttttttgagataagcataaaatatttctttgtttttattagtgggaggcgaaagtgcaacaaggggaaagagattttgaacagatatctaaaacgattcgaaaagaagtgggaagatttgaggca

SEQ ID NO: 153606 - DNA, 601 bp, Human
agagattttgaacagatatctaaaacgattcgaaaagaagtgggaagatttgaggcatgtataataattttgcatttatcttaacaacatggtcacattttgctgcaattttgtggtaaagttgaatttagctttctactaacggactttttaaaatgtacttcaacagaaagaacgagtgaaggattttaaaaccgttatcatcaagtacttagaatcactagttcaaacacaacaacaggtaagccatttttgtttataacttaaacttctagaatttgtttttggtatactttcttaytttaaaaagatgattaatgaactgggcatttaaactcaagaataagaaatggaagacagaaagccagtgatggtaaaggataaaagggtaaactaatcggaaactatctcacgtgttttttttttttttgcctctgcttaacactaaggcagagatagacttttcccagttttaggccatcagaaacctcatgggcaactttcccctttcactgtctttctagtttgttttccttgttggtcagacctgtttgagtaaattctcatagtaagttcttctcttccataacaaatagaactt

SEQ ID NO: 153607 - DNA, 601 bp, Human
gaaactatctcacgtgttttttttttttttgcctctgcttaacactaaggcagagatagacttttcccagttttaggccatcagaaacctcatgggcaactttcccctttcactgtctttctagtttgttttccttgttggtcagacctgtttgagtaaattctcatagtaagttcttctcttccataacaaatagaacttaagctaaacactttttcagaattaaaaaaaaaactgtactgttttcatttttgctttattttgtttggggttggtggtggttgaatgctgcaagtggcakttatctcatttaccatggattttaatggtatattaaataaaaagataatcacagaaaattttcctgtatattttaatgtaaattagagtaacaggtcaagtaatttaatatcttgaaggatttcttccttccagttttaaaatatgtggatctagaatgtcatttgtgtaaaacataataggttgtttttgaattaagtggtatgatgtcttcaaattgtgtttaatttttatttaaacagctcataaagttaaatttttttaaatatgaaaataagtcatataagcttgtttttaaagg

SEQ ID NO: 153608 - DNA, 601 bp, Human
ttatttaagtgcaaattattttagcttaaattataatggtgttctggcggtgggggtcgggggttggttctactataaccaactccacacaatatgggccataaaacctgccaggttttctgtgctgtgggcatgttcagaagaatgtatgtgactctgttttttcagtgctatccttttgctatcacaggcttcatctatctctaatgttgtgacaacacttgtaaagcacagtctctgcttctttatgtagaaagtcctgggtttttgtatcaggcagaaatttctattaattatgagwttctagtatagctctgctatacctgtctgtatgatccagtggcactggtggttctccagtgacaaagcaaagctgatgagtgttgagtatcattccaatggaaatagtattctcattgttgggaaggcataactcaagtggcatatgtaattataatctagcacccagcaacacttggggaggtagtgcttaaggagatggggcaggacagacaggcatgcagtcaaacctacccaaccttttttcattattttcatcagagcacctccctgtgaatagatatcttccagtatttcattc

SEQ ID NO: 153609 - DNA, 601 bp, Human
gccacagtcacaagcatatgcattctctagaatatctggaaaaccaaaaagccaactattgtaacttttcatgtttcaaaaatcttgttaggactgtggtgaggggcagtgaatatcaaagcaacactcacccccccgacccccgtccccctataaattgattctacaccttacagcaggtagctcagagtcattacgatgtttggcctagagtaaaagctaaataaaattagaaaaatttcttttgacaccaaagaaatacttttaaggaagcaaaatccttacctgttgcagaatgccsaagaaatgtcttgacagtaaaatgactgactccggaaatcaaatttgttcaacaaaaggaggtgaaaacaaaagcggcccaagccttttcactgtggttgatttcctcataggatcaacctctccctcgttcccgagaatattaactgattcacactggaagaactgaaaatacaacagttgggctggcagggagtccaccccaagatggttgggttagtgtgtgtggggcagcaggagcaatccgaatgtgacaaaagagattagcaagttcctgtgcctaagtcaatttcctgtagcc

SEQ ID NO: 153610 - DNA, 601 bp, Human
aagattaaatttaattaaaaaatacatgttatacatcatagagcacttttgggaaatggtcattaacattggcaataggtgaaaaacacaagctagaaattccagattgaaatctacatcatttagacttcggttctgtttcttttctgaactagacaactttaaaattcatatttgcacaacttagagcatctttagatttacttcatcaaaccttgggtagtatttaaactacccatacagttgagctcagccacagtcacaagcatatgcattctctagaatatctggaaaaccaaamagccaactattgtaacttttcatgtttcaaaaatcttgttaggactgtggtgaggggcagtgaatatcaaagcaacactcacccccccgacccccgtccccctataaattgattctacaccttacagcaggtagctcagagtcattacgatgtttggcctagagtaaaagctaaataaaattagaaaaatttcttttgacaccaaagaaatacttttaaggaagcaaaatccttacctgttgcagaatgcccaagaaatgtcttgacagtaaaatgactgactccggaaatcaaatttgt

SEQ ID NO: 153611 - DNA, 601 bp, Human
gcattcttccaaagcccagatcttcctgacaactccagtttgcccccaggccccctccatggaattcacagaactcttcaagcctgtgctgccccactcatcactgaattctcatcttgcattgcttcctaaattttacttcttatcacaactaccagattatagggtccttcaaagtagagatttttaaaatatttctcttatatcctccacggcaccagcttagaaccaataaggggacaccaactacttgttgcctgcttgaatacgtcaatggcaactttcatttagtaaagcacckaaaaccggtgatttcccaaactttgtttagttacaactcaggctactgactggtacctcgtagcatatctccaaatcaaaccacctcagaagaaagattaaatttaattaaaaaatacatgttatacatcatagagcacttttgggaaatggtcattaacattggcaataggtgaaaaacacaagctagaaattccagattgaaatctacatcatttagacttcggttctgtttcttttctgaactagacaactttaaaattcatatttgcacaacttagagcatctttagatttacttc

SEQ ID NO: 153612 - DNA, 601 bp, Human
ctctcacatggaattctgctggtgccgtgagagccgaggaagcgcagccgcagggcagaaggagaccaaggactattgaatggggtcacttctccccagtgcctgcaaggtcctcgcttttgtgtccacaccctaactgtctaatctgatttcctgcaatgtgtaaaacaaactgtcttctcttctccagtgtctcttcaactggccttatcatctccaggtcagtctcgcctttgtgcctttgcccacaaggtcctcccagtctgaaatcacctgccccttctccttctaccgacacttygcattcttccaaagcccagatcttcctgacaactccagtttgcccccaggccccctccatggaattcacagaactcttcaagcctgtgctgccccactcatcactgaattctcatcttgcattgcttcctaaattttacttcttatcacaactaccagattatagggtccttcaaagtagagatttttaaaatatttctcttatatcctccacggcaccagcttagaaccaataaggggacaccaactacttgttgcctgcttgaatacgtcaatggcaactttcatttagtaaagcacc

SEQ ID NO: 153613 - DNA, 601 bp, Human
aagctagagaaactgttaccaaatggcttaaaatagcggtttccaagtttgttttccttctttcatatgtattctcactagaaaaacacccaacccctgtgccttgtccatatttggtgctcaaaaaacgttaattcccagcctccacctgtcaccctactttccctggaaaggaatgttgggattaggagagttagctttgcaggcttcttgctcttaagccagggctcataacaccttcatttgtggcaatagccaagtccttaataagaatcataagagttgcatctattgagagatktttttttcagtcaggcactaggctacatgctttacatatttttatctcatttgatctctacgacaaccctctgaggtaggtattttcagttattattactgttattagagatattttgtgaattttttttttaatctgagcattgaagaagttaagtaacttgtctgaggttcccacagcccagaaatgatagaatgatagaatggggattccatgcaaagtgatctggctcaaaagttgggttcttattcaccgtgctgtatgtttgttattatatgggttcagatattttatggtcca

SEQ ID NO: 153614 - DNA, 601 bp, Human
agttagccaagtgtggtggcacacgcctgtggtcccagctacttgggaggctaaggcaggaggatcaaatgagcacaggaggtcaaggctgagtgagctgtgattacacactgcactccagcctgggtgacaaaacaagaccctgtcttaaaaaaaaaaaaaaaaaaaaaaaaactcatggagttaatgttgccagaactcctattgcttagtgttcagggtattttcagattttgctgctataaatgataatacagtgaatatgttcatgcatattacttttctttgaattatttattcrgaataaatttccaggggtggaatgaatggatcaaagtgtatgaacactttaatggctcttgatacatatcgtcaaattgccatatttgtattttacacagttcctcagtagcatgctagtaaacgtttaacaacatgcttgccccccgccccgaaaaaaaaaaggtggggagcctgatttattgtgtttgctgattttcacagtgtacttttaccatagccaatttcaagccaccatcatgacatcgctgaatgcaaaattgaaaacagatgctcagatagcacaatattatatagcatt

SEQ ID NO: 153615 - DNA, 601 bp, Human
tgatctgcctgcctcggcctcccaaagtgctgggattacaagtgtgagccacctcgcccggccctgcctgcatttcttgtgccacccaaggcatcacgagctgataagtaagacattaaagtggcatcttgagagactgctttcccaaatgggaaccaaccctggcttcacatgagagaattcagaactaaggatttagagcattaatcatatgttatctgaagggaaacaactctagccccacatgctactcattttaaggatctgatgctataaaactacacctgtatccgccatcttrccctcatttcagccatcaattggagaagcagcatttctgtctttaggggcttaatctgatgtcagtaataaccagaacttcctctgcaatgctccctctgctgagggcagagctcctcacttgaggcctctagatccctgagagtccatgaatgggttttagagggtccttatatcccctaggactgtgcagcaaatgttcatggccctgtgtgagaaagtctttggctctcatcacattgtcaaacgaatctgtgaccaaaactagtgattaggaaacattgctccaaagcacaagcca

SEQ ID NO: 153616 - DNA, 601 bp, Human
gacctcagatgatctgcctgcctcggcctcccaaagtgctgggattacaagtgtgagccacctcgcccggccctgcctgcatttcttgtgccacccaaggcatcacgagctgataagtaagacattaaagtggcatcttgagagactgctttcccaaatgggaaccaaccctggcttcacatgagagaattcagaactaaggatttagagcattaatcatatgttatctgaagggaaacaactctagccccacatgctactcattttaaggatctgatgctataaaactacacctgtatcygccatcttgccctcatttcagccatcaattggagaagcagcatttctgtctttaggggcttaatctgatgtcagtaataaccagaacttcctctgcaatgctccctctgctgagggcagagctcctcacttgaggcctctagatccctgagagtccatgaatgggttttagagggtccttatatcccctaggactgtgcagcaaatgttcatggccctgtgtgagaaagtctttggctctcatcacattgtcaaacgaatctgtgaccaaaactagtgattaggaaacattgctccaaag

SEQ ID NO: 153617 - DNA, 601 bp, Human
tttttatgctatcccacaccaagagaaccttgactcaccatgtatttagtcaatttcacattctttttctccggagggatgaagatgaagtgcgtttctctttctcatccagtgtcaatccactgtatgaccgtgacatgagaatgtggcctcatcttaccacttccagtagggttggctaatttaaacagacgggtttggggtaagtctccataccctgcctgataccacagtctgggaggacaggaaatgaacaaagccctgagctttcagctgaaaacactcagttccccaaattgcrggtcagatacccactaatggaagatgaccaacagggcttctgtgatcaaaaggctacacaggaaaagaactatcttcaaagttatcaaagcccaaccagatgttcagcttcagataagacaactacatcttacacccagaagggagcactttacccaccggctaatgctaatgcctttcaccctaaaagcagctgggctgggtatccagtacgttgcttaggggcatcagctgaccccacactactcactacactctagagttggccagatcagtgcttacaacctgcctgcatttcttt

SEQ ID NO: 153618 - DNA, 601 bp, Human
tggcttttcccctcctatttcctgtacgtgcctccaaccctctctcctacttccttatcacatgaagaagacagagaaagactactattgatataattttcagcaagttactgcccaaagagtagagcttgaggaaaatcaggttttatcaagaaaaagtatgccaaaggggacttttaggccccttaaaggtttttgtaattgattttacatcatttaaatttgactctaaatatattgagtttccttttccttgttagaaggaataattacaggcattcttatgcttctcaaccacagytgggatcattttcagctcaaaactggaacaaagaccagaagaattttttgtggcaactgagaaaaaaaaatgcaagaaagggagaaaaaggttcgtagtaagggttgtatatttagagtctctcaagaaggtgacagctggacctggagggaagacaaattaaaagtaggggtcctgcctgaaagaaaggaaaagagccaaggaagagatttgtgccagtccattctctgcatgggcaactaggttgctagacataatgacctggcaggggaaaataatctccaggaggtaagaggagta

SEQ ID NO: 153619 - DNA, 601 bp, Human
atattgccggatattctgtgtttaggaatatagtgacaatattgttttggcacatataggaaattgtggtattgtcaataagtaagggtttttctggcttttcccctcctatttcctgtacgtgcctccaaccctctctcctacttccttatcacatgaagaagacagagaaagactactattgatataattttcagcaagttactgcccaaagagtagagcttgaggaaaatcaggttttatcaagaaaaagtatgccaaaggggacttttaggccccttaaaggtttttgtaattgatkttacatcatttaaatttgactctaaatatattgagtttccttttccttgttagaaggaataattacaggcattcttatgcttctcaaccacagttgggatcattttcagctcaaaactggaacaaagaccagaagaattttttgtggcaactgagaaaaaaaaatgcaagaaagggagaaaaaggttcgtagtaagggttgtatatttagagtctctcaagaaggtgacagctggacctggagggaagacaaattaaaagtaggggtcctgcctgaaagaaaggaaaagagccaaggaag

SEQ ID NO: 153620 - DNA, 601 bp, Human
cctgaaatgtagaggatgaaaaaaaaggaaagatagctataggactcagaaaaaatactcatagttgccttttgttaattcaaatgatcctacaattattagctgtatttctatcacattaggaagcaatgtttatgcttctttctatagattttgcacatcgtggaggaaaaacactgggatgatgactttttttttttttttgagatggagtctcagtctgttgtctgggccggagtgcagtggcacgatctctgctcactgcaaactctgcctcccaggttcaagcaattccctgccycagcctcccgagtagctgggattaaaggtgcctgccaccatgcctggctaatttttgtagttttagaagagacggggtttcaccatcttggccaggctggtcttgaactcctgacctcgtgatccgcccgcttcagcctcccaaagtgctgggattacaggcatgagccaccgcgcccagcctgatggcaattttaatacataaacacttacaaataagatgtatacaagtatatttaacctaaaaggcatatgacatatttgctacaacaaatatccattactattatatttttaaagt

SEQ ID NO: 153621 - DNA, 601 bp, Human
aacgctggtgatttttttttttaacacaattgtaccatctagtttttttaaattattatttatttatttgttttttgagaccaagtctcactctgttgcccaggctggagtgcagtggcatgatctcagctcactgcaacctccgcctcctgggttcaagcaattctgtgcctcagcctcccatgtagctgggattacaggtgtgagcaaccacgcctggctaatttttgtatttttagtagagaccaggtttcactatgttggccaggctggtctcgaactcctgacctcaggtaatccrttcgccttggcctcccaaagtgccgggattacaggcgtgagccacagtgcccggccaccatctagtttttaaacagaaaccacaagcatctagcccctgctggaggagaaactttaatttttccttccatatatgtgtgtgatgggtctttcctggtgacatattaagtgggtagtacttggggaaatccaaaactattagtttggggtttgaactctggaccgacgttttacgtagaaccctcctgctgcatcctgaaaaccatccatgtgttttcatagctctagaatgtaatagaaa

SEQ ID NO: 153622 - DNA, 601 bp, Human
atgctctaagggaattgttaataataagtctatttcctgtttcccaccttcacggcagctggagtggctgtgtaacctagttctaccaatgacacggaagctgatatctgggaggcctccgggaaaattcttggtttcctggaaaatgagacaaccactgccaactcatcctcctttccaccccaaccttcccgtgcgtcttgaatggagtacatggctagaagctgcagcaatcatcgtgcagccatgacgaaagacaacaaaatggcaggcagtctcattgagccattggcccagggcsggaaacgcagacctccgaattcctgttacgtggagaaatgaatcctggttgctttaagtccccgttggtaggtattgtatcactttcaattacacaattgttatacaaagcattgttcattgatcagctgggttcattacaagcaatagctgtcctcttatgatcatgaattattgttaaaccaagccggaaagaaacacagaaacacacacacacacacacacacacacacacacacacgcacacaatgtaatcaggaatattacacaaatcagacacgagatttcactccgtttaaga

SEQ ID NO: 153623 - DNA, 601 bp, Human
cctatgacgcttaaatgtcttcctgcatcacttcatttttgccattaaaaataatcaacattacactttgggaggccgaggcaggcggatcacttgaggccgggagttcaagaccagcctggccaacatagtgaaagcccgtctctgctaaaaatacaacaacaaaaaaattagccaggcatggtggtacacgtctgtaatcccagctacttgtgaggctgaggcacgagaatctcttgagcccaggaggcagaggttgcagtgagctgagattgcaccactgcactctggcctcggtgasaaagagagaggctgtctcaaaataaataaataaataaaatttaaaaaaaatagaaataaagtatatgttaaataaaatgttgtttgttccattcaacttacaaaacatacctcttgagggactagtgtgctaatatacaaagatatacatcgaaataagacacagttcccacttttaagatgtttacagtacaatgagagaagaccaacaacaattacaacataaagtaagctgttcattaatttaatgtatgacattctctacggcacgcattgttagtttgccactccatacctgtgc

SEQ ID NO: 153624 - DNA, 601 bp, Human
gtctttgtaccatccacataagagcaatcaaacagctcgctaaaaatcctgtgaaactacccccaagacatcacctatgacgcttaaatgtcttcctgcatcacttcatttttgccattaaaaataatcaacattacactttgggaggccgaggcaggcggatcacttgaggccgggagttcaagaccagcctggccaacatagtgaaagcccgtctctgctaaaaatacaacaacaaaaaaattagccaggcatggtggtacacgtctgtaatcccagctacttgtgaggctgaggcacragaatctcttgagcccaggaggcagaggttgcagtgagctgagattgcaccactgcactctggcctcggtgacaaagagagaggctgtctcaaaataaataaataaataaaatttaaaaaaaatagaaataaagtatatgttaaataaaatgttgtttgttccattcaacttacaaaacatacctcttgagggactagtgtgctaatatacaaagatatacatcgaaataagacacagttcccacttttaagatgtttacagtacaatgagagaagaccaacaacaattacaacataaag

SEQ ID NO: 153625 - DNA, 601 bp, Human
ctagattttgcacagaggacaaaggaaactgaggaagtctaatccatcccaaggtcaagtgtccaatgtatggatgaagattgcctaggttcataatattgatcataacgaagatgttaaggaaggatttggcagttaattcgcttcatttgctatccaccctacagtcctaggaagtatctgtattcataatttataaagcagttgaggcccagggtagtgaagtcagggcagcctccaaatttaatcatctaaatcattatgtaccctgggagttgtttacaatgttttcctgggaagmtgtatttttaaagcatcggatgactcagaagcatagtccagctggaggaatactgttagacagctcggggcagctttctcagacagcttttcatttgaccatcacaattcgagaaggaaggattttgacattataattcccattttacaactgaagcagcttaggcacagaaaaaacaatccagctaaaaagtaaaacaaaacaaaacaaatcttctctctttttccattttatttccttttcatctcttacaaacaaactaacggaactatcagaactaattatctcatgcacaatcat

SEQ ID NO: 153626 - DNA, 601 bp, Human
ccagttttccatgtcatctgtggattatctgaagtgacattaatctgaactctcaacaatatcaatcatgcaataattcctcaaacgtgttgcactctgacgataggctggcaatattctagattttgcacagaggacaaaggaaactgaggaagtctaatccatcccaaggtcaagtgtccaatgtatggatgaagattgcctaggttcataatattgatcataacgaagatgttaaggaaggatttggcagttaattcgcttcatttgctatccaccctacagtcctaggaagtatctstattcataatttataaagcagttgaggcccagggtagtgaagtcagggcagcctccaaatttaatcatctaaatcattatgtaccctgggagttgtttacaatgttttcctgggaagatgtatttttaaagcatcggatgactcagaagcatagtccagctggaggaatactgttagacagctcggggcagctttctcagacagcttttcatttgaccatcacaattcgagaaggaaggattttgacattataattcccattttacaactgaagcagcttaggcacagaaaaaacaatcc

SEQ ID NO: 153627 - DNA, 601 bp, Human
cgctacccaggtaccatctggaatttttgcctccactcctctctcaccagagcgattctttggtaactaggaactatgccctcacatctgttgttattagttgtcttaaccagaccctaacaaggattttttttagagaatttttgttttgttttgtatgaagaaatcttactaaatctgactaaaattaaattttaaaacctcccagaagactcttccgtgttccatttcccatgaggctttacaaacctggcccaagatgggtgtgtgtgtgagagagagagagagagaaaaaaaaaaaagagaaacgagagagagagagagagaagtcaggaactagaagagtgagacccacacttgccatttttctaaaacaaggttcaaggcaactttcactatcatagttagctacccatgggtaaactgtgtctcctcttttttgcaccgttgttcacataatgatacagagggttttgtttttgtaccacacaaaaagtctgttttcccttctccctcttttaatgatattctcctggctgaattctagtgtcttcccaaccatgagtcatctctgctattcctgcataaagtagagtgttct

SEQ ID NO: 153628 - DNA, 601 bp, Human
agctaaccttctgaaatctcataaccccaaagtgaattgaaatgtaccagagggtaatccccaaacaccatctacctttctctaaccacctcgccacctgtgcatgatgcccatatcttgtaaccttctcgtatactgtgcaaacattcatcagaaagcttccttccgccccgccttccccaaagtgccacccgtaccaccatctgcgaaccaaatagcaaaggaggagattaaggaacctgcatcacatcaagcaagtcttcacagtactgtatgcttcatgcatttaagcttttaaaayaaaggaactaggccaggcacagtggctcacacctgtaatcccaacactttgggaagctgaggcgggcagatcacttgagcacaggagtttgagagcagtctggccaacatggtgaaaccctgtctccactaaaaatacaaaaattagccgggcgtggtggcacacacctgtaatcccagctactcaggaggctgagcaggagaatcacttaaacctgggaggcggaagttgcagtgactggggatcatgccactgcactccagcctgggagacagagcaagactctatctcaacaaaaaa

SEQ ID NO: 153629 - DNA, 601 bp, Human
ttcccaatacatatattttagccagaaccccaaagggtacaccataagggtaagggtgagtcagaagtaattccacccccttccctatcccaagaaactggagaggggcattaccttagactctgtttagagaaggaaggaaaggaaggagggagcgagggaggaccaggaaaagacacacagtgcttgaaagattggagtccacccaggtaactggcataagttttcaaaaccctctctgaagaaatatttttatccgaggccttgggaaactcataccaatcatttttctatggcaatraagagcccacaaagacagaccttttattatcttaaggcatgcattactacctaaagcaagagggacaaaaggagaagagaaattgcggtggtgctcaaaactcatggtctcctatttccctcattctcaggactccagcttggcacccactcctgatacccctgatgtctcgtaagaggaacctcgctggacatatggtgttgcagtttgaaagaaaatgggcagccttaccgggtagtttttatcaagataatgaatttgccatgttcttggcttcacctcttaccctcagaaatctga

SEQ ID NO: 153630 - DNA, 601 bp, Human
ctttgtaaaagaaaatacaaacacatcctgtcatttcttcccgggaagaggtaacatttgctagtgtcactggatagtcactttaagaaagtatggcccagcaggactggatcctgggtcaggattaacccctaactgatgaaattacttgaacaactccaagaccccgaccctcctgccacatctgacagaggagcaagtctcagtaggtctgtaagttcccttctcactcattctagaagtcctcagagcaggtctctttcacacaccactcaaaacaattttttaaatttgtaatattccagtgatttggactgtgtccaacccatcctgctcagcatgctagaaagatttctaggagaactaagatcctaggaatattggtttcttggataatatcattggattccactgtaatgacttatgggaacttgtttcctttcgtcattgagaccagaatagtcaagttagtcaaaatctgaaagatcatcttctaatcctgcccccaaatttcagtcatctgataaccatatttgaactatcatttatgtggtatgttttaaaaatcaactctaagtgaactcatatggccttgtcctaa

SEQ ID NO: 153631 - DNA, 601 bp, Human
aatcctaattccgtttctagcagcagggactttcagaaaacacactccttgtggaattaatttgccatttctatttatttttgccttaatttgtctctacttctaaaatacaagtcaagctgccacacaaaataacttgtataaggtgggaggaagacaatatgcctcttttatcattgaattccttactattgtagaacaatatttaataatgtggggaaaagtatgtgacaacattgttatatggatcaaagaaaggcaagttcaaatcggtatgtgcaacgtaatcctgattttttartaaaaatagagagaggaaaaaagtaagaaactatactaagattttaacaatgctcatactggtgcaattacaaattttttgtgtgtgcttatctatgttttctgagtttccttcacagacatataccacttctataacaaaaaaaaagtaaaaataaaatcgcatgatcctttgtaaaagaaaatacaaacacatcctgtcatttcttcccgggaagaggtaacatttgctagtgtcactggatagtcactttaagaaagtatggcccagcaggactggatcctgggtcaggattaaccc

SEQ ID NO: 153632 - DNA, 601 bp, Human
gtgagccaccgcgcccagccacacacacatttttatatacaaactacagcatactatactgtactccatgatgcctttctcacttagtaatagattgtaaatctttttccttatcagtagattgagtcacccaactctttctaaattcctttagtacaggactaaacaattccttccattatggatcaatcttaaaatacaaatataatattaaatataaatgaagagtcaatgtggtggttgagactttctcactatactgtatatagaggcagcttgtggtgatcagagccctggactraccatcaggcttgaatcccagctctactcctagtgacacgaccttgcttacgccatttagccactccaaacctgttttttcatccgcaaaatgaggcattgaactagatgggctctcagggcccctccaaggctggtagttcatgtttctgtgaaccatcaatatcacatgctgccttgagagcagatttgaacagagaaaagggtgaaggagcagagagagcctaaagctcctgccaccagatgaactttttcccctcccaagctgttcctcatgccttccttgacttccctagcctta

SEQ ID NO: 153633 - DNA, 601 bp, Human
atatatatgaatgtatgtgtataattatcacacacactttttttttttttttttttgagatggagtctcactctgtccccaagctggagtgcagtggtgcgatctcggctcactgcaacctccgcctcctgggttcaagtgattcgcctgcctcagcctcccatgtagctgggacttcaggcatgtgccaccatgcccagctaatttttgtatttttagtagagatggagtttcaccatgttggccaggatggtctcaaactcctgacttcaggtgatccacccaccttggcctcccaaartgctaggattacaggcgtgagccaccgcgcccagccacacacacatttttatatacaaactacagcatactatactgtactccatgatgcctttctcacttagtaatagattgtaaatctttttccttatcagtagattgagtcacccaactctttctaaattcctttagtacaggactaaacaattccttccattatggatcaatcttaaaatacaaatataatattaaatataaatgaagagtcaatgtggtggttgagactttctcactatactgtatatagaggcagcttgtggtg

SEQ ID NO: 153634 - DNA, 601 bp, Human
cttgtatgaggccttcccaataagcaatatatttctcccttatttgagctcacatggcatctttaaatgtttttacattttttgaatagtgattacatgcctatagtaacattttaaaagtataaaagtgaaaaatatacctccctcctatggtgcccaggccattttcccagacgcaaccatcagactaagtttctcatgcatttttccaaagctattacattattacatgaatccacatgcatatatatatgaatgtatgtgtataattatcacacacactttttttttttttttttttgagatggagtctcactctgtccccaagctggagtgcagtggtgcgatctcggctcactgcaacctccgcctcctgggttcaagtgattcgcctgcctcagcctcccatgtagctgggacttcaggcatgtgccaccatgcccagctaatttttgtatttttagtagagatggagtttcaccatgttggccaggatggtctcaaactcctgacttcaggtgatccacccaccttggcctcccaaagtgctaggattacaggcgtgagccaccgcgcccagccacacacacatttttatata

SEQ ID NO: 153635 - DNA, 601 bp, Human
acattgctgacactctccctggtctttcctgctttgacagcttcagtcctgctgctgcaagctttcctgccctggctcttcctggtgaacttctacccatcccagagcccagctcagatgctacctcttgtatgaggccttcccaataagcaatatatttctcccttatttgagctcacatggcatctttaaatgtttttacattttttgaatagtgattacatgcctatagtaacattttaaaagtataaaagtgaaaaatatacctccctcctatggtgcccaggccattttcccagasgcaaccatcagactaagtttctcatgcatttttccaaagctattacattattacatgaatccacatgcatatatatatgaatgtatgtgtataattatcacacacactttttttttttttttttttgagatggagtctcactctgtccccaagctggagtgcagtggtgcgatctcggctcactgcaacctccgcctcctgggttcaagtgattcgcctgcctcagcctcccatgtagctgggacttcaggcatgtgccaccatgcccagctaatttttgtatttttagtagagatggag

SEQ ID NO: 153636 - DNA, 601 bp, Human
cttttaaggagcctaatggggcagaagataataaagaaaatgttaatgtagtttagactaggcccagaggttaaaaaaatttttttttttacttagttaataatgtctctgatcctcacttttttttctctatagaagaaatgatttcatttggagaggtcatgcaatggccacacaaaggcagaatggtgtggctgtacttcatcaccataaagtaccatatagctaggacctcagagaataaaatgctaaattaaagagaggagacgcaatgttctgcgtataaatgacctcactctcyggttcgtcctgcaaaaaattaaaatttaaacagccaagttctataataaaggtaaatgcaaaatgccaagagaacactaaggacagagtgttaaaatcttccagggtggtggggtggggagggggagaggaggaacatttgaacttggtcttggaggagagaaagaaataggactggtggaccgcatgcaggcagaggaagcggctggtgcccaggtgtgcacgtgggtatttggagaatagacagctggctatggtggctgaagcacaggtggaagatgatgttggaaagggacaatgg

SEQ ID NO: 153637 - DNA, 601 bp, Human
atatgtactttttatacagataatattatagatacatagcaataggataaaatatttccttagatgctcagcttctgattaaggatcagaaagatcaagaaactgagcaaaacaaatatataatgaccctgaaactaccaggatattccagagcaaaattcttttttaatggttcagttcattgcttacgcatatatagtgttctattaacatgacatttcaaatccatagaagtctaaaaaaagggacagaatatctgcctttaattgtctttaaactaggcctacttttaaggagcctratggggcagaagataataaagaaaatgttaatgtagtttagactaggcccagaggttaaaaaaatttttttttttacttagttaataatgtctctgatcctcacttttttttctctatagaagaaatgatttcatttggagaggtcatgcaatggccacacaaaggcagaatggtgtggctgtacttcatcaccataaagtaccatatagctaggacctcagagaataaaatgctaaattaaagagaggagacgcaatgttctgcgtataaatgacctcactctccggttcgtcctgcaa

SEQ ID NO: 153638 - DNA, 601 bp, Human
acacaagtttattcagattttcttaattttttcaatcttcttttgaaatatagacatatgtactttttatacagataatattatagatacatagcaataggataaaatatttccttagatgctcagcttctgattaaggatcagaaagatcaagaaactgagcaaaacaaatatataatgaccctgaaactaccaggatattccagagcaaaattcttttttaatggttcagttcattgcttacgcatatatagtgttctattaacatgacatttcaaatccatagaagtctaaaaaaagkgacagaatatctgcctttaattgtctttaaactaggcctacttttaaggagcctaatggggcagaagataataaagaaaatgttaatgtagtttagactaggcccagaggttaaaaaaatttttttttttacttagttaataatgtctctgatcctcacttttttttctctatagaagaaatgatttcatttggagaggtcatgcaatggccacacaaaggcagaatggtgtggctgtacttcatcaccataaagtaccatatagctaggacctcagagaataaaatgctaaattaaaga

SEQ ID NO: 153639 - DNA, 601 bp, Human
gtattgacctcttactagctgtgaaagtcctagatggcatcttcttccaatagaaggccattttgtttccattgaaaattctattgtacactgtagccaccttcatcaatgaccttagctagatcttctggataacttgctgtagtttattcatcaggacctgctgcctctctttatactttggtgttatgaagatggcttctttccttaaacctagtgaaccaacttctgctatcttcatacttttcttctgcagcttcctcacttcattcaaccttcatagaattgaagcaagttaggsccttgttctggattagtctttggcttaaagaaattgtatagctggtttgatcttctacccagaccactaaagctttgtccaagcagtaaggctgtttcacttccttatcattcatgtgttcccaggagttgaacttttcatttcttcaataaattttcctttgcattgacaacctggctaactggcaagagacctagttttcggcctctctcagctttcaacatgccttcctcattaaacttaatgatttctagcttttgatttaaagtgagagacacatgactcttcctttcacttaaa

SEQ ID NO: 153640 - DNA, 601 bp, Human
tacattaaattttaacatgagattacagacattcagtcccaccttcagcctcctcttctaattctagctctcttgctccttctaccacatctgcagttacttcctccactagcatcttaaatccctcaagtcagtcatgaggcttggaatcaacttcttccaaactccagttaatgttgctattttgaccttctgccatgaatcacaaatgttctgaatggcatctaaaatggtagatcctttcagaagattttaaatttactttgcctagattcatcaaaggaatcactatctatagcasctatagccttacaaaatgtattcttaaataataagatttgaaagttgaaatgactccttgatccatgggttgcagaatagatattgtgttaacaggcatgaaaacagcattaatctccttgtacatctccatcagagctcttgggtgactaggtgcgttgtccatgagctgtaatattttgaaaggaatctttttcctgagcagtaggtctcaacagtgggcttaaattattcagtagacattgctgtaaatagatgtgttgtcattcaggctttagttgttccatttatagagcacagg

SEQ ID NO: 153641 - DNA, 601 bp, Human
ggtgataataaaaaacagacccacactggttttattactgttttaaaattctatataaatgatatacccccttacttcctgtacttaggggggaccccttgcaccactccatcctttaagtccttgccagtatctattaaacttttaaatgcggagaccttttaatccagcaattccaattctttcaacacgttgtactgatgtgtctacacaagtagtcaagatatgcaagaatttccattgctacattattcacgacagcaaaaaaagaactggaaagatctgaaaggtccattaagamgcaggggttaaattaattatgccatatccattcgatagaatccactcagcattagaaggaattaggtcagcctgttcgtattgcccaggaagggtatgatatacagacataccttacagatatcgcgggttcagttccagaccactgcaataaagtgaatcttgcaataaagtgagtcacacagttttttttgtttcctagtgcacataaaagttatgttggccaggagcagtggctcgagcctgtaatcccagcactttgggaggccgaggcaggcagatcacctgaggtcgagagttc

SEQ ID NO: 153642 - DNA, 601 bp, Human
cacaccattaagaacttactctgactttttcactgccagcgcatggtgataataaaaaacagacccacactggttttattactgttttaaaattctatataaatgatatacccccttacttcctgtacttaggggggaccccttgcaccactccatcctttaagtccttgccagtatctattaaacttttaaatgcggagaccttttaatccagcaattccaattctttcaacacgttgtactgatgtgtctacacaagtagtcaagatatgcaagaatttccattgctacattattcacracagcaaaaaaagaactggaaagatctgaaaggtccattaagacgcaggggttaaattaattatgccatatccattcgatagaatccactcagcattagaaggaattaggtcagcctgttcgtattgcccaggaagggtatgatatacagacataccttacagatatcgcgggttcagttccagaccactgcaataaagtgaatcttgcaataaagtgagtcacacagttttttttgtttcctagtgcacataaaagttatgttggccaggagcagtggctcgagcctgtaatcccagca

SEQ ID NO: 153643 - DNA, 601 bp, Human
caaggacttgagagaagtggttaagctgctgggggcccacacgaggcccagaaactgaaccagctgagtcagcacactttccatctacacaggattttttcagatacacattatgcctacattgtatagcccatacttaatttccttaatattttaagcacaatgctcatatagctagatagacatgccaaattattcacacagtagcaacctttatttctttgcctttttcccacagaaagattttattgtgtactgatggctttttactcaaaaggtagctgtcaatgttttttgtttttttttgtttttgttttttgtttgcttgttttcagagtctcactgtcacccaggctggagtgcagtggcgagatcggctcactgcaacctccacctctcaggttcaagtgattctcgtgtctcagcctcccgagtagctggaattacaggcatgcaccaccacacccggataatttttgtatttttagtagaaacgggatttcgccatgttggccaggctggtctcgaactcctgacctcaagtgatccacctgccttggcctcccaaagtgctgagattacaggcgtgagccaccacacc

SEQ ID NO: 153644 - DNA, 601 bp, Human
tatgtaaatatagcatcatttatttaaccaattgcctactgttggatagtttaataattccttattttcactatagcaacattgagtgaatatttttaatataaatatatgattatttctttaggataaatagatatgagagcaactgctggaacagaagagataaaaaattgaaccaatttatattccatgtatgggcctatcactgcatctctctatcaactctcactgggtataatatttgcaagtttgacttgttttcatttgcatttcatttacaactggtgaagattaaaatttkctcatctgtttcttgacaacatatattttttcttttgtaagtcatcagttttacctacttttccagcaagacggtcattgtttcttaatgacttttaaaatccttttagagattaaggatattaatcttttatgattaaatgtgttgcaaatatatatatatatatagtgcccaggtattctgggaattccccagattcctggtactcccccttcactgagcaaaccctaaacagaatgtaaagtagcatgttccctgctgcggaaaaaaaactcagcatgatgagatgcctgaaaggtc

SEQ ID NO: 153645 - DNA, 601 bp, Human
aaggtgattctgaggctgtaggcctgggggcctgggagaagctgctggcaaacataggcagcaccagaggagagagacagatctgtgagatccatgaagaggtgggtgtttcccactggggggcctgctgaagagacagagcgctttcaggagagccacaggctgccgtcatatgacaaggctatcgtttactgaatgaaggggaagagaagtggggtagccagggtcatcttcctctcccatgagctttgacatgaaatctttagctagaaacatgttctcttctatgttatgtatagcaaaaaaaaaaaaaaaaaaaatcacctaagaataggtgggtcttgcacaaaccaatttgctcctatattgaaatccattaacataacatcgtacgggtctattcacagacacaggaaaaggcttcctaagctaaatgggtggaaagcaggtttcaaaatggcaggtttcaaaatggcctgtacaggagattccagagctgtgaaaatgtctagagtggtgcccactggcttgtctctgggtcctggggttgtatgtgattcccattttcttctccttgcttaagtgcatttaaaaatgtgtc

SEQ ID NO: 153646 - DNA, 601 bp, Human
tgcctataatcccagcactttgggaagccaaggcaggaggatcacctgaacccaggagttcaagaccagcctgggcaacatgatgagacccctgccccccgcctccggtgcctcaccaccaagtctatactaaaaaaaaaaaaattagccaggcatggtggagcatgcctatagtcccagctagttgggaggctgaggcaggaggattacttgagcccaggaagctgaagctgcagtaagccattatcacaccactgcactccagcctgggcaacaaagcaagaccctgtctcaaaaaataaaaaaactgttaccaatccattctcttttaacttaaatgttactaacctctttgagcacctactctgtgtcaggcattgaagccaagttaaagaaaacacagcttctgccttcaaaaaaacttacagtctaatggcaacaccagacataaacttcagcaaggatctgagggaggaacaaataaagtgccaacaaagggaaaaaggtgctacctgcaactagcaggaatcaaggaaggctttgtggaggccatggtattagaacatgacccttaaaaccactgagcttgagatgcacagag

SEQ ID NO: 153647 - DNA, 601 bp, Human
ttatgggagatgagcctgtgattttatacaatccaaggttgccttctgctcatcagcagccacagcacactattagctccagctgactccagttaaaatcagttaacagtcaattaaaatccctgggtctttggcacataaaatgttactagccaggcacagtggctcctgcctataatcccagcactttgggaagccaaggcaggaggatcacctgaacccaggagttcaagaccagcctgggcaacatgatgagacccctgccccccgcctccggtgcctcaccaccaagtctatactaaaaaaaaaaaaattagccaggcatggtggagcatgcctatagtcccagctagttgggaggctgaggcaggaggattacttgagcccaggaagctgaagctgcagtaagccattatcacaccactgcactccagcctgggcaacaaagcaagaccctgtctcaaaaaataaaaaaactgttaccaatccattctcttttaacttaaatgttactaacctctttgagcacctactctgtgtcaggcattgaagccaagttaaagaaaacacagcttctgccttcaaaaaaacttacagtcta

SEQ ID NO: 153648 - DNA, 601 bp, Human
gggattatgggagatgagcctgtgattttatacaatccaaggttgccttctgctcatcagcagccacagcacactattagctccagctgactccagttaaaatcagttaacagtcaattaaaatccctgggtctttggcacataaaatgttactagccaggcacagtggctcctgcctataatcccagcactttgggaagccaaggcaggaggatcacctgaacccaggagttcaagaccagcctgggcaacatgatgagacccctgccccccgcctccggtgcctcaccaccaagtctayactaaaaaaaaaaaaattagccaggcatggtggagcatgcctatagtcccagctagttgggaggctgaggcaggaggattacttgagcccaggaagctgaagctgcagtaagccattatcacaccactgcactccagcctgggcaacaaagcaagaccctgtctcaaaaaataaaaaaactgttaccaatccattctcttttaacttaaatgttactaacctctttgagcacctactctgtgtcaggcattgaagccaagttaaagaaaacacagcttctgccttcaaaaaaacttacag

SEQ ID NO: 153649 - DNA, 601 bp, Human
gtgacagctgatctgtaggatgagtaagattttgataagcaacagagaagaaaggctttgggggtggggagaagcatgtgcaaaggcccaggggcatgaaaatacatgtttgatttggggaagtagaagaagttcagggaggttgcactgtgggctgctcagtggggagcaggaagtggccggtggagggattatgggagatgagcctgtgattttatacaatccaaggttgccttctgctcatcagcagccacagcacactattagctccagctgactccagttaaaatcagttaacagycaattaaaatccctgggtctttggcacataaaatgttactagccaggcacagtggctcctgcctataatcccagcactttgggaagccaaggcaggaggatcacctgaacccaggagttcaagaccagcctgggcaacatgatgagacccctgccccccgcctccggtgcctcaccaccaagtctatactaaaaaaaaaaaaattagccaggcatggtggagcatgcctatagtcccagctagttgggaggctgaggcaggaggattacttgagcccaggaagctgaagctgcagtaagc

SEQ ID NO: 153650 - DNA, 601 bp, Human
atttaaaaggtgacagctgatctgtaggatgagtaagattttgataagcaacagagaagaaaggctttgggggtggggagaagcatgtgcaaaggcccaggggcatgaaaatacatgtttgatttggggaagtagaagaagttcagggaggttgcactgtgggctgctcagtggggagcaggaagtggccggtggagggattatgggagatgagcctgtgattttatacaatccaaggttgccttctgctcatcagcagccacagcacactattagctccagctgactccagttaaaatcrgttaacagtcaattaaaatccctgggtctttggcacataaaatgttactagccaggcacagtggctcctgcctataatcccagcactttgggaagccaaggcaggaggatcacctgaacccaggagttcaagaccagcctgggcaacatgatgagacccctgccccccgcctccggtgcctcaccaccaagtctatactaaaaaaaaaaaaattagccaggcatggtggagcatgcctatagtcccagctagttgggaggctgaggcaggaggattacttgagcccaggaagctgaagct

SEQ ID NO: 153651 - DNA, 601 bp, Human
taataataaaaattaaaataaaataatgatacctaccttacaaggtggttgtacagaattaaatgggtagtgcatgtaaaccacattgaatagtgcctggcacagagtgagtaccgtagaagtatttaccattattataatttaccttgaggggttgtcgtaagatggttctgagctagtgtatgtcatgagcctaaaacagtgcctggaacaaaacaggtactagcaaatagtagctgctatgatgatgatgatatgaaccagtactacagacacacaggagagggagcattaattctcragacgggagaaaggagtggtgatttgggagccccgcatttaaaaggtgacagctgatctgtaggatgagtaagattttgataagcaacagagaagaaaggctttgggggtggggagaagcatgtgcaaaggcccaggggcatgaaaatacatgtttgatttggggaagtagaagaagttcagggaggttgcactgtgggctgctcagtggggagcaggaagtggccggtggagggattatgggagatgagcctgtgattttatacaatccaaggttgccttctgctcatcagcagccaca

SEQ ID NO: 153652 - DNA, 601 bp, Human
ctgttctaggaaaaagagagcaaaaaggcaaatcatgcctatctaatcattctataatgtcacgatgctataaagtaaggttgtcaaactatggcccacgcatggctgaatccagcccgccacctggttttgtagggccataaattgagaatggtttttacattttatttcattttattttattttattttattttattttattttattttatttgagagggagtattactctgtcgcccaggctggactgcagtggcatgatcccggctcactgcaacctctgcctcccaagttcaagcrattctcctgcctcagcctcccaagtagctgggattacaggtggtttttacattttttaatggttgaaaaaaatccaaaggaggaaaatattttatgacatgtgaaaattatatgaaattcaagtttcaggtttcacaaatagcattttattggaacacagtcatgcccattcattgacatgttgcctatgactgctttctcgctgcaacataaagttgcaaccaagcctaaaatattttcaatttggtctttacacaaaaaagtttgccaactcctactagacagaaaggtagttcagag

SEQ ID NO: 153653 - DNA, 601 bp, Human
ggtgtgctcagggaaggacacgtggtctctgaacttcttttagggaatgtggatcttgtttaccaaagactcgtgttttctcagttgggtatccatgtttggggcctgagctgaactgttctaggaaaaagagagcaaaaaggcaaatcatgcctatctaatcattctataatgtcacgatgctataaagtaaggttgtcaaactatggcccacgcatggctgaatccagcccgccacctggttttgtagggccataaattgagaatggtttttacattttatttcattttattttatttyattttattttattttattttattttatttgagagggagtattactctgtcgcccaggctggactgcagtggcatgatcccggctcactgcaacctctgcctcccaagttcaagcgattctcctgcctcagcctcccaagtagctgggattacaggtggtttttacattttttaatggttgaaaaaaatccaaaggaggaaaatattttatgacatgtgaaaattatatgaaattcaagtttcaggtttcacaaatagcattttattggaacacagtcatgcccattcattgacatgttgc

SEQ ID NO: 153654 - DNA, 601 bp, Human
gtgcaaccccaagaggtgtgctcagggaaggacacgtggtctctgaacttcttttagggaatgtggatcttgtttaccaaagactcgtgttttctcagttgggtatccatgtttggggcctgagctgaactgttctaggaaaaagagagcaaaaaggcaaatcatgcctatctaatcattctataatgtcacgatgctataaagtaaggttgtcaaactatggcccacgcatggctgaatccagcccgccacctggttttgtagggccataaattgagaatggtttttacattttatttctttttattttattttattttattttattttattttattttatttgagagggagtattactctgtcgcccaggctggactgcagtggcatgatcccggctcactgcaacctctgcctcccaagttcaagcgattctcctgcctcagcctcccaagtagctgggattacaggtggtttttacattttttaatggttgaaaaaaatccaaaggaggaaaatattttatgacatgtgaaaattatatgaaattcaagtttcaggtttcacaaatagcattttattggaacacagtcatgcccatt

SEQ ID NO: 153655 - DNA, 601 bp, Human
aaactgcttggagttgagggtgcaaccccaagaggtgtgctcagggaaggacacgtggtctctgaacttcttttagggaatgtggatcttgtttaccaaagactcgtgttttctcagttgggtatccatgtttggggcctgagctgaactgttctaggaaaaagagagcaaaaaggcaaatcatgcctatctaatcattctataatgtcacgatgctataaagtaaggttgtcaaactatggcccacgcatggctgaatccagcccgccacctggttttgtagggccataaattgagaatggtttttacattttatttcattttattttattttattttattttattttattttattttatttgagagggagtattactctgtcgcccaggctggactgcagtggcatgatcccggctcactgcaacctctgcctcccaagttcaagcgattctcctgcctcagcctcccaagtagctgggattacaggtggtttttacattttttaatggttgaaaaaaatccaaaggaggaaaatattttatgacatgtgaaaattatatgaaattcaagtttcaggtttcacaaatagcattttattg

SEQ ID NO: 153656 - DNA, 601 bp, Human
aagcctgaagcatattaaacccctttatagttgaattaaaacaaaacattgccaagtcctgaagccttttattatttcaacatattaagctctgaagcctctctgagccgtgtgtcctgccctctggtccccaatcacaccgggaccgtggtccccttcccctcctctggtccagcaactctgccctgactggtctcttccactcccaggagcacaatcaaggaatcgttgcctgaggtctagagttcttagtccggttcaatttcagagtcaaatacaagactagccagctaggcaaccrcccagagcacccttagaaactcatctcaaaactaaagtgatggggaaatgcatttcctacttcttttctcaaaatagttggaatagcctgaaaaactgcttggagttgagggtgcaaccccaagaggtgtgctcagggaaggacacgtggtctctgaacttcttttagggaatgtggatcttgtttaccaaagactcgtgttttctcagttgggtatccatgtttggggcctgagctgaactgttctaggaaaaagagagcaaaaaggcaaatcatgcctatctaatcattctataatgt

SEQ ID NO: 153657 - DNA, 601 bp, Human
tgatgtggaaggaccacttgaggccaggagttcaatgccagcctgggcaacatagcaagaccctgtttctacaaaaaaaaaaaaaaaaaaaaaaaaaagatgctgatttgcaacttttaacataagttcaccagaataaaaaatgttaagcagtatttatgttcctaagcctgaagcatattaaacccctttatagttgaattaaaacaaaacattgccaagtcctgaagccttttattatttcaacatattaagctctgaagcctctctgagccgtgtgtcctgccctctggtccccaaycacaccgggaccgtggtccccttcccctcctctggtccagcaactctgccctgactggtctcttccactcccaggagcacaatcaaggaatcgttgcctgaggtctagagttcttagtccggttcaatttcagagtcaaatacaagactagccagctaggcaaccacccagagcacccttagaaactcatctcaaaactaaagtgatggggaaatgcatttcctacttcttttctcaaaatagttggaatagcctgaaaaactgcttggagttgagggtgcaaccccaagaggtgtgctc

SEQ ID NO: 153658 - DNA, 601 bp, Human
gccttggcagatgcctaaatatggagctgtgggaggaggggaggtaggggaggagctgcagtccaaggcagagccataccctataaggacatgacagataatcttcagaatgggtcacatgtgtccaggagtgagctgccgcgggttacatcatcagcatgtgagtctgatgggcttgaattcagcggaatttctcctaaagaaattctccctaaaagggcttctgggtgaaaaaaagtgagtcttccgtggtatttcccaagtggctaactggcaagagtggcccaagtatgtctcttcrtacggaagagttacgagagcgtcatgggtgatgacactgagtggccctccaggccgttcttctcaggctttgaatcagatagaattaatgagccttcacctccagagcctccggggtctccataatttgatgctcttgccctttttcctctttctaccattttcatagaaaagggtccctcaacaggcctccagggttcacacgcacagagacagaggagggaagggaggcttcacgttgcaaaagcaacagagttgggcccttctgcccactctggcaaagagaccaagatagacacaa

SEQ ID NO: 153659 - DNA, 601 bp, Human
cttagagctgagagtgcaaaattcttttttttttttcttgagacggagtctcgctctgttgctcaggctggagtgcagtggtgtgatctcagctcactgcaacctccaactcccgggttcaagtgattctcctgcctcaacctcccgagtagctgggattacaggcaccaccaccacgcctggctaatttttgtatttttagtggagatggggtttcaccatgttggccagactgctctcaaactcctgggctcaagtgatctgcccaccttggcctcccaaagtgctgggattacaggcrtgagccactgtgcctggcctagagtgcaaaattcttagcaggtgcataatataaacacattgtatgtacatagtaaacacacagtaagtagtccctattaataacattctcaaataacaattactaaatataatgataaacagttattaactctaagtagggaatttaaagtagcacaaaagaggtttctccagcaaagggtgttctgtgtgtctcatacccagacatggctacaaaaagagaaagaaagagagagactcctgtctaagctttgctacctagagagtcagaaaggagaaa

SEQ ID NO: 153660 - DNA, 601 bp, Human
ttaatttaatttaattatcttattttttataaatagagtgggggtctcattatattgttcaggctggtctcaaactcctgagctcaagcagtcctcccacctcagcctcccaaagtgctgggattacaggcatgagctactgcacctggccttaagttttatttgaccccagtgtagcagggccagaattaggaaaaatgtacatgcttcggacatttatttatttatttattttaattttatttttttgaaatggagttttgctctgttgcccaggctggagtgcagtggctcgatctcrgctcactgcaacctctgcctcctgggtttaagcaattctcatgcctcagcctcccgagcagctgggactacaggcatgcactatcatacccagctaatttttgtatttttagtacagacagggtttcaccatgttgccaaggttggtcttgaactcctgacctcaaatgatccacccgccttggcctcccaaagtgctgggattacaggcgtgagtcaccacacacagccactggccacctttatttattttttgagacagagtcttgctctatctcccatgctggagacagagtacaat

SEQ ID NO: 153661 - DNA, 601 bp, Human
tccttagaccaagaggcaacttaaatatatgcatttgtgacttagtccagagccaagacctcttaagacatttctatgttttatttttttaatttaatttaattatcttattttttataaatagagtgggggtctcattatattgttcaggctggtctcaaactcctgagctcaagcagtcctcccacctcagcctcccaaagtgctgggattacaggcatgagctactgcacctggccttaagttttatttgaccccagtgtagcagggccagaattaggaaaaatgtacatgcttcggrcatttatttatttatttattttaattttatttttttgaaatggagttttgctctgttgcccaggctggagtgcagtggctcgatctcggctcactgcaacctctgcctcctgggtttaagcaattctcatgcctcagcctcccgagcagctgggactacaggcatgcactatcatacccagctaatttttgtatttttagtacagacagggtttcaccatgttgccaaggttggtcttgaactcctgacctcaaatgatccacccgccttggcctcccaaagtgctgggattacaggcgt

SEQ ID NO: 153662 - DNA, 601 bp, Human
acatttattttttctttttcttttttctgagacaggatctcgctctgtcgcccagactggagtgcagtggtgtcatcacagctcactgcagcctggacctcctgggctcaagagatcctcccacctcagcctcccgagtagctgggactacatgtgtgtgccaccacaccgggctaatttattgctttttttgtagagacacagtctcactatgttgcccaggctggtcatgaactcctggcctcagggatcctcctgcctcagcctcccaaagtgttgggattacaggtgtgagccaccrcgtccggctgccaagacatttttatcctcgtcaacccactgtccctgttgtttaattatacctaatagcttttgcaaatgagttagccatataaataattcacatgatacatattcatgtttttaaacacatgtaagccaggtgaccttggccaaattacttaacctctctgaaccttggttttctcataaaaatgaaaataagaaaaggactttcctcatgtgatcactgtaaggattcagaatgtggagagtctgatttagcacaaaacctggcatctgggaattataggaagccatc

SEQ ID NO: 153663 - DNA, 601 bp, Human
gtgtatcccgaactccgctaggcccctggttaaacaaaataacttgcttgaaagcaaccatattcagtgcctgtcacttaaacagaggactgcataaatgggacaatctgaatttcattaaaggccaaataaattctcattcagtgcagtgggaaagccccaggcaatgagctccgccttggagacagtgtcgtgtctgctgtggcacaatatcacaaggccagcccagctccagacgaaggaaaagtctttcagaccaaaattcagagtaaaggttattcctgcaacctgggcttgtaasctcccctccctggcgatcttcctgacatgtgtcatgcagggcaatacaaagcaaacctacacgtctgatttaaacataatttttaagtcacttctctaaatcctggcattcctttccaaaacatttattttttctttttcttttttctgagacaggatctcgctctgtcgcccagactggagtgcagtggtgtcatcacagctcactgcagcctggacctcctgggctcaagagatcctcccacctcagcctcccgagtagctgggactacatgtgtgtgccaccacaccgggctaattt

SEQ ID NO: 153664 - DNA, 601 bp, Human
gacggagtctcgctcttgtcgcccaggctggagtgcaatggcgcaatctctggttgctcactgcaacctccgtcttccacgttcaagtgattcttctgtctcagcctccggagtagctggaactacaggcacccgctaccagacccggctaatttttttttttttttttttttttttttttttggtacagacggggtttcactatgttggccaggctggtcttgaacttctgaactcaggtgatccacccaccttggcctcccaaagtgctgggattatttctacctgaagccctccttaraagtaggcagtacagccgaatcaagcctggtgatcaatggggtgacagatgtcacagccagatcgccttcacatcggtagtaggcagtacaaacagtaaacaaatgaaaggggacatgagtagggagggcagggcccaggctctggctcctgaactcaggatgttcagaggtgatgggctggtgctcacagggaggcctttggctctgggctgtgtgtactggaggggagaggaagtccccaggactcctgacctctggcactgataggctgattgaaggagtgagctgtctggatggtc

SEQ ID NO: 153665 - DNA, 601 bp, Human
tgctcagagctcaggagtgctcctgctgcccaagccctgggcccctccctttgaactcctggacctctgtcatgtatctaggaggtcaatgtctggtgcagctggcctccaggactctacgccactgctcacggccagtgtctgtcccctttctgtactaccagttgtttaatatttgaatgttactcctgctgtgtccaaacaccctggcctggcctccaggacgctttaagatcaactcaagcccagcgaactggccttgcaaattcctaactccttgctttggtttctcatgtgttcygccattttcttttttctttttttttttttttaaacggagtcttgctctgttgccaggctggagtgcagtggcacgatctcggctcactgcaccctccgcctcccaggttcaagcgattctcctgcctcagcctcctgagtagctgggattacagacatgtgccaccatgcccagctaattttttgtattttagtagagagggggtttcactgtgttagccaggatggtctcaatctcctgatcttgtgtctgcccgccttggccgcccaaagtgctgggattataggcgtgagccaccgc

SEQ ID NO: 153666 - DNA, 601 bp, Human
cctggaggcggaggttgcagtgagccaaaattgtgccactgcactccagcctggatgaaagagtgagactccatctcaaaaacaaaacaaaacaaaacaaaaaaattattcttgcagagttctggaggccagaagccccacatcaaggtgtcagcagggctgtgctccctccaaagaccctaggagagaatccttccttgtcttttccagcttctggtggccccaggcgtaccttggctgtggctgcatcactctagtctctgcctctgtcttcgcgtggccttctcttccttcactctgkcttctcctcttctgtttcttataaagatactttgtcgttggatttggggcctaaccagctaatccaggatgatcgcatctggagatcctaattacttctgcaaagacccttttcccaaatcaggtcacgtttatgggttccaggggttagatgtgaacatatctttgaggggccaccattcagccccctacaggcagcgatcctgcactgtgcttgtcacccacccccatgcctgaccctgaggtggggaagcctcagacacaggcactgtcaagtcaaggaagggcgtggctcccggga

SEQ ID NO: 153667 - DNA, 601 bp, Human
tggccaggcctggggcagcccaagggcatcagggggtgcccaagcctgatagccactcctgtgtgcagaggaaagacccaaaccaggtggaactgtggggactcaaggaaggcacctacctgttccagctgacagtgactagctcagaccacccagaggacacggccaacgtcacagtcactgtgctgtccaccaagcagacagaaggtgagggaggggtgaggagcagcacctggagcccccgctgtgcggattggccgcacggtcccctcataagctctcccccctagactactgcctygcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaaggtgggcctttgagaggcagctctggggctcaggcgactttcccccagggtgagtggtctctctcttctgtggccagggaggtgggtggtgggagctctcccttgcccacccaccccaattatctcatccccactggagcc

SEQ ID NO: 153668 - DNA, 601 bp, Human
tatactattttattatcccttagaattattctatacttagagaaagagcttgttaaaacttagacacgttctttagaaattatatctttccaggcatacataaagtatgagtatgataaactggtccaaatatttctcattatctagctcttctaaatgattctgagtgactcagagcacggatgtctgtgttttccatgcagtttcatgctctgtgtctcgggagatggatgatgcagcgtttcctgagagaatgcccctctgttatagctgggattctcatccaagctcctgacacacyttccgcaagttcgctattgggcctgacatgttcttaccaaaaggcatcagtggaaaggctgtagacaacagccaaaacttgctttccttcctgaagtggcccttgaagggtttgttggcggaaggatccaggggctgaatctgcccggtcaggccacggagaataacaacaaagtcaccccatttttcagtgttctccttcaacaagtctgtgcaagcatgatgatgatgttacagtctcatctggccagtagcaattgtaggacacatctgaatttcagagatgtgaaaatggggaaaa

SEQ ID NO: 153669 - DNA, 601 bp, Human
ggcggaaggatccaggggctgaatctgcccggtcaggccacggagaataacaacaaagtcaccccatttttcagtgttctccttcaacaagtctgtgcaagcatgatgatgatgttacagtctcatctggccagtagcaattgtaggacacatctgaatttcagagatgtgaaaatggggaaaaatgtctatgctaaaactgacaaagtaggtttattggctcacaaaactgaggagcctagtggtgcagcttatgtcatctttcctcccggcccctgtccccctccttctttcagctttkctcactctttgaggtggcctcccttctctctctgcaattgatctgtctccacgcgccaagggagagtgcctccgacggctccagctcagccacctgctcagaaaataaacctctgggtaggcttgcttggtccacacgcccacccttctgaccaaacacgactgcagagggatggacaccacatgggggccgtgcgcagcatgtggctgagcttgtatttgggatgtgacccacagccctattggctcagcatgcgagagagcagggatggtgctccccaaggaaggactggtgggcagg

SEQ ID NO: 153670 - DNA, 601 bp, Human
attggcaacttctgcccacttgaacaccactccaaggtcatctgatggcacattagtcatggagttatttatttttcctccagattataaagtccttgagggcatatgctcttgactggcttaagagtactgcatgcctctgtttcccatgaaagctaaagctagggtaggcccatttgctaaaatgaagtatggctcagtgtggcggtgcacacctatagtcccagctgctcaggaggcaaaggtgggaggatcgcttgagcccatgagttggaagctgcagtgagctatgatcgtactrctacactccagcctgggtaactgggtgagaccaaaacatgaaatgaagtgtgaaaaataaagtatcttatacccttttagacatggagaaggttgctcttgattatactaaattctggatttgcttcatatgtatttttcaggtagcttatttaaaactcgatgtacctcttgtggagttgtggctgagaattacaagagtccaatttgtccagctttatcaggaaaagggtaattataccacactacagaataagtataggttgttttctcctttaggttgaacataaatgtgaggaaa

SEQ ID NO: 153671 - DNA, 601 bp, Human
ccccacacatgcattccctcactggcagtacaaccactggtgatttttttttttctgagacaggttcttgctctgtttcccaggctggagtacagtggcacaatcacaccttactgcagcctccaactcctgggctcgagcaatcctcctgcctcagcctcccaagtagctaggactataggcacacatcaccacactcagctaatttttgtatttctggtagaaatgcagtcttactgtattgccgagggttgtcttgaacttctggcctcaagcagtcctcccactttggcctcaccaratgctgggattacaggcatgagccactgtgcccagcaccactggtaattaatggcttggggtccttccttctaatgcccttccaagtgagcatgtattaattaggagttttataccacatactgccaggcaaatatacaaactgagttatgttgtttctttattttttattatgccaataacaatctttcttttctaatattatttacttcagtgctccagaacctggaactcaagatgccagcatcccagttgagaaacttccccggtaggtagaaaactctgatttgtactggtgttc

SEQ ID NO: 153672 - DNA, 601 bp, Human
cgcctgggcagcagagtgagactccgtctcaaaaaaaaaaaaaaaaaaaaagaccattaaacctgatgcttcataagcaaggcaagtttatataggctgggagggagggtgtagggaataagaggcatcagaggtgacccatctggatgtactaggtttggggcagcccctggcctccctccgatccagctgggcagacttggctcggggttggcttaaggatcccattcttccaggtgtgaagaggcaggctgcgggggcttgctgcgacctcatgtcgtgtggtttggagaaaacctgratcctgccattctggaggaggttgacagagagctcgcccactgtgatttatgtctagtggtgggtcatgcccttccctaaccccaggacaggactggagtttgttattttttccttccccctctcctcttttccttcctccctcccttgcttctttccttcccgccttctctcctccctccatttcttcctttccttcaaatgtatgttgagaggtctttgtggtatcctatagaaaaactgagaaacaatgaataagaatttgtattaaaataggaaaccatgcatgtcttgggcatct

SEQ ID NO: 153673 - DNA, 601 bp, Human
ctctgaaaactacagaacattattgaaagaaataaggaaggcctaaatgaatggaaacatatccagtgttcatggattggacaacttaatatgattaagatggcaatgctccccaaattgatctatgggctcaatcaactcagtccctatcaaaatcacaactggcttttgacagcaattaattgaaaagattaatctaaaattcatatgaaaatgcaagggacccaaaatagccaaaacaaaatgaaaaatgaagttggagaactcatacttcccaatttcaaaacttactatgtattamctaggcatgatggcacatgcctgtaatcccagctacttgggaggctgaggcaggagaatcgcttgaacctgggagggggaggttgcagtgagccgagattgtgccattgcactccagcctgggcaacaagagtaaaactccgtctcaaaaaaaaaaaaaaacttactacaaagttgcagtaatcaagacagtgtggcactggcataggatagatatatagaatcagtggagtagaattgagagtccagtaaaaaacaaaacaaaacagaacaataaaacaaacctcacattcatggtcaa

SEQ ID NO: 153674 - DNA, 601 bp, Human
tttttcaagaaatagtgctggatacccacatgcaaaagaataagcttggacccctctgtcacaccattacaaaaaataacccaaaatggatcatagacctaaatgtaagagctaaaagtataaaatgtcaaaagaaaatgtaggagtaaatctttgtaaccttgggttaaagctttcttagatatgacaccaaaagagcaagtaacataagaaaaatggataaattggactttatcaaaatttaaaacttctgtattccaatgggtaccatcgattaagtaaaaagacaacccacaggccrggtgcggtggctcacgcctgtaatcccagcactttgggaggccgaggcaggtggatcatgaggtcaggagatcgagaccatcctggttaacacggtgaaaccccgtctctactaaaaatacaaaaaattagccgggcgtggtggtgggcgtctgtagtcccagctactcgggaggctgaggctggagaatggcgtgaacccgggaggtggagcttgcagtgagccgagatcgcgccactgcactccagcctgggcgacagagccagactccgtctcaaaaaaaaaaaaaaaaaaaagaca

SEQ ID NO: 153675 - DNA, 601 bp, Human
taagagctaaaagtataaaatgtcaaaagaaaatgtaggagtaaatctttgtaaccttgggttaaagctttcttagatatgacaccaaaagagcaagtaacataagaaaaatggataaattggactttatcaaaatttaaaacttctgtattccaatgggtaccatcgattaagtaaaaagacaacccacaggccgggtgcggtggctcacgcctgtaatcccagcactttgggaggccgaggcaggtggatcatgaggtcaggagatcgagaccatcctggttaacacggtgaaaccccrtctctactaaaaatacaaaaaattagccgggcgtggtggtgggcgtctgtagtcccagctactcgggaggctgaggctggagaatggcgtgaacccgggaggtggagcttgcagtgagccgagatcgcgccactgcactccagcctgggcgacagagccagactccgtctcaaaaaaaaaaaaaaaaaaaagacaacccatagaatcggagaaaatatttgtaagtctaatatttgatatttgataagggatttgtatccaggatatataaagaactcttacaactataaataataaaaa

SEQ ID NO: 153676 - DNA, 601 bp, Human
ttcctagaaataactctcttaacagctctatttttgcagtttattacgtaattttaaatgcagcaggatgattacattaaccaatgcaagtggcgtgagcagatgtgcagctaacactgtagtcgtggttgtcctacaactggtgggggccagcagagtgcacaggtgtgctagaaagaggctttcaaacactgttcatgtttgcctttcccattttaaaagttgacatctaaggttttttaaatcaaatatagttggagatgtgattccaagtgcattggaaacactgccattttatttrtttattgatgtttgagacagagtctggctctgttgcccaggctggactgcagtggcacgatctcgactcactgcaacctccgcctccctggttcaagcaattctcctgcctcagcctcccaagcagctaggactacaggcgtgcgccaccacacccagctaattttttgtattttttttttagtagagacgggttttcaccacattgcccaggctggtctcaaactactgacatcaggcaatctgcctagctcaagctcctaaaagtgctgggattacaggtgtgagccactgtgcctgg

SEQ ID NO: 153677 - DNA, 601 bp, Human
actgttcatgtttgcctttcccattttaaaagttgacatctaaggttttttaaatcaaatatagttggagatgtgattccaagtgcattggaaacactgccattttatttgtttattgatgtttgagacagagtctggctctgttgcccaggctggactgcagtggcacgatctcgactcactgcaacctccgcctccctggttcaagcaattctcctgcctcagcctcccaagcagctaggactacaggcgtgcgccaccacacccagctaattttttgtattttttttttagtagagaygggttttcaccacattgcccaggctggtctcaaactactgacatcaggcaatctgcctagctcaagctcctaaaagtgctgggattacaggtgtgagccactgtgcctggccgaaacactgacattttaaaataaaaactaccatatcattgtttaaaatgtatccagtccaatctgaatgttataactatctggtacataccaccatccatttacaaaataaatatacaagcccttccttaacaattggaaactttgcattttttcttttctctttgaacttgtatttccattctatca

SEQ ID NO: 153678 - DNA, 601 bp, Human
aacactgccattttatttgtttattgatgtttgagacagagtctggctctgttgcccaggctggactgcagtggcacgatctcgactcactgcaacctccgcctccctggttcaagcaattctcctgcctcagcctcccaagcagctaggactacaggcgtgcgccaccacacccagctaattttttgtattttttttttagtagagacgggttttcaccacattgcccaggctggtctcaaactactgacatcaggcaatctgcctagctcaagctcctaaaagtgctgggattacaggygtgagccactgtgcctggccgaaacactgacattttaaaataaaaactaccatatcattgtttaaaatgtatccagtccaatctgaatgttataactatctggtacataccaccatccatttacaaaataaatatacaagcccttccttaacaattggaaactttgcattttttcttttctctttgaacttgtatttccattctatcactactacagaatttatactaatgtaatatatttttatgcatgaaaatcttttactggccaggtacaatggcttatgcctgtaatcccagcac

SEQ ID NO: 153679 - DNA, 601 bp, Human; identical to SEQ ID NO: 35330

SEQ ID NO: 153680 - DNA, 601 bp, Human; identical to SEQ ID NO: 35331

SEQ ID NO: 153681 - DNA, 601 bp, Human; identical to SEQ ID NO: 35332

SEQ ID NO: 153682 - DNA, 601 bp, Human; identical to SEQ ID NO: 35333

SEQ ID NO: 153683 - DNA, 601 bp, Human; identical to SEQ ID NO: 35334

SEQ ID NO: 153684 - DNA, 601 bp, Human; identical to SEQ ID NO: 35335

SEQ ID NO: 153685 - DNA, 601 bp, Human; identical to SEQ ID NO: 35336

SEQ ID NO: 153686 - DNA, 601 bp, Human; identical to SEQ ID NO: 35337

SEQ ID NO: 153687 - DNA, 601 bp, Human; identical to SEQ ID NO: 35338

SEQ ID NO: 153688 - DNA, 601 bp, Human; identical to SEQ ID NO: 35339

SEQ ID NO: 153689 - DNA, 601 bp, Human; identical to SEQ ID NO: 35340

SEQ ID NO: 153690 - DNA, 601 bp, Human; identical to SEQ ID NO: 35341

SEQ ID NO: 153691 - DNA, 601 bp, Human; identical to SEQ ID NO: 35342

SEQ ID NO: 153692 - DNA, 601 bp, Human
tgaaacataatttcttatggcttttggaggcattgtgaagacgcattcacatttttccagtgttttggaatgaatgatgtaatatgagggctgagtgttatggaatggagtgttattacgattgttacaatacagtgaacagaaaggatgctcacaaacgttccaggaagaagctggcagttcctggcctctgcaccaggagtgagggcttgtcgctccctgtgcccagtttctcctggttttttttccttgccttttttcatgtgcgtccgtgtgaagagaccaccaaacaggctttgtktgagcaacatggctgtttatttcacctgggtgcaggcgggctgagtccgaaaagagagtcagcgaagggagataggggtggggccgttttataggatttgggtaggtaaaggaaaattacagtcaaagaggggttggtttgttctctggcgggcagagtaggggtcacaaggtgctcagtaggggagcttttgagccaggatgagctaggagaaggaatttcacaaggcaatgtcatcagttaaggcaggaacaggccattttcacttcttttgtggtagaatgtcatcagttaaggcag

SEQ ID NO: 153693 - DNA, 601 bp, Human
ctgcaaaggtctgcggcttcactcctgaagtcggcgtagaccatgaacccacgaggaggaacgaacaactctgggtgcgccacctttaagagctgtaacactccctgcgaaaaaggtggcacgtcggacgtgccacctttaagagctgtaacatggccgggcgctgtggctcacgcctgtaatcccggcactttgggaggccgaggtgggcggatcaccaggtcaggagatcatgaccatcctggctaacacggtgaaaccctatctctactaaaagtacaaaaaaaagaaaaaattagtygggtgcagtggcgggcgcctgtagtcccagctactcgggaggctgaggcaggagaattgcatgaacctgggaggtggagcttgcagtgagccgagatcgcgccactgcactccggcctgggtgagagggagactccgtctcaaaaaacaaagagctgtaacactcactgtgaaggtctgtggcttcactcctgaagtcagcgagaccacgaaccgtccgggaggaatgaacaactccggacggtgccacttttaagagctgtaacactcactgcaaaggtctgcggcttcactcctgaag

SEQ ID NO: 153694 - DNA, 601 bp, Human
cttcactcctgaagtcggcgtagaccatgaacccacgaggaggaacgaacaactctgggtgcgccacctttaagagctgtaacactccctgcgaaaaaggtggcacgtcggacgtgccacctttaagagctgtaacatggccgggcgctgtggctcacgcctgtaatcccggcactttgggaggccgaggtgggcggatcaccaggtcaggagatcatgaccatcctggctaacacggtgaaaccctatctctactaaaagtacaaaaaaaagaaaaaattagtcgggtgcagtggcgggygcctgtagtcccagctactcgggaggctgaggcaggagaattgcatgaacctgggaggtggagcttgcagtgagccgagatcgcgccactgcactccggcctgggtgagagggagactccgtctcaaaaaacaaagagctgtaacactcactgtgaaggtctgtggcttcactcctgaagtcagcgagaccacgaaccgtccgggaggaatgaacaactccggacggtgccacttttaagagctgtaacactcactgcaaaggtctgcggcttcactcctgaagtcagcaagaccatgaa

SEQ ID NO: 153695 - DNA, 601 bp, Human
atctaatgtgttcagattagatagaggccaagctctactcccctggggcaatgccgtgtcagctgctgcgggcagatctccgggagccatgggctggatctccagggcgggaccctgacatttccatgcatgactgatggctcattggcctgcccacattctttctcaaggttctgagccacacagatgtttccgctgtacgcctcttcacagagaggcggacacattgaatgttccttgaaagcttggggcaggtctggggcctcaccattcaagtgtccctcccctgaggtacaagggrtgtgtatggctgagagcacctctcaggccgtgttccctggattttctgtattcacccactttctggaaccatggctgaaagctacaaaggtgatgttctctctgaagagtcacataataaactcagtttaacatggctgttgcctggatagcaactatttttccatgggcaggtagtgggacattttccacgtgcttgggaacagtcactggggttgatactcctcttttttgttgttgttgagatggactctcactctgttgcccaggctggagtgtggtggcacgatcttggctaact

SEQ ID NO: 153696 - DNA, 601 bp, Human
ctgaactgtacacctaaaaacttatttactaacaaattttatattacataaatttaaaataaatatgaattattttaaattaaaaattttaaataaatttaaattttttatttatttttaggtgtacagttcagtggcactaagtcccttcacgaaaaaaataaaaattatttaaaaaacaaaaattttatttctgttttctatgtgtaaaatttacacctagtaaattttatgtgtatttgaccacaattacaaaaaaactaaaaagaatgggtaaaggagcaatatacagaaagtactyttaaatggagggactaacatttataaagcaccaccaagagctgggccctgtgctaagaatttgagagaactttctttgtaaaccttttaaggactaaaagtgggtacatccacccccattttatagcaggataaatggagactctggttgaagtgatttgctcaaaagtacccagtaatgagggaggtctagcattcgaccccagatctttccgaacttattttgccatagatgttgaggcctaaaggaaagctggaaaaattggggcaaagcagtttttgtttttatttttgcccagag

SEQ ID NO: 153697 - DNA, 601 bp, Human
tgctgctacgcacagtcccattctgacagtcctgtatccgctccacacccaaggtgcttcatgacaagataaagtagactcctcacttaatcaccctgaccagctgcttcctggcccctgttatcacaccccattcccagaggctgctcgagggcacaccggggacttcactaaagcctgaccacactcctgtcatattctcatttctgatttggtcttttcctcttttcccttattttgcccttcttgatttcaaacttgaattgacagctttttgttcctgccaatggaaactcccccktcctcctggaagcattcttgctgtgctgtccctcatggttgaggcatttcataatcactttgggtttttccagacagtagcagtgaccacatttggaccatggacagattcagcagccacacaggtagctgatgggatggagagacatttgcacaagcttctgggttactaaagcggcgtcagccttcttgatgtttttaagctgactttggccagttgaggtggctcatacctgtaatcccagcactttgggaggcagaggtggggggattacttgaggccaggagttagagaccagcc

SEQ ID NO: 153698 - DNA, 601 bp, Human
cacccaaggtgcttcatgacaagataaagtagactcctcacttaatcaccctgaccagctgcttcctggcccctgttatcacaccccattcccagaggctgctcgagggcacaccggggacttcactaaagcctgaccacactcctgtcatattctcatttctgatttggtcttttcctcttttcccttattttgcccttcttgatttcaaacttgaattgacagctttttgttcctgccaatggaaactcccccgtcctcctggaagcattcttgctgtgctgtccctcatggttgaggsatttcataatcactttgggtttttccagacagtagcagtgaccacatttggaccatggacagattcagcagccacacaggtagctgatgggatggagagacatttgcacaagcttctgggttactaaagcggcgtcagccttcttgatgtttttaagctgactttggccagttgaggtggctcatacctgtaatcccagcactttgggaggcagaggtggggggattacttgaggccaggagttagagaccagcctgggcaacatagcaaggccctatctctgctttaaaaataattaaa

SEQ ID NO: 153699 - DNA, 601 bp, Human
tcttataggtttgtaagagctcttattatgttaaggataataacactttgtcaaaattgtagatatttttctctacctgggtatttgttgattgtatgaatatctgtgtttatgtgtatgtcagttttttttcttttttcttttttttacatagagatgggattttgccatgttgcccaagctcgtctcaaactcctgggctcgagcaatccacttacctcagcctcccaagtgctgtggttataggcgtgagccactgcacttggccaagtttttagtttttatgtagacagctctgtcrttatgttttttcacttttatgcttattgaaagtattcaaggtttccttctgaatttggggagtataactttaattttaattctttaatctacctctagtcctctttctgggccatctgtgatttttccattgtcagctactgtttggattaaagctttaagccctcctcatcaccttttccccacatccttttatatgaagttaaaagtcactttgtctacgttaaaaaagaaaaattccctctgggaagcaattcagagagaagacacttggacttcagtgcaaaagacatgagtggaa

SEQ ID NO: 153700 - DNA, 601 bp, Human
cttttatatgaagttaaaagtcactttgtctacgttaaaaaagaaaaattccctctgggaagcaattcagagagaagacacttggacttcagtgcaaaagacatgagtggaatgagtaaggattcattttgcaaaatatgactttgcacagttgtgaaaactcagccagggcatcttgccaagtatcctatatactggctgaagaatccacagggcagtgagttgtaataaaaagggctatttttgcactcctacactcctgcagtgaaagagcttgtactgtttccaaaccagacacatscttctggttgatagattctgccacttcctggaggcttgtgtgttcttaggccaaagcttcatgttctgtaaactgagcacgtgctgatgctatgtggtccatgagggctcatctgccctttcctgtctagatgggaatcccagccctagagagtggggcacactgctattttcttaactgcgttttctaattctgactctctggggttccataaagattcttcaggggctttgcaaactgtgaaacatttttttgcccaacactaaagatattaattaccaagagtgtttcattgctgac

SEQ ID NO: 153701 - DNA, 601 bp, Human
tgagccaccaagcccagcctcctctaagatttttgttgttgttgttgattgctgagatgtctgaaaagccctgacctggactctctaagatctcttctagttcttaaatcatataatgctgtatcttctcatgccaacagctcacccaaggggcctttcccaaaagtggtctccaggtatgaaattctgtgttccttttttgtcccccagctgcctggtggctttaggacatgcacatcctcgtgttcaggtgtggggttcctcacctttataccagcaatagtagttcatgatcatcagstgtattctttctgtctcaggcagggaacgtggtgacaggagaaatggtagaagagcttattctttccggagcagatatcatcaaagtgggagttggaccaggtaagacttgttaggagcacagcagaggacgtgtgtggggaagaatgggatctggggcttgcggggactgcagatcactggaggggatgcatgaatgactcattcacagatatttaaagcatgctttttctggaagcataattgagcttctcggggaagcccctgatgaaaagtattgttgagctgctttttgatgccc

SEQ ID NO: 153702 - DNA, 601 bp, Human; identical to SEQ ID NO: 35343

SEQ ID NO: 153703 - DNA, 601 bp, Human; identical to SEQ ID NO: 35344

SEQ ID NO: 153704 - DNA, 601 bp, Human; identical to SEQ ID NO: 35345

SEQ ID NO: 153705 - DNA, 601 bp, Human; identical to SEQ ID NO: 35346

SEQ ID NO: 153706 - DNA, 601 bp, Human; identical to SEQ ID NO: 35347

SEQ ID NO: 153707 - DNA, 601 bp, Human; identical to SEQ ID NO: 35348

SEQ ID NO: 153708 - DNA, 601 bp, Human; identical to SEQ ID NO: 35349

SEQ ID NO: 153709 - DNA, 601 bp, Human; identical to SEQ ID NO: 35350

SEQ ID NO: 153710 - DNA, 601 bp, Human; identical to SEQ ID NO: 35351

SEQ ID NO: 153711 - DNA, 601 bp, Human; identical to SEQ ID NO: 35352

SEQ ID NO: 153712 - DNA, 601 bp, Human; identical to SEQ ID NO: 35353

SEQ ID NO: 153713 - DNA, 601 bp, Human; identical to SEQ ID NO: 35354

SEQ ID NO: 153714 - DNA, 601 bp, Human; identical to SEQ ID NO: 35355

SEQ ID NO: 153715 - DNA, 601 bp, Human; identical to SEQ ID NO: 35356

SEQ ID NO: 153716 - DNA, 601 bp, Human; identical to SEQ ID NO: 35357

SEQ ID NO: 153717 - DNA, 601 bp, Human
aaccataaatagcattacacaaatgttatttcattattttccctctttagtatctacatgaaaatgggattgtccatcgtgatctcaaaccagagaatcttctttatgcaactccagccccagatgcaccactcaaaatcggtgagaacatttcttcttgttttgtgaccccttttttcagagcagaaaaaattttactgtgtggaatttttaaatattgctccatccagttttacatccattcagttttcctgaataattgacatctgtaaaggaaataatatgttgttttggaagtttktgctctttcctggaatgtttatttggaaaatattgcttagaagttagtattctgttgctgggcacacaaaggaatcacagcttagaaatggcaaggaccacaggagatgaccttgtattttgtaaataagtttatagtgaacaaaatgatagaaaaagtaacacatcttttggagatattaacttttattccacagattgcttggagcttaattttaggtaataaagaactttgacataaaatatttagcacatattagtgagtctaggctttgagtcgcttgtttatatgaacagagat

SEQ ID NO: 153718 - DNA, 601 bp, Human
aggctttgagtcgcttgtttatatgaacagagataaattaagatctgcctttcccaaaatgcactccatagaacactggtttctcagcagggtagatgaggatgggagtgattcacagaaatgctatggctgatcaactaagttaggaaatgccaactttaaaaaagttaaacaagatttgtatttctgtaggactttccagaacctttaacctgttaacatataaatttacatattatatcatattctatgagacttttttaaaatttttaccaataagcattttgaaaaactataaagrtgaactttgggaaattctgatctacccaaagaaacctttaattagcactttagaaaaaaataaatgttactttccaagtatcttccaaagcaaatcttcatttcaaaaaatattgtaaactttattttcgatgaattctcactagtggaatcttcattaaatcctctgaagggcattgctcttctggtgccttccttatcgtgctaatctgcgaagttcactgcatttacagatgttaacacctttaacaattaagttgttcatatcagggaagagctcagataacataatgtgctttat

SEQ ID NO: 153719 - DNA, 601 bp, Human
ggtttctcagcagggtagatgaggatgggagtgattcacagaaatgctatggctgatcaactaagttaggaaatgccaactttaaaaaagttaaacaagatttgtatttctgtaggactttccagaacctttaacctgttaacatataaatttacatattatatcatattctatgagacttttttaaaatttttaccaataagcattttgaaaaactataaaggtgaactttgggaaattctgatctacccaaagaaacctttaattagcactttagaaaaaaataaatgttactttccawgtatcttccaaagcaaatcttcatttcaaaaaatattgtaaactttattttcgatgaattctcactagtggaatcttcattaaatcctctgaagggcattgctcttctggtgccttccttatcgtgctaatctgcgaagttcactgcatttacagatgttaacacctttaacaattaagttgttcatatcagggaagagctcagataacataatgtgctttatgaatgcaagaacctaaggaaaaaatcctgaaagtcctgctgggcagccagcttgttctcataatcactcctgtaagg

SEQ ID NO: 153720 - DNA, 601 bp, Human
agccagcttgttctcataatcactcctgtaaggcaggggacagcaggcagtttccatttcctttcacatcactttcaaagatttaatccttaaagcaatttctttaaatggatggatagatactaatttaggcaggagaggttttctttctgaagggcttcctgctgcttccactgataaggatcaggcacctgccaggaaatgtgggtttatctttgaagtctaaaatggaattcattctgcacctgcctctcttgaagaatgcccttgaatggtttcctgatgtttcctgagtgcaagmgatatagctcagcaaatagttcataatggtagcaactttcgataatcttttacctaggtaatattctgagaaataaataaaaaggattcttaccaaaaaaatcttatagtcttcttatgagagtaaattcttataagtgaaatacattggagactgaatgtattttcaagctgaacaaaccttttgatgtttctgttaattctcgtgtcactgatgaaagtctattttttttctcctctctgtcaataaattgaagattctggattatatcattaattctgtattgtcccttagagttac

SEQ ID NO: 153721 - DNA, 601 bp, Human
tggcctggcctagcctcactaagacaaggacttcaggtgagattttcctagaagagttctccagtccctgcagatggaccacaactacgttgagctcttcacatcttcccgcctcatcgcccagagtgggctgaaggcattgcaatcagaaagaacaaaagcttttgacccatactagcataaaacctgctctgtttttcttgatggtcaaattaatttggcaacaacttgaaagccaataaagtttgtaaaaattatcaagaattcctaaaattgttgtgattattgaatatgtcacagwtcaattaaaattctaatctaaattataaagaaaaaagacaagatttcaagttatcaatcacaagattagtgatccttttctcttagatcagaatatttttacacaggccaggtgtggtggctcatgcctataatcccagcactttgggaggccaaggtagacgggtcacttgaggtcaggagttcaaagctagcctggctaacatggtaaaaccctatctctactaaaaaaaaataaataaaataaaaattagccaggtatgatggtgcacaccataatccccagctagctcctcaggaa

SEQ ID NO: 153722 - DNA, 601 bp, Human
gctctgtttttcttgatggtcaaattaatttggcaacaacttgaaagccaataaagtttgtaaaaattatcaagaattcctaaaattgttgtgattattgaatatgtcacagatcaattaaaattctaatctaaattataaagaaaaaagacaagatttcaagttatcaatcacaagattagtgatccttttctcttagatcagaatatttttacacaggccaggtgtggtggctcatgcctataatcccagcactttgggaggccaaggtagacgggtcacttgaggtcaggagttcaargctagcctggctaacatggtaaaaccctatctctactaaaaaaaaataaataaaataaaaattagccaggtatgatggtgcacaccataatccccagctagctcctcaggaagctgagacaggagaatccctagaacccaggaggcggaggttgcagtgagccaagatcgcaccactgcactacagcctgggcgacagagactccatctctaaaaacaaaaacaaagagaatatttttacacaaatgtcctttatttcaattcatctcttcagtgaactgttaatcacctactgtgtagt

SEQ ID NO: 153723 - DNA, 601 bp, Human
cagtggctcatgcctataatctcagcacttcgggaggctgaaatgagaggattgcttgagggtcagaattcaagacgagcctggccaacatggtgaaaaaaaaaacaacaacaaaataattagctgggcatgttggcatgtacctgttgtcctagttactcaggaggctgaggcaggaggattgtttgagcccaggagttagaggctgcagtgagctatgattttactactgcattccagcctgggcaataaaaggaaacctggtctcagggaaaagaaaaagtattccttggtcattggmagaaataaaaatccaaataactatactcaatattaacagcctcctgtgcattctcttgtactcttctatgtctccttgtccatctaagcattttataatattgttttaatgagttagtattaattctggatggagagttcttagaaggaacattttaggtagacatgaaggatgagtaagagttcaacaagtgaagaagtggccacagggcattctttgtcagtgggtacagggagagcaaagtcatggaggattggcagcatctggtgagtttaggtgctgtttgtcactttgtcaact

SEQ ID NO: 153724 - DNA, 601 bp, Human
gattgcttgagggtcagaattcaagacgagcctggccaacatggtgaaaaaaaaaacaacaacaaaataattagctgggcatgttggcatgtacctgttgtcctagttactcaggaggctgaggcaggaggattgtttgagcccaggagttagaggctgcagtgagctatgattttactactgcattccagcctgggcaataaaaggaaacctggtctcagggaaaagaaaaagtattccttggtcattggcagaaataaaaatccaaataactatactcaatattaacagcctcctgtgyattctcttgtactcttctatgtctccttgtccatctaagcattttataatattgttttaatgagttagtattaattctggatggagagttcttagaaggaacattttaggtagacatgaaggatgagtaagagttcaacaagtgaagaagtggccacagggcattctttgtcagtgggtacagggagagcaaagtcatggaggattggcagcatctggtgagtttaggtgctgtttgtcactttgtcaactttgtatgactagaacatagagtttttggtacagagggcacaaatggact

SEQ ID NO: 153725 - DNA, 601 bp, Human
agggatagaaagaaaacagacaaattagctattgtaaatgctcttttctaccactctcatgtcagaaatctacacacatgctcatgtccttccttagcttctcagcagatgacatgttcaatctattcttaaatctatctacttttttaaaatatttaaaaattgtaaaaatactgttttaatatattgtcctttccataaacaggcccttcatacaaataatgccatcttataatggaggcttattttctattattattttctcttgcaaatatccgtttcagcctagatggtaaataaygaggaaacagaaataagaggttgaaagtgaccaggataattctactataggtagtggcttatcaggaaaaagtagtttgccatattataagaaaaggaagtgaaagcagcaaggaagcttggcatgggggttggaaggtagactctacttaccttagtgaactattttggggattgagatggaaaataaaagtgtttttttggctctaaagtgctaaacatagaaatgtaattactattatataggcgggggcagtcttggaagtcaaaaacaagtaagtttaacatatttctttagcag

SEQ ID NO: 153726 - DNA, 601 bp, Human
agaggttgaaagtgaccaggataattctactataggtagtggcttatcaggaaaaagtagtttgccatattataagaaaaggaagtgaaagcagcaaggaagcttggcatgggggttggaaggtagactctacttaccttagtgaactattttggggattgagatggaaaataaaagtgtttttttggctctaaagtgctaaacatagaaatgtaattactattatataggcgggggcagtcttggaagtcaaaaacaagtaagtttaacatatttctttagcagacaaaggttccatttytatgtaagtaaatacatatgtgttcatacatactcttgacccaaaggaaatacactaaaatattacctcacaatgggagccaaagagggggtaggattttaaggatacacctgtgtgtggtaacataggaaacattggaaaacacttgggaaaaacagaagtcacagtaatactagggcccaggagtagataacctagagcagaggcaatatctagggttttgaattaaatacaaattttaatctagttatgaatatttgtttcatctatcttataaaaaattaaattgttaacaggtaa

SEQ ID NO: 153727 - DNA, 601 bp, Human
tacgcagagactgttttatattcttttatggccacaagaggagacagaggagagcctcaggaaaaaaaaagaaaagtgtattaaacttacatatcctagagacaggaggcacagcaagccacccagggccacgcaggaaagaagacaccagggtggtcaggaggcagaagacaggagaaagggaaagtttagactactgccttttggggtattttcttgggaaaggcaaggcaaggcagggtgaacagtttaggattgcctagtttgaataatttgtgtgggttgcctggctcctggctcytggccctgggatgattaaggcagaggaatatcccctcctggggtgtgtaggtcagatggatgaggtatggcactggactggttaatcggtatgtgaaaggcatgctccaggctggacgctttcttatctttcagaattaacaagccacaggagagacaggctctctgcaaccagaaaagctttttaagatgtcaaaaacatcataatatatataaagaaaaatttaaaatatttacaatacagagactttactttgaacttgaaaaagtgtctgacacccatataattgacagagatgag

SEQ ID NO: 153728 - DNA, 601 bp, Human
ttatattcttttatggccacaagaggagacagaggagagcctcaggaaaaaaaaagaaaagtgtattaaacttacatatcctagagacaggaggcacagcaagccacccagggccacgcaggaaagaagacaccagggtggtcaggaggcagaagacaggagaaagggaaagtttagactactgccttttggggtattttcttgggaaaggcaaggcaaggcagggtgaacagtttaggattgcctagtttgaataatttgtgtgggttgcctggctcctggctcttggccctgggatgaytaaggcagaggaatatcccctcctggggtgtgtaggtcagatggatgaggtatggcactggactggttaatcggtatgtgaaaggcatgctccaggctggacgctttcttatctttcagaattaacaagccacaggagagacaggctctctgcaaccagaaaagctttttaagatgtcaaaaacatcataatatatataaagaaaaatttaaaatatttacaatacagagactttactttgaacttgaaaaagtgtctgacacccatataattgacagagatgagatgcgagcttgtttc

SEQ ID NO: 153729 - DNA, 601 bp, Human
gtgttcaaaaataacccatgaagagttcagtgttgaagggattctcaacatcttgtggatgagaaaataagtaggtcacacagacaaaaaaaaaaaaaaaaagaaaaaatcgatcaggccatagctcctaataaatgtgctacaatataactatacaatattaactgccaaaatgttttaactggtctagatatttaaggcttgaagtttgtggatgtttcaaacccacccacgccaatcctagaaaagaaaatcaagttgttagagtagaaaagaaaccactatgttaagggcttaggtaaaaaaaaaattatatctaatacgaattatctaatttattcataagcttaagtatgttcatatttcatatttgtacttgtctttattcaaattctattttcagagtctacaagctgttaggagtttgttttcttttggcatttgccaaggtctcattagttctgagacagtcctactggcataactcagaggaagtattaatacataaaaatgtcccatgtgctaagcctctaagcataacagtgttttgctattttcaggctttagtaatggcaaatatatattgtgcttctatttaagc

SEQ ID NO: 153730 - DNA, 601 bp, Human
aaggctaattattaacaattgaagaatgagttcctacgatatgcagaaatccctgtacttagagtctgcaggtgcctaattctacaaataatattgtagaataataatattctacaataatattctgagtttccataaagaaggaatacatatatttcatatatactatgactgattcagtcttaaaaactctcattgcttggtaaccaattaattctgtcataattatcaataattataaatggaggtggtataataaagagatgattaaatgtggcacttcagctattgaatgtgaagkcatgatgaaagtgtagaatgacaggtaaaagagagagtccctcaccttccagctcttaaaactatccttgaatgatacctcccaaaggatcagcaaatagtgatgggctaacaaaagtcagtgtcaccaacctgatgttcagtattaaaaccacacatatattgctcatctaccctaaggcgtggtaggtctccatagatatatgggtgactacagggatgggctggccatatttggccctgtttacctgatgctcacaggcatagattgctggttgttgttgctgttgtggtattgttg

SEQ ID NO: 153731 - DNA, 601 bp, Human
tgcttggtaaccaattaattctgtcataattatcaataattataaatggaggtggtataataaagagatgattaaatgtggcacttcagctattgaatgtgaaggcatgatgaaagtgtagaatgacaggtaaaagagagagtccctcaccttccagctcttaaaactatccttgaatgatacctcccaaaggatcagcaaatagtgatgggctaacaaaagtcagtgtcaccaacctgatgttcagtattaaaaccacacatatattgctcatctaccctaaggcgtggtaggtctccayagatatatgggtgactacagggatgggctggccatatttggccctgtttacctgatgctcacaggcatagattgctggttgttgttgctgttgtggtattgttgttgttcatgttttcatgctttactaggcttggaagtcagatggctgttcctacttcaggcttgaccttgaatatgttagtgaaaccctctaaatctcagtctcctcaactatacaatgggaataataagaacacttatttcacagggctattataaagaataaataagataatgtatgtgaagttcttgcacagta

SEQ ID NO: 153732 - DNA, 601 bp, Human
ccttgaatgatacctcccaaaggatcagcaaatagtgatgggctaacaaaagtcagtgtcaccaacctgatgttcagtattaaaaccacacatatattgctcatctaccctaaggcgtggtaggtctccatagatatatgggtgactacagggatgggctggccatatttggccctgtttacctgatgctcacaggcatagattgctggttgttgttgctgttgtggtattgttgttgttcatgttttcatgctttactaggcttggaagtcagatggctgttcctacttcaggcttgacyttgaatatgttagtgaaaccctctaaatctcagtctcctcaactatacaatgggaataataagaacacttatttcacagggctattataaagaataaataagataatgtatgtgaagttcttgcacagtacctggtaactaaaacatgtaatgaatgttaggcattactaaagtcattataatgaatatcatcatcctcatcttttcttattactgttaaaaatgtatcaattccttttattatgcagtatgatttttccattttgtcctcacaagagtaagtcctaatattcggggagt

SEQ ID NO: 153733 - DNA, 601 bp, Human
agtatttcttaaaatgctattaacagaacagtttctaagatgacacaacacaattaagcaagtcttgtcttccattagtgcccattcatgatttcaaggatgattccacacacttgccacattgctactttgaaaagaaataacccattagattcactatgccaaaatttaagacaaattttcaacagcttatagttgaacagaagagatctctgcttaactcttaacaaaacagaaagttgggttagccaataagctacattttctctaacatgaacacatatgaaaaatgtaggaaaayttaaataaaagaaatacatctcataatctaaaatagaaacttttagtatagtttcacaaaaggcatagtgtttgtgttcatttccagaagaataaatagcttaagtgaaataataagagtcttaaattatactgcaatccaatcaagtaaaggacgatctcacccaagaatgaattaaatacccaaagtggcaacttcatttttacaatgaacttttaaaaaatctagttaattaaatgcatggtaaaattccagttgcactgactgtaactttctacttgaccggctcgtgtgctgcac

SEQ ID NO: 153734 - DNA, 601 bp, Human
ttggagtctttatattggtttcgtactgccctgaacaaagcggtttctctggaactttagttgtgtaaaacaatcaggttttttgtcatttattaaatatttgttgtgcttctatgcactaggcactgttgtatgttgtaaagacatagcagtaaaaaccagaccaaaagaactcttccttaagtatactgtaatacattttagtgggagaagacaacaatacacatgtaaaatatacagaaagaggtgataatttcccatagaaattataatataaagttggaaaaggagcctgggttayagtttaaacaaggtaattaaggaaggctttgtgttagaatggaatatataagcaaaaatttgagagaggagagagcaaaccacatacatacctagtgaaagaatgttctaggtgaaggggatggggcacactaatcctgaggcaagaacacaccaggtgtctttaaagtccaccaagaaggttagttggttgattggaatgcagtgacaagggcagaaaatagtagataggagaggggataactaacaactgagggaatggagttaacatttcctgagatgggaagacatcggagcatca

SEQ ID NO: 153735 - DNA, 601 bp, Human
aagaggtcaaaaggaagaggtgattgatagcaagtgggtagaagatttgcttaaaatgtcttattttggaccagaacacccacaaaatgttccactttaaaatgttattacagaaaggatatgcataaaataaaaataaaaagttttgcaagaattattattgattatcatcagtgagaaggtttatatctccgttagagaaaaacataatgtttttcttttcttttcttttcttttttctttttttttttttttgaggcagagtctcactcattcccccatgctggagtgcagtggtgcratcgatcttggctcactgcaacctccacctcccaggttcaagcaattctcctgcctcagcctcctgagtagctgggaccacaagcgcacactgccacaccgggctaattttttgtattttagtagagacggggtttcaccgtgttgcccaggctggtcttgaactcctgagctcagacaatccacccaccttgtaatatttttcacacttaacacgagacactttaaattctaagtccattactttatctttgcacctccatctactgaagatatttttatgtaattttaatattaggat

SEQ ID NO: 153736 - DNA, 601 bp, Human
ttttagtagagacggggtttcaccgtgttgcccaggctggtcttgaactcctgagctcagacaatccacccaccttgtaatatttttcacacttaacacgagacactttaaattctaagtccattactttatctttgcacctccatctactgaagatatttttatgtaattttaatattaggatgagataggtttatttattttatcctacttcatcccacgaaaattgaaaggtagcttttcaacagttaataccactttgctggcatccatcacaactctgaagtgacctggagactcrgtctgattcagagttggagaaaatggcaatgacttcaagataggaaggctcaatggaatttcacagaaaagcaaatttcacagggcaataaaaataagttgtatttttttttccttttttgaaagcactaggtattctcaaatatttgattttctcttcaggatattatttaaaaataaaaaataagatgagggaaataaacagactattttcactcatttattagatttatacaaagagaaaatcatataattcttgcggtaaggaagacttttttaacagcttaaatgaaaaacatga

SEQ ID NO: 153737 - DNA, 601 bp, Human
cattgaagattggagtatgaggttttgtgggagcttggtatcatttagtgttttatgagcaataacatgaatggtaagataattttaggaagtggtagacagattggattcacttggaacacagccagaaaaatcaataaatgattatttactaattcagaaaagatgatgattctaagtcttttaaaatgcatttttaaaaactgttttacaaatcagcaagaaaaaaaagggcgcaaagggcatgaatagacaatgctcaaaagaagatatacaaatgggagagaatccacagaccctstgtataggaagcagattgttcctgcaggccccaggagacaaccgaaaaactctgaagacaaaggacataacctcttgggagctctaggctctacctaccacctgatcctccctgtactaccacagctgatgctctcttgaaagtgccacctcctggcaggaggccaaccaacacaaaacactgcaataaacaaatctacaactaaggaccctcacagagtccatttcactttcctgccacctccactggagcaggtgctgctatacatggctgagagacctgaagatggtttacaccaca

SEQ ID NO: 153738 - DNA, 601 bp, Human
taaagagggaatcctccctaaatcattctatgaagccagtatcaccctaatatcaaaaccaggaaaggacataaccaaaaagaaaactatagatcaatattcctgatgaatatagaagaaaacatccttaacaaaataccagctaacctaattcaacagcatatcaaaaagataatccaccatgatcaagtgggtttcataccagggatgcagggatggtttaacatatgcaagtcaataaatgtgatacaccacataaacagaattaaaaacaaaaatcacatgatcatctcaatagacycaggaaaagcatctgacaaaatccagcaatgctttatgattaaaaccatcagcaaaatcagcatagaagggtcgtacctttacataataagactcatctatgacaaacccaaagctaacataataccgaatggggaaaagttgaaagcattccccctgagaactggagcaggacaaagatgcccactgtcacaacttctattcatcatagtactggaagtcctagccagagcaatcagacaagagaaagaaataaaaggtatccaaatcggtaatgaggaagtcaaactgtcagtttgct

SEQ ID NO: 153739 - DNA, 601 bp, Human
taaaaattatagaagataaatcagaaaaaccatcctgtaaattagcttaggcaaagacttcatgaccaagaacccaaaagcaaatgcaactttgtttttacaaagataaatagatggacttaattaaactaaaaagcttctgcatagcaaaaaaaaaaaaaaaaaaaaaaaagcagagtaaacagacaacccacagagtgggagaaaatcttcacaatctatacatctgacaaaagactaatatccagaatctacaaggaactcatacagatcagcaagaggaaaacaaacaatcccatcaaaaagtggactaaggacatgaatggacaattctcaaaagaagatatacaaatggctaacaaacatatgaaaaaaatgcctaacatcactaatgatcagggaattgcaaatcaacaccgcaatgcaatgccaccttactcctgcaagaatggctataatcaaaaaatcaaaaaataatacatgttggtgtggatgtggtgaaaggggaacacttttacgctgttgatgggaatgtaaactagtacaaccactatggaaaacagtgtggagattccttaaataactaaaagtagaactaccg

SEQ ID NO: 153740 - DNA, 601 bp, Human
atatatatatatttgaaagttattgaaaataatatctaattgtgtctaggtgttttgactttgtttcaccccatttttttatgattttcaaaataagttattttaaaaacaattatttttaagatgaatttattatggatggcataaacattttttattccttttgtctgttaacttcactgtgggacatttaactttttacatggcaagtttactcacattgcagtacagtgcttcacaaagaaataaattgcctttggagagtaaggttacacccagtgctgcgacagatcagaacttrccatgtcaggtatgaaactcagactccctgtatagtggatccaaaaagcagtttgtgacacactattcattttccttagagttctttggctgggagctattagcagtgcctagagaaaacatctgacccttgccagtatgtgtctctggcctgcacggggtgggagggttgatttcactagagccaacaggatgagtccccatagggcagcatacacagtagctgttgtagcagaagaaatgagaaatgcaacaggtctgcaggttagaatgcttgttcttgtcctctcttcttgttgaa

SEQ ID NO: 153741 - DNA, 601 bp, Human
cttgtcctctcttcttgttgaatgatcagtaacacatcctttactaataatataatgggtagcaggttaaaactcaaagttaacttggaaatcagctatttggattcatttacagtttagaggtaaaaaaccaagatccagaaaatataaaagactctctcaacatatttctatatttatgtttaaatgtcagtatggggcttgatagcatttcagactgaataagattcactgatgtgaagacctgcatggagaaggactaatgcaagtggaatatgcatgctcaatatgtgtgcattcrgctccttgactggaacatctcctagagacaaaaataggcaatagcagccttcctgcaatggcagcataatctgagttcccctttacaagggaaagttcactgtcagggctgttgtgctcaaagacactttctgtggggtacagattgccccagagaatgaaagctaacctgacagagtgaatgatggtagttcgtatcagccatgcatgtttcttaattttgttaattaaaccttaaaagaaaagttttctaggaataattcatctgtagattaaaaaaagctttttggctacagataca

SEQ ID NO: 153742 - DNA, 601 bp, Human
ttgtccttgtttgataagaggaatgagcatgagcatttttgtggtggagaaggattctctggtgaaggtttcctgggaatttttctgctacagctttggctaactctctcaaaacagtctcatatgaaacacgttatttttctttggccctccagaaagtcaacaggcaaaatgccttgagcatccaaaaaaaccattgccatgacacttgctctttaccaatctgcttttgcttagcctggaccacttccacctcttggtagccattgctttgattgtgccttgtcttcagaattatacwgttgaagccatgttttatctcctgtaacaattgtttgaagaatcaggctcaggatttcaatcccacttgtttaaaatttccattgaaagctctatttttgtctgcatcgatctggatgcaacagtgttgtcacccatcgagtgaaaactttgctcaacttttaatttttcagtcagaattgtgtcagcagaactcacagatgtctgtgatgttgactattgtttctgctcttgccagtcctcttcaattaggccatgagcaagatttatttttttctcaaaaattgatgtggatgatctg

SEQ ID NO: 153743 - DNA, 601 bp, Human
gcatgagcatttttgtggtggagaaggattctctggtgaaggtttcctgggaatttttctgctacagctttggctaactctctcaaaacagtctcatatgaaacacgttatttttctttggccctccagaaagtcaacaggcaaaatgccttgagcatccaaaaaaaccattgccatgacacttgctctttaccaatctgcttttgcttagcctggaccacttccacctcttggtagccattgctttgattgtgccttgtcttcagaattatactgttgaagccatgttttatctcctgtwacaattgtttgaagaatcaggctcaggatttcaatcccacttgtttaaaatttccattgaaagctctatttttgtctgcatcgatctggatgcaacagtgttgtcacccatcgagtgaaaactttgctcaacttttaatttttcagtcagaattgtgtcagcagaactcacagatgtctgtgatgttgactattgtttctgctcttgccagtcctcttcaattaggccatgagcaagatttatttttttctcaaaaattgatgtggatgatctgccactgtgggctttgtcttcaacatt

SEQ ID NO: 153744 - DNA, 601 bp, Human
tgaagtcttagcctttttagtgtctcagactagatcctgtttggacatgttatgacaagttagtacaagtttattttggtacaaaaaattgtgaaattcatgcataattttttataatatgcatttaccatgaccttttgaagactcctcatattttatgtaacccagcttctacagggaaattggaacatgatgagagttaagggatagttagggaagaggtcagtggaatgcccacagtattccttcctgtatggtaaatccacagtcccatgaggatagcctccctccagagctcacttatttatttatttatttatttattttttgagacagagtcttgttctgttgcccaggttggagtgcagcggcgccatctctgcaacctccacctcctgggttcaagctattctcctgcctcagcctcccgagtagctgggattacaggcacctaccaccatgcctggctaatttttttgtatttttagtagagacagggtttcaccatgttggccaggctggactcaaactcctgacctcaggtgatccacctgcctcgatctcccaaagtgctaggattacaggtgtgagccactgtgcc

SEQ ID NO: 153745 - DNA, 601 bp, Human
tattttggtacaaaaaattgtgaaattcatgcataattttttataatatgcatttaccatgaccttttgaagactcctcatattttatgtaacccagcttctacagggaaattggaacatgatgagagttaagggatagttagggaagaggtcagtggaatgcccacagtattccttcctgtatggtaaatccacagtcccatgaggatagcctccctccagagctcacttatttatttatttatttatttattttttgagacagagtcttgttctgttgcccaggttggagtgcagcggygccatctctgcaacctccacctcctgggttcaagctattctcctgcctcagcctcccgagtagctgggattacaggcacctaccaccatgcctggctaatttttttgtatttttagtagagacagggtttcaccatgttggccaggctggactcaaactcctgacctcaggtgatccacctgcctcgatctcccaaagtgctaggattacaggtgtgagccactgtgcccagccccagagctcatcttgataggcaacactgaatgtgacatttccagccagcatggacagagaatcctg

SEQ ID NO: 153746 - DNA, 601 bp, Human
tagatacttgtcaaccctcctcaccacctacactggttcccaccctgcacactgtcagacccacacactcgctgacacaccctgctcccagcaggtctagatctcaaggcagcatgcttgtgacttttttctcccttgttatgcttaactttcatttctttgttttctatgtacaaaactccctttgaagtattgcgtcttttgtagcatacatacagctctatctacttgatttgagcagtatcatgatattctgacatagaatattaaagttaatagtgttattttatgcatcccaaacacagatagactataatctctcctactaaaatagacataagtatttatagcttcatactgtggtttggggagagaagattggttataaaactgttcagaaattgttttgatgaatttatttctttcccattgcttgatattaaaatataaatattgactaagctctaatttaacacaattttcactttttctgcagcacctgaaattcttagaggttgtgcctatggacctgaggtggacatgtggtctgtaggaataatcacctacatcttgtaagtgaagaaaagcaatatttatgtaa

SEQ ID NO: 153747 - DNA, 601 bp, Human
ttcccaccctgcacactgtcagacccacacactcgctgacacaccctgctcccagcaggtctagatctcaaggcagcatgcttgtgacttttttctcccttgttatgcttaactttcatttctttgttttctatgtacaaaactccctttgaagtattgcgtcttttgtagcatacatacagctctatctacttgatttgagcagtatcatgatattctgacatagaatattaaagttaatagtgttattttatgcatcccaaacacagatagactataatctctcctactaaaatagacrtaagtatttatagcttcatactgtggtttggggagagaagattggttataaaactgttcagaaattgttttgatgaatttatttctttcccattgcttgatattaaaatataaatattgactaagctctaatttaacacaattttcactttttctgcagcacctgaaattcttagaggttgtgcctatggacctgaggtggacatgtggtctgtaggaataatcacctacatcttgtaagtgaagaaaagcaatatttatgtaaactatttaccttgctgtgacattttctagatacctc

SEQ ID NO: 153748 - DNA, 601 bp, Human
tatttaatttcttaagcaattccaaactggtatatttcttatcaggaatattttaaatgcatttttagctatcaattttgtttcttatttctgttaggttttcaagggtcttaaatttaacaccctacacaaatttcttgggaaaaaaaatgagtgaaatattttaatccctggtatccccacatccattcctgagctcctgtctaataagaaataaggagtttcatgaaatttgccaaagacatggtggaactgcaggtggtgatgaaaaaaatcaaccaaatagaagagcgtctgagawggaagaatactgtagaacaactagaaaataagatatcgatgctttcaagagtttagttcaaaacaaggagacttagttgccatttagagagtactacaaagttagttgttggaatgcataatattccaatttagagaaattttgaagggtttgaaagtaggtatactagtctacctgggcttacataacaaaatatatagactgggtggcttaaataacagaaagttattttctcacagttttcgggggctggaagtccaagaccagagtgtcagcacagtcagcttctgctgagggccc

SEQ ID NO: 153749 - DNA, 601 bp, Human
aaacaaggagacttagttgccatttagagagtactacaaagttagttgttggaatgcataatattccaatttagagaaattttgaagggtttgaaagtaggtatactagtctacctgggcttacataacaaaatatatagactgggtggcttaaataacagaaagttattttctcacagttttcgggggctggaagtccaagaccagagtgtcagcacagtcagcttctgctgagggccctctcttggcttgcagatggccgccctctcacggtgtcctcacatgatggggagaaggagaragcaagctctgtgtactcttttcttatgaggggactaatcccatgaggaagaccccactctcatgacctcatctaaacctgattgcctcccaagggctccatctccaaatactatctcattgggagctggggcatcaacatatggattttggggttggaggggggaatacaattcagtccgtagcagaatgcttttaattaaagttgtttttaacttaatagtgatcttaaaaaattcaatatccaggtgatatggactaggaatgggctaactgtggtagggcccacaagcacgttagc

SEQ ID NO: 153750 - DNA, 601 bp, Human
atccattttgttaatgcttcctgggaaagtaaatcttacaatgaagctacgttataagcttcagtcagattctttcttctgtcttccaaatgttgaggcatttgctttactgatacttgtctgtatgtacataaactctggggctgtttttttttaataaagccatgaatagacattggattcttcctatcagtgtaaagaattctgttacctcttttgtccctcttcttgtggctactgctgcattttaacttcactctttgcttctttgtgtgtgtgtgtgtgtgtgtgtgtgtgtttttgtgtgtgtgtgtgtgtgtgttttgagatgaagtcttgctctgtctcccaggctagagtgcagtggcgtgatctcggctcactgcaacctccgccttgggttcaagcaattcttctgctccagccccccgagtacctgggattacaagcacgtgccaccatgcccagctaattttttgtatttttagtagagatggggtttcaccatgctggccagcctggtctcaaactcctgacctcctgttccacctgcctcagcctcccaaagtgctgggattacaggtgtgacccaccgcgcatg

SEQ ID NO: 153751 - DNA, 601 bp, Human
ataggtttctagtgttgtggagagcagggcagggcaggcaaggtcagactctctcgttgtcagggtgaggacatgtgccctgtctcaccttaggctgctcttccacaggtgggtcaggagcgggattctctgtgcagactgctcagtagggaaagggagaacacattggcccaggcgtctgcactgtcaggccttgcatttttctcactggctccagaatatctggaagagacaaacattctcccagtgggacattctgtgagtaaaaggacatacgaaactgcttctttctaaaaactcwctgtattaggatgcactttaatttttcatgctatgtaccaacctggccagcttgagtgaagcctttgggaaaatgtcttttattcatcctccctcccaccctcattttttttcaaatggaacacatgcaacacatgccctgccatgggcttttttaagcagttccctcttggtccctactgattttagaacttccacccgtctgtaaacagtggatgcttggtggtcacaaacaactcgcttttcctttctctcttgttaagatgcccaagatagttctccgtcccttttatcccacttt

SEQ ID NO: 153752 - DNA, 601 bp, Human
agttgactccatagtagaaaatgatacaaagaatgaggtaaattgagggtgctcatctctttggctgcatctggtgactatattaatcttatacattttttaaggtcattgcctgacaatagtttcagcttctgtctttgttcactctgaaatccaaactggaatggaatggaaatgtcataaagctttactcatttctatggaggatttcatagaatagggcagaataaaaataagtgaaaatttctaatttccactttttaatttctttactctcaaaatcccagctcttccctttcayactaaattggaagtctattcaatctctgtctgcctgtctgtctgtcttctcaatacctgtcaaaaaatccatggaaaggctttagcataatgtctataatgttagctattattattattgttcttctgtgtaataagaattataataataattattattacacaataattataattattattatagctttttgtagaaatcctaagttggttttatattaattcctacttcctgaggacttgattgtgtgtttacactataaatagtgaattgtaataaggcagttgcatacttaagctg

SEQ ID NO: 153753 - DNA, 601 bp, Human
tgaggtaaattgagggtgctcatctctttggctgcatctggtgactatattaatcttatacattttttaaggtcattgcctgacaatagtttcagcttctgtctttgttcactctgaaatccaaactggaatggaatggaaatgtcataaagctttactcatttctatggaggatttcatagaatagggcagaataaaaataagtgaaaatttctaatttccactttttaatttctttactctcaaaatcccagctcttccctttcacactaaattggaagtctattcaatctctgtctgsctgtctgtctgtcttctcaatacctgtcaaaaaatccatggaaaggctttagcataatgtctataatgttagctattattattattgttcttctgtgtaataagaattataataataattattattacacaataattataattattattatagctttttgtagaaatcctaagttggttttatattaattcctacttcctgaggacttgattgtgtgtttacactataaatagtgaattgtaataaggcagttgcatacttaagctgagtagacttgcttccatggcaggaagcagtgaa

SEQ ID NO: 153754 - DNA, 601 bp, Human
tgtttgtttgtttttacattgcttctcacttaagttaatattgacatttgtttgcattcaggaaatccataccttctggggaggtcactcacctcttataaaataaagaggatgctaacatgagattgaaacatttctcatcaatccactagagaacaaccacacagacataatcaaaagctgacttttgaatcatagaaggttagatatagaagaggtcttaggaggcatctagtcctcctctcattttaaagatgagaatgctaaagaccagagaggtgaaatgactgctaaggtcacrcagcttcccagcagaaagacattattagggctgatccagtcgtccagactccctttcctgtgctcttttttcttcaagcatttcttccttaccctctgtgttccttcatggaacagattccctaaggctcatggcttttccagcatgagtgggaagagaaagtcagtgtgtgtgatgtgtgatgtataaatatgtcattgcaactccttcctcaagtcataccccatgctcctaaacacctcttgaatccatccagttctctcccccggaccactgccccaacctcctatctgacctccc

SEQ ID NO: 153755 - DNA, 601 bp, Human
cttcatctaatactattatctatttcttaaggcaccagggaaaatcctgctttgaaactccaataaggctgacacaaagctacttaagttttcttatactctcataaggaatatatgattaataaagggaaatttgttatataagttgatatttacatatcaaatatattattgctgcttctcatctaattaaagtatactgcttaaacagcattgttcagggaaaactgatatttattcagaaagttgttttctttcagaatatgtaaaacttggtaaacaatttttgaaactatatttmctaatatagataaataattacttgacaaaaatttaaaaatttaagtgatataataaattacttaactaaatatatcattttatatagtacctatcgaatagagattaggagcttttctattacataactgtgtttaggactagctatgtaagtagaggatctcagagagcagctgggggtcagaattagggtcctatgcagccattgcttacggtctgatacagactaaataaatctgaaaggctccatggtcaaattaattataaataccccaaattaaatagtattgacttcacctag

SEQ ID NO: 153756 - DNA, 601 bp, Human
ccgctcacccggggccccagggtgcgggctgcatccccgcagcgtagagacatttcctctttaggactagcgcagtgcaggggttgagggatcgctaactcccgggaaaggacaggtcgaaattacgtcgctccatttatgacaagcagccaagctgctccacgattggctgctttagccttacgtgcgtcgcgcactcatgacgcaatacgcaggccccttacgcgatacaagtacgtaatgacgacagacgttctttctttgctgcgtctactgcgaggtaaggatgtttctgtgctcstgggggtactgggaatctgaaaccatctgctctgggaaaggctgcggcgcggctcccactctcggaaccttgtcctgtttgtcccccagctcggcaagcgccatatgagcctggcggcgccagatgcgaatcctgttgtgggctttttggcctattcccgcccctcagtcttgccgggatggcaccgcccgcataggacttccagggttgggctgagtgggagttcgactgctgggcctcgtaattctcgctttggggctgctccttccaggctgggacacactggggcccgctgtcggt

SEQ ID NO: 153757 - DNA, 601 bp, Human
atgacaagcagccaagctgctccacgattggctgctttagccttacgtgcgtcgcgcactcatgacgcaatacgcaggccccttacgcgatacaagtacgtaatgacgacagacgttctttctttgctgcgtctactgcgaggtaaggatgtttctgtgctcgtgggggtactgggaatctgaaaccatctgctctgggaaaggctgcggcgcggctcccactctcggaaccttgtcctgtttgtcccccagctcggcaagcgccatatgagcctggcggcgccagatgcgaatcctgttstgggctttttggcctattcccgcccctcagtcttgccgggatggcaccgcccgcataggacttccagggttgggctgagtgggagttcgactgctgggcctcgtaattctcgctttggggctgctccttccaggctgggacacactggggcccgctgtcggtctcccgtcctccgacatcttgtctggaacttccgcctggcagtctccagtaggagtggagctctgtgcggcgtagtttggtggaaaaacgggccttgcgtcggcctcacccccagtgtttgtgtttcagaatgaagac

SEQ ID NO: 153758 - DNA, 601 bp, Human
agaaaggaactggctaccgttcggactatttgtagtcatgtacagaacatgatcaagggtgttacactggtaagcagatgtatcagacttccttgttttggaaagggaggtttctcaaacctgtgctttatacagcgtaagtgtctctttcagagaatgggtcatgtattttatttggtgtaatacgcaagaacttggcaaaaataggcatctgtgggtctttaagcgatagagctgagagcaaagaccagatgggtacaacatgtttgtttttttctgttgttgggttttttttttttttaatcaaggctggggtctcgctattttgtccaggctgagctcaagtgatcctcccaccttggcctcccatagtactgggattgcaggcatgagccaccatgcatggctagatgggtacaacttttaaaaagtaggctaatgatgaattttcataccttccgaattctttaagataggaaatctacagttgcagtactagttggtagtcaaatctcaccatcaggaccccttgttgggatagaaaaagatgtagtttctgagttttctgtctgctgccataatgtatgtcattattctttcc

SEQ ID NO: 153759 - DNA, 601 bp, Human
caggcatgagccaccatgcatggctagatgggtacaacttttaaaaagtaggctaatgatgaattttcataccttccgaattctttaagataggaaatctacagttgcagtactagttggtagtcaaatctcaccatcaggaccccttgttgggatagaaaaagatgtagtttctgagttttctgtctgctgccataatgtatgtcattattctttccaacccaccgtctctcccctcaagataaaaagttcatgctgaaatggttttctttgcattataccttctagaatgcacctgatratggcaccctgtacatctattataaatctgttaagattcccccatctacccttgctcttagccttaagttccttgaaggcagggggcctgcctttggcttggtggtctcaattcctgccatgtgctgtaccttagtaactcagtaaatgttagtctaatgtctaagatcagggctttggggttctcattaaaagaaggcagcattgttcattgagggcataagagctagtgaaataaagcctccgcaaggagctttacagtccactgaatagacagaacaatgtttataaggcttggttc

SEQ ID NO: 153760 - DNA, 601 bp, Human
actgtttcgccacgttgcccaggctgatttcaaggaatgctatggtgcctggccccagctaatttttaaattttttgtagaggcagggtcttgctatgttgtccaggctggtcttgaacttgcaggctcaagcagttcttcccccttggcctcttaaaacatacctggctcggcctcttgatgcattttgattccattggggtggggaggggtgggaagaagggagattcttagtatcaaaataatggctgtccagaaatactctgatactagctatggtcagcaacatttaatgaaaacscttatgttaaaaataaacccctgcctcctggcttcaagcgattctcctgcctcagcctcctgagtagctgggagtataggcacgtaccaccacacccagctaattttttgtatttttactagagatgggtttcacagtgttagccaggatggtttcgatctcctgacctcatgatccgcccgcctcggcctcccaaagtgctgagattacaggcgtgagccactgtgcccggcctcaaaatcttaagaaaaggttcttttggtgcatggagttttacatggaataaattagtgcctctgc

SEQ ID NO: 153761 - DNA, 601 bp, Human
cggcctcaaaatcttaagaaaaggttcttttggtgcatggagttttacatggaataaattagtgcctctgcaatttaaatattttttacacagatttgatgctgtgcaaatgccctctccccttttaggtgttgcttgttcagtatctcaagcccagaaagatgaattaatccttgaaggaaatgacattgagcttgtttcaaattcaggtttgtatgtttactatgtctaactatgcctacaagattttgtctaaatcttgtttaaaatacagtattttgctaatttttatttgattagytttttaaattgtgaaaataaaaaggtcacattctgaaattttaagtacagcacataatgaaatactttctttttaagatgggttaggctgatgtattaattgctttatcttcactcctatagcggctttgattcagcaagccacaacagttaaaaacaaggatatcaggaaatttttggatggtatctatgtctctgaaaaaggaactgttcagcaggctgatgaataagatctaagaggtaagttcttacagtgtcttaagttttattactgctctagttgaatgaagctcttaattta

SEQ ID NO: 153762 - DNA, 601 bp, Human
tctggccgctggggataccctggcctgatggagagggtctaagaccttcccgtcttctccggacacgggaaaacattacccctctctctttattcgctatgctgagtggcagggagggtgccccgctcctggtccccttttttatccccagcccttgaacttttccggactgacctatgtttcttgccagctgagggaagcggcggactacgatcctttcctgctcttcagcgccaacctgaagcgggagctggctggggagcagccgtaccgccgcgctctgcgtgagtcgaggctgccsggctcgcgggcgcccgggacgcggggaaggtgggactctgtgcggggggcagagggctcgcggacatctcggggaaggggctggccggaaccgccaggggcgcggtccccttagctaaggatcggtccgcggaggcgcgccaggagcgggagagggtggcgcgcccggggcgcaggaacccagcgcagcctaggctggaagtcggggcgctgggcactacagagcccgggaatggggcgcgcggagagcggccgcccgaggacggcgctgcggcggctgcagcccgggacttattgcccc

SEQ ID NO: 153763 - DNA, 601 bp, Human
ccagccaacctagccggagggcggcacgggagggttggaaagggctggggcgctgcacccagcgtggggctgctgagcgtaggtagccagtggcacttcttagacacttcgctggtgcccgagtcggagaggcgcgttcgaggacccccacacggcgagaatctcgcccttacccgaagacctcgacccacacacatccagtggggctggggccggtgcctctggacgctgccatggtttaaattcccttctgggcgctttcgaggccctaggaacttctaaagacttgaactcgcagcgyggaactctgacgcaatccagggccgaggaaaaatgattaaaacccaacaagctcgagtgctggggtccaccaagcgggccgtcttggttagaaggcccgccccacacgtctcacatctgagcccgcctcgctcctgctggtccacgctcggcagagccgttccgagagcacagaggctgtcttcagtgcgcgggtgacccgattttggagcagtaggggactggctgccgagggggcatctagattgagataggtgggagggcaggacaagacccctaagctcactgcctcctcgattcc

SEQ ID NO: 153764 - DNA, 601 bp, Human
ctagccggagggcggcacgggagggttggaaagggctggggcgctgcacccagcgtggggctgctgagcgtaggtagccagtggcacttcttagacacttcgctggtgcccgagtcggagaggcgcgttcgaggacccccacacggcgagaatctcgcccttacccgaagacctcgacccacacacatccagtggggctggggccggtgcctctggacgctgccatggtttaaattcccttctgggcgctttcgaggccctaggaacttctaaagacttgaactcgcagcgcggaactcttacgcaatccagggccgaggaaaaatgattaaaacccaacaagctcgagtgctggggtccaccaagcgggccgtcttggttagaaggcccgccccacacgtctcacatctgagcccgcctcgctcctgctggtccacgctcggcagagccgttccgagagcacagaggctgtcttcagtgcgcgggtgacccgattttggagcagtaggggactggctgccgagggggcatctagattgagataggtgggagggcaggacaagacccctaagctcactgcctcctcgattccagtcgtcag

SEQ ID NO: 153765 - DNA, 601 bp, Human
gctgcacccagcgtggggctgctgagcgtaggtagccagtggcacttcttagacacttcgctggtgcccgagtcggagaggcgcgttcgaggacccccacacggcgagaatctcgcccttacccgaagacctcgacccacacacatccagtggggctggggccggtgcctctggacgctgccatggtttaaattcccttctgggcgctttcgaggccctaggaacttctaaagacttgaactcgcagcgcggaactctgacgcaatccagggccgaggaaaaatgattaaaacccaacaarctcgagtgctggggtccaccaagcgggccgtcttggttagaaggcccgccccacacgtctcacatctgagcccgcctcgctcctgctggtccacgctcggcagagccgttccgagagcacagaggctgtcttcagtgcgcgggtgacccgattttggagcagtaggggactggctgccgagggggcatctagattgagataggtgggagggcaggacaagacccctaagctcactgcctcctcgattccagtcgtcagactccataagtataacagggcagcatgggatggctgatggag

SEQ ID NO: 153766 - DNA, 601 bp, Human
tgctgagcgtaggtagccagtggcacttcttagacacttcgctggtgcccgagtcggagaggcgcgttcgaggacccccacacggcgagaatctcgcccttacccgaagacctcgacccacacacatccagtggggctggggccggtgcctctggacgctgccatggtttaaattcccttctgggcgctttcgaggccctaggaacttctaaagacttgaactcgcagcgcggaactctgacgcaatccagggccgaggaaaaatgattaaaacccaacaagctcgagtgctggggtccaycaagcgggccgtcttggttagaaggcccgccccacacgtctcacatctgagcccgcctcgctcctgctggtccacgctcggcagagccgttccgagagcacagaggctgtcttcagtgcgcgggtgacccgattttggagcagtaggggactggctgccgagggggcatctagattgagataggtgggagggcaggacaagacccctaagctcactgcctcctcgattccagtcgtcagactccataagtataacagggcagcatgggatggctgatggagctctactgtccaattaaaa

SEQ ID NO: 153767 - DNA, 601 bp, Human
tcgaggccctaggaacttctaaagacttgaactcgcagcgcggaactctgacgcaatccagggccgaggaaaaatgattaaaacccaacaagctcgagtgctggggtccaccaagcgggccgtcttggttagaaggcccgccccacacgtctcacatctgagcccgcctcgctcctgctggtccacgctcggcagagccgttccgagagcacagaggctgtcttcagtgcgcgggtgacccgattttggagcagtaggggactggctgccgagggggcatctagattgagataggtgggarggcaggacaagacccctaagctcactgcctcctcgattccagtcgtcagactccataagtataacagggcagcatgggatggctgatggagctctactgtccaattaaaataatcatgattaacatctccaaagtaggattattttggaacctgtcacatgcgttagaaataatttgtagctgggttgttggtaattttgctaatgtggactagattggactcgttaaactggagacctgtggtgattttgagggtcaagtcaatagactctgaccctttgttcaactgcaaactttaac

SEQ ID NO: 153768 - DNA, 601 bp, Human
gctgagcggtacatagatttctgtgagagtggtcttagcaggaggagcatcagatcttcccagaatgtggccatgatcttcttccgagtccatgaaccaggaaatggattcacattaaccataaagacagaccccaacctctttcgtaagtgttctcagtcaaaaggcagaacttcggatatagacccgctttttgaaagtagtatcattgcacagacttaaagaaatttgaactgaggaatgatttgaatggaaatttttttgtaattagaaatgacctaaaggatagtttctattcttyattatgaaaatcaaatcacagtttttaatttatttcccaggttaggtagtatactaatttatgaagagtacaattctatcttttctccaaagtcttgctctgagcttctcaggttctacaatgcatttagtgataagctttaatcttccaagtcatttcactaatccaggataagcttgagtgatcagatataaagttgcagtcttagagatattcaggcacaggcttgaaagtctccatgtctttcagcctgtgcctgaatgtggtagaccgatgtcatgccctgaccagagggttgga

SEQ ID NO: 153769 - DNA, 601 bp, Human
tccccacctgcccctgctcattagtgaagcagttgccattatgttattttccaatttgctgtttagttccagttgtattccaatgctcttctgtgtttttttgtttgttttgttttgttttgttttttcggagacagagtctcactctgtcgcccaggctggagtgcagtgacgtgatcttggctcactgcaacctctgcctcccaggttcaagtgattctcccacctcagcttcccgagtagctgggactacaggtgtgtgccaccgcgcttggctaatttttgtatttttagtggagayggggtttcaccgtgttggccaggctggtctcgaactcctgacctcaaatgatccacctgccttggcctcccaaagtgctggaattacaggcgtgagccaccatgctggtcagtgcccttctaaatgcctgaatgtgtgtgcttatgtgtgtgtgtgggtgtgtgtgtgtattaagttctctattttagattttggttcctatgtgttaaggtctatctagtgaagtactgagcaccttgtcacattctactagatctcttaatgagcacacttcaatgaaaaagaggatcacaggcaaaa

SEQ ID NO: 153770 - DNA, 601 bp, Human
ggcactggctttttgtggctgcacaggtggcatacttgtgagactgccctggggagatgggggctcagagtacttttgggactaagagtggttgctttgtttgtgttggaaagtgaggcacggggattgctatggacaagacagtgtggaaaaaatgaaaaggctgggtgaggtggctcacacctgtaatcccagcattttgggagtccgaggcaggaggatcccttgaggttaggagttcaagaccggcctgggcaacatatcaaggacccatctctacaaaattgaaaaaaaaaaaaargggggaagcaggaaaaggtgatcatggtggaccacacaaagctttagaatgaattcttttgagtagcttgaaataaatttgttttagttgaaaggagaaagatcatggtaactgtagctaacttgggccccaaatcagggttttattatttctttaacatactcataattaatcaaaattcttattgttagaaatgaggtgttccaatagcacacaaatttcctttacaaagaagaagaaaagagatgaggtgaaggaaaaacggatgtgaaagccctatttataaaatgtaggtatttg

SEQ ID NO: 153771 - DNA, 601 bp, Human
tggtattgccaggatgttgagggctgattgagtgaattcatggacccgctgttggtcaaatggtttgacttctgtaattggtttaaatgtgtctttctctgctgctttattcccttagaaatcctcagcaggttgcgagggaataggagactttgtggagctgctgggaggaactggattggacccttccaagatgacgcctttagctgatctctgctacccctttcatggcccgggtgaggtatttctttgattgttatgtatgtgcctatcaagattaaaaaaaaataagcactccccyaatattttctacattggaaggtgagtttcgccaaaaaagccttcaatttttcacactgagccagtatgaggatttgaggctatatataacatcagtatctttaccaaaatatccgacactgggagagaaacctttgaagcaataaaggttggccttaagtaaaactatgaaaaagacaaagcttttaaaatctgcattctttccattttcttgggggtctctgctttcattttctagagactaaagagtttactaactgaaacacttatggttcaaatagtagatgtatcatcaattagt

SEQ ID NO: 153772 - DNA, 601 bp, Human
tctctctgcctggtgtttcaatactcctgtctctgaatgttaaatgttcagctgcatatgatttttttctgattgattgtctcaggtgtttaatgaagactgcctttgtaaatcacatgttgttatcctctatttctagctattgtggacgatgaaaggctctctgcagaggagatggatgagaggaggcggcagaacattgcttatgaatatctgtgccacttagaggaagccaaaaggtaagatccagacttagtctatttgtgcaccatctcttggagataagctttgtgataagggygtgggatttgatgaccagagggttctgaaatgggccagcaattctaaagagttgtcgtagttggagatggccagggagagattcttgcctgcactcagtgatttagatttggccaaacctcccatgccaggaggccagtgggctaggggatgacccctccacactctgctccactcctgagtcacagctgggtgcacatcacactcctgtgcatatgctacatagttctaataactcatttgcagtcttgttggcagcaggataatgggagaagaagcatctatttcttgcaaatggttg

SEQ ID NO: 153773 - DNA, 601 bp, Human
ttcttgcaaatggttgggcagagttgagaaaaagttgatgccacagccaaagttgaggcactaggaggaaggcaactattcatttccctgcctcggagcctcccaggaaatcacggggccaactgcagattgtttcaaattcttcatctcactggcttggatgtagaggagcaacaatgacttaaatcaacttcctttttccgcagagcttccttgggtcttttccccactcgcagcccaatgatgataaatgcccagcaggacagtggcatatcagactgaagtccatcagtccctaagyaggtttatgacagcaatctcctctttaaaccgtgggtgtgtggccacttagggtatattgtctctaaaatcacattgactcttttaggctttttagattaaataaatgttgcgttctccaaggagaaagtgaagataaagagtcctaagtgcaaatactttcctcatgagaggaattgagagaactttatcctttgtggggtgaatactacagagttcatataccatgagttagagtttgattgaatgctttatgccagggtggagcgacagtattgttccctggacaaagatatgttcc

SEQ ID NO: 153774 - DNA, 601 bp, Human
atgacttaaatcaacttcctttttccgcagagcttccttgggtcttttccccactcgcagcccaatgatgataaatgcccagcaggacagtggcatatcagactgaagtccatcagtccctaagtaggtttatgacagcaatctcctctttaaaccgtgggtgtgtggccacttagggtatattgtctctaaaatcacattgactcttttaggctttttagattaaataaatgttgcgttctccaaggagaaagtgaagataaagagtcctaagtgcaaatactttcctcatgagaggaaytgagagaactttatcctttgtggggtgaatactacagagttcatataccatgagttagagtttgattgaatgctttatgccagggtggagcgacagtattgttccctggacaaagatatgttccagccctcttagctatatagaaataaatacttggttaaatggtcactggtgttaattatctctgatcactgatgaatggctatctacagaactagaatgatgaggtttttaatcagtattttggtgacacatgccctaatttgacatcaaaattgctttcaaggggtttctcagagt

SEQ ID NO: 153775 - DNA, 601 bp, Human
accactcctgaggctaaggtgggaggatcacttgagcctgggaggtggaggctgcagtgagctgagatcgggctgctgcactccagcctgggtggcagagtgagacgctgtctttaaaaaaaaaaaaaaaaaaaggaaaagaaagaaagaaaaagaaaagaaaaaatatactttcagtgaataagttcaaggagatagtagaaaaacttacttttctattgatactcactttacattctgtttttgcctcctgtttttaacaagtgggaaggggtgtcatgtagaggaaaatgatatgtgrttgggagttggtttgcctaacttcctggtcccagctccaccacttacacaagcagcttgaccttccacagaccattttacctgtgggaagttcaatttgtcccctctgtaaatgagacaatcaagatgatgttacttattgccctacttattcatggattcaaggatttttaaaaaatcatttaaagaaggtgaaagtattctgtaagctatagtgccagtcaggtttatggtgataacataagcaaagttttctcctcagtatattgaaatggtataaatgtagcttgaaagcttgtca

SEQ ID NO: 153776 - DNA, 601 bp, Human
aaatactttttttcttttttctttttctttttttttttctgagatggagtctcactctgtcgcccaggctagactgcagtggcgggatctcagctcactgcaacctctgcctcctgggttcaagtgattctcctgcctcagcctcccaagcagctgagattacaggcgctcaccactacacctggctaatttttgtatttttagtagagatggagtttcaccatgttagccaggctggtctcgaactcctgacctcaagtgatccgcccacctcggctcccaaagtgctgggatgacaggygtgagccactcactgtactcggccaagacacaaatactttgaaagaagctgatttttggtcatggattatataaaaatttgtggctactactagacatatagttgtgctgatttaagaaagcatagtgcacagaaaactcatggtcttgaatgcaagaaatacaggaaagggtgaatttgtctttcttgaaaagatgagaggatttattgcatgattcttttgaagtattagtacctttggaatttgtgatattgggtttattataatgcacatatgtgtgttcacatgaatggagttga

SEQ ID NO: 153777 - DNA, 601 bp, Human
ctcaagtgatccgcccacctcggctcccaaagtgctgggatgacaggcgtgagccactcactgtactcggccaagacacaaatactttgaaagaagctgatttttggtcatggattatataaaaatttgtggctactactagacatatagttgtgctgatttaagaaagcatagtgcacagaaaactcatggtcttgaatgcaagaaatacaggaaagggtgaatttgtctttcttgaaaagatgagaggatttattgcatgattcttttgaagtattagtacctttggaatttgtgataytgggtttattataatgcacatatgtgtgttcacatgaatggagttgacttagaatattgagtttctactaaattgtatgcttgtactgtatatattcatctaggaagtgtttcttgtttctgatttcagttgaaatgactttattgcattttaattaaaaatgtattggttctgtctttgcacctgtttttctttctggaggtgagaattggaaggtatctagtttgtatatcctgtaacttaagatttttacaaattgagaattataatattccagtatatctttaattttggttttat

SEQ ID NO: 153778 - DNA, 601 bp, Human
atattgagtttctactaaattgtatgcttgtactgtatatattcatctaggaagtgtttcttgtttctgatttcagttgaaatgactttattgcattttaattaaaaatgtattggttctgtctttgcacctgtttttctttctggaggtgagaattggaaggtatctagtttgtatatcctgtaacttaagatttttacaaattgagaattataatattccagtatatctttaattttggttttattaatttcaaaattctataataaatcaggccattgaaaagttctttattcagagrggacatcactaccaacattacagaaatacaaaggattataaaggaatactatgaacaattacatgccaatgaaaacttagaggaaattgacaaattcctagaatgacaagctactaaaactgactcaataagagacttaaacatctgaaaaaaactaatataaacagaatgagacttataataagtgaagagcctgacttagaaatcagaaaacttcccacaaacccagataacttcacagtagaattctgccaaatgtttaaagaagaattaagagcagtccttgcaaactcttccaaa

SEQ ID NO: 153779 - DNA, 601 bp, Human
agccatatgatcatctcaatatatgcaggagaagcatttggtaaaatccagccccctttcttgacttaaaacgttcaacaaactaggaatagaagagaatttcaacctgataaaggacatctatgaaaaacctacaagtaacaccatactcagtggtgaaatacaggaataaggatgttttttcttaccacttctgtttaacattgtactggagattttagccaggcagttaggcaagaaaaataagcaaaaggcatccaggttagaaaggaagacgtgaaactatttctaagggatgttwtctggtttatagaaaatccataggaatctactaaaaaacagaacaggagaaaacactaagaaaaccccaccacaatgagtccatcatggttgtaggatactaggggagtgtgtaaaaatggcatttcttgacacgagcaataagcaatctgaaaatgaaattaagaaagcaattcactatatgatagcattaaaaacaataaaattcttaggaataaaattaacaaaagaagtacaagaattgaacactgaaaactacaacacattgaaaattttaaaactcttaaatagacagaaagac

SEQ ID NO: 153780 - DNA, 601 bp, Human
ccagccccctttcttgacttaaaacgttcaacaaactaggaatagaagagaatttcaacctgataaaggacatctatgaaaaacctacaagtaacaccatactcagtggtgaaatacaggaataaggatgttttttcttaccacttctgtttaacattgtactggagattttagccaggcagttaggcaagaaaaataagcaaaaggcatccaggttagaaaggaagacgtgaaactatttctaagggatgttttctggtttatagaaaatccataggaatctactaaaaaacagaacagragaaaacactaagaaaaccccaccacaatgagtccatcatggttgtaggatactaggggagtgtgtaaaaatggcatttcttgacacgagcaataagcaatctgaaaatgaaattaagaaagcaattcactatatgatagcattaaaaacaataaaattcttaggaataaaattaacaaaagaagtacaagaattgaacactgaaaactacaacacattgaaaattttaaaactcttaaatagacagaaagacatctcatgttcatggattggaaaatagcattaagaaaacaatggtcc

SEQ ID NO: 153781 - DNA, 601 bp, Human
actcagtggtgaaatacaggaataaggatgttttttcttaccacttctgtttaacattgtactggagattttagccaggcagttaggcaagaaaaataagcaaaaggcatccaggttagaaaggaagacgtgaaactatttctaagggatgttttctggtttatagaaaatccataggaatctactaaaaaacagaacaggagaaaacactaagaaaaccccaccacaatgagtccatcatggttgtaggatactaggggagtgtgtaaaaatggcatttcttgacacgagcaataagcartctgaaaatgaaattaagaaagcaattcactatatgatagcattaaaaacaataaaattcttaggaataaaattaacaaaagaagtacaagaattgaacactgaaaactacaacacattgaaaattttaaaactcttaaatagacagaaagacatctcatgttcatggattggaaaatagcattaagaaaacaatggtcccaaattgatttatagattcaatacagtttctagaaatattcccagctgccttctttttttttaaatggagaaattagaaagctgattctaaaatttatat

SEQ ID NO: 153782 - DNA, 601 bp, Human
ggatgttttctggtttatagaaaatccataggaatctactaaaaaacagaacaggagaaaacactaagaaaaccccaccacaatgagtccatcatggttgtaggatactaggggagtgtgtaaaaatggcatttcttgacacgagcaataagcaatctgaaaatgaaattaagaaagcaattcactatatgatagcattaaaaacaataaaattcttaggaataaaattaacaaaagaagtacaagaattgaacactgaaaactacaacacattgaaaattttaaaactcttaaatagacrgaaagacatctcatgttcatggattggaaaatagcattaagaaaacaatggtcccaaattgatttatagattcaatacagtttctagaaatattcccagctgccttctttttttttaaatggagaaattagaaagctgattctaaaatttatatggtggccaggtctggtggcttgtgcttatcttccagcactttgggaggctgagatgggagtattgcttgaggccaggagtttgagaccagcctaggtaatgtagcgaaaccctgtctctgcaaaaaaaaaaatttttgaattagct

SEQ ID NO: 153783 - DNA, 601 bp, Human
aaacaataaaattcttaggaataaaattaacaaaagaagtacaagaattgaacactgaaaactacaacacattgaaaattttaaaactcttaaatagacagaaagacatctcatgttcatggattggaaaatagcattaagaaaacaatggtcccaaattgatttatagattcaatacagtttctagaaatattcccagctgccttctttttttttaaatggagaaattagaaagctgattctaaaatttatatggtggccaggtctggtggcttgtgcttatcttccagcactttgggargctgagatgggagtattgcttgaggccaggagtttgagaccagcctaggtaatgtagcgaaaccctgtctctgcaaaaaaaaaaatttttgaattagctagatgtggtggcatgcaccagtagacctagctactctggaggctgaggcgtgaagatcactcaggaggctgaggatgcagtgagttacgatcacaccactgcactccaggctggatgacagagcaagaccttgtctcaaaaacaagaacaaaaataaagtttatatggagatgcaaggaatgcagaatagtcaaaagtgtc

SEQ ID NO: 153784 - DNA, 601 bp, Human
actcttaaatagacagaaagacatctcatgttcatggattggaaaatagcattaagaaaacaatggtcccaaattgatttatagattcaatacagtttctagaaatattcccagctgccttctttttttttaaatggagaaattagaaagctgattctaaaatttatatggtggccaggtctggtggcttgtgcttatcttccagcactttgggaggctgagatgggagtattgcttgaggccaggagtttgagaccagcctaggtaatgtagcgaaaccctgtctctgcaaaaaaaaaawtttttgaattagctagatgtggtggcatgcaccagtagacctagctactctggaggctgaggcgtgaagatcactcaggaggctgaggatgcagtgagttacgatcacaccactgcactccaggctggatgacagagcaagaccttgtctcaaaaacaagaacaaaaataaagtttatatggagatgcaaggaatgcagaatagtcaaaagtgtcttgaaaaagaaacgcaaagttggaggactcatttttcaatttcaaaacgtacttacaaagcccacagtaattgagacagtatggt

SEQ ID NO: 153785 - DNA, 601 bp, Human
aaatggtgcagctactttagaaaatagtctggcagctctttaaaaaattaaacagagttaccatatgacccagcaattatcctcccaggtatatacgaatgaaaattgaaaatctatgcccatacaaaaacttgtactcgaatgttcacagaatcattattcataatgacaaaaagcagaaacaatccaaatgtctacccactgataaacggtgatgtatccatacaatgaaatatttctcagctataaaaaagaatgaagtactgatacatactacaacatggatgaaccttaaaaacaygttgagtgaaagaagctagacacaaaaggccacatattatatgaaatgtccagaatagacaaatccacagagacaaagtagattagtgattgccagggcctaggggaagaagagaaatgctgggtaactgctactgggtatgggatttctttttgggctgataaaaatattctaaaattgattgtggtgatggttgcacaactttgagtatactaagaaccactgagttgtttactttaaaagggagaattgtatggtatataagttgtatctcaataaagctatttattaaagataatt

SEQ ID NO: 153786 - DNA, 601 bp, Human
cgacaggtttgtgacccagtaagttatgaagctgggaattccagacaacttaataagccgtgataccacagtgaactagaaaatatccagaaaggcgtatagagtattgctcaatgaatgaatgaagagagaaagaggaagcctgtgtattaggaggacttaaggctgaaattattgctcaaactttataaaattatgaagtctttacgtatagatgttaagactcaaaaaatgaattttttttttttttgagacgtagtgtcactctgttgcccaagctggaatgcagtgcagtggtgcratctcggctcaccgtaacctccacctcctgggttcaaacgattatttctcctgcctcagcctcccaagtagctaggattacagaagtatgccaccatgtctggctaatttttatattgttgtagagacaggatctcaccatgttggccaggctggtctcaaactcttggcctcaagtgatccgcctgcattggcctccaaaagtgctgggattacaggcatgagccaccgctcctggcctcaaaaaactaatattgatggcaatgaacaaaatattaaacaggcttttttttttagggcc

SEQ ID NO: 153787 - DNA, 601 bp, Human
atgtattagttgcctatgactatataacaagttattctaaaacttagtagcttaaaacaataaacatttatctcggaatttttgagggtcagaaatctgtcattgcttaactgggtcctctggttttgggtctctcacaaagctgcagtcatctcacagttcacgtggggcacacccacttccaagccacccagtgacactggcaggattcagtttctgacaggtttttggactggagatctcagttccttgctgctgttggccagagtcttccctcagttgctcaccacttgggcctctkacacatggaaacttacacatggcaactggtttccatcagagtaggcaactgagagaagaagatggaagctagtctttttgtaacctattcttagcaatgacacccatcatttatgctgtatcctattcattagaatcgagttactaagtcaaggccatgctcaaggggaggagttttccacaaggggttgaattcagagggatggggatgactggggcaccaccttagaagctgcctttcacagggtgtcttcataggcttttgaaatggaccccagaaagggaatttgaggataaaatt

SEQ ID NO: 153788 - DNA, 601 bp, Human
cctaaaatttattcaaataatgaaaatgaatctgttttaagaaattcagtcttttagtttttaggacaactatgcaaaaatgtacgatggagaattctttttggataaactctaggttgaggaacttaatccaaccggagctattgtgaaggtcagaaaacaggagagggaatcttggcaaggaatggagacggagtttgcaaattgcagcttgagtaaatagttatgaatgggactgctattgtgtctcccaaggaaagttcctgtgatattatattccttttttaaggaaagagaaaaygcacagaaaacttttgctgtgcttcctttttctgtcctacctctgaaaataaactaagcaaaaaaaaaaacaaaaaaaaaacacccttcccttggtgataggcttgtttagaaatattatcttcaaaggtctctttatgtaagccaagccattggctatattggtgagtctgggacagttatatatgtgccctggaaagaaaacaaaacacgggtgtgtttccttttgtgtcagtgtttacaactcagataccaaaagaacaccttgttgattaaatcaagtctcaagctctggccttat

SEQ ID NO: 153789 - DNA, 601 bp, Human
agctattgtgaaggtcagaaaacaggagagggaatcttggcaaggaatggagacggagtttgcaaattgcagcttgagtaaatagttatgaatgggactgctattgtgtctcccaaggaaagttcctgtgatattatattccttttttaaggaaagagaaaatgcacagaaaacttttgctgtgcttcctttttctgtcctacctctgaaaataaactaagcaaaaaaaaaaacaaaaaaaaaacacccttcccttggtgataggcttgtttagaaatattatcttcaaaggtctctttakgtaagccaagccattggctatattggtgagtctgggacagttatatatgtgccctggaaagaaaacaaaacacgggtgtgtttccttttgtgtcagtgtttacaactcagataccaaaagaacaccttgttgattaaatcaagtctcaagctctggccttatctagtggtgagttagagaatcagatttgaaaggagaagtgcttcaaatgtttaagcaagtgaaagccatgagttgcttaacagtcaatattcatgattagtttaaaaaaaaaagagaatcttctgactggggaatact

SEQ ID NO: 153790 - DNA, 601 bp, Human
tgcagcttgagtaaatagttatgaatgggactgctattgtgtctcccaaggaaagttcctgtgatattatattccttttttaaggaaagagaaaatgcacagaaaacttttgctgtgcttcctttttctgtcctacctctgaaaataaactaagcaaaaaaaaaaacaaaaaaaaaacacccttcccttggtgataggcttgtttagaaatattatcttcaaaggtctctttatgtaagccaagccattggctatattggtgagtctgggacagttatatatgtgccctggaaagaaaacraaacacgggtgtgtttccttttgtgtcagtgtttacaactcagataccaaaagaacaccttgttgattaaatcaagtctcaagctctggccttatctagtggtgagttagagaatcagatttgaaaggagaagtgcttcaaatgtttaagcaagtgaaagccatgagttgcttaacagtcaatattcatgattagtttaaaaaaaaaagagaatcttctgactggggaatactttagagaatccagtggatttcctctgcatgcttggacctcactatccttattcctaggacataccca

SEQ ID NO: 153791 - DNA, 601 bp, Human
atagttatgaatgggactgctattgtgtctcccaaggaaagttcctgtgatattatattccttttttaaggaaagagaaaatgcacagaaaacttttgctgtgcttcctttttctgtcctacctctgaaaataaactaagcaaaaaaaaaaacaaaaaaaaaacacccttcccttggtgataggcttgtttagaaatattatcttcaaaggtctctttatgtaagccaagccattggctatattggtgagtctgggacagttatatatgtgccctggaaagaaaacaaaacacgggtgtgwttccttttgtgtcagtgtttacaactcagataccaaaagaacaccttgttgattaaatcaagtctcaagctctggccttatctagtggtgagttagagaatcagatttgaaaggagaagtgcttcaaatgtttaagcaagtgaaagccatgagttgcttaacagtcaatattcatgattagtttaaaaaaaaaagagaatcttctgactggggaatactttagagaatccagtggatttcctctgcatgcttggacctcactatccttattcctaggacatacccatggataagcaatgc

SEQ ID NO: 153792 - DNA, 601 bp, Human
taatgaaatttttaagaattcctaattgcattttcaaaacataaatagttttcatgtttccactgtaactctccatttctcccttccctcccttgttctctccctggctctgacctcacctctgctttccacggggagcaagatgaactgcttggttgttccatgcggcagctggtggggcagagggtgcagtgagctgagagcagggaccccctcgcaagtctggcacctggttgaggggaaggcctgcttggggctgctttccaaccagcttgcctcaggagccctgtgccagcgaggstgagatcagggcctggcacatcccaatggcagggagagagtaacttgtgaggagcccagacttgtccagcgtagcttggcagagttggagaggtggtcttaacagggtgatctccgtggcacaggaatagacgtgatcccagccagccctacctgccaacaagtagtgcttgtagttggggcctcagagaggtgttggtgctgagggccagctggcggtgaccagggattatgctgtggagctagaatggaaggaacacttattaaggatataaaggaaaaagctacaggacttggcagg

SEQ ID NO: 153793 - DNA, 601 bp, Human
aatgaaatttttaagaattcctaattgcattttcaaaacataaatagttttcatgtttccactgtaactctccatttctcccttccctcccttgttctctccctggctctgacctcacctctgctttccacggggagcaagatgaactgcttggttgttccatgcggcagctggtggggcagagggtgcagtgagctgagagcagggaccccctcgcaagtctggcacctggttgaggggaaggcctgcttggggctgctttccaaccagcttgcctcaggagccctgtgccagcgaggcwgagatcagggcctggcacatcccaatggcagggagagagtaacttgtgaggagcccagacttgtccagcgtagcttggcagagttggagaggtggtcttaacagggtgatctccgtggcacaggaatagacgtgatcccagccagccctacctgccaacaagtagtgcttgtagttggggcctcagagaggtgttggtgctgagggccagctggcggtgaccagggattatgctgtggagctagaatggaaggaacacttattaaggatataaaggaaaaagctacaggacttggcaggg

SEQ ID NO: 153794 - DNA, 601 bp, Human
atgttgagtagtaaaagtagaaagctcaataaagaaaaaatataaacatgaatattaaacttatttggtagattcagttcaagtttgcttttggttaaatgctgcaaatggtttgggggaattagccattcatatgttcttgtccttgatctttcatttttgctgagaaacttgaacccattttggtgcaagaacaggaattcaggaattaacatttctagtcatttctgcactctgtactccgtcctacttggcttaatgtccctgggttgcttttttgtttgtttgttttttcccatcrtgtgatttgtaatacacagcttttcctgcccctggtatttctcaaggcaagagttgaggcagctatgtcatctgggagagtgacttagggcagtgatccccaaattcatttacacctgcatcaaggtcacttggatgcttgtgtgagtgcaggcttctgaggatcactcctgaccctataaggccatctctaaggacaacctccgcctcccaggttcaagcgattctcctgcctcagcctcccaagtagctggaatcacaggcatgcatcaccacacctggctgattttgtatttttagt

SEQ ID NO: 153795 - DNA, 601 bp, Human
gggctggttagcaggatggagacagatgactttatatgagttctgggggggtcaggacttttactagagtttactaggaaaccaaatccactgcagaaacaggcatagatttatgtaactgtggtaggggcccattagagatcttgtgttactgatttactaattgtgctactgatttattactaattcattagctgtgacatacactttcagcaagtgactaaaaccttatgacccagagtaaaataattttatatcatgacccaggtagctgtgtgatatgtgtaataagtgggcgtgwgtgtctaactaaagattcaccgagcaacacttaacttctactatatgcaacagcctcttatgtttactattctgttctgttctaattcattttctaagaaaatgctggtcatgaaccactgtgttgattttatgatccgttaaaacattacaggtcaggcatggtggctataatcccaggactttgggaggccaagatgggtagattgcctcagcccaggagtttgagaccagcctgggcaacatggtgaaaccctgtctctgcacaaaatacaaaaaaaaaaattaaccaggcatggtg

SEQ ID NO: 153796 - DNA, 601 bp, Human
cattgttatcataggagataacagctccatgcagacctttcagtgggacaagatgtggaggtggaagacagtgatattgatgatcctgactcatgtgggatcttgctaatatgtgtgtttgtgtcttagtttatagcaaaaaagtttaaaaagtaaaaaaaaaattaaaaagttaaaaatagaaaaaagcttatagaataaggacataaagggaaaaatatttttgtacagcagtaaaatgtatttgtgttaagctaatgagtcaaaaagttaaaattcaaaagtttataaagtaaaaaagttacagtaagctagggttaatttattattgaagaaagaacctttctttttctttttttgagatggagtttcgctcttgtcacccaggctggagtgcaatggtgtggtggctcacgcctgtaatcccagcactttgggaggccaaggcgggtggatcacctgaggccaagagtttgagaccagcctggccaacatggcaaaacccctatctctactaaaaatacaaaaattagccaggcgtggtggtgcatacctataatcccagctacttgggaggctgaggaaggagaatcacttgaac

SEQ ID NO: 153797 - DNA, 527 bp, Human
agttaaaattcaaaagtttataaagtaaaaaagttacagtaagctagggttaatttattattgaagaaagaacctttctttttctttttttgagatggagtttcgctcttgtcacccaggctggagtgcaatggtgtggtggctcacgcctgtaatcccagcactttgggaggccaaggcgggtggatcacctgaggccaagagtttgagaccagcctggccaacatggcaaaacccctatctctactaaaaatacaaaaattagccaggcgtggtggtgcatacctataatcccagctayttgggaggctgaggaaggagaatcacttgaacccaggaggtggaggttgcagtgagccgagatcgtgccactgcacttcagcctaggagacagtgagactccgcctcaagaaaaaaaataatttagcataccctaagtgtacgatgtttataaagtctacagtagtgtacggtaatgtcctagggcttcacattcactatactaaaggacagtgacacaagtcctg

SEQ ID NO: 153798 - DNA, 601 bp, Human
gcatgatcacgactcattgcagacctgacctgggctgaagggatcctcctgcctcagccttgtgagtagctgggactacaggtgtatgccaccatgcctggctatgcttttaattttttgaagcaacagagtcttcctgtgttgcccagtctggtctccagctcctaagcaatcctctgacttggcctcccaaagtgctgggaggtgtgagctatggtgtccagccttcttttttcaaaatcattttcatacctgctttccctataacacctcgaggtagggtgcgaatgggcacagaggsaagagagctgagcctatatccagagcccaggccagaacccaattctctggatgaccatgcttcttcggtaagtatatttttgtggaatatttggagctcttttgacacataaagatttactaaacaacatattcacatatggcaaaatattatctataaatagcttcaaaatgtctttgctttagttttaggttctgatttgctgtggtgtagtgaggacagaatttttcttttgctgtattttaattgcaatagcgagtaaacaaaccttttttccccccttggttatacttttctttg

SEQ ID NO: 153799 - DNA, 601 bp, Human
gagctatggtgtccagccttcttttttcaaaatcattttcatacctgctttccctataacacctcgaggtagggtgcgaatgggcacagaggcaagagagctgagcctatatccagagcccaggccagaacccaattctctggatgaccatgcttcttcggtaagtatatttttgtggaatatttggagctcttttgacacataaagatttactaaacaacatattcacatatggcaaaatattatctataaatagcttcaaaatgtctttgctttagttttaggttctgatttgctgtgrtgtagtgaggacagaatttttcttttgctgtattttaattgcaatagcgagtaaacaaaccttttttccccccttggttatacttttctttggtttccttggagttttccttggttacattgaaaaccacccagtatttgcatttgcatgggttagttcttaaagtcctaagtgggtcctagtgtttggaggttttgtagaaatcatatctttgtgtagtacaggccacacatggggagttgaatgtccatgtagtcattggagaagtggccagagttgggtgtcagagctgctgtttgg

SEQ ID NO: 153800 - DNA, 601 bp, Human
aggtagggtgcgaatgggcacagaggcaagagagctgagcctatatccagagcccaggccagaacccaattctctggatgaccatgcttcttcggtaagtatatttttgtggaatatttggagctcttttgacacataaagatttactaaacaacatattcacatatggcaaaatattatctataaatagcttcaaaatgtctttgctttagttttaggttctgatttgctgtggtgtagtgaggacagaatttttcttttgctgtattttaattgcaatagcgagtaaacaaaccttttytccccccttggttatacttttctttggtttccttggagttttccttggttacattgaaaaccacccagtatttgcatttgcatgggttagttcttaaagtcctaagtgggtcctagtgtttggaggttttgtagaaatcatatctttgtgtagtacaggccacacatggggagttgaatgtccatgtagtcattggagaagtggccagagttgggtgtcagagctgctgtttggacttggacagatcctgagtgtgtcatccttggccaggcactcattctgtacagccccccaggtgtg

SEQ ID NO: 153801 - DNA, 601 bp, Human
aacatggatttaaaattctgcccagttttatgtcccctcatcaaatgattttaccatgtattagattataatgttagtgatgtttctggcttatattaatatactgctttatgttgaaataaactcattttcatcctcaacacataaatttcatcaatttcagaccttaagcacggttatcaacctgttagatgcttctatttgactttgcttaaatagcgctgaaggcctgtcagatgactagggggaagtttttcctaaacaaattcaagttattttgccaattcagtgatttttttttaaaaaaggatttctttaataaaatgaatgttatcacacccttaaaagtgacaacacccatgtaaaagaagctgattgtatatctaaatatcataaaaaagatcattgaatttaaacttcttcagagttttgttttgttttgttttgtttgccactgtagccaccattacaagctcagttataagtaataagtgaactgtttctcatttattttcctttttatatctgtcctaggcacattttcttacctaggagtttactaatcatttaacctgaggactatctagaatatatgatgttt

SEQ ID NO: 153802 - DNA, 601 bp, Human
aatttaaacttcttcagagttttgttttgttttgttttgtttgccactgtagccaccattacaagctcagttataagtaataagtgaactgtttctcatttattttcctttttatatctgtcctaggcacattttcttacctaggagtttactaatcatttaacctgaggactatctagaatatatgatgtttaatattttagtcacctgcatttatcataactgagcatttgatccatgccaaacactgttttaagcacaatagtgtttttttaatgtaatatataatagtgacattttwacacactttgattgctgtgtaaatgtttattggtatttctttctttctttttttttttttgagatggaggcttgctctgtcacccaggctggagtgcagtggcacaatctcagctcgctgcaacctccgcctcccaggttcaagcagttttcctgcctcaacctcctgagtagctgggattacaggtgcccaccaccacgcccagctaatttttggatttttagtcgagacagggtttcaccatgttggccaggctggtctcaaactcctgaccttgtgatctgcccaccttggcttccc

SEQ ID NO: 153803 - DNA, 601 bp, Human
gactaatccaccagcttatattaggaagattagccatctgttagcttctaaaacagaggcaaaagtttctgctttcagattctcttggtgtgcgggcttgggaaggacagatgggagctaataaatatcataccttgaaaggccaagcacccggctgagttgtcctatccactgttaagtccagcccccacagcagtcctgtgatgtaggtgttgttcctcccttcaggtaggaggttcagtaatcattcagggtcacacgactggaaaaggctgaccccagatgtaaagccaggctcccmgctccttgttcttccactgtgttctaaactccttcccagcttgcgcttgacacagccttgtcttctctccctccgtgcctcgcagtggtagggttccatggaacacgcaggtgaacagtttgacctatggatgagccgatctggagagcctgcctggtgggagcaggttggtccctgcagtccagagtctgcacacagtccttccagtgagtgtctctggaggctgtatttcctgattacaactctatagttttgtctactagagctgacacctttgttttctgtcacttctcaggccaa

SEQ ID NO: 153804 - DNA, 601 bp, Human
aggaggttcagtaatcattcagggtcacacgactggaaaaggctgaccccagatgtaaagccaggctccccgctccttgttcttccactgtgttctaaactccttcccagcttgcgcttgacacagccttgtcttctctccctccgtgcctcgcagtggtagggttccatggaacacgcaggtgaacagtttgacctatggatgagccgatctggagagcctgcctggtgggagcaggttggtccctgcagtccagagtctgcacacagtccttccagtgagtgtctctggaggctgtatytcctgattacaactctatagttttgtctactagagctgacacctttgttttctgtcacttctcaggccaagaagtaactttttttaggaaaatatctttttccagtaaagatgtcctttcatctcgccaccccacccccatccctgacctcttctacgtgcagtcttttttgtttttgttgtttgtttgcttgttttttagatggagtctcgctctgtcccccaggctggagtgcagtggcacaatctcggctcattgcaacctccgcctcccaggttcaagcaattcttgtgcctcggc

SEQ ID NO: 153805 - DNA, 601 bp, Human
gtagggttccatggaacacgcaggtgaacagtttgacctatggatgagccgatctggagagcctgcctggtgggagcaggttggtccctgcagtccagagtctgcacacagtccttccagtgagtgtctctggaggctgtatttcctgattacaactctatagttttgtctactagagctgacacctttgttttctgtcacttctcaggccaagaagtaactttttttaggaaaatatctttttccagtaaagatgtcctttcatctcgccaccccacccccatccctgacctcttctacrtgcagtcttttttgtttttgttgtttgtttgcttgttttttagatggagtctcgctctgtcccccaggctggagtgcagtggcacaatctcggctcattgcaacctccgcctcccaggttcaagcaattcttgtgcctcggcctcccaagtagctggggctacaggtgcacacctccatgccaggctaactcttttggatttttttagtagagatggggtttcaccattgttggccaggctggtctacaacacctgacctcacgtgatccgtccgccttggcctcccaaagtgctgggat

SEQ ID NO: 153806 - DNA, 601 bp, Human
ttgacctatggatgagccgatctggagagcctgcctggtgggagcaggttggtccctgcagtccagagtctgcacacagtccttccagtgagtgtctctggaggctgtatttcctgattacaactctatagttttgtctactagagctgacacctttgttttctgtcacttctcaggccaagaagtaactttttttaggaaaatatctttttccagtaaagatgtcctttcatctcgccaccccacccccatccctgacctcttctacgtgcagtcttttttgtttttgttgtttgtttgyttgttttttagatggagtctcgctctgtcccccaggctggagtgcagtggcacaatctcggctcattgcaacctccgcctcccaggttcaagcaattcttgtgcctcggcctcccaagtagctggggctacaggtgcacacctccatgccaggctaactcttttggatttttttagtagagatggggtttcaccattgttggccaggctggtctacaacacctgacctcacgtgatccgtccgccttggcctcccaaagtgctgggattacaggcgtgagtcaccatgtccagcccacat

SEQ ID NO: 153807 - DNA, 601 bp, Human
ctgacctcacgtgatccgtccgccttggcctcccaaagtgctgggattacaggcgtgagtcaccatgtccagcccacatacacttttaaaaataatagtttatcttgataaaatctgaattaagctgttgtttttatgaggattgtttctgactcctgtttctcatttcccttttcacctcccctgtcagacacatacactccacgtccacaccacacatatgcacactgcggacttcaccactcacattcactttactttgttaatctggctgcaaggaaatttcttagcccttgacacrgtatgtgaagagagttctgttggcagctcaccatggtatttcaaatgtgtgcctcaaattgagagtgccggttggaaataacaattcactctaagcagtgcttttcattgaaatgtaaattgccttatacccgttttcattcttgcggacttctcaggaggaagacaggttttatgttacaagcattgaagagaaaatctttctcctggtatctctttttttagtatgcaacaagattgaggatgattcatttaggcaactctggtctactctaggagcttgcatatctaacaatatgca

SEQ ID NO: 153808 - DNA, 601 bp, Human
catggtatttcaaatgtgtgcctcaaattgagagtgccggttggaaataacaattcactctaagcagtgcttttcattgaaatgtaaattgccttatacccgttttcattcttgcggacttctcaggaggaagacaggttttatgttacaagcattgaagagaaaatctttctcctggtatctctttttttagtatgcaacaagattgaggatgattcatttaggcaactctggtctactctaggagcttgcatatctaacaatatgcagtattctcaggaattttaccagtgtgggattsctggtactttgaggggagaaggataacttcatatctggatttaatttctgagttaataaaccgccatcaccctggaatgcccatttttatttgtttccttatccatttatgaactaccttaaggcatttatcaaatagtgacttaaatctaaaaataaaattaatgtcctttgtttggaatgcttttagagaccattaggacttaggagcagtgcagtggatgtggagagaatgaaagattcaacaataactacataaaaccctaaggtcccactcaagtggggcggcctggccaaaatg

SEQ ID NO: 153809 - DNA, 601 bp, Human
agcattgaagagaaaatctttctcctggtatctctttttttagtatgcaacaagattgaggatgattcatttaggcaactctggtctactctaggagcttgcatatctaacaatatgcagtattctcaggaattttaccagtgtgggattgctggtactttgaggggagaaggataacttcatatctggatttaatttctgagttaataaaccgccatcaccctggaatgcccatttttatttgtttccttatccatttatgaactaccttaaggcatttatcaaatagtgacttaaatccaaaaataaaattaatgtcctttgtttggaatgcttttagagaccattaggacttaggagcagtgcagtggatgtggagagaatgaaagattcaacaataactacataaaaccctaaggtcccactcaagtggggcggcctggccaaaatgtagctcaaaacataatagtggctatgagaaaaaagctattttgttgtcattgttataacacccagcaaggaactgtataggttatagggccttttaaaatttttcagctggataccactttatttttattgtgactttcaaacacgaaaa

SEQ ID NO: 153810 - DNA, 601 bp, Human
atctaacaatatgcagtattctcaggaattttaccagtgtgggattgctggtactttgaggggagaaggataacttcatatctggatttaatttctgagttaataaaccgccatcaccctggaatgcccatttttatttgtttccttatccatttatgaactaccttaaggcatttatcaaatagtgacttaaatctaaaaataaaattaatgtcctttgtttggaatgcttttagagaccattaggacttaggagcagtgcagtggatgtggagagaatgaaagattcaacaataactayataaaaccctaaggtcccactcaagtggggcggcctggccaaaatgtagctcaaaacataatagtggctatgagaaaaaagctattttgttgtcattgttataacacccagcaaggaactgtataggttatagggccttttaaaatttttcagctggataccactttatttttattgtgactttcaaacacgaaaataccattatgttaaaaaaaaatactatggaatctgtgtggcagaatgtatttaagctgaacagattaaggctgtaggaccaaagggctgaacaaccttgagcat

SEQ ID NO: 153811 - DNA, 601 bp, Human
attgcatctttacatagtaataaatgtgtcataattgacatgtgctttaaaatgctctcacttcctctacttcctggaagattgtttctgtcttgcatgttgtccttgctgtgttttatgatgtgtttgtataaacatgatgaaactattcatgttcttgttgatgcttctctgaatggttagcactggctctctgggtgtgttttgtttgctaaaccttgaaaaagtcttagtagatggaatacagtggaaagattaggaagatgcctttttccctcatacttcctttaattaaataatrtgaaaatatactgatttaatagatgtttctgtgagttgtgctaaatagaattggtaacagtgttacagttttatagggctttttatctgtttgagaggtatgcaggatttcttttttattattattttttattttttgtagagataagatttcactatattttccaggctggtctcaaactcttgggctcaagtgatcctcccacctcggcctcccaaagtgctgggattacaggcgtgagccaccgcacctggccgatatgcaggatttcttgatgtttctcatcttcccataactttt

SEQ ID NO: 153812 - DNA, 601 bp, Human
gatgcatttggccccagtagttcttacctagggtggggaaatcaggcatgtacctgaggaaggttgctgtgctgctaggcagaggagttgtgaagtgaaacagagcacagcatgcacctgtggactgctttcaggccatgttctctggagtgtgaggtgccggacggctcaggcctcctgtccctggaaggcagagtgggagcaagcatcttgctggtagcggtcagaggctaaagggaaaggtagcactgggatattgccttaagatgaataggatttccataagctggggtgaaggaaygaggaggagcacaaggaaaagattagcattgagaaggagcaaggtatttgggcaaaaggttggagcagagatttcctgttctggaattagcagtgggagggaaggaagaaaggaatcccagaagccagttacggagagccttgattgctaggctaaagatatttgggtgttatcctgacgtacagaagagtgtgtgaaggttttgtaactttgaagaaatgggagcaaacagtctagtgatgaaagcagaggaatactgggcagagaaggagacttttgcagtagtctaggcagggagca

SEQ ID NO: 153813 - DNA, 601 bp, Human
tctgaaatgtaagcacctgggctcactctttctgcccctctgtctttgaatcagacagcagctttacctcttggcctcttagcagatttattcttaagcaatattaaaagtattgttgcttcttgtccaaatctcctttccccattcagaaataaaacaactcccttaaaggggagagataccatcacctccctacttggggcctgagaggtgttgcagaaaataaaattctctgagctctttgggccaattgttccttagattttaataccttagcatgttgtctgtgcagttttttaargcatggcatcacacacatacccagcagcatttgatgaaaggctccagtttcaaggtaagatagtagtgtcaagctgtgcaaaatggttagtcggcctactaactcaactctggagcaagctgcttaacctttttaagctacctgtaaaatgagaataagaagagctgcctcacagaattgttaccaagagaataggctcacagtaagaactcaattgttaatttccttaaaaaaaaatcctgctggggcctggtggctcatgcctgtgatcccaacactttgggaggccaaggcaagagg

SEQ ID NO: 153814 - DNA, 601 bp, Human
tttctagaatcaagttagttctgtttatgtagttttatattgtgtttttgttcctactgtatcataagtatttttcaataatgtcatcattttaggttgctttcttatctttagagctcaaggtaattacagatcatagaatagcctttccggtaccgtgccttatatactcatttaattttacaacatgctgtgagctgcagcagctccccattttacagatgtgaaacctacatttcagaatgtttaggtaaattgccttgatgacagagtatgccaaaggactgagattagagtccamgtctgtgtttccaaaacccttgccatttctaccatggacaggctgactttatggggctgtatgttggaggcaccgtgtacatttaaggaattgaccattaaatgtgatgatgacgttatgggaacttgcttaatgataaagtaggaacaaaaacacagtccgaaactacataaacagaaatatagtatttctgcctaattctaaacaagaataacacatgactaagttctagtttttaagtggtactggtgccagaaaattccagatgaaggcaagcttccacaaggaatgtggaaaaac

SEQ ID NO: 153815 - DNA, 601 bp, Human
gtctaagacaaggcttttgtttgtaagtctctattaaatgtttctttctgataaactggatttgtcaacctctttcttcggcctctcagctcccttggcctttggaggtaggttagcttagatctgctcacagcagaacaccacgctttctgcctgaaggaatttcttttttcttttcttttttttttttttgagatggagtttcgctcttgttgcccaggctggagtgcaatggtgtgatctcagctcactacaacctctgcctcctgggttcaagcgattctcctgcctcagcctcccractagctgggattacaggcatgcaccaccacacctggctaattttgtgtttttcgtagaggcgggggtttcaccatgttggtccgggtggtctcgaactcctgacctcaggtgatccacccacctcggcctcccaaagtgctggtattacaggtgtgagccaccgctcctggcccctgctgcattttctacagttgtacagttgtgcatctgtgattgattgtgctacaacctgggaggaagccactctcctcctttgctttgcccatgaagacgtggccctgtaaagtctagaagaata

SEQ ID NO: 153816 - DNA, 601 bp, Human
ctaagacaaggcttttgtttgtaagtctctattaaatgtttctttctgataaactggatttgtcaacctctttcttcggcctctcagctcccttggcctttggaggtaggttagcttagatctgctcacagcagaacaccacgctttctgcctgaaggaatttcttttttcttttcttttttttttttttgagatggagtttcgctcttgttgcccaggctggagtgcaatggtgtgatctcagctcactacaacctctgcctcctgggttcaagcgattctcctgcctcagcctcccaastagctgggattacaggcatgcaccaccacacctggctaattttgtgtttttcgtagaggcgggggtttcaccatgttggtccgggtggtctcgaactcctgacctcaggtgatccacccacctcggcctcccaaagtgctggtattacaggtgtgagccaccgctcctggcccctgctgcattttctacagttgtacagttgtgcatctgtgattgattgtgctacaacctgggaggaagccactctcctcctttgctttgcccatgaagacgtggccctgtaaagtctagaagaataaa

SEQ ID NO: 153817 - DNA, 601 bp, Human
aagtctctattaaatgtttctttctgataaactggatttgtcaacctctttcttcggcctctcagctcccttggcctttggaggtaggttagcttagatctgctcacagcagaacaccacgctttctgcctgaaggaatttcttttttcttttcttttttttttttttgagatggagtttcgctcttgttgcccaggctggagtgcaatggtgtgatctcagctcactacaacctctgcctcctgggttcaagcgattctcctgcctcagcctcccaactagctgggattacaggcatgcrccaccacacctggctaattttgtgtttttcgtagaggcgggggtttcaccatgttggtccgggtggtctcgaactcctgacctcaggtgatccacccacctcggcctcccaaagtgctggtattacaggtgtgagccaccgctcctggcccctgctgcattttctacagttgtacagttgtgcatctgtgattgattgtgctacaacctgggaggaagccactctcctcctttgctttgcccatgaagacgtggccctgtaaagtctagaagaataaaatggttgctatggttgctgtgg

SEQ ID NO: 153818 - DNA, 601 bp, Human
gcctcccaaagtgctgtgattacaggcatgagacaccatgcccgacctccaaatattttcttatgataggttactcctggaagcaataaatatgatgtaaagctcagattgactttttaattatctttatttttaaattttgcttttaaatttccttttctttttcttttcttttcttttttttttttttttttgagacggagtttggtcttgttgcccaggctggagtgcaatggtgcgatctcagctaactgcaacctccccctcccgggttcaagcaattctcctgcctcagcctccygagtagctgggattacaggtgcctgccatcacacctggctaatttttcatatttttagtagagatggggtttcaccatgttggccaggctggtcacaaactcctgacttcaggcgatccacctgcctcagtgtcctaaagtgctgggattacaggcatcagccaccgctcctggctgctttttaattttctaattcatttatttttattgtggtatagattgagttttgttgtcataccttcctgtgtttgtggagtcttagaaaagaactctcaggttacttttttttaaaaattttat

SEQ ID NO: 153819 - DNA, 601 bp, Human
tacagggagaatggagcaggacttcttctagtagagaaattagggagacattgaagagacttgcattttaccgatgctaatttccttagggtcatttctttaagaaaaaaaaaatcctcttaagtaacaagcttggggagctgtagagctagatcagagattttgctgccaacctctaagtaacattccaagtccactttccactgcttcctgaggaggcctgtcagagttttgcaggtgtattcctgatctcctggcttggagctcttattcagtctgcttcagctcttcctctctactmttttggttcttgtctctttagaccatatttattcattcaagaaacttttactgagcacccattatgttctaggcactacgctggttgcccacctttattcctgttcctggtaagcatctccttaccattgcccctctgctcagcaacccccacacttttacaggaactatcattcattacgtaatgaggtcttgaacttatgatttaagttcaacattaattagacactttctgtgtagcagatactgtgctaggtttggaagtttaagaagagacacaccctgtgccttgaaatctgtt

SEQ ID NO: 153820 - DNA, 601 bp, Human
aagagacttgcattttaccgatgctaatttccttagggtcatttctttaagaaaaaaaaaatcctcttaagtaacaagcttggggagctgtagagctagatcagagattttgctgccaacctctaagtaacattccaagtccactttccactgcttcctgaggaggcctgtcagagttttgcaggtgtattcctgatctcctggcttggagctcttattcagtctgcttcagctcttcctctctactattttggttcttgtctctttagaccatatttattcattcaagaaacttttactkagcacccattatgttctaggcactacgctggttgcccacctttattcctgttcctggtaagcatctccttaccattgcccctctgctcagcaacccccacacttttacaggaactatcattcattacgtaatgaggtcttgaacttatgatttaagttcaacattaattagacactttctgtgtagcagatactgtgctaggtttggaagtttaagaagagacacaccctgtgccttgaaatctgtttacactaccatcaaccacacaagaatgggcagatgaactagtgtgaagtcagg

SEQ ID NO: 153821 - DNA, 601 bp, Human
tgcatgaagagatatttcatgttcacagataggaaccctccatgttgtcaagataccagttcttcccaacttgatctataggtccaaagcagtgccaatcaaaatcccagcaaataactctggatattgacaaactgactctaaagtttatagatagaggcaaagaccccgaatagccaatacaatattgaaggagaagaacaaagttggagaactgttgctatctaactttaagacttattataaatctacagcaatcaagacagtgtggtattggtgaaagaacagacaaatagatcartggaacagaatagggatctcagaaatagacctacttaaatatagtcaactgatctttgacaaaggagcaaaggtgtgatacaaggcagaaaagataatttttttcaacgaatggtgctgaaacaactggaatccacatgcacaaaaatgaacccagacacagaccttacaaccttcacaaaaattaacataaaatgaacaagacctgaatgtaaaacacaaaactctaaaactcctagatattgtacatgttttgttagatttataatagaaaatctattatacatgactgtaggtttgg

SEQ ID NO: 153822 - DNA, 601 bp, Human
gggatctcagaaatagacctacttaaatatagtcaactgatctttgacaaaggagcaaaggtgtgatacaaggcagaaaagataatttttttcaacgaatggtgctgaaacaactggaatccacatgcacaaaaatgaacccagacacagaccttacaaccttcacaaaaattaacataaaatgaacaagacctgaatgtaaaacacaaaactctaaaactcctagatattgtacatgttttgttagatttataatagaaaatctattatacatgactgtaggtttggcattgacgttatrtacaataccaaagacatgatctgtgaaagaaagaatcgataaactggacttaaattaaaattaaaaatttccgttctgtgaaaggccatgtcaagagaatgaaaagacaggccacagactgagagaaaatatttgcaaaaaagatatatctgataaaagactgtttttcaaaatatacaaataattcttaaaactaaacaataagaaaacaatctgattaaaaattgggccaatgggccaggcacggtggctcacgcctgtaattccagcactttgggaggctgaggcaggcggatcata

SEQ ID NO: 153823 - DNA, 601 bp, Human
acgcgcctgtagtcctagctactcaggaagctgaagcagaagaattgctcgaacctgggaggttgcagtgagccaagatcgcgccactgtactccagcctaggtgatagagcgtgagactccttctcaaaaaaaaaaaaaaaaaaaaaaaatgggccaaagatatgaacaggggctgggtgcagtggctcacacctgtaatcccagcactttgggaggctgaggcaggtggatcacttgaggtcaggagttcaagagcagcctgggcaacatggcaaaaccccatctcaactaaaaaaaaatacaaaaattagctgggcatggtggcacatgactataatcccagctactcgggaggctgaggcatgagaattgctggaacccaggagagccgagatctcgccactgcactccagcctgggtgacagagccagactcccatctaaaaaaataaaaaagatatgaatggatacctcaccaaagaagatatacagatatacagatggcaaataagtatatgaaaagatgctcaatatcatatgccattagggaattacaaattaaaacagcaatgagatatcactatatacgtcttagaatgg

SEQ ID NO: 153824 - DNA, 601 bp, Human
agagccgagatctcgccactgcactccagcctgggtgacagagccagactcccatctaaaaaaataaaaaagatatgaatggatacctcaccaaagaagatatacagatatacagatggcaaataagtatatgaaaagatgctcaatatcatatgccattagggaattacaaattaaaacagcaatgagatatcactatatacgtcttagaatggcctttatgatgggctggtacagagggtggcttccagaacccctctgaaaaccaaagatcaagtattagaatttaataaagatcagrcccggtttggtggctcacccccataatcccagcactttgggaggcggaggcaagagaattgcttgagcccaggtgtttgaaaccagcctgggcaacatagtgagaccctgtctctggttttttttttgttttgttttgtttttttttttttaaagatcacgtgagaggcatacaaattcataggaaaaaatacgaaatggacaaagaacaggagtagccaattcacaaaaaagtaaaactaaaagcttccagcatgctcagttccacaaaatgacaaaaccatgcggtcccttttttcta

SEQ ID NO: 153825 - DNA, 601 bp, Human
cagtgtgctctgggggagcctttttggtaaacagtttggctgtatatatatgtgtgtgtgtgtgtgtgtgtgtgtgtgtatgtatgtatgtgtgtgcatgcttgcgtgtgtgtgtatatatatatttcatactttaatgtctgtctttaaactctgcttaagaaaaccatctcaagtgcagtaaatgccacatgtttatcatgacaccacttagtatagtgaagaatgggaaatcttaatctagccagccaatgggagtgttaggcagacttcacaaatgatgtgtagaaagactgaatartaacactgaacaatgtttatgatcgtattgttgagtgagaaaagcaagactcaattgtaccttataaactctctcttttatagtacttgccaatttgttttttgtttgcaattccttgtcctttttttttttttgagacagagtctcactctgttgcccaggctggagtgtagtggtgcagtctcggctcactgcaagctccgcctcccggtttcacgccattcttctgcctcagcctcccgagtagactacaggtgcctgccaccatgcccggctaatttttttttgtatttttagtag

SEQ ID NO: 153826 - DNA, 601 bp, Human
ccgagtagactacaggtgcctgccaccatgcccggctaatttttttttgtatttttagtagagatggggtttcaccatgttagccaggatggcctcaatctcttgacctcgtgatcctcctgccttggcctcccaaagtgctgggattacaggtgtgagccactgtgcccagattccttgtcctttttaaactgtctttatgtctagacttgggagtatcctgagggcagagatgggtcataggacagaacatgagaaaagtatccgtagtacttttacccttagtagatagtcaccctcytggacctaagggtgtacctgtgggcagaatgaataataaaactttcttcccacccaacatttcctaagagctgctaatagttttccatatcttaaaattatgggaaacaatatttagagagctccttttcacactgaatagatttaaatgattaattttctttcttttttttttttttgtttgttttttagttttttgagatagtctcactctgtcacccaggctggagtacagcagctcaatctcagctcactgtgaactccgcctcctggattcaagttattctcctgcctcggcctc

SEQ ID NO: 153827 - DNA, 601 bp, Human
ttaatttttatttttaaccttgttgaatgttattggatcattaagaaggttttccaatatagtattagcaactgcaataaagatgtgtctttcttgggggatgcagtgatgacggtgcagggcccatacaggcaggggtggcgcctgagggtcccgggccaggcagcagcacacaggtggcaggatccactcaggctgcatctcccgtggtgctcatctggctgctgccatctgtgctggaccccgccaaggtatagagtctcatggacacgatctggaaggacccagacagtgtgccatygatgtcctctagatcagaggggcccagggaggtgactacttctactcctttggggactgccaccgctaaacagcctagcagcagctgcagccagactgccaagcttgtccatttcaccctctcggacctaagggtgtacctgggggcacccacaccagacttgcagtaaccacctccttggcacctgcccccacctccaagagcccagaagacacacctggcctccagcaggctgggccttccagaagggatagcagggatgcattctctttgcacctgtggggagggtctcactctggg

SEQ ID NO: 153828 - DNA, 601 bp, Human
gggatgcattctctttgcacctgtggggagggtctcactctgggcacccctctcaccagctgcaaggccttggactcatgctgaacagtgtgggagcctcagttccaacatctatgacagttggatcatggccttacccatgaagcattattgagagaatgaaaggagaacagagatgggcttgcagagccacatgctgctggctccacattcccaggaacaaggatcctactgcatttttgtctttatataaccctattatatggactacattctgccataaggaaaggaaaaccttggwtgcgatggtttaaacaaacaagtttgtttttccacatagcatgaattccagagatgggtggctaatggtattggttcaacagctgtgtgatggtaggggtcacatctccgagatccttttgccttgccctcatttgcttgttacttcatggtcacaagatggctgccatgtctccaagaatcatgtctgtgatcaaggacaaaaggagtgggggaagaagaagggccaagctcgctggacctgtcaacttctatcaaaaagtaaaacttctgtcagaaacctgtttcctgctctctcctc

SEQ ID NO: 153829 - DNA, 601 bp, Human
cggagtctcgctctgtcgcccaggctggagtgcagtggcgcgatctcggctcactgcaagctctgcctcccgggttcacaccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccttaaatgagttttatacagacaaktggcatatagtcctttcatcagtatccttaggtcaagattatattacattgcagattgtctccagggtactttggagatggattctaattcttattctcatattgcagtaacagggaaactgagagataggggtgtgtcagagtttgaaagacaaactatttgaagacagaaactctagtggagcttgattattagccaaaatacagaatttactattaaagaagagggtccagaatcctatcccaagaagttacttgggcatccaaaaacagatcgtaagacacattgaaagtgtggaa

SEQ ID NO: 153830 - DNA, 601 bp, Human
agaaatgttacttttgcactttcgtggccttggctagttttaaatgctttttcattggtagaaggcttacagagatcatgaaacattaatagttaccatttattgtgtactctttctgtgccaagtactgtgctaaatattttaggcatattatcacagtcagtccttacagcactcctttgaggaacatggcattttccccaaaatacatttttaagaacccttgagatttcaaagatcaagaccagagcaggaagggaaagctctgggtctgaaccaggtctgtctgccaccaaaacamcactcttgatagggatgatgatctggaacagtggtaaaatctggcataattcaaacacttaaactagtttgcgtatatgtataaaattcctagaattccttataaaacacacttatgacattgaagttcagtaacttcccatgttccatataagccacagaaatattgatttgccacagtgaaagagttagtggaagctattgggccatccaaaagaagctaaggctgaaaaggctacatatggtatgattccaagtacatgacatcgtggaaaaggcaaaactacagagagtaaaagga

SEQ ID NO: 153831 - DNA, 601 bp, Human
cttatgacattgaagttcagtaacttcccatgttccatataagccacagaaatattgatttgccacagtgaaagagttagtggaagctattgggccatccaaaagaagctaaggctgaaaaggctacatatggtatgattccaagtacatgacatcgtggaaaaggcaaaactacagagagtaaaaggatcagtggttgccaagggctaaggggagggagggatgaataggtggagcatggaggatttttaggaatgtgaaactattctggatgatactgtcatagtggattatacattcrtcaaaatacagaatgtgcaacaccaacagtgagccatcacatgaactatggattatagttattaataacatatggatattggctcatccattgtaacaaatgctccacactaatgtaagacattaatgggcataggtgaggggctatacggaaatcctgtacttttcttttaattttcctgtaaacctaaaactgctcaaaagtctatttgttgccttttttttttttttttttttttttgagacggagtcttgctctgtcacccagggtggagtgcagtggcatgatgatctcagctta

SEQ ID NO: 153832 - DNA, 601 bp, Human
tattgatttgccacagtgaaagagttagtggaagctattgggccatccaaaagaagctaaggctgaaaaggctacatatggtatgattccaagtacatgacatcgtggaaaaggcaaaactacagagagtaaaaggatcagtggttgccaagggctaaggggagggagggatgaataggtggagcatggaggatttttaggaatgtgaaactattctggatgatactgtcatagtggattatacattcgtcaaaatacagaatgtgcaacaccaacagtgagccatcacatgaactatggrttatagttattaataacatatggatattggctcatccattgtaacaaatgctccacactaatgtaagacattaatgggcataggtgaggggctatacggaaatcctgtacttttcttttaattttcctgtaaacctaaaactgctcaaaagtctatttgttgccttttttttttttttttttttttttgagacggagtcttgctctgtcacccagggtggagtgcagtggcatgatgatctcagcttactgcaacctctgcttcctgggttcaagtgattctcctgcctcagcttcccga

SEQ ID NO: 153833 - DNA, 601 bp, Human
tgacatcgtggaaaaggcaaaactacagagagtaaaaggatcagtggttgccaagggctaaggggagggagggatgaataggtggagcatggaggatttttaggaatgtgaaactattctggatgatactgtcatagtggattatacattcgtcaaaatacagaatgtgcaacaccaacagtgagccatcacatgaactatggattatagttattaataacatatggatattggctcatccattgtaacaaatgctccacactaatgtaagacattaatgggcataggtgaggggctatayggaaatcctgtacttttcttttaattttcctgtaaacctaaaactgctcaaaagtctatttgttgccttttttttttttttttttttttttgagacggagtcttgctctgtcacccagggtggagtgcagtggcatgatgatctcagcttactgcaacctctgcttcctgggttcaagtgattctcctgcctcagcttcccgagtagatgggattacaggcacccatcaacacaaccggctaatttttgtatttttaatacagacggggtttcaccatgttggcctggctggtcttgaac

SEQ ID NO: 153834 - DNA, 601 bp, Human
aaactacagagagtaaaaggatcagtggttgccaagggctaaggggagggagggatgaataggtggagcatggaggatttttaggaatgtgaaactattctggatgatactgtcatagtggattatacattcgtcaaaatacagaatgtgcaacaccaacagtgagccatcacatgaactatggattatagttattaataacatatggatattggctcatccattgtaacaaatgctccacactaatgtaagacattaatgggcataggtgaggggctatacggaaatcctgtacttttcytttaattttcctgtaaacctaaaactgctcaaaagtctatttgttgccttttttttttttttttttttttttgagacggagtcttgctctgtcacccagggtggagtgcagtggcatgatgatctcagcttactgcaacctctgcttcctgggttcaagtgattctcctgcctcagcttcccgagtagatgggattacaggcacccatcaacacaaccggctaatttttgtatttttaatacagacggggtttcaccatgttggcctggctggtcttgaactcctgacctcaagtgatct

SEQ ID NO: 153835 - DNA, 601 bp, Human
gagggatgaataggtggagcatggaggatttttaggaatgtgaaactattctggatgatactgtcatagtggattatacattcgtcaaaatacagaatgtgcaacaccaacagtgagccatcacatgaactatggattatagttattaataacatatggatattggctcatccattgtaacaaatgctccacactaatgtaagacattaatgggcataggtgaggggctatacggaaatcctgtacttttcttttaattttcctgtaaacctaaaactgctcaaaagtctatttgttgccttttttttttttttttttttttttgagacggagtcttgctctgtcacccagggtggagtgcagtggcatgatgatctcagcttactgcaacctctgcttcctgggttcaagtgattctcctgcctcagcttcccgagtagatgggattacaggcacccatcaacacaaccggctaatttttgtatttttaatacagacggggtttcaccatgttggcctggctggtcttgaactcctgacctcaagtgatctactcaccttggccttccagagtgctaggattacaggcaggattcccttc

SEQ ID NO: 153836 - DNA, 601 bp, Human
ggttcaagtgattctcctgcctcagcttcccgagtagatgggattacaggcacccatcaacacaaccggctaatttttgtatttttaatacagacggggtttcaccatgttggcctggctggtcttgaactcctgacctcaagtgatctactcaccttggccttccagagtgctaggattacaggcaggattcccttcatttttaaaattactgaccccaggccacaagacatcaatcatggtaaaaattccactgtccttgatggcacacttgatattttgctagctctgtggatgagcktttccttatctgttttctctctcccattccagctgccagcatgctagctgcttacgtttggtctacccactcccagcctgtcctacctcctgccatcagattaatcttcctgaaatggagtcctgagtctatcattcccctggggaaaaacctttgttcatgctactctccctcctcggtttctccatcacctgcatcacgtggtctgtcctctctgaaatctcgttagaagcagtcattgaaatcagaagtgacctctatcatagtatgttgtttgtagcttgttgacatttgttcaga

SEQ ID NO: 153837 - DNA, 601 bp, Human
ccttacctggaaaatgagctgttgtaagggttaaatgaaaacctatctaaagcacctattttagagtaggaactcactaagatggtagggctgctgcttttataaggggactgtattagtccattttcacgctgccgataaagacatacctgagactgggcaatttacgaaataaagacgtttattttattttatttattttttgagacaagagtcttgctctatcacccaggctggagtgcagtggcatgatctcagctcactgcaacctccgcctcctgggttcaagagattcttctgyctcagcctcccaagtagttgggaccaccaggcacgcaccaccatgcccaggtaatttttctgtatttttttagtagagacggggtttcaccatgttggccgggctggtctcaaactcctgaccttaggtgatctgctcaccttggcctcccaaagtgctggaattacaggtgtgagccaccacacccggcccaagaaagatatttaattggacttacagttccatgtggctggggaagcctcaagatcattgcagacggcaaggaggagcaagtcacattttacatggatggcagcaggc

SEQ ID NO: 153838 - DNA, 601 bp, Human
acatacctgagactgggcaatttacgaaataaagacgtttattttattttatttattttttgagacaagagtcttgctctatcacccaggctggagtgcagtggcatgatctcagctcactgcaacctccgcctcctgggttcaagagattcttctgcctcagcctcccaagtagttgggaccaccaggcacgcaccaccatgcccaggtaatttttctgtatttttttagtagagacggggtttcaccatgttggccgggctggtctcaaactcctgaccttaggtgatctgctcacctyggcctcccaaagtgctggaattacaggtgtgagccaccacacccggcccaagaaagatatttaattggacttacagttccatgtggctggggaagcctcaagatcattgcagacggcaaggaggagcaagtcacattttacatggatggcagcaggcaaaaatagagagcttgtgcaggagaactcctctttttaaaaccatcagatctcgtgagacttattcattatcatgagaacagcacaggaaagacttgcccccatgattcaattacctccaaccagcccctcccacaacacgtg

SEQ ID NO: 153839 - DNA, 601 bp, Human
atttttctgtatttttttagtagagacggggtttcaccatgttggccgggctggtctcaaactcctgaccttaggtgatctgctcaccttggcctcccaaagtgctggaattacaggtgtgagccaccacacccggcccaagaaagatatttaattggacttacagttccatgtggctggggaagcctcaagatcattgcagacggcaaggaggagcaagtcacattttacatggatggcagcaggcaaaaatagagagcttgtgcaggagaactcctctttttaaaaccatcagatctcrtgagacttattcattatcatgagaacagcacaggaaagacttgcccccatgattcaattacctccaaccagcccctcccacaacacgtgggaattcaagataagatttgggtggggacacagccaaaccatatcagggacataagtggaagaagggatataaatagagtttaggatttcaactttgatgtatgtaagtaatggcggttcttctgggtgctgcttggcagtaattgaacggaggttatttgcccaaagtttctttgaatttatcagctatttaccaaacactattgatgga

SEQ ID NO: 153840 - DNA, 601 bp, Human
cctatgtaccttgatagagcagagatagtatggtagagtagaaagatcaatcattaaccaaggaaatctgttctgtgtgccttggacactcaatacaagggccttggaagccacttactttgaatatcactttagtcaggaaattgaggagtttttggaatcgatctttttaagtttctttttggccttgagattttatgtttttatgtttctatttatttctgcctaagtaaatgaccccgttttctttcttaccaccatccatccccattacaaattacatgcctttttgtaaaagatsttaacctcagaaggagaggaaatgcaatcagcaaactcacaaattttctttcagtcttaattttcttttgcctttttttttttttttttttttctgtgaggcaaggtctcactctgctgcccaggctggaatgcagtggtgtgatcatggcttactgcagcctcaacctcccatgctcaagtgattctcccagttcagcctcccaagtaactgggaccaaaggcaggcaccaccacactctgctaatttaaaaaaaaaaaattttgtaagggggagagtctctctatgctgctggggctg

SEQ ID NO: 153841 - DNA, 601 bp, Human
agtaactgggaccaaaggcaggcaccaccacactctgctaatttaaaaaaaaaaaattttgtaagggggagagtctctctatgctgctggggctgttcttgaactcctaggctcaagcgatcctccctcttggcttcctaaattgctgggattacagccattgaaccaccacgaccagccttaattttcactgggaaagattattgaactgtatgctgtgttcattagcaatctcgccatatcaaatttttgctacctgggttgaaacagggaatttgcatgtctttctaaaatgcatgcrtttttgtctgcagatgtcaaataggcaaggcacagctgaataagacatggaaatgtagcttgttacaagtatagtgtgtggaggaatttctaatctctttctgtccaatcagctatgcagtaagagctcagttttcatcctctagccctgaatagaatgggggcatcatcagcaatctattctggagcatacatttttaaagtgctttgaagagaaaaattttcatctactaagtagtgaagaactcctgattaataatcgcatttcttttaatttgtttaaattgagatgattaggaga

SEQ ID NO: 153842 - DNA, 601 bp, Human
caagccacatgtctaggcataaatggggaggccatgatttctcactgcttttgacatgaaaccacaaagaatgtctttgttaagaatcaaaaaacataagagttgaacaagccaaaggaagaaatgatatcatggcctagttgaatcaactaagaaatatttttatgttaaagaaattctttaaccttataactagggcattcacattcttgagtatattgagtggaagattcctctgaaaagaaagttcacatcaatagcctttgaaagatttagggaatattttgcagtgtaagattcrttatttaaaatctgaaatatatttttccttcctacgactcttctatgtgtttatagtaacatcaagacaatgacatcctgcaattgcactagaatgtattacaaatgcatgccttgtgccaatgtattcaacaaggaagctatctttttcctctgtcttattttcattgaggaaacccatgcctatgcattatgcatgcgagtctggtgtggtgtttaagtaacctcccatgggactgccgtgagactgctgtgagtctggatttgggggagagctgtgtcttggcattttcaaatataa

SEQ ID NO: 153843 - DNA, 601 bp, Human
atgtgtttatagtaacatcaagacaatgacatcctgcaattgcactagaatgtattacaaatgcatgccttgtgccaatgtattcaacaaggaagctatctttttcctctgtcttattttcattgaggaaacccatgcctatgcattatgcatgcgagtctggtgtggtgtttaagtaacctcccatgggactgccgtgagactgctgtgagtctggatttgggggagagctgtgtcttggcattttcaaatataagagaaggatgttacctgatactcagagaatcttggctgaagcttrgcatccctctctggattagcttagtgttgtttcatgatactattttttgttttaaccagttgtgccattgtttgctgatggaaattgttacatgccagccggcaatgctagggtttcagataaatagaatatcagcatcattcttcatatcagcaaaatgataagttgtggttttgcccatcatacttaaagctaatttaggacttaaaatctggagccatgcaaatttataagaactgcttaataggagacagtgcattagttgatttagtggttgaatttccagtgaatttttttttt

SEQ ID NO: 153844 - DNA, 601 bp, Human
gactttatgctaggcagggaactcaaagattacactgaaagcagaaaactcctttacctttagattttcttaagagttgtcgacccttaaggagtgtcagaagtgggatataatatggagaaaagagaaagcattataaaatatgtggaaaggagtctattaggaaatttcctcctggccttgttgatccaaagcctttagttgcaaagaaacagctttttgttcattataaatgttttaacaataactagaactggtgttgccatccaccccatttgggcatgagcttttttcttccacyggagacgtaggtccccagatgattgattggctgcaaagtatggacatgtcttgattgtttctagaaggggcgggaccactgccttcttggattgtaactactacacctgcagagccccaaaaggtctggctactctattagattaaggtttaacatgtgataatagtctagttttattacttaaggggaaactcaaaagtgtggataccttgattttgtctggatattttattaagcacatgtacctataggccataaggatgtgttctttttctggctggccactgagtgtgtctgtgc

SEQ ID NO: 153845 - DNA, 601 bp, Human
cttccaagaccctaagctcacattgtatcctgtattaacttgctaactaacctcctgtttttgtggttttctttctctgatctaatcagtccaatcagaagaaagattacacttacagatgcacatgctgatgtcatgacatcatcctcttatttaaggatctccctttgcttccctatcaagtctcaacttctctggccatctagacctcaggtgaggtccttttatcttagcgaccttgttctttgattcactgacatggatcttgggcgccattaagatggtttatttgttgtcagayaccctttgttcttttctgtcctttcactgtggaatttttctcttggccaaattctatccattcttggcccacactgccttcctagcattcttgtatccctctctcactgtctcgcctgcacaatttggtatatttggtttactattggtcttctgttatttcacatattacttgtttttccagcaagtcagagttccttaatagaaagtattctgctctatttattttatatattataattcttagcaaagcaccagcacacagtaagtgttcaataaatatttagaggaagcaggtaaa

SEQ ID NO: 153846 - DNA, 601 bp, Human
tcactgtggaatttttctcttggccaaattctatccattcttggcccacactgccttcctagcattcttgtatccctctctcactgtctcgcctgcacaatttggtatatttggtttactattggtcttctgttatttcacatattacttgtttttccagcaagtcagagttccttaatagaaagtattctgctctatttattttatatattataattcttagcaaagcaccagcacacagtaagtgttcaataaatatttagaggaagcaggtaaaaggtgtcatgagttagatatttcmaataggaggagatggacccttgatggggtcaaccagcatcaagtgtgcctcttttacaaaaccaggaacccaatcttctccttttttcaaagttgatccaggcttatggaattcagttcataaaaaccaagctcaagggagtgaatgccaattcaataacaatgaaaagtctaacctctaggtaacagaaatatctgtgtcagccattcattgcatcctttttcttgtagcaaggcttccagcaggcgactctagggtcattcgtggccaatatgattcatttgcaccagctctgaagcc

SEQ ID NO: 153847 - DNA, 601 bp, Human
gaaggtttgattagtctgtaacagcagctggcacattttttttgtaaggggctggatggttttgtgggctgtgtggactctgtccttatagtttgaaagcagccataggccataaacaaatgtgtgcagcagagtttgaataaaactttatagaaaatgaagtttgattttcatgtaaactaatgtgttatgctattcttttttaaaaactttccagccattaaaaaatctaaaaaatatccttgacccacaggctgtatgtgccaatccctggtacataacatagaataggatgagtttygggaagaaacagtacaaaatacaggctgctatatgtttgcaatagtgtgaaaagaaagtttacccagcgttttcttggcaactgagacttcttgtaccattcattttcaaaagtcatttcaaaaccaggaattttttcctaatttctccaaactgattatatcagctttctaaaatatttggtgtgtaatcaaagtacagttttgttgctggatttcaaaggctgcagtttagtactaggtttctcctgtttcaaaagaaattgtgttatgtacataaatatgtacgtgcacatgcacac

SEQ ID NO: 153848 - DNA, 601 bp, Human
aacttcaaacccctaggctcaagcaatccacgtgagtagctaggactacaagtgtgtgccaccatgcccagataatttttatttatttatttatttattttgagggacagggttttgctatgttgtccaggctagctcaagctcttttgatagcagcattaatctactcatgagggttgtaccgttatgacgtcaatacctcccattaggctgcacctcccaacactgctgcattggggattaagtttccaacatgcaaatttggaggacatattcagactatagaaggctctgttcctcrgaacactgtctttttaaaaagaagtgcatttaattattcaaagaatacatgattatatttttgtcttttaaaataatatggataaattgaatttctcatttgaccctgtctcctccactcaatacttcttcccttcccagagataatgtcttagtctatccaggctgctataacaaaatgtcataaactgggtggcttagaaaccacagaaatttatttctcacaattcaggagactgggaagtccaagatcaagacattggtagattcggtatctggtgagggtctacttcctcataga

SEQ ID NO: 153849 - DNA, 601 bp, Human
ttaggctgcacctcccaacactgctgcattggggattaagtttccaacatgcaaatttggaggacatattcagactatagaaggctctgttcctcggaacactgtctttttaaaaagaagtgcatttaattattcaaagaatacatgattatatttttgtcttttaaaataatatggataaattgaatttctcatttgaccctgtctcctccactcaatacttcttcccttcccagagataatgtcttagtctatccaggctgctataacaaaatgtcataaactgggtggcttagaaacmacagaaatttatttctcacaattcaggagactgggaagtccaagatcaagacattggtagattcggtatctggtgagggtctacttcctcatagatggctgtctgctcacgtaatctcacctggtggacagagccagggatctctctagtgccattcatgagggctccaccctcatggcctaatggcctcccacaggccatatctcctaatactgtcatattctgggttaagattttagcataggagtttgagggggacataagcattcagttcattgcgggcaaccattgctatcaatg

SEQ ID NO: 153850 - DNA, 601 bp, Human
catcctcatcatgtgtatactagaaacttacttgtggaattgttggatgatagagggatggtgcagtagaatgttaaattactcaccgacggggtctcaggtacatgccacacgcttgccaacactttacaaaattgatctttaaatgtttttaccaggcttttgaaggaaaaagacacatatatctcaccattttacttttctttactaggcagttctttatatatttattgagcattttaatttttctttccatgaatttcctgttaaagtcctttgccctattatttatatatatatatttttttatttttttcttgagatggagtctcgctctgtcgcccaggcttgagtgcagtggcacgatcttggctcactgcaagctctgccccctgggttcatgccattctcctgcctcagcctcccgagtagctgggactacaggcacccaccacacctggctaattttttgtattttttagtagagacggggtttcaccgtgttagccaggatggtctcaatctcctgacctcatgatccgcctgcttcggcctcccaaagtgctgggattataggcgtgagccaccgcgcctggcttgc

SEQ ID NO: 153851 - DNA, 601 bp, Human
tcctcatcatgtgtatactagaaacttacttgtggaattgttggatgatagagggatggtgcagtagaatgttaaattactcaccgacggggtctcaggtacatgccacacgcttgccaacactttacaaaattgatctttaaatgtttttaccaggcttttgaaggaaaaagacacatatatctcaccattttacttttctttactaggcagttctttatatatttattgagcattttaatttttctttccatgaatttcctgttaaagtcctttgccctattatttatatatatatatytttttatttttttcttgagatggagtctcgctctgtcgcccaggcttgagtgcagtggcacgatcttggctcactgcaagctctgccccctgggttcatgccattctcctgcctcagcctcccgagtagctgggactacaggcacccaccacacctggctaattttttgtattttttagtagagacggggtttcaccgtgttagccaggatggtctcaatctcctgacctcatgatccgcctgcttcggcctcccaaagtgctgggattataggcgtgagccaccgcgcctggcttgccc

SEQ ID NO: 153852 - DNA, 601 bp, Human
cctatatattcttctcatgctgtaatagttgacattttacagtgttttgagggttaatccatcagggatattttcatgaatagtagaactctaacttaattttttcccacatggagagctagttatttcaacactgtttgtggaaagccagtagcatggtgtgtggccactagaataagggtagtcaaagggctaaagtggctggagtggggagaatgacagataattgctaaacatcctactgatcaaggttagatgacttctcagtctagaagatacatacccttctgagaaagccccytgtaggagtgaacacccaacatcctttgaccggttttactatcagaacatttacatacaggcagaactaaaatctgtgattatctggatgagaaaacagttgtaggcaacttactcatttttctgaacaagaaaaggttctacataattacgttctctatgaatcttttatcagatttaatagttaagtctcttcaaagaacatgagatattctttttttaaagtgagcctatgatttatttatcctcattaatacttgttttccccaacccttccaagctgtttgggaatgttgtgtgt

SEQ ID NO: 153853 - DNA, 601 bp, Human
ataatgtgcagtggtttccagccacttttgattatctcaaatgccacctatagagctgggtagtaatagtgatattaaggtattatttcagagggacccacaaggccaactttggactcttgacattaaacactgcaaaattccaaagtgcagacagcttggcaagtttgagttctggtgcattctgttcacaactatttttttttttttttcaatagtgcttttgtctttctgctaaaggtcagactgtagttgtcgagtactggtattgttcctgaattattcgggaagagggtggaartattgacttagtttttctattataatatcctatcacaatgctggattttaatgatttaaaaatgtaaataaaagtatttgcatttttagactacttgtgagcagctgccaattctaaaatcactatgggtgtttgcagctcttttctgggctcattttacccatctttgatcttctatcaacatgcaggtctgtgtgatgggctagaaccagcatgtattttgtttagagtcagactttgttggaatcctggtgtcacaatttggaccctcggggcagcacccagattaagtaacctctg

SEQ ID NO: 153854 - DNA, 601 bp, Human
gccagagtggaatagagttctcttataaccagctcctgttccctcaaaccttcgcatgacaccccttgtggttttcagcccgtctctctgtgtggtcgctaatgacttcattaaaggtgaagcatttcagtgatcaagagccagtgcttgatgatggttggagggacgtaaatgtgcaagcgggcctcagagcctaggtggaccggcctccttgccttcactctcaggcatcacggccctccagcatgtttctctgaggagctgttgatcatttgcccaggagatggagctgggaacctcrttgtcaccaagtcagtaccaatgatttgtgcttcctgtcagggaaacctgtggtgcatgtgtttgtcttctgcttctcagccagtttctttttgcatccatcaatctcttcttatctgtcttctttttcctgactgggcatagtagtcagttgtgagtttggacttgtattttcttattttgtaacagtttgtttcctggcttcatcttgcccctccctcctaaaagctccacttgtcttttatttctcaaggtagatgggacgaggttttttgttttttgtttttgtttttgttttgtc

SEQ ID NO: 153855 - DNA, 601 bp, Human
agccacgctttcctggcagcctgttcctctcatcatcttcctgttcccatggccatggcaccccaaatgtctgctgctctgaccaaaaagctggcagacagtaaataaactgacttctaagataagaaccttcatttgaaacaatttttaacatgccttctttgtcaaggagtaaagaccctgaatcccccaggggttcctacagcccacgatggttcacaagagagtctacaatcctcagagccaagaagcactgagactcaaggacagggccacttgacagagagagcagttcccagcygacttggggcctaggaggatattctgggtggcagggctctaattgattattaacctacatataaaatcaaggacatatagccaagcacagcagcaaatgctgccaccttgtgagctgcctgtggttgtgctgggtggagatggatctagctaaggcacaccaggatgcagcttagagagaacttggtcagatttttactgcttctggtataattggaacactttacttcttaagcctactgtgtaatgttatgtgtacagagtgagtggttgcttaattaagtgctttaattttttttgg

SEQ ID NO: 153856 - DNA, 601 bp, Human
acatatacatacatatatacacataactatgtatataaaactatacaattgttacactgttgtgtaacatggatgtgtatacaatagcgatatgattaaatatttcttattaatgatgatttcctgcagcctttcaatcttgttaaacacaaggaaaattagaaatggaccgaacagaagtggcatcataaaaggcagctactgtttgggagcaagggacatgccgtggagaggaaatgtgtggtggtctgaaattgcaccagtttccactacaattttaaaaccatgcctagccttgccraaggacctcgggggcaaaggttaagccgacacaccctttaggtcatggtacacagtatctctgggcacatggtggactctggtttgtgctggacccctaaaagttatttccttttatccctggttccctccctcccataggcaacattctgatatgtatacaatgtatcatttagatttgtgtgtattcttgcaatggatcttgttttgtgtgtaagtatttttaatttatgcaaatggtatggctatctcattctgttccttagttttttttactaggctttgaaagttccatccattt

SEQ ID NO: 153857 - DNA, 601 bp, Human
caccactttttatttgtagtgcactatacttagagctgttgccataggaattgatataccaggcgtcatggtggtcagcagacaaataggaaactcctgttatgtcgtcagaatgagttgcagagagtaccatctgctacctgtattgtacatctttctgttcctctgtcacgcctggcacaagagcagcattggtttaatcatcagcagcccttctgctctctgtagtcaggattggcagtaactcattggtgggcaacactgccttggtcttgccgcttgcactgtgaactgtaactamggacacacatgtcaggaaagaatggtgcttgggatgctcctcctatctgtgcctcaaacgttttcactcgagggatattaaaaagtggcctactgcttataaagactgtgtgtcagtgaagaggaagaggtgggagtggagagtgggaggcatttgcaagaacatatgttggattctttttttctcttcttggtgacaatgattgacggcatctagtgagtccctgtttgtcacttccttggtacagctggtagtggaggtgggggaaatcaataagggctggacaaaggacatagctag

SEQ ID NO: 153858 - DNA, 601 bp, Human
tgctgaaggtcaggtgtgaacagtgaatcatattggcggggcatggtctgggatatggtggtgagcagtaaaaactacaatagctaccatgaaaggtacctactatatgccaggcactgttctagtgcttttctcctattagcccttggaagcagttctattattatcccattttgtagattaggaaacagactcagattaattcagttacccaaggggcacgtaactggtaagtggcagagctttggttcagtctcaggcgtcgagctctggagtgtgtgtgtgtgtgtgtgtgtgtgttctttcaaccattgtgttagatgcctctcaagacagataaggtccttgctattgtagaattcacagtctaactgagtgagccagtcaaactaataagtattatatctagtctgccaggtagtaataaatgcagtgaagagaaaattgggtgaggaattttagaggatgatgggagttgatgttttagctagtgtattagtttgttcaggctgccataaacaaaataccacagattgggaggcttaaacaacagaaatttactttctcacagttttggaggctggaaatccaagagcaaggt

SEQ ID NO: 153859 - DNA, 601 bp, Human
aatgcaattcagcaatgttcttggccattttataacaaggattgccttttttcagtgtctaataacatgttcctcatttctgtctaaaatctcactagaatcacctttcatgtccatatttctagcaacagtctctcttagcatctgagacaacgttctgtggaacacagtttggggaagcttgccaaactcaacagattatactatatcatctccccctgaaagagaagagtgagacataagtcctctgcagtctgttccactcctactagatcttgaagtcatatgttgattcttttcwtggtattgtgtgcctgtgttttaaggaaaataattagcattcttaaagcaaagcaaaaattttactaaagaaaataattagcctttcatgtcactttcttagagtgaaccaaataagttttgtatgagagaaagataggggcccgtagatgcccactttagttttgcagggtgggttcctacagccacgttcccctgggctaataaggctaatggaatcatggtggcagttttgcattggcctccagctaatgaaaagttttgccatgagaacttaacttagtccttctgatgcttttac

SEQ ID NO: 153860 - DNA, 601 bp, Human
tgcaattcagcaatgttcttggccattttataacaaggattgccttttttcagtgtctaataacatgttcctcatttctgtctaaaatctcactagaatcacctttcatgtccatatttctagcaacagtctctcttagcatctgagacaacgttctgtggaacacagtttggggaagcttgccaaactcaacagattatactatatcatctccccctgaaagagaagagtgagacataagtcctctgcagtctgttccactcctactagatcttgaagtcatatgttgattcttttcatsgtattgtgtgcctgtgttttaaggaaaataattagcattcttaaagcaaagcaaaaattttactaaagaaaataattagcctttcatgtcactttcttagagtgaaccaaataagttttgtatgagagaaagataggggcccgtagatgcccactttagttttgcagggtgggttcctacagccacgttcccctgggctaataaggctaatggaatcatggtggcagttttgcattggcctccagctaatgaaaagttttgccatgagaacttaacttagtccttctgatgcttttactg

SEQ ID NO: 153861 - DNA, 601 bp, Human
tgcagggtgggttcctacagccacgttcccctgggctaataaggctaatggaatcatggtggcagttttgcattggcctccagctaatgaaaagttttgccatgagaacttaacttagtccttctgatgcttttactgcctgttgacacagaaggtggaaaatgaccaactatgctatacataaaaacaaagtccagatattcttatattcttttagaatatgtcttatgtgctgatttttaaaatattaagggaaaaattgacttgtgatacttgaaagttcatagaacagggcactgcrttaaaacagggcttatgcaaataaaacacatttttctgttcttggccagcagttctaccgtcaggatacttattccatacagcactgtatgatacagaccaagatttatagttggtgatttcctgagtaacaactcagatagcaaatgcctccacaaaacaactttcgtatgttctgcaaggcacaaagtagtacaatagaaaggattgtttgcttcaggatttttgtggggtggtttctttttctttttcttttttctcccacaagacagaatttttcttcttgccctaaaatttgaaa

SEQ ID NO: 153862 - DNA, 601 bp, Human
ccatacagcactgtatgatacagaccaagatttatagttggtgatttcctgagtaacaactcagatagcaaatgcctccacaaaacaactttcgtatgttctgcaaggcacaaagtagtacaatagaaaggattgtttgcttcaggatttttgtggggtggtttctttttctttttcttttttctcccacaagacagaatttttcttcttgccctaaaatttgaaagatttctcctttctctccccttctgccacaagtagtcccaccctaaaaaggaagatgaggttctctagcaacccwtaagatgctcataagaaatagcttaaacttttgctttgaaacaagacattcacatattggggttgtgggccaataaactagtcaatagaaagaatggggaagaagcagtgaatgcaaggacagtgttggtggggaagggggaatattctggttttcgtttctgtggatttttaggccaaatttgaacacaggctcttgatgacacatgaagtatctctaacttgattttatgtatgcacactttatgtactatctgtacataagtcatagacatatagattggactagaatttagagttc

SEQ ID NO: 153863 - DNA, 601 bp, Human
tagtcccaccctaaaaaggaagatgaggttctctagcaacccataagatgctcataagaaatagcttaaacttttgctttgaaacaagacattcacatattggggttgtgggccaataaactagtcaatagaaagaatggggaagaagcagtgaatgcaaggacagtgttggtggggaagggggaatattctggttttcgtttctgtggatttttaggccaaatttgaacacaggctcttgatgacacatgaagtatctctaacttgattttatgtatgcacactttatgtactatctgtrcataagtcatagacatatagattggactagaatttagagttcagaaatgaacactcacttgtacagtcagttaattttcaataaaggtgccaagacagttcaacaaaggtagtcttttcaactggtggtgctgggacaactgggtagccacatgcaaaagaatgaagttagactctcacctcacatcatatacagaaagtagttcaaaatggatcaaagacctaaactatgagataaaagagaagaaaacataggtataaatatataacatataaaataccaaaaatataaacaacaaaa

SEQ ID NO: 153864 - DNA, 601 bp, Human
tttcgtttctgtggatttttaggccaaatttgaacacaggctcttgatgacacatgaagtatctctaacttgattttatgtatgcacactttatgtactatctgtacataagtcatagacatatagattggactagaatttagagttcagaaatgaacactcacttgtacagtcagttaattttcaataaaggtgccaagacagttcaacaaaggtagtcttttcaactggtggtgctgggacaactgggtagccacatgcaaaagaatgaagttagactctcacctcacatcatatacaraaagtagttcaaaatggatcaaagacctaaactatgagataaaagagaagaaaacataggtataaatatataacatataaaataccaaaaatataaacaacaaaagaagaaatagataaatgagacttcatcaagataaaaacatttttgcttcagataacaccattaagaaagtgaaaagacggctcacagaatggaggaaacactttcaaatcatataccaaataagaatcttgtatactgaatatgtaaggaactcttataactcaaaagtaaaaagacaaataattcaactaaaac

SEQ ID NO: 153865 - DNA, 601 bp, Human
aagtatctctaacttgattttatgtatgcacactttatgtactatctgtacataagtcatagacatatagattggactagaatttagagttcagaaatgaacactcacttgtacagtcagttaattttcaataaaggtgccaagacagttcaacaaaggtagtcttttcaactggtggtgctgggacaactgggtagccacatgcaaaagaatgaagttagactctcacctcacatcatatacagaaagtagttcaaaatggatcaaagacctaaactatgagataaaagagaagaaaacmtaggtataaatatataacatataaaataccaaaaatataaacaacaaaagaagaaatagataaatgagacttcatcaagataaaaacatttttgcttcagataacaccattaagaaagtgaaaagacggctcacagaatggaggaaacactttcaaatcatataccaaataagaatcttgtatactgaatatgtaaggaactcttataactcaaaagtaaaaagacaaataattcaactaaaacatgagcaatagatttgaaagacatttctccaaaagtatataaatgggctatatgca

SEQ ID NO: 153866 - DNA, 601 bp, Human
gagtctatttatatttacatgaaatgttcagaataggcaaatctaaagacagtagattagtgtgttaggggcttgggggtaaatggagaatgactgtttatggatataaggtttctttttcggtgtaaggaagatgttctaaaattgataatgatgatggtctttcaaccctgtgaatatactacaaaccattgcattatacgtgttaagtgttgagtgtatgatgtgtggattatatctcaataaagatgttaaaccacacacagtcatattacataattacacagtcatattgaattcygttataatttcagatttatggactaacactgaatactcagagtattaagcgacctgttccagtgcatatagctggtgatcacagagccagacttcctgaacatcaggccaactgtctctccattgtgattgttacaggaagtttgaccccaacataccatacaagtcacacttaaaatttgtattggtgtggccaggtaccactcacttgttcatgtaacagatcagcaagcccctgaaaccgaggctggcaatagcagtttaattcctgctcctgtaaggttcagtagtgtaggctggg

SEQ ID NO: 153867 - DNA, 601 bp, Human
catcttgtctgctcctttacagtacaggtggctggcagagaagggaagatggagccgccatcttgaacatgtctactccttagttcccgctggcattcacctgtgcaagctcccagcttgctggctgctctttgatagaaaatgatttggggctgcttttcattaaaaagaagaaccttaccaaggactcccatacccttgctatctgcctgcgtgatttcttcttaactcctatatccctatctgggcttgaagttttctccttatacttaaaaaatcaatccaaaggctagtcagcccrcatgatgactgggcacaagtttagaagtttcatatcatggctcctgcttcattgtgagggattttaatacctttagagcaatgttaagtacccagtctgactggttattctgtcagcagagtctgtcacctgtcctagaagaatagtcttgtttgttgctcctagactggctgatgattgataggagtttccaagttgtatcttattggaaggacctttgagagctctaggcctgtgggccttcctgaggaggtgactgcatttgaataggctctaagtttcctatatcttgcctctgcc

SEQ ID NO: 153868 - DNA, 601 bp, Human
gcctcctgagtagctgggactgcaggtgcccattacgatgcctggctaatttttgtctttagtagagatggggtttcaccatgttggccagggtggtcttcaactcctgacctcaagtgatccgcctgcctgcgcctcccaaagcgttgggattacaggcatgagccaccatgcccggcctggtatcagtgttttaaacctactgcacatatatcctaatatagacaaaaatgtgattacctctttttaaaaacaagcccaactctaaaatatcatacttcggggagcttttatttttgcmtcctgccccttgctcccaattgtcaacttatctccccctactcttgctaccaattgtcagtttacccccagcccctacccctcacacatataccccaatttccaggttgttataaagcattcatatatttttgtgtaaaaaatgatttcttgcatttttccaagataattatttgaaaatgtaattatttgaaaacagattgtgttttaatgtgaaatcacctaataccctaattagtttatttagcttagaaacttggtctagagcagtggctcttaacttggccatattttttttaag

SEQ ID NO: 153869 - DNA, 601 bp, Human
gggtttcaccgtgttagccaggatgatctctatctcctgacctcgtgatccgcccgcctcagcctcccaaagtgatgggattacaggcgtgagccaccgcacctggccctctgtttttcaactcccttttctgagctgtcaccaagtcctcttactgtttcctggaactgtctttcggttgtcttccttcccgtttcttcctggctgatcccgtccctcaacatctcacaatgggaaaggcctgacagaggagtcggtctctgaggcgtccattataccatattaattttctctaattacyactgtcagcacattactcctcttcggtgaggctgccaggagctccctgcttcttgtggctacaaatgtcaacaccgtcctcacatgctagaccttccagagcctagcttcacgggaaggcccagcttcattgctcttttctccctgtgagccccagaggcccactgtcttccctgggttttcttcgtgagtcagccatgtttcttttatgcctttagtttctgttctccccagcttccggttctctccctgcctttccaactacagcaggtcctccaataatgtcgtttcattcgatgtc

SEQ ID NO: 153870 - DNA, 601 bp, Human
gttagccaggatgatctctatctcctgacctcgtgatccgcccgcctcagcctcccaaagtgatgggattacaggcgtgagccaccgcacctggccctctgtttttcaactcccttttctgagctgtcaccaagtcctcttactgtttcctggaactgtctttcggttgtcttccttcccgtttcttcctggctgatcccgtccctcaacatctcacaatgggaaaggcctgacagaggagtcggtctctgaggcgtccattataccatattaattttctctaattaccactgtcagcacrttactcctcttcggtgaggctgccaggagctccctgcttcttgtggctacaaatgtcaacaccgtcctcacatgctagaccttccagagcctagcttcacgggaaggcccagcttcattgctcttttctccctgtgagccccagaggcccactgtcttccctgggttttcttcgtgagtcagccatgtttcttttatgcctttagtttctgttctccccagcttccggttctctccctgcctttccaactacagcaggtcctccaataatgtcgtttcattcgatgtcatttcctcataa

SEQ ID NO: 153871 - DNA, 601 bp, Human; identical to SEQ ID NO: 34897

SEQ ID NO: 153872 - DNA, 601 bp, Human; identical to SEQ ID NO: 34898

SEQ ID NO: 153873 - DNA, 601 bp, Human; identical to SEQ ID NO: 34899

SEQ ID NO: 153874 - DNA, 601 bp, Human; identical to SEQ ID NO: 34900

SEQ ID NO: 153875 - DNA, 601 bp, Human; identical to SEQ ID NO: 34901

SEQ ID NO: 153876 - DNA, 601 bp, Human
gatattctgctttgttgtgcaagacacatttgaaagctgaggaacaatcctctaataaatacagtgggtttgataaatactcttgctgcatagttagaaatgatgatggaaatgaactaacatgtcttcagcttttatatcctggctgcaaatacagcactgctgctgtatttgagagttgttattacctggtagagtaattaggcaggtcagagattctgattataactcagaagccagcaaggaagtttccctaggaagttaagcttgccaggcgctgccttcttcctgccccagcctrtgggcctgacttgatctaaaaagttagctcttagccctgaccaaacttgtctcctattccctgtcatcttgatttgggcttaacaacctaacttctgggtgcttatgcttgcttcctgtttgtatctgtgttcccctttgctgcctgcccctcaccttatcattttatttctgatcccagtctcgtgtcctaccactcaccaatccctgtgtcagtttagcttggtgttctcaagccagactccatgaacattaccacagcagcaaagggaggaaattctcaagcttcacctaatgtaga

SEQ ID NO: 153877 - DNA, 601 bp, Human
cctcaacatcaatgatttaaaaaaaaagaaaaaaagttgaaaattgaggccaaacagaaactatacaatattttttttaattttttagtaaatgagattttttgatatatgcaaatgagatctttacctgatcaatattagcttaagaaaatatcagacttaaatttaaaagcaaagattcttccatgttcagaaagctaacttctcagcaccaccttgtggtaacttttacttaagccaggatgtttgtttattgtaagatttatattaatattacattgtacaatggagaaattaaaartgtaattggaaatagctatctaacttctttatcatcaaaggggaaaattaacagtttagtataaacattttacttcatgttatcatcaaacctatattttgtggtagcctaagtaccttaatttagggatagcatggtagagaaaattttttttttttttgagacacagagtcttgctctgttgcccaggatggagtgcagtggcacaatcgtggctcactgcaacgtctgtctccctggttcaagcaattctcctgcctcagcctccctagtagctgggattacaggcgtgtgccaccg

SEQ ID NO: 153878 - DNA, 601 bp, Human
tacaattatacatttttgattatttgttcatctattctcatttctttttttctttttttctttttttttttgaggtggactttcactcttgctgcccaggctggaatgcaatggtgcaaattcagctcaccacaaacctccacctcctgggttcaagcgattctcctgcctcagcctcccgagtagttggggttacaggcatgtgccaccatgcccagctaattttgtatttttagtagagacagggtttctccatgttggtcaggctggtcttgagctctcaacctcaggtgatttgccygcctcggcctcccaaagtgctaggattacagtcgtgagccaccgcccccagctatgtattctcatttcttaaatgatggcttgatctccattcaccccccaaattcttttgcagtttatcttgcctgttaaattctgtttaattttgtcgttcccattactagaaaggagcaagtgaagaggttgacatttcattgttccaagtaatatgagcacccttttaactggaattttttccctatgtaataatgagttgagaattggttcataaaatattatggttttgaaaatgtcagcatgg

SEQ ID NO: 153879 - DNA, 601 bp, Human; identical to SEQ ID NO: 34902

SEQ ID NO: 153880 - DNA, 601 bp, Human; identical to SEQ ID NO: 34903

SEQ ID NO: 153881 - DNA, 601 bp, Human; identical to SEQ ID NO: 34904

SEQ ID NO: 153882 - DNA, 601 bp, Human; identical to SEQ ID NO: 34905

SEQ ID NO: 153883 - DNA, 601 bp, Human; identical to SEQ ID NO: 34906

SEQ ID NO: 153884 - DNA, 601 bp, Human; identical to SEQ ID NO: 34907

SEQ ID NO: 153885 - DNA, 601 bp, Human; identical to SEQ ID NO: 34908

SEQ ID NO: 153886 - DNA, 601 bp, Human; identical to SEQ ID NO: 34909

SEQ ID NO: 153887 - DNA, 601 bp, Human; identical to SEQ ID NO: 34910

SEQ ID NO: 153888 - DNA, 601 bp, Human
agggacaagaatctcttgaaccgagaggtagaggttgcagcgagctgagatcgcaccattgcacccccacctgggtgacagagcaaggctctgtctcgaaaataaatacataaaataaaataaaacaaaatcaagctatctaaaagataattagtcctgagactacatgcagctcaggtctgtctgattcggaaacattataattatgtattaaggcagatgggaaaagatgtttattgcagctttgtttgcaatcacaaaacatgaaaaacaacctaaatgttgttaagcaaaaaaaaaatcatgctgtgatgtgcacatagatggaatatagataggcttgtgtatgtgttgggggaggggcgcacacactcttacatgtgtctaaaatatttctggagggaggataccttctggaaggtgaactagaaggctagtatggatgggagatttattcttcactccgtttttgtactgcttggatttttaaattttttaaggagtgtgtgtattaaataattactgtttctaaacttttaaaaaccaatgtaaatcctatcctcactactccactgcctcattgaaggtggagaaatgtatc

SEQ ID NO: 153889 - DNA, 601 bp, Human
cactccgtttttgtactgcttggatttttaaattttttaaggagtgtgtgtattaaataattactgtttctaaacttttaaaaaccaatgtaaatcctatcctcactactccactgcctcattgaaggtggagaaatgtatcccccatggtggcgccctctgcactgccagccttccaacaggaacggcagtggcattgcctgaccctcctcactttgccaagcgcccccactcacatcagtctttctcatttaagcctcataccacctgtggaatgggtgctgtctcatctgatgtgaaygagcctgaggctcagggcgaatgcctggccaaggtacagccagtgagtgggagagtgagggctcatacacaagcctggagtccatacatcccaggggcaggagagtgggccttcaccttgatgtttccactgaggtggctgtggccatggcacatggtaaacttacaagcattggaagacaaagttatttgctttgaaggtagacatcatttaaatcctggctttgccacaaattagttatgtgatcttggtcaaatcatcaaatctctatatgcttatttttgcatgtataaaattgga

SEQ ID NO: 153890 - DNA, 601 bp, Human
ctgaccctcctcactttgccaagcgcccccactcacatcagtctttctcatttaagcctcataccacctgtggaatgggtgctgtctcatctgatgtgaatgagcctgaggctcagggcgaatgcctggccaaggtacagccagtgagtgggagagtgagggctcatacacaagcctggagtccatacatcccaggggcaggagagtgggccttcaccttgatgtttccactgaggtggctgtggccatggcacatggtaaacttacaagcattggaagacaaagttatttgctttgaagrtagacatcatttaaatcctggctttgccacaaattagttatgtgatcttggtcaaatcatcaaatctctatatgcttatttttgcatgtataaaattggaataatagtacctgtcttataggattatggtgagggttcaatgagaatatacaataagtaaatatatatcaatatataactataggtactattaatgaagaatatgtgcacgtgtttgtgtagctatagcatttagcatggagcctggcaccaaaaaaagggcttaaataatgtagctagtattattgtgggcacctatgg

SEQ ID NO: 153891 - DNA, 601 bp, Human
actttgccaagcgcccccactcacatcagtctttctcatttaagcctcataccacctgtggaatgggtgctgtctcatctgatgtgaatgagcctgaggctcagggcgaatgcctggccaaggtacagccagtgagtgggagagtgagggctcatacacaagcctggagtccatacatcccaggggcaggagagtgggccttcaccttgatgtttccactgaggtggctgtggccatggcacatggtaaacttacaagcattggaagacaaagttatttgctttgaaggtagacatcattyaaatcctggctttgccacaaattagttatgtgatcttggtcaaatcatcaaatctctatatgcttatttttgcatgtataaaattggaataatagtacctgtcttataggattatggtgagggttcaatgagaatatacaataagtaaatatatatcaatatataactataggtactattaatgaagaatatgtgcacgtgtttgtgtagctatagcatttagcatggagcctggcaccaaaaaaagggcttaaataatgtagctagtattattgtgggcacctatggttgcctcccaag

SEQ ID NO: 153892 - DNA, 601 bp, Human
ctgaatttacacaccaaagtcaggatcttctgaggacaaatagagacagacctgggtccctgtctgcccacagccacatgggggtttgtctttgaggtgagcctgactccacaaacccaaggcctttcataggcaggcagtataggtcccttctagactgagcattccaatctagattgagatggaactccacaggcgtcctttgaaagaagcccctgagtgcccacaccatgccagctctgtgtcaggcatcctttctaggtgtggaaacagtagctttcatggtgtgattagagcattratatggagcctagggatctgggttctagttcaggcgttaaaccactgttagactatagttagaggtttgaaatatactggcaattactaacagatttaaacagatttaaaatactgcaggtccaagcgatgaatcatatttggttaaattcctgtttttaagcagttttctttctctgttcattgactttgaaactttcttttctcagcctgttcttttttcttggaaaaatcctaattctgttgtttggcaatgtctttaatgtctttgtttttcccctctgctttttttttttttttt

SEQ ID NO: 153893 - DNA, 601 bp, Human
gcctagggatctgggttctagttcaggcgttaaaccactgttagactatagttagaggtttgaaatatactggcaattactaacagatttaaacagatttaaaatactgcaggtccaagcgatgaatcatatttggttaaattcctgtttttaagcagttttctttctctgttcattgactttgaaactttcttttctcagcctgttcttttttcttggaaaaatcctaattctgttgtttggcaatgtctttaatgtctttgtttttcccctctgctttttttttttttttttttttttttttggagacaggatcttgctgtgttgcccaggctggtctcaaactcctgggctcaagtgatcctcccacctcagcctctcaagtagctgggattgtaggcacaagccaccacattcagcatcctctactattttgattcctagaagtttccagttgtgtgtttatgatggtatttctgtgccttgtcttcccaaggtctggccttggaaaataatattagaaaattatattgctggtattatcagtataaagtaaaactgtgccaaaggctacagccattaaaggtcacaatgggtaaca

SEQ ID NO: 153894 - DNA, 601 bp, Human
tttcctcagccccatttatattcactactatcattcactctttaccactaatatcttccctgctgtctaatcactaatatcttccctcctgtctaatcactaatgtcttccttcctgtctaatcactgagttaagggaaaaatagtcatttacttacaggaatataatgggtattaataacaaaattccatttccccattaaaagctatgtctaagaaaaaaaatagtggaggcattatttaaaacttctaaatggcctggtgagtatagtcttagtttagcttccttacttttttgtatkcccaacctgaaatgatgtcatcccgtatcatcacagtatgttgctttttcagtacgaagttaatgggctttcctgctgtttaactgctttgagattttaaaaattcattcagccacatagtattcaaagcatggagctgggtgccacaaagacttgggcctggcatcacccagaagctcaaggaaggcagaggatgagcaccttctccattatacttggtacttgattgttcatggaattaaaatttaaatataaatgaactatatataaatgccataataaaaatatacgaaagtgctt

SEQ ID NO: 153895 - DNA, 601 bp, Human
ttagtttagcttccttacttttttgtatgcccaacctgaaatgatgtcatcccgtatcatcacagtatgttgctttttcagtacgaagttaatgggctttcctgctgtttaactgctttgagattttaaaaattcattcagccacatagtattcaaagcatggagctgggtgccacaaagacttgggcctggcatcacccagaagctcaaggaaggcagaggatgagcaccttctccattatacttggtacttgattgttcatggaattaaaatttaaatataaatgaactatatataaaygccataataaaaatatacgaaagtgctttggaagtacagataagaaaagtgacacttctagcctgagaatcagggaagaatggtccttcaaggacttgaaaaaatgaacagaattaaggcaaagacgttaggactagcttttcagtctgaggcagagtggagatatagcagagcaagaggtttggttggtgcctatatcataagcaaggtttaatgggaagtgtgattagcaagttagccttgaatgccaggctaaagatttatgatttattatagaaacagtggagttagtggaaatgt

SEQ ID NO: 153896 - DNA, 601 bp, Human
gtggtgcatgcctgtagtcttagttacttgggaggctgagacagcaggattgcttgagcccaggagttggaggctgaagtgagctatgatcaggctactgcacttcagccaggtgacgaagcgagacactgtctctattaaaaaaaggaaaaaagaaggcaaaggtgaaactagataaaagaccctggtgagggaccctacaaagatagaatcagttgatgaggcagccaccagcatgagagtcaaaagagaccaaagaataaaaaatgatgtcaaatgtcaaggatggcaataccactcrcagaaatagggaagatggtgatttaaagagcttgaagtagcaataaggcaaatggaaatgtcattttccatagagttgtgatatcttttctcctgcattaacatttttaaaatactgataaagtgtttttaaaaattactaatgctggctggctcagtggctcacgcctgtaatccagcactttgggaggctgaggccggaagatcacttgaggtcaggagttcaagaccagcctggtcaacatggtgaaaccccgtctctactaaaaatacaagtatttttagtagctgggcatggtgg

SEQ ID NO: 153897 - DNA, 601 bp, Human
tcacgcctgtaatccagcactttgggaggctgaggccggaagatcacttgaggtcaggagttcaagaccagcctggtcaacatggtgaaaccccgtctctactaaaaatacaagtatttttagtagctgggcatggtggtgtaatcccagctacttgggaggctgacctgggaggcagaggttgcaatgagccaagatagtgccactgcacgccagtctgggtgataaagtgagactcagtctcaaaaacaaacaaacaaactactaatgcttttgtaatgtttgacctttgaagcatatytcttaggagctcggaaatggagctccttgcactatgcttatgttgttcttgaaaacagacgttctctgtgatggctgtccttgttctctaagatcatttcactattttgtaaggtaagcagtggagtgatttctggtttttgacatgagaaaataaaggaatggatctaagcaactattaagactacccaggcacaaagctatgagatatataaaatataagccatcagtgttgttgtagtagtagttagcatggtgaataataagaataatattgcttggagcaaagcaaatggtaaaa

SEQ ID NO: 153898 - DNA, 601 bp, Human
gtatcattttccatgcctgtaattgaaagaaagtattaacataaatgtatagttcaagagaaaagaaagtgtgtttaattatttgtaaataatttctgtgattgtagaatttaagatcatttttattttaaaaagttattgtagattaggcagtcaacaagcatatatttaatacatatcatatgccccagaacaacactatcttgtgcggaaacaaaaactaaatgatcagtccttgtatgtaaagtgtttataatactattagaagaaacaaaaacagcccatcagaacattataggcrtgttgactacaaactatacaggcattcagacaatacttaatagattcagatgtttgagcaaaatgtcaaggaaaagatgaacttgagcaaagactagcaaggttcctaaaaagatggaatttaatgagtaagattctgctggtgatgaatggacagaagcatagtgtgggctatcatgggatctgggaatgccagataagttgatttagcaaatttttattgtacattgatgtgtcagtggtgtaaagttttaaataaaatccatttctatctgtaagtaatgctactcgtggagaagat

SEQ ID NO: 153899 - DNA, 601 bp, Human
tagaatttaagatcatttttattttaaaaagttattgtagattaggcagtcaacaagcatatatttaatacatatcatatgccccagaacaacactatcttgtgcggaaacaaaaactaaatgatcagtccttgtatgtaaagtgtttataatactattagaagaaacaaaaacagcccatcagaacattataggcatgttgactacaaactatacaggcattcagacaatacttaatagattcagatgtttgagcaaaatgtcaaggaaaagatgaacttgagcaaagactagcaaggtwcctaaaaagatggaatttaatgagtaagattctgctggtgatgaatggacagaagcatagtgtgggctatcatgggatctgggaatgccagataagttgatttagcaaatttttattgtacattgatgtgtcagtggtgtaaagttttaaataaaatccatttctatctgtaagtaatgctactcgtggagaagatgcataaaaatgcattgtcttatgcgaataaagtgcagctgagaaaggaaattgaaagagtgggtgacagctaaattcctgaagggcctctaaactgtcctaaga

SEQ ID NO: 153900 - DNA, 601 bp, Human
ccccgcaaagattctacctgctaattcctggaacctacaagtatattcctttacctagcaaaagggattttgcagatctaacttagttaaggatcttcctttttttttttttttttttttgagacagtctcactctgtcgcccaggctggagtgcagtggcacgatctcagctcactgcaacctccgcctcccgggttcacgccattctcctgcctcagcctccccagtagctgggactacaagcgcccgccaccaggcctggctaattttttgtatttttttagtagagacagggtttcrccatgttagccaggatggtctcgatctcctgacctcgtgatctgcccgcctcggccacccaaagtgctgggattacaggcgtgagccaccgcgcccggccagttaaggatcttaaaatgagattttcctggattgcctgggtgggtcaaatataatcataacagtccatataaggggaaggtaagagggttgtcaaagtcagagatttgaagatgctatgctgctggctttgaagatggaagaaagggtcataacccaaggaatgcaggcagattctagaagctgaaaaaagcaagatag

SEQ ID NO: 153901 - DNA, 601 bp, Human
agtgctgggattacaggcgtgagccaccgcgcccggccagttaaggatcttaaaatgagattttcctggattgcctgggtgggtcaaatataatcataacagtccatataaggggaaggtaagagggttgtcaaagtcagagatttgaagatgctatgctgctggctttgaagatggaagaaagggtcataacccaaggaatgcaggcagattctagaagctgaaaaaagcaagatagccgattctctcctagagcctccagaatgaacacaaccccaccaacagccttgattttaagacstctgatctccagaaatataatctgttattttaagccactcagtttgtaatgatttgatatagcagcagtaggaaacgaatatagccgttattttgacttgtttttaagatgacttaggtaatagtgtagagaacagattggaaaggtaagaaattacaggcaaggggacctgatttggaggctactgtcatcattcatagctcagtgagttactgagctagaacagtggttatggaaaggcagaggcgaacacgtgagactctgatggcggcttaaagggacttggttctgattggcttt

SEQ ID NO: 153902 - DNA, 601 bp, Human
gttatggaaaggcagaggcgaacacgtgagactctgatggcggcttaaagggacttggttctgattggctttggggtgcagtgagggagaggcaggaagcaataatgactcaggtttctactctagatgacttggagggagaggatgccattaactgagttggagggagacaaggagacaggatcggggagaagctacaatctgtttttagtctgactgaggatgagttgctggtggaatattagtgtgtaaaatgtccagcaactggttagaagactggatgtgggtccaaaattccagragcccaaattagaggcatgatttattgtagtctgcatggaggctctcgtttaatttaatgggagtggttgagatggcctagggggagttatgagaagaaagaatccaaaggtggactttaggggtaatgacagattttaagggaagaggaaacaaaggaggaaaaatcggaagatgaaatcggtatgaggacctaagaagttggaaatgaattctttaaaagatagaaacacatcaactatatgctatcaatatttggtgttacttggcatgttgatgttaataatcctaattcctgcaa

SEQ ID NO: 153903 - DNA, 601 bp, Human
ctcttcctgctttaatctctagcagttagctcccgggtgaaatggaaaccctccacgtaaacctgagattgcacaagctgaattcacggtgtaaaatagaggaggtgtgtcctagtaactgaggggtatggaggtgatcaggtatcatttaagaaaaggtagattaaagaaaaggaaagaaaaatttgggaggcagcattcttctatgcctgtatttagaggtgatcttagaagctgtgttgtgtgacacacaaacccttctgctcacttttgcattttggaaaagttcttgcatctgacwtcacccaaagagaagtgcctttaaagataggcacaaagttagagaatggtgcctgaagagcatgccgtacaagttattagcctgattttaaaaagctgttaaaaccaagtgtttgtccgttttcagaaagtttctgggatttagcaagacatcatgcctccagacatgccaaacagtgcctgtgttttgtggaaaagttgatttgattccattttccgtgagaatgccagatctgggtccacttaaataaggcttttattcctcagagcctggttttccttatgaattgtactcattgtt

SEQ ID NO: 153904 - DNA, 601 bp, Human
gcacaaagttagagaatggtgcctgaagagcatgccgtacaagttattagcctgattttaaaaagctgttaaaaccaagtgtttgtccgttttcagaaagtttctgggatttagcaagacatcatgcctccagacatgccaaacagtgcctgtgttttgtggaaaagttgatttgattccattttccgtgagaatgccagatctgggtccacttaaataaggcttttattcctcagagcctggttttccttatgaattgtactcattgttaaatttttttattgtattttaattctttatrgaggcttccattgggcataatatttcggaaatgtttttctatccgggaaaaggccttgaagaactaatccaaagagaatgaactccggcctctcaggggtgtccaagggagagaatacagtcatggattcatagtttctgtttctagttgagccagtaaagccccttcctcatccctcttttccatttacctctagagacagaaactaaaaaccatggcttcaggctgctaaaagcctaaaacaaaacaaaaccacaacgaaataaggcaggttggacaagcttgcttcattcttccttc

SEQ ID NO: 153905 - DNA, 601 bp, Human
cgttttcagaaagtttctgggatttagcaagacatcatgcctccagacatgccaaacagtgcctgtgttttgtggaaaagttgatttgattccattttccgtgagaatgccagatctgggtccacttaaataaggcttttattcctcagagcctggttttccttatgaattgtactcattgttaaatttttttattgtattttaattctttatagaggcttccattgggcataatatttcggaaatgtttttctatccgggaaaaggccttgaagaactaatccaaagagaatgaactccrgcctctcaggggtgtccaagggagagaatacagtcatggattcatagtttctgtttctagttgagccagtaaagccccttcctcatccctcttttccatttacctctagagacagaaactaaaaaccatggcttcaggctgctaaaagcctaaaacaaaacaaaaccacaacgaaataaggcaggttggacaagcttgcttcattcttccttcacatttctcccccaccccatggaagaaagcaaattcactgcctctttgtttccttcagaggcccccgttttcacctccatcaaaccc

SEQ ID NO: 153906 - DNA, 601 bp, Human
ggggatcacttgaggtcaggagtttgagaccagcctgaccaacatggtgaaaccccatctctactaaaaatgcaaaaattagctgagcgtggtggcgggcgcctgttatcccagctacttgggaggctgaggcaggagaatagcttgaccctgagaggcggaggttgcagtgagcaagcctgggtgacagagcaacactccatctcaaaaataaaataaataagaaaaagcagactttacattgataagattcagcttttacttttggttttacatttaactctagtaatcgttagttcartgtttcataatttaaaccgttgacttaaattcatctgatttgtaatttctctcttcagtttggcctataagactaatactttaagctttgaagtaagattgttactgccttctcatctgggtagaaatctgtgtggtgtatcttctacagtgataagttatgaaggaaggcaaatacccttcaaaagaactgagacacataaatgaactcatagagcttagtttttaggttatagctggggagtgttgggttctcttagatcttgtaaacagagaaaaattagctcctgcttccctgtct

SEQ ID NO: 153907 - DNA, 601 bp, Human
ttattcctacacataggtaaaatgttcccatttgttaaatgtcacatgtttcctgaaaatatctctgctgataattatttacttgccatctcagaaaagattttataaaacacaattgctacctggaagttccacttaatatctgtcagggctgcttttgtagcaggaccatcagaatcaacccaaagttaaataggaatatttacctataataggaataatgcaatacattttcattgctgctgttgcttcctttctaaagctatctttaactacttagtctttgctccccctgcaactygacacctttaccataggttaaccctttctcacctatgtctggatcatgtgtctgcagtatatattgccctgatcacattgtattataattgtttttctttttttttttcttttcttttttttttttttttttttttgtgagacagagtctcactctgtcccaaggctggagttcagtggcctgaccttggcttactgcaacctccacccaccaggttcaagcaatcctcccgccttcctcccaagtagctgggactacaggcatgcaccaccactcctggctaatttttgtatttttagt

SEQ ID NO: 153908 - DNA, 601 bp, Human
tattcctacacataggtaaaatgttcccatttgttaaatgtcacatgtttcctgaaaatatctctgctgataattatttacttgccatctcagaaaagattttataaaacacaattgctacctggaagttccacttaatatctgtcagggctgcttttgtagcaggaccatcagaatcaacccaaagttaaataggaatatttacctataataggaataatgcaatacattttcattgctgctgttgcttcctttctaaagctatctttaactacttagtctttgctccccctgcaacttsacacctttaccataggttaaccctttctcacctatgtctggatcatgtgtctgcagtatatattgccctgatcacattgtattataattgtttttctttttttttttcttttcttttttttttttttttttttttgtgagacagagtctcactctgtcccaaggctggagttcagtggcctgaccttggcttactgcaacctccacccaccaggttcaagcaatcctcccgccttcctcccaagtagctgggactacaggcatgcaccaccactcctggctaatttttgtatttttagta

SEQ ID NO: 153909 - DNA, 601 bp, Human
cagaaaagattttataaaacacaattgctacctggaagttccacttaatatctgtcagggctgcttttgtagcaggaccatcagaatcaacccaaagttaaataggaatatttacctataataggaataatgcaatacattttcattgctgctgttgcttcctttctaaagctatctttaactacttagtctttgctccccctgcaacttgacacctttaccataggttaaccctttctcacctatgtctggatcatgtgtctgcagtatatattgccctgatcacattgtattataattstttttctttttttttttcttttcttttttttttttttttttttttgtgagacagagtctcactctgtcccaaggctggagttcagtggcctgaccttggcttactgcaacctccacccaccaggttcaagcaatcctcccgccttcctcccaagtagctgggactacaggcatgcaccaccactcctggctaatttttgtatttttagtagagatgaggtttcaccatgttggccaggctggtctcgaactcctgacctcaagtggtccaccaccctcagcctctcaaagtgctgggatt

SEQ ID NO: 153910 - DNA, 601 bp, Human
cctcccgccttcctcccaagtagctgggactacaggcatgcaccaccactcctggctaatttttgtatttttagtagagatgaggtttcaccatgttggccaggctggtctcgaactcctgacctcaagtggtccaccaccctcagcctctcaaagtgctgggattacaggtgtaagccaccatgcccagctatatgtcttgacacatctgtctcttacactacattgttaggtccttgaggacaatcaccatgttgttgtttgtttttaatttttgtctctgtgtctgataaatatcgaygatccctgtgtttctctcaaattaaaaatatcccatggtaccctgggacaccttgacacttagtttgggaaccacaataattgattgagggagagagtgtttgactagggtagcccgggaagactttttggagtaggtagcatttgagttgagacctgaatggtgagaaaaagccaacagccacacagtgagggtagagtattgtggtctgaaagagactcgtgtgaaggtctagaacaggaagggggaagtaaacgggtgtgaggtgcagccagagaggcagtaggcagggccatgccg

SEQ ID NO: 153911 - DNA, 601 bp, Human
agatgaggtttcaccatgttggccaggctggtctcgaactcctgacctcaagtggtccaccaccctcagcctctcaaagtgctgggattacaggtgtaagccaccatgcccagctatatgtcttgacacatctgtctcttacactacattgttaggtccttgaggacaatcaccatgttgttgtttgtttttaatttttgtctctgtgtctgataaatatcgatgatccctgtgtttctctcaaattaaaaatatcccatggtaccctgggacaccttgacacttagtttgggaaccacartaattgattgagggagagagtgtttgactagggtagcccgggaagactttttggagtaggtagcatttgagttgagacctgaatggtgagaaaaagccaacagccacacagtgagggtagagtattgtggtctgaaagagactcgtgtgaaggtctagaacaggaagggggaagtaaacgggtgtgaggtgcagccagagaggcagtaggcagggccatgccgttggagccccgccatccctgagaaggcaccctgtgtttccttctaactgccggggggaagcctttggggaagcttta

SEQ ID NO: 153912 - DNA, 601 bp, Human
gatgaggtttcaccatgttggccaggctggtctcgaactcctgacctcaagtggtccaccaccctcagcctctcaaagtgctgggattacaggtgtaagccaccatgcccagctatatgtcttgacacatctgtctcttacactacattgttaggtccttgaggacaatcaccatgttgttgtttgtttttaatttttgtctctgtgtctgataaatatcgatgatccctgtgtttctctcaaattaaaaatatcccatggtaccctgggacaccttgacacttagtttgggaaccacaayaattgattgagggagagagtgtttgactagggtagcccgggaagactttttggagtaggtagcatttgagttgagacctgaatggtgagaaaaagccaacagccacacagtgagggtagagtattgtggtctgaaagagactcgtgtgaaggtctagaacaggaagggggaagtaaacgggtgtgaggtgcagccagagaggcagtaggcagggccatgccgttggagccccgccatccctgagaaggcaccctgtgtttccttctaactgccggggggaagcctttggggaagctttaa

SEQ ID NO: 153913 - DNA, 601 bp, Human
tacaggtgtaagccaccatgcccagctatatgtcttgacacatctgtctcttacactacattgttaggtccttgaggacaatcaccatgttgttgtttgtttttaatttttgtctctgtgtctgataaatatcgatgatccctgtgtttctctcaaattaaaaatatcccatggtaccctgggacaccttgacacttagtttgggaaccacaataattgattgagggagagagtgtttgactagggtagcccgggaagactttttggagtaggtagcatttgagttgagacctgaatggtragaaaaagccaacagccacacagtgagggtagagtattgtggtctgaaagagactcgtgtgaaggtctagaacaggaagggggaagtaaacgggtgtgaggtgcagccagagaggcagtaggcagggccatgccgttggagccccgccatccctgagaaggcaccctgtgtttccttctaactgccggggggaagcctttggggaagctttaagtagaggagtggtgcactgagctatctattttgaagggatcctctgggccctctgtagagggccactgtggtgagggcaagcttaga

SEQ ID NO: 153914 - DNA, 601 bp, Human
aatatcgatgatccctgtgtttctctcaaattaaaaatatcccatggtaccctgggacaccttgacacttagtttgggaaccacaataattgattgagggagagagtgtttgactagggtagcccgggaagactttttggagtaggtagcatttgagttgagacctgaatggtgagaaaaagccaacagccacacagtgagggtagagtattgtggtctgaaagagactcgtgtgaaggtctagaacaggaagggggaagtaaacgggtgtgaggtgcagccagagaggcagtaggcaggsccatgccgttggagccccgccatccctgagaaggcaccctgtgtttccttctaactgccggggggaagcctttggggaagctttaagtagaggagtggtgcactgagctatctattttgaagggatcctctgggccctctgtagagggccactgtggtgagggcaagcttagatgcagcagaagctgctagggggctgatgcagctgtccagttgggagatgatggggggctggactaaagagtggtggggaagaaggaggaagtggtcgggtttggggtctgcttcattaggagtgtgt

SEQ ID NO: 153915 - DNA, 601 bp, Human; identical to SEQ ID NO: 34911

SEQ ID NO: 153916 - DNA, 601 bp, Human; identical to SEQ ID NO: 34912

SEQ ID NO: 153917 - DNA, 601 bp, Human; identical to SEQ ID NO: 34913

SEQ ID NO: 153918 - DNA, 601 bp, Human; identical to SEQ ID NO: 34914

SEQ ID NO: 153919 - DNA, 601 bp, Human; identical to SEQ ID NO: 34915

SEQ ID NO: 153920 - DNA, 601 bp, Human; identical to SEQ ID NO: 34916

SEQ ID NO: 153921 - DNA, 601 bp, Human; identical to SEQ ID NO: 34917

SEQ ID NO: 153922 - DNA, 601 bp, Human; identical to SEQ ID NO: 34918

SEQ ID NO: 153923 - DNA, 601 bp, Human; identical to SEQ ID NO: 34919

SEQ ID NO: 153924 - DNA, 601 bp, Human; identical to SEQ ID NO: 34920

SEQ ID NO: 153925 - DNA, 601 bp, Human; identical to SEQ ID NO: 34921

SEQ ID NO: 153926 - DNA, 601 bp, Human; identical to SEQ ID NO: 34922

SEQ ID NO: 153927 - DNA, 601 bp, Human; identical to SEQ ID NO: 34923

SEQ ID NO: 153928 - DNA, 601 bp, Human; identical to SEQ ID NO: 34924

SEQ ID NO: 153929 - DNA, 601 bp, Human; identical to SEQ ID NO: 34925

SEQ ID NO: 153930 - DNA, 601 bp, Human; identical to SEQ ID NO: 34926

SEQ ID NO: 153931 - DNA, 601 bp, Human; identical to SEQ ID NO: 34927

SEQ ID NO: 153932 - DNA, 601 bp, Human; identical to SEQ ID NO: 34928

SEQ ID NO: 153933 - DNA, 601 bp, Human; identical to SEQ ID NO: 34929

SEQ ID NO: 153934 - DNA, 601 bp, Human; identical to SEQ ID NO: 34930

SEQ ID NO: 153935 - DNA, 601 bp, Human; identical to SEQ ID NO: 34931

SEQ ID NO: 153936 - DNA, 601 bp, Human; identical to SEQ ID NO: 34932

SEQ ID NO: 153937 - DNA, 601 bp, Human; identical to SEQ ID NO: 34933

SEQ ID NO: 153938 - DNA, 601 bp, Human; identical to SEQ ID NO: 34934

SEQ ID NO: 153939 - DNA, 601 bp, Human; identical to SEQ ID NO: 34935

SEQ ID NO: 153940 - DNA, 601 bp, Human
aagccaaaaggagacatccatattattttctaaaagataaaatatcagaagctattctatgtgtgcctttcagctgatgtgtgaagtgtaaccataagaaatatctcttgccaggacattattgaggaagtcacagtaggttacattcgtgagaatatatggtctgcttcagaagagttgcttcttcgctttcaagccacaagctcaggacccatccttagggaagagtttgaagctagaaaatcatttttgcatgaacaagaagagaatgtggtcaaaatacaggtatgtggatcacctrccactgtttacacaaaactgtcatatcacctgaaaatgttttatttgataatagaatagtcaactaccagcattcctataaacaaatctgactgcatatttttacataatcagtgcccctagtctacttcactaaggctttaaaataggaagcattttgatgatgaatgacttaacctatggtcttctagagagcatttaggagcaccgcagatttgcacagatccacctgctgccaacctagttggacccaaagggatataccttggatcagagttgaaatcatacctgacttggggac

SEQ ID NO: 153941 - DNA, 601 bp, Human
tgccaggacattattgaggaagtcacagtaggttacattcgtgagaatatatggtctgcttcagaagagttgcttcttcgctttcaagccacaagctcaggacccatccttagggaagagtttgaagctagaaaatcatttttgcatgaacaagaagagaatgtggtcaaaatacaggtatgtggatcacctaccactgtttacacaaaactgtcatatcacctgaaaatgttttatttgataatagaatagtcaactaccagcattcctataaacaaatctgactgcatatttttacatwatcagtgcccctagtctacttcactaaggctttaaaataggaagcattttgatgatgaatgacttaacctatggtcttctagagagcatttaggagcaccgcagatttgcacagatccacctgctgccaacctagttggacccaaagggatataccttggatcagagttgaaatcatacctgacttggggactttacaatttggcttttttgtggttagtagatgttgagtggcgtcttagtttctgtgctgttctagcctgaaagaacaggagaactaatgaaataaacagatttagcc

SEQ ID NO: 153942 - DNA, 601 bp, Human
ctttttattgtgagttcaaaggggtattattaacaactggtaaagtctgatgctgatgggtttttactttgaagtttcctaaattgaacatttttctgttgaagaccttcttttttgtgtggtcactggtgaactcatctgcttttcccacctaactgtaatgtccaaggcagaaaatgaattttacaaacatttgtcttcttgtatcttgcacatgataggtgcttacatatttaaatttgcttggagcttaagatattattagcaaagcagaaataattaattttataaaagaaatttstactataaatctgacactcaaaggatttttctaggtgggccaatgagtttacaatgtattcctttaaacaaatagtaggcaaaacacacaggaagtgaacaaaagcctaaaaatagtcatctacactgatgagactctaattttgcacaaatttcacgtgtcagccaatataaaattgggaccccacactctccagtctcaggtcacacagcagtgttgcagttggaagatataccacagagcccaccagtacagaatccctctatattagaaaccagggctgaaggatgagagaaatgg

SEQ ID NO: 153943 - DNA, 601 bp, Human
ggcatgaggcctaaaggtaagcctactttacagatgtggaccagaagtgaataatacagttaataggaacctgctgacccataaaaccaagagactgtgaaccaaaaggtgtcatgctaatctcatttctcaccaaagtggctggttcaccttcaagtaggaaaatgttctgatatctgagaaggtcccctacgtaaaacactgtgagcttcctagctggctgaactgccccccagacacagtagtcttaacacatttggagagaaatacaaaggcaaaactcctaggccgaggccagctrtactccggctacaccaccctccctgccatcagtggtctgccaaggaaatgagtagtggtacagagaatgtgcagcatgatcaacatccagcattctgtctcaagtgcttatggagttaactgggaggtgcccaggtcaatatagaggaagtcaaggagaatctacatagccatattatttttgagcagttagaagtccccgataaaattgcctgagtgagccagaaaaaaaaatctgttcataaacaaaaaagattttatatcagaaatagaaaaaggaatgtaacttgtaaaatataaa

SEQ ID NO: 153944 - DNA, 601 bp, Human
tgacctctgaggtctaagcgttttgacagacttcttttatacagatactctgcacagaaaatatatttatggtactagaaaacaaaacaaataagatggctattataaattttcccacaagttcccataccaggcaggagaatgagactgccattttttttttttttttgagacagagtcttgctctgtcgcccaggctggagtgcagtggcaccatcccagctcactgcaacctccacctcctgggttcaagtgattctcatgcctcagcttcccaagtagctgggattactggcatgcrccaccacacccagctcattttggtattttttatagagacagaatttcaccatgttggccaggctggtcttgaactcttggcctcgagtgatctgcctgcctcggctttccaaagtgctgggattataggcataagccaccacacctggcctgtaaatcccatctgtctgtaattttcaaagtttctttatatcaactgtatacccatatttgcttataataaacagcctctaattagagaagagattacaatgtcatggctatgcacaagagttctgttgttaggacataataggaaaag

SEQ ID NO: 153945 - DNA, 601 bp, Human
tataaattttcccacaagttcccataccaggcaggagaatgagactgccattttttttttttttttgagacagagtcttgctctgtcgcccaggctggagtgcagtggcaccatcccagctcactgcaacctccacctcctgggttcaagtgattctcatgcctcagcttcccaagtagctgggattactggcatgcgccaccacacccagctcattttggtattttttatagagacagaatttcaccatgttggccaggctggtcttgaactcttggcctcgagtgatctgcctgcctcrgctttccaaagtgctgggattataggcataagccaccacacctggcctgtaaatcccatctgtctgtaattttcaaagtttctttatatcaactgtatacccatatttgcttataataaacagcctctaattagagaagagattacaatgtcatggctatgcacaagagttctgttgttaggacataataggaaaagctcatctcaaaggaactaaaacttacagactaaaaaaagaaaaacagaattttggcaaatgaaatatgaggcatgtagtattctgcttctatggaacaaaaaa

SEQ ID NO: 153946 - DNA, 601 bp, Human
ccagctcactgcaacctccacctcctgggttcaagtgattctcatgcctcagcttcccaagtagctgggattactggcatgcgccaccacacccagctcattttggtattttttatagagacagaatttcaccatgttggccaggctggtcttgaactcttggcctcgagtgatctgcctgcctcggctttccaaagtgctgggattataggcataagccaccacacctggcctgtaaatcccatctgtctgtaattttcaaagtttctttatatcaactgtatacccatatttgcttatrataaacagcctctaattagagaagagattacaatgtcatggctatgcacaagagttctgttgttaggacataataggaaaagctcatctcaaaggaactaaaacttacagactaaaaaaagaaaaacagaattttggcaaatgaaatatgaggcatgtagtattctgcttctatggaacaaaaaaattcttttattattatgctttaagttcgggatacatgtgcagaatgtgcaggtttgttacataggtatacacgtgccatggtggtttgctgcacccatcaacccaccatctagat

SEQ ID NO: 153947 - DNA, 601 bp, Human
cagctcattttggtattttttatagagacagaatttcaccatgttggccaggctggtcttgaactcttggcctcgagtgatctgcctgcctcggctttccaaagtgctgggattataggcataagccaccacacctggcctgtaaatcccatctgtctgtaattttcaaagtttctttatatcaactgtatacccatatttgcttataataaacagcctctaattagagaagagattacaatgtcatggctatgcacaagagttctgttgttaggacataataggaaaagctcatctcaawggaactaaaacttacagactaaaaaaagaaaaacagaattttggcaaatgaaatatgaggcatgtagtattctgcttctatggaacaaaaaaattcttttattattatgctttaagttcgggatacatgtgcagaatgtgcaggtttgttacataggtatacacgtgccatggtggtttgctgcacccatcaacccaccatctagattaggtatttctcctaatgctatccctcccctagttccccaccccctgacaagccccagtgtgtgatgttcccctccctgtgtccatatgttct

SEQ ID NO: 153948 - DNA, 601 bp, Human
tcccaccagtagtgtaaaaagcattcctatttctccacatcctctccagcatctattgtttcctgacgttttaatgattgccattccaactggcgtgagatggtatctcattgtgattttgatttgtatttctctgatgaccagtgatgatgagctttttttcatgtttgttgactgcataaatgtcttcttttgagaagtgtctcttcatatccaggagcaaaaaaattatattcccagccaagctgcctttgtttggaaacgtaaaaaaactcataaatatagaagaataccagaaaawtttacataaatagttatgagatgaaacataataatgagctctcaaggtaaatagttaatccttagtatattaaaaaaaaaaaacagaatggacgaatggggtaattttgccaatgcaggaatgattcaatattaaataatctgttactatgacaggtcacttattcagaatgtttgcgaatctcagataattgaaattaagtgtttttggagtttaggtaattccagaagagcagaataggaacttgagctaattccaattatcttgtttagcctttcagtatggactaaggaaggagtg

SEQ ID NO: 153949 - DNA, 601 bp, Human
ttttaatgattgccattccaactggcgtgagatggtatctcattgtgattttgatttgtatttctctgatgaccagtgatgatgagctttttttcatgtttgttgactgcataaatgtcttcttttgagaagtgtctcttcatatccaggagcaaaaaaattatattcccagccaagctgcctttgtttggaaacgtaaaaaaactcataaatatagaagaataccagaaaattttacataaatagttatgagatgaaacataataatgagctctcaaggtaaatagttaatccttagtayattaaaaaaaaaaaacagaatggacgaatggggtaattttgccaatgcaggaatgattcaatattaaataatctgttactatgacaggtcacttattcagaatgtttgcgaatctcagataattgaaattaagtgtttttggagtttaggtaattccagaagagcagaataggaacttgagctaattccaattatcttgtttagcctttcagtatggactaaggaaggagtggaatttataatatacattcaaacaattgcacttctctgctttaaaccagtgttaaccaccaaaatata

SEQ ID NO: 153950 - DNA, 601 bp, Human
taaatgtcttcttttgagaagtgtctcttcatatccaggagcaaaaaaattatattcccagccaagctgcctttgtttggaaacgtaaaaaaactcataaatatagaagaataccagaaaattttacataaatagttatgagatgaaacataataatgagctctcaaggtaaatagttaatccttagtatattaaaaaaaaaaaacagaatggacgaatggggtaattttgccaatgcaggaatgattcaatattaaataatctgttactatgacaggtcacttattcagaatgtttgcgratctcagataattgaaattaagtgtttttggagtttaggtaattccagaagagcagaataggaacttgagctaattccaattatcttgtttagcctttcagtatggactaaggaaggagtggaatttataatatacattcaaacaattgcacttctctgctttaaaccagtgttaaccaccaaaatataggaactgttaagatccatcacaacacatgttttactggttggactgccatggaatcccagtgacccacgattagggtccacttcccctagtttctgttgtgctgttgggcc

SEQ ID NO: 153951 - DNA, 601 bp, Human
aatggggtaattttgccaatgcaggaatgattcaatattaaataatctgttactatgacaggtcacttattcagaatgtttgcgaatctcagataattgaaattaagtgtttttggagtttaggtaattccagaagagcagaataggaacttgagctaattccaattatcttgtttagcctttcagtatggactaaggaaggagtggaatttataatatacattcaaacaattgcacttctctgctttaaaccagtgttaaccaccaaaatataggaactgttaagatccatcacaacacrtgttttactggttggactgccatggaatcccagtgacccacgattagggtccacttcccctagtttctgttgtgctgttgggccacttttatgaacaactgttggtgacatcagagaattttgcccatctcagaattgtcacactgtgacaaatcccatggggtagcattttctaaacggataattaatttaaaattttttattttggttatttacatttttatcatttaatgtgtgaacacatacccaatgctctctttgcctggaagattggtaaaagtacaaaatctcaagccttcc

SEQ ID NO: 153952 - DNA, 601 bp, Human
cctttcagtatggactaaggaaggagtggaatttataatatacattcaaacaattgcacttctctgctttaaaccagtgttaaccaccaaaatataggaactgttaagatccatcacaacacatgttttactggttggactgccatggaatcccagtgacccacgattagggtccacttcccctagtttctgttgtgctgttgggccacttttatgaacaactgttggtgacatcagagaattttgcccatctcagaattgtcacactgtgacaaatcccatggggtagcattttctaaayggataattaatttaaaattttttattttggttatttacatttttatcatttaatgtgtgaacacatacccaatgctctctttgcctggaagattggtaaaagtacaaaatctcaagccttccccgaggcctactgaatcctaacctgcattctgacaagatcctcggatgattttatattcacattaaagtttgagaagcaccgttaagatcactccagtttcaaaactccagataataattcatcttcctgtataattctttatcaccataagagcttaagggagaaaaacccatgtgc

SEQ ID NO: 153953 - DNA, 601 bp, Human
aaatggaatgcatgttcttttccctattcttccgtaaatacaactaaaagcctccaatattatatataaacaaacataacactcttaaaagtgaagagaaaaaagtcagactaagtagtgaaccttgggacccaaggaatgacatagtggtgagttctttgagttttctttttgtttatatttttctgacctggagctggagaggctggccacccagaaatgccaatgggtacaggctctgatatggtttggctctgtgtccccacccgaatctcatcttgaattgaacttccataattcytgcatgttgtgggagggacccagtgggagataatttgaatcatgggggcggtttcccccatactgttcttgtggtagtgaataagtctcatgagacctgatggttttataaggggtttccacttttgcttctttctcattctctcttgctgccaccgtgtaagaagtgccttttgccttccaccatgattgtgaggcctccccagccacatggaactgtgagtccattaaacctgtttttcttcccagtctcaggtatgtctgtatcatcagcgtgaaaactgattaatacaggctctag

SEQ ID NO: 153954 - DNA, 601 bp, Human
attgaacttccataattcttgcatgttgtgggagggacccagtgggagataatttgaatcatgggggcggtttcccccatactgttcttgtggtagtgaataagtctcatgagacctgatggttttataaggggtttccacttttgcttctttctcattctctcttgctgccaccgtgtaagaagtgccttttgccttccaccatgattgtgaggcctccccagccacatggaactgtgagtccattaaacctgtttttcttcccagtctcaggtatgtctgtatcatcagcgtgaaaacwgattaatacaggctctagtgaaagcctgctctctgtagccaaaggaccaagaaagaaacaggctagcaagacagaaataatttcagacagtaactgctctactctagccaaacaccacacacacacacacacacacacacacacacacgaaaaaaactgtaatgcctccacctaggcagcgaagcctgaatggcgagcctggacttccaccctcctggactgtaataaggcacccagacttatagaatctggatcttgtgcccactgagcagtaatgtggcagccctccctctccctgct

SEQ ID NO: 153955 - DNA, 601 bp, Human
tcttgcatgttgtgggagggacccagtgggagataatttgaatcatgggggcggtttcccccatactgttcttgtggtagtgaataagtctcatgagacctgatggttttataaggggtttccacttttgcttctttctcattctctcttgctgccaccgtgtaagaagtgccttttgccttccaccatgattgtgaggcctccccagccacatggaactgtgagtccattaaacctgtttttcttcccagtctcaggtatgtctgtatcatcagcgtgaaaactgattaatacaggctcyagtgaaagcctgctctctgtagccaaaggaccaagaaagaaacaggctagcaagacagaaataatttcagacagtaactgctctactctagccaaacaccacacacacacacacacacacacacacacacacgaaaaaaactgtaatgcctccacctaggcagcgaagcctgaatggcgagcctggacttccaccctcctggactgtaataaggcacccagacttatagaatctggatcttgtgcccactgagcagtaatgtggcagccctccctctccctgctagagtggtgtgagagg

SEQ ID NO: 153956 - DNA, 601 bp, Human
ttgcatgttgtgggagggacccagtgggagataatttgaatcatgggggcggtttcccccatactgttcttgtggtagtgaataagtctcatgagacctgatggttttataaggggtttccacttttgcttctttctcattctctcttgctgccaccgtgtaagaagtgccttttgccttccaccatgattgtgaggcctccccagccacatggaactgtgagtccattaaacctgtttttcttcccagtctcaggtatgtctgtatcatcagcgtgaaaactgattaatacaggctctartgaaagcctgctctctgtagccaaaggaccaagaaagaaacaggctagcaagacagaaataatttcagacagtaactgctctactctagccaaacaccacacacacacacacacacacacacacacacacgaaaaaaactgtaatgcctccacctaggcagcgaagcctgaatggcgagcctggacttccaccctcctggactgtaataaggcacccagacttatagaatctggatcttgtgcccactgagcagtaatgtggcagccctccctctccctgctagagtggtgtgagaggag

SEQ ID NO: 153957 - DNA, 601 bp, Human
tgcttctttctcattctctcttgctgccaccgtgtaagaagtgccttttgccttccaccatgattgtgaggcctccccagccacatggaactgtgagtccattaaacctgtttttcttcccagtctcaggtatgtctgtatcatcagcgtgaaaactgattaatacaggctctagtgaaagcctgctctctgtagccaaaggaccaagaaagaaacaggctagcaagacagaaataatttcagacagtaactgctctactctagccaaacaccacacacacacacacacacacacacacacacacgaaaaaaactgtaatgcctccacctaggcagcgaagcctgaatggcgagcctggacttccaccctcctggactgtaataaggcacccagacttatagaatctggatcttgtgcccactgagcagtaatgtggcagccctccctctccctgctagagtggtgtgagaggagccatggcagagaggcaggaccttcacaccatccagttgtaatgaggtctttcccctcagttggtcaattgaggccacatggggagtaataagaaggcacccctactctcccagccagagtgatatc

SEQ ID NO: 153958 - DNA, 601 bp, Human
cttctttctcattctctcttgctgccaccgtgtaagaagtgccttttgccttccaccatgattgtgaggcctccccagccacatggaactgtgagtccattaaacctgtttttcttcccagtctcaggtatgtctgtatcatcagcgtgaaaactgattaatacaggctctagtgaaagcctgctctctgtagccaaaggaccaagaaagaaacaggctagcaagacagaaataatttcagacagtaactgctctactctagccaaacaccacacacacacacacacacacacacacacacacgaaaaaaactgtaatgcctccacctaggcagcgaagcctgaatggcgagcctggacttccaccctcctggactgtaataaggcacccagacttatagaatctggatcttgtgcccactgagcagtaatgtggcagccctccctctccctgctagagtggtgtgagaggagccatggcagagaggcaggaccttcacaccatccagttgtaatgaggtctttcccctcagttggtcaattgaggccacatggggagtaataagaaggcacccctactctcccagccagagtgatatcaa

SEQ ID NO: 153959 - DNA, 601 bp, Human
tctttctcattctctcttgctgccaccgtgtaagaagtgccttttgccttccaccatgattgtgaggcctccccagccacatggaactgtgagtccattaaacctgtttttcttcccagtctcaggtatgtctgtatcatcagcgtgaaaactgattaatacaggctctagtgaaagcctgctctctgtagccaaaggaccaagaaagaaacaggctagcaagacagaaataatttcagacagtaactgctctactctagccaaacaccacacacacacacacacacacacacacacacaagaaaaaaactgtaatgcctccacctaggcagcgaagcctgaatggcgagcctggacttccaccctcctggactgtaataaggcacccagacttatagaatctggatcttgtgcccactgagcagtaatgtggcagccctccctctccctgctagagtggtgtgagaggagccatggcagagaggcaggaccttcacaccatccagttgtaatgaggtctttcccctcagttggtcaattgaggccacatggggagtaataagaaggcacccctactctcccagccagagtgatatcaaga

SEQ ID NO: 153960 - DNA, 601 bp, Human
gaagtgccttttgccttccaccatgattgtgaggcctccccagccacatggaactgtgagtccattaaacctgtttttcttcccagtctcaggtatgtctgtatcatcagcgtgaaaactgattaatacaggctctagtgaaagcctgctctctgtagccaaaggaccaagaaagaaacaggctagcaagacagaaataatttcagacagtaactgctctactctagccaaacaccacacacacacacacacacacacacacacacacgaaaaaaactgtaatgcctccacctaggcagcraagcctgaatggcgagcctggacttccaccctcctggactgtaataaggcacccagacttatagaatctggatcttgtgcccactgagcagtaatgtggcagccctccctctccctgctagagtggtgtgagaggagccatggcagagaggcaggaccttcacaccatccagttgtaatgaggtctttcccctcagttggtcaattgaggccacatggggagtaataagaaggcacccctactctcccagccagagtgatatcaagagaggtccagtaggtagctggaccccctcccagc

SEQ ID NO: 153961 - DNA, 601 bp, Human
aagcctgctctctgtagccaaaggaccaagaaagaaacaggctagcaagacagaaataatttcagacagtaactgctctactctagccaaacaccacacacacacacacacacacacacacacacacgaaaaaaactgtaatgcctccacctaggcagcgaagcctgaatggcgagcctggacttccaccctcctggactgtaataaggcacccagacttatagaatctggatcttgtgcccactgagcagtaatgtggcagccctccctctccctgctagagtggtgtgagaggagccawggcagagaggcaggaccttcacaccatccagttgtaatgaggtctttcccctcagttggtcaattgaggccacatggggagtaataagaaggcacccctactctcccagccagagtgatatcaagagaggtccagtaggtagctggaccccctcccagcaataatgaggaggccttccccaccttagtagtaaggttccttgggtcccaagattcactagcctcctttttttctcttcacctttaagagagttatgtttgtttatatagacagaaaccaaatggagaacctagccttctc

SEQ ID NO: 153962 - DNA, 601 bp, Human
acagtaactgctctactctagccaaacaccacacacacacacacacacacacacacacacacgaaaaaaactgtaatgcctccacctaggcagcgaagcctgaatggcgagcctggacttccaccctcctggactgtaataaggcacccagacttatagaatctggatcttgtgcccactgagcagtaatgtggcagccctccctctccctgctagagtggtgtgagaggagccatggcagagaggcaggaccttcacaccatccagttgtaatgaggtctttcccctcagttggtcaatkgaggccacatggggagtaataagaaggcacccctactctcccagccagagtgatatcaagagaggtccagtaggtagctggaccccctcccagcaataatgaggaggccttccccaccttagtagtaaggttccttgggtcccaagattcactagcctcctttttttctcttcacctttaagagagttatgtttgtttatatagacagaaaccaaatggagaacctagccttctcctcccacctcctagtaatgaggcagtgcccccactttttccttgccaaaacaatgtcaggaaaag

SEQ ID NO: 153963 - DNA, 601 bp, Human
tgaatggcgagcctggacttccaccctcctggactgtaataaggcacccagacttatagaatctggatcttgtgcccactgagcagtaatgtggcagccctccctctccctgctagagtggtgtgagaggagccatggcagagaggcaggaccttcacaccatccagttgtaatgaggtctttcccctcagttggtcaattgaggccacatggggagtaataagaaggcacccctactctcccagccagagtgatatcaagagaggtccagtaggtagctggaccccctcccagcaataaygaggaggccttccccaccttagtagtaaggttccttgggtcccaagattcactagcctcctttttttctcttcacctttaagagagttatgtttgtttatatagacagaaaccaaatggagaacctagccttctcctcccacctcctagtaatgaggcagtgcccccactttttccttgccaaaacaatgtcaggaaaagccacctaaaacagtaggattaaataagatccaggaccccaaactaccgacattacctaaggttcaatcacttgactgtttggatattgcaatcacaacaa

SEQ ID NO: 153964 - DNA, 601 bp, Human
aaagcagactgaaagaaataaagaacagagcctcagggatcagtgggattataacagaagatttgacatttgtgtcatcggattcccagaggagaggagaaagaggcagtactgacaaagtacttgaaataaaagtggaaatgttccaaaaacacagattcaagaagctgaggaaacctcagacaggataaagtgaaagaaattcacacaaagacatatcatagtcaaacttctgaaaacaaaagacaaagaaaatatttggaaaagcagtgagatagaaacaacttacctgtaagagggrgacagttctaatgacagaggatttttcataacctaaggaggccagaaggaagtacaacatttttcgggggaatcaaaggctgaatgaggagtctagacttccaccctcctgtaacaaggcacccagacacttgtagaacctggagagaaaataactgtcaacatagaattttatatccagcaaaaataacctttaggaatgaaggagaaactaagagcacttgttaccagcaaacttccctcaaagaatgactacagatagctctctaaaccaaaaggaaatgaagaaagaagaaatttc

SEQ ID NO: 153965 - DNA, 601 bp, Human
gtcatcggattcccagaggagaggagaaagaggcagtactgacaaagtacttgaaataaaagtggaaatgttccaaaaacacagattcaagaagctgaggaaacctcagacaggataaagtgaaagaaattcacacaaagacatatcatagtcaaacttctgaaaacaaaagacaaagaaaatatttggaaaagcagtgagatagaaacaacttacctgtaagagggagacagttctaatgacagaggatttttcataacctaaggaggccagaaggaagtacaacatttttcgggggaakcaaaggctgaatgaggagtctagacttccaccctcctgtaacaaggcacccagacacttgtagaacctggagagaaaataactgtcaacatagaattttatatccagcaaaaataacctttaggaatgaaggagaaactaagagcacttgttaccagcaaacttccctcaaagaatgactacagatagctctctaaaccaaaaggaaatgaagaaagaagaaatttcggaacatcagaagggaagaaaggatagctagaagaataaaaatatgaataaatacatttttctactcttgagt

SEQ ID NO: 153966 - DNA, 601 bp, Human
tccaccctcctgtaacaaggcacccagacacttgtagaacctggagagaaaataactgtcaacatagaattttatatccagcaaaaataacctttaggaatgaaggagaaactaagagcacttgttaccagcaaacttccctcaaagaatgactacagatagctctctaaaccaaaaggaaatgaagaaagaagaaatttcggaacatcagaagggaagaaaggatagctagaagaataaaaatatgaataaatacatttttctactcttgagtttttaaagttgacagttgaagtgctgwtgtggctctgaatgaagcctgcttcattctctgtggtttctctcaagggatggcgttcagtgtctgtggcttttccaggcacgtggtacaagctgtcgatggatctaccattctggggtctggaggacagtggccatctgctcacagctccactaggcaatgccccagtggggactctgtgtaggagctccaaccccacacttctcctccatactgccctagcagagattcttcatgacagttctgctcctgcagcaggcttctgcctggacacccaggcttttccaaacattctttgaa

SEQ ID NO: 153967 - DNA, 601 bp, Human
aaaataacctttaggaatgaaggagaaactaagagcacttgttaccagcaaacttccctcaaagaatgactacagatagctctctaaaccaaaaggaaatgaagaaagaagaaatttcggaacatcagaagggaagaaaggatagctagaagaataaaaatatgaataaatacatttttctactcttgagtttttaaagttgacagttgaagtgctgttgtggctctgaatgaagcctgcttcattctctgtggtttctctcaagggatggcgttcagtgtctgtggcttttccaggcacrtggtacaagctgtcgatggatctaccattctggggtctggaggacagtggccatctgctcacagctccactaggcaatgccccagtggggactctgtgtaggagctccaaccccacacttctcctccatactgccctagcagagattcttcatgacagttctgctcctgcagcaggcttctgcctggacacccaggcttttccaaacattctttgaaatctaggcagaggctcccaaacctcgacttttgcattctatgcacccacaggcttaacatgacatggaaggcactaaggctta

SEQ ID NO: 153968 - DNA, 601 bp, Human
aaataacctttaggaatgaaggagaaactaagagcacttgttaccagcaaacttccctcaaagaatgactacagatagctctctaaaccaaaaggaaatgaagaaagaagaaatttcggaacatcagaagggaagaaaggatagctagaagaataaaaatatgaataaatacatttttctactcttgagtttttaaagttgacagttgaagtgctgttgtggctctgaatgaagcctgcttcattctctgtggtttctctcaagggatggcgttcagtgtctgtggcttttccaggcacgkggtacaagctgtcgatggatctaccattctggggtctggaggacagtggccatctgctcacagctccactaggcaatgccccagtggggactctgtgtaggagctccaaccccacacttctcctccatactgccctagcagagattcttcatgacagttctgctcctgcagcaggcttctgcctggacacccaggcttttccaaacattctttgaaatctaggcagaggctcccaaacctcgacttttgcattctatgcacccacaggcttaacatgacatggaaggcactaaggcttac

SEQ ID NO: 153969 - DNA, 601 bp, Human
ggcaatgccccagtggggactctgtgtaggagctccaaccccacacttctcctccatactgccctagcagagattcttcatgacagttctgctcctgcagcaggcttctgcctggacacccaggcttttccaaacattctttgaaatctaggcagaggctcccaaacctcgacttttgcattctatgcacccacaggcttaacatgacatggaaggcactaaggcttacagcttgcaccctctgaagcagcagccttagctgtacctgagccccttttagccatggttagatctggagcgsctgggatgcagggattactgtcccaaggctgtgcagtgcatcaaggccctgggcccacaaaaccattctgccctcctaggcttcccagcctgtgatggcaggggctgctgtgaaggtctaaagcattggggatttcagttcaacatgagatttgggtggggatgcaaatccaaaccatattaaggcatgagccatcatgtccagttcacatctttatataagtttgtatttgtatttgtgtgtacaatgatggggtatgtgtgtttacacatgtgcgtatttcagaagatacataataaa

SEQ ID NO: 153970 - DNA, 601 bp, Human
ggcttaacatgacatggaaggcactaaggcttacagcttgcaccctctgaagcagcagccttagctgtacctgagccccttttagccatggttagatctggagcggctgggatgcagggattactgtcccaaggctgtgcagtgcatcaaggccctgggcccacaaaaccattctgccctcctaggcttcccagcctgtgatggcaggggctgctgtgaaggtctaaagcattggggatttcagttcaacatgagatttgggtggggatgcaaatccaaaccatattaaggcatgagccaycatgtccagttcacatctttatataagtttgtatttgtatttgtgtgtacaatgatggggtatgtgtgtttacacatgtgcgtatttcagaagatacataataaaatgttaaatagtagttgcctttataaagtagctaggtggaagtagagataggtacacaggtatgtataccctttctctttgttcactgtgtattttaatagatattctagatattgaggtacagattgtttgcatagaaatatatagaattattctgtgggttttttgttaacatgtggtatcataatatgtgtg

SEQ ID NO: 153971 - DNA, 601 bp, Human
gatctggagcggctgggatgcagggattactgtcccaaggctgtgcagtgcatcaaggccctgggcccacaaaaccattctgccctcctaggcttcccagcctgtgatggcaggggctgctgtgaaggtctaaagcattggggatttcagttcaacatgagatttgggtggggatgcaaatccaaaccatattaaggcatgagccatcatgtccagttcacatctttatataagtttgtatttgtatttgtgtgtacaatgatggggtatgtgtgtttacacatgtgcgtatttcagaagrtacataataaaatgttaaatagtagttgcctttataaagtagctaggtggaagtagagataggtacacaggtatgtataccctttctctttgttcactgtgtattttaatagatattctagatattgaggtacagattgtttgcatagaaatatatagaattattctgtgggttttttgttaacatgtggtatcataatatgtgtggtaagctaaaatttccttttcatattagcaatatatcttagaggtcttcctgttctccaaaatacagagcattgccatagtcagtatatatgac

SEQ ID NO: 153972 - DNA, 601 bp, Human
attaaggcatgagccatcatgtccagttcacatctttatataagtttgtatttgtatttgtgtgtacaatgatggggtatgtgtgtttacacatgtgcgtatttcagaagatacataataaaatgttaaatagtagttgcctttataaagtagctaggtggaagtagagataggtacacaggtatgtataccctttctctttgttcactgtgtattttaatagatattctagatattgaggtacagattgtttgcatagaaatatatagaattattctgtgggttttttgttaacatgtgrtatcataatatgtgtggtaagctaaaatttccttttcatattagcaatatatcttagaggtcttcctgttctccaaaatacagagcattgccatagtcagtatatatgaccttactttactctttttttatatatatactttaagttctagggtacatgtgcacaacgtgcaggtttgttacatatgtatacatgtgccatgttggtttgctgcgcccactaactcgtcatttacattaggtatttctcctaatgctatccctccccgctcccttactttactcttaactgatgtgtaac

SEQ ID NO: 153973 - DNA, 601 bp, Human
agataggtacacaggtatgtataccctttctctttgttcactgtgtattttaatagatattctagatattgaggtacagattgtttgcatagaaatatatagaattattctgtgggttttttgttaacatgtggtatcataatatgtgtggtaagctaaaatttccttttcatattagcaatatatcttagaggtcttcctgttctccaaaatacagagcattgccatagtcagtatatatgaccttactttactctttttttatatatatactttaagttctagggtacatgtgcacaaygtgcaggtttgttacatatgtatacatgtgccatgttggtttgctgcgcccactaactcgtcatttacattaggtatttctcctaatgctatccctccccgctcccttactttactcttaactgatgtgtaacatccctcagtgggactgcaattgcagtgtctctagctgttccccctattagtgaacattttactggatgcacaattttggtattacaaacaatgctgtgacaaaaatacttatatatggggcttttctacacaggtgctttaattttcctgggctagatatattgaa

SEQ ID NO: 153974 - DNA, 601 bp, Human
gtacacaggtatgtataccctttctctttgttcactgtgtattttaatagatattctagatattgaggtacagattgtttgcatagaaatatatagaattattctgtgggttttttgttaacatgtggtatcataatatgtgtggtaagctaaaatttccttttcatattagcaatatatcttagaggtcttcctgttctccaaaatacagagcattgccatagtcagtatatatgaccttactttactctttttttatatatatactttaagttctagggtacatgtgcacaacgtgcakgtttgttacatatgtatacatgtgccatgttggtttgctgcgcccactaactcgtcatttacattaggtatttctcctaatgctatccctccccgctcccttactttactcttaactgatgtgtaacatccctcagtgggactgcaattgcagtgtctctagctgttccccctattagtgaacattttactggatgcacaattttggtattacaaacaatgctgtgacaaaaatacttatatatggggcttttctacacaggtgctttaattttcctgggctagatatattgaaaattag

SEQ ID NO: 153975 - DNA, 601 bp, Human
tttaatagatattctagatattgaggtacagattgtttgcatagaaatatatagaattattctgtgggttttttgttaacatgtggtatcataatatgtgtggtaagctaaaatttccttttcatattagcaatatatcttagaggtcttcctgttctccaaaatacagagcattgccatagtcagtatatatgaccttactttactctttttttatatatatactttaagttctagggtacatgtgcacaacgtgcaggtttgttacatatgtatacatgtgccatgttggtttgctgcrcccactaactcgtcatttacattaggtatttctcctaatgctatccctccccgctcccttactttactcttaactgatgtgtaacatccctcagtgggactgcaattgcagtgtctctagctgttccccctattagtgaacattttactggatgcacaattttggtattacaaacaatgctgtgacaaaaatacttatatatggggcttttctacacaggtgctttaattttcctgggctagatatattgaaaattagaaatactaggtgaaaggctaaataattttaaatttgatactg

SEQ ID NO: 153976 - DNA, 601 bp, Human
ccctattagtgaacattttactggatgcacaattttggtattacaaacaatgctgtgacaaaaatacttatatatggggcttttctacacaggtgctttaattttcctgggctagatatattgaaaattagaaatactaggtgaaaggctaaataattttaaatttgatactgctaaattccctccccaaaactatacccttttgtagtttcctcgagctcacacttcaccatctatgctttctttgtccaccgattgacatatggataaggcaagaattttcccaaaattactctgactrcctcaagcttaaagccataaaaaaaagttttgacattttttatggaaatttgctctgcctcttcctctttcagttcagttctagttgctttctgttttctaggaaccctcataatttttatctctatgccttcttattttctagcactattatggattgctttaaaagtatgtttgggccaggcatggctaacacctgtaatcccaacactttgggaggccaaggtagggtggattgcttgagtccaggaattcaagaccagcctgggcaacatagtgaaacttagtctctctgaaaaat

SEQ ID NO: 153977 - DNA, 601 bp, Human
acaaacaatgctgtgacaaaaatacttatatatggggcttttctacacaggtgctttaattttcctgggctagatatattgaaaattagaaatactaggtgaaaggctaaataattttaaatttgatactgctaaattccctccccaaaactatacccttttgtagtttcctcgagctcacacttcaccatctatgctttctttgtccaccgattgacatatggataaggcaagaattttcccaaaattactctgactacctcaagcttaaagccataaaaaaaagttttgacattttttrtggaaatttgctctgcctcttcctctttcagttcagttctagttgctttctgttttctaggaaccctcataatttttatctctatgccttcttattttctagcactattatggattgctttaaaagtatgtttgggccaggcatggctaacacctgtaatcccaacactttgggaggccaaggtagggtggattgcttgagtccaggaattcaagaccagcctgggcaacatagtgaaacttagtctctctgaaaaatagaaaaatcagtcaggcatggtggtgcacacctgtagtccca

SEQ ID NO: 153978 - DNA, 601 bp, Human
caccatctatgctttctttgtccaccgattgacatatggataaggcaagaattttcccaaaattactctgactacctcaagcttaaagccataaaaaaaagttttgacattttttatggaaatttgctctgcctcttcctctttcagttcagttctagttgctttctgttttctaggaaccctcataatttttatctctatgccttcttattttctagcactattatggattgctttaaaagtatgtttgggccaggcatggctaacacctgtaatcccaacactttgggaggccaaggtrgggtggattgcttgagtccaggaattcaagaccagcctgggcaacatagtgaaacttagtctctctgaaaaatagaaaaatcagtcaggcatggtggtgcacacctgtagtcccagctattcaggagtctgaggcaggaggatcagttgagcccaggaggtggaggctgcagtgagccatgattgagccactgcactgtagcctgggacaaaatgagaccctgtctcaaaaaataataagaaaataaaagtatatttgtatgatgttaccattgggggaagctgtgtaaaggggtacacg

SEQ ID NO: 153979 - DNA, 601 bp, Human
aaaattactctgactacctcaagcttaaagccataaaaaaaagttttgacattttttatggaaatttgctctgcctcttcctctttcagttcagttctagttgctttctgttttctaggaaccctcataatttttatctctatgccttcttattttctagcactattatggattgctttaaaagtatgtttgggccaggcatggctaacacctgtaatcccaacactttgggaggccaaggtagggtggattgcttgagtccaggaattcaagaccagcctgggcaacatagtgaaacttwgtctctctgaaaaatagaaaaatcagtcaggcatggtggtgcacacctgtagtcccagctattcaggagtctgaggcaggaggatcagttgagcccaggaggtggaggctgcagtgagccatgattgagccactgcactgtagcctgggacaaaatgagaccctgtctcaaaaaataataagaaaataaaagtatatttgtatgatgttaccattgggggaagctgtgtaaaggggtacacggaactcattgtataatcttttgtccttcctgtgagtcgatgattctttccaaattaaa

SEQ ID NO: 153980 - DNA, 601 bp, Human
ttattttctagcactattatggattgctttaaaagtatgtttgggccaggcatggctaacacctgtaatcccaacactttgggaggccaaggtagggtggattgcttgagtccaggaattcaagaccagcctgggcaacatagtgaaacttagtctctctgaaaaatagaaaaatcagtcaggcatggtggtgcacacctgtagtcccagctattcaggagtctgaggcaggaggatcagttgagcccaggaggtggaggctgcagtgagccatgattgagccactgcactgtagcctggtacaaaatgagaccctgtctcaaaaaataataagaaaataaaagtatatttgtatgatgttaccattgggggaagctgtgtaaaggggtacacggaactcattgtataatcttttgtccttcctgtgagtcgatgattctttccaaattaaaaggtttttttttttaaacatatttatgccttctagggacttggactgaggggaagtctggagcaagtgcccagttcgtcattttgattccatcctgactaaattgttttgactcattacaaaaatattatttttttgaaataacaaaat

SEQ ID NO: 153981 - DNA, 601 bp, Human
ccaggaggtggaggctgcagtgagccatgattgagccactgcactgtagcctgggacaaaatgagaccctgtctcaaaaaataataagaaaataaaagtatatttgtatgatgttaccattgggggaagctgtgtaaaggggtacacggaactcattgtataatcttttgtccttcctgtgagtcgatgattctttccaaattaaaaggtttttttttttaaacatatttatgccttctagggacttggactgaggggaagtctggagcaagtgcccagttcgtcattttgattccatccwgactaaattgttttgactcattacaaaaatattatttttttgaaataacaaaatttcatttaccctttttaaaaagaatgaggtaaatatatacagacatgaaaagaagtttataaaaaaatttgattttttatatttgccctttttaacaaggaacttttacttcctaatttgaaaaacggtatcagaattggggtgagttacaaagatgtttcaataaaaagatgctcataaatgaattggaataaactgtaacagttatgaatttacttcttctaaagatactagtttgtgtccagt

SEQ ID NO: 153982 - DNA, 601 bp, Human
atgagaccctgtctcaaaaaataataagaaaataaaagtatatttgtatgatgttaccattgggggaagctgtgtaaaggggtacacggaactcattgtataatcttttgtccttcctgtgagtcgatgattctttccaaattaaaaggtttttttttttaaacatatttatgccttctagggacttggactgaggggaagtctggagcaagtgcccagttcgtcattttgattccatcctgactaaattgttttgactcattacaaaaatattatttttttgaaataacaaaatttcatktaccctttttaaaaagaatgaggtaaatatatacagacatgaaaagaagtttataaaaaaatttgattttttatatttgccctttttaacaaggaacttttacttcctaatttgaaaaacggtatcagaattggggtgagttacaaagatgtttcaataaaaagatgctcataaatgaattggaataaactgtaacagttatgaatttacttcttctaaagatactagtttgtgtccagtttttgtaaagagtttcctgtaaaaattattcttaatggtgataatcaggtaaagctatgt

SEQ ID NO: 153983 - DNA, 601 bp, Human
agtcgatgattctttccaaattaaaaggtttttttttttaaacatatttatgccttctagggacttggactgaggggaagtctggagcaagtgcccagttcgtcattttgattccatcctgactaaattgttttgactcattacaaaaatattatttttttgaaataacaaaatttcatttaccctttttaaaaagaatgaggtaaatatatacagacatgaaaagaagtttataaaaaaatttgattttttatatttgccctttttaacaaggaacttttacttcctaatttgaaaaacrgtatcagaattggggtgagttacaaagatgtttcaataaaaagatgctcataaatgaattggaataaactgtaacagttatgaatttacttcttctaaagatactagtttgtgtccagtttttgtaaagagtttcctgtaaaaattattcttaatggtgataatcaggtaaagctatgttgatgaagcgttgtttaactttatgtggggatatatgaaatgatggtcagttgcagcaccagtgttttcagggatccaagggattcagggccacaagttggtagagcatcctcctttccag

SEQ ID NO: 153984 - DNA, 601 bp, Human
taaaaagaatgaggtaaatatatacagacatgaaaagaagtttataaaaaaatttgattttttatatttgccctttttaacaaggaacttttacttcctaatttgaaaaacggtatcagaattggggtgagttacaaagatgtttcaataaaaagatgctcataaatgaattggaataaactgtaacagttatgaatttacttcttctaaagatactagtttgtgtccagtttttgtaaagagtttcctgtaaaaattattcttaatggtgataatcaggtaaagctatgttgatgaagcrttgtttaactttatgtggggatatatgaaatgatggtcagttgcagcaccagtgttttcagggatccaagggattcagggccacaagttggtagagcatcctcctttccagtcggggccacagtgggccacgtgttgtggtaaagatacttaatattaggcattattttcaagcattttttgttgttatcaaataccactagcacctagttaatactgtttatgggttttggagaaattccattttattactcctttttgccacccagggccttggtaaagttaagctttccagcaggaa

SEQ ID NO: 153985 - DNA, 601 bp, Human
aatattaggcattattttcaagcattttttgttgttatcaaataccactagcacctagttaatactgtttatgggttttggagaaattccattttattactcctttttgccacccagggccttggtaaagttaagctttccagcaggaactgtgcttctccatgtaatttatcacccttactctgctgtcctaagcttagaactagtctcagctgtgagctgatgtgctctgctgtgtttaactggctacccccagagagggtgtccagatgagatctgaagggagggtgcctgacagtgycccagctccatgcggcctgagatgtgctctgctcttgcacttcctagataaattgggaaacttgctggtaaataattctataacccactcttttccttaggctttttggaaaggatataaacaacggaaggagtatatgcacaggcggcaaacgttcattgataatactgattctattgtgaaggtaaataccctttcctaccataccaagtgcttggcttaaacgtttcccctcatttcatgtttaatctgaaagacagctatagaaagggagggtacatgtgagccttgaagtcagaa

SEQ ID NO: 153986 - DNA, 601 bp, Human; identical to SEQ ID NO: 34936

SEQ ID NO: 153987 - DNA, 601 bp, Human; identical to SEQ ID NO: 34937

SEQ ID NO: 153988 - DNA, 601 bp, Human; identical to SEQ ID NO: 34938

SEQ ID NO: 153989 - DNA, 601 bp, Human; identical to SEQ ID NO: 34939

SEQ ID NO: 153990 - DNA, 601 bp, Human; identical to SEQ ID NO: 34940

SEQ ID NO: 153991 - DNA, 601 bp, Human; identical to SEQ ID NO: 34941

SEQ ID NO: 153992 - DNA, 601 bp, Human; identical to SEQ ID NO: 34942

SEQ ID NO: 153993 - DNA, 601 bp, Human; identical to SEQ ID NO: 34943

SEQ ID NO: 153994 - DNA, 601 bp, Human; identical to SEQ ID NO: 34944

SEQ ID NO: 153995 - DNA, 601 bp, Human; identical to SEQ ID NO: 34945

SEQ ID NO: 153996 - DNA, 601 bp, Human; identical to SEQ ID NO: 34946

SEQ ID NO: 153997 - DNA, 601 bp, Human; identical to SEQ ID NO: 34947

SEQ ID NO: 153998 - DNA, 601 bp, Human; identical to SEQ ID NO: 34948

SEQ ID NO: 153999 - DNA, 601 bp, Human; identical to SEQ ID NO: 34949

SEQ ID NO: 154000 - DNA, 601 bp, Human; identical to SEQ ID NO: 34950

SEQ ID NO: 154001 - DNA, 601 bp, Human; identical to SEQ ID NO: 34951

SEQ ID NO: 154002 - DNA, 601 bp, Human; identical to SEQ ID NO: 34952

SEQ ID NO: 154003 - DNA, 601 bp, Human; identical to SEQ ID NO: 34953

SEQ ID NO: 154004 - DNA, 601 bp, Human; identical to SEQ ID NO: 34954

SEQ ID NO: 154005 - DNA, 601 bp, Human; identical to SEQ ID NO: 34955

SEQ ID NO: 154006 - DNA, 601 bp, Human; identical to SEQ ID NO: 34956

SEQ ID NO: 154007 - DNA, 601 bp, Human; identical to SEQ ID NO: 34957

SEQ ID NO: 154008 - DNA, 601 bp, Human; identical to SEQ ID NO: 34958

SEQ ID NO: 154009 - DNA, 601 bp, Human; identical to SEQ ID NO: 34959

SEQ ID NO: 154010 - DNA, 601 bp, Human; identical to SEQ ID NO: 34960

SEQ ID NO: 154011 - DNA, 601 bp, Human; identical to SEQ ID NO: 34961

SEQ ID NO: 154012 - DNA, 601 bp, Human; identical to SEQ ID NO: 34962

SEQ ID NO: 154013 - DNA, 601 bp, Human; identical to SEQ ID NO: 34963

SEQ ID NO: 154014 - DNA, 601 bp, Human; identical to SEQ ID NO: 34964

SEQ ID NO: 154015 - DNA, 601 bp, Human; identical to SEQ ID NO: 34965

SEQ ID NO: 154016 - DNA, 601 bp, Human; identical to SEQ ID NO: 34966

SEQ ID NO: 154017 - DNA, 601 bp, Human; identical to SEQ ID NO: 34967

SEQ ID NO: 154018 - DNA, 601 bp, Human; identical to SEQ ID NO: 34968

SEQ ID NO: 154019 - DNA, 601 bp, Human; identical to SEQ ID NO: 34969

SEQ ID NO: 154020 - DNA, 601 bp, Human; identical to SEQ ID NO: 34970

SEQ ID NO: 154021 - DNA, 601 bp, Human; identical to SEQ ID NO: 34971

SEQ ID NO: 154022 - DNA, 601 bp, Human; identical to SEQ ID NO: 34972

SEQ ID NO: 154023 - DNA, 601 bp, Human; identical to SEQ ID NO: 34973

SEQ ID NO: 154024 - DNA, 601 bp, Human; identical to SEQ ID NO: 34974

SEQ ID NO: 154025 - DNA, 601 bp, Human; identical to SEQ ID NO: 34975

SEQ ID NO: 154026 - DNA, 601 bp, Human; identical to SEQ ID NO: 34976

SEQ ID NO: 154027 - DNA, 601 bp, Human; identical to SEQ ID NO: 34977

SEQ ID NO: 154028 - DNA, 601 bp, Human; identical to SEQ ID NO: 34978

SEQ ID NO: 154029 - DNA, 601 bp, Human; identical to SEQ ID NO: 34979

SEQ ID NO: 154030 - DNA, 601 bp, Human; identical to SEQ ID NO: 34980

SEQ ID NO: 154031 - DNA, 601 bp, Human; identical to SEQ ID NO: 34981

SEQ ID NO: 154032 - DNA, 601 bp, Human; identical to SEQ ID NO: 34982

SEQ ID NO: 154033 - DNA, 601 bp, Human; identical to SEQ ID NO: 34983

SEQ ID NO: 154034 - DNA, 601 bp, Human; identical to SEQ ID NO: 34984

SEQ ID NO: 154035 - DNA, 601 bp, Human; identical to SEQ ID NO: 34985

SEQ ID NO: 154036 - DNA, 601 bp, Human; identical to SEQ ID NO: 34986

SEQ ID NO: 154037 - DNA, 601 bp, Human; identical to SEQ ID NO: 34987

SEQ ID NO: 154038 - DNA, 601 bp, Human; identical to SEQ ID NO: 34988

SEQ ID NO: 154039 - DNA, 601 bp, Human; identical to SEQ ID NO: 34989

SEQ ID NO: 154040 - DNA, 601 bp, Human; identical to SEQ ID NO: 34990

SEQ ID NO: 154041 - DNA, 601 bp, Human; identical to SEQ ID NO: 34991

SEQ ID NO: 154042 - DNA, 601 bp, Human; identical to SEQ ID NO: 34992

SEQ ID NO: 154043 - DNA, 601 bp, Human; identical to SEQ ID NO: 34993

SEQ ID NO: 154044 - DNA, 601 bp, Human; identical to SEQ ID NO: 34994

SEQ ID NO: 154045 - DNA, 601 bp, Human; identical to SEQ ID NO: 34995

SEQ ID NO: 154046 - DNA, 601 bp, Human; identical to SEQ ID NO: 34996

SEQ ID NO: 154047 - DNA, 601 bp, Human; identical to SEQ ID NO: 34997

SEQ ID NO: 154048 - DNA, 601 bp, Human; identical to SEQ ID NO: 34998

SEQ ID NO: 154049 - DNA, 601 bp, Human; identical to SEQ ID NO: 34999

SEQ ID NO: 154050 - DNA, 601 bp, Human; identical to SEQ ID NO: 35000

SEQ ID NO: 154051 - DNA, 601 bp, Human; identical to SEQ ID NO: 35001

SEQ ID NO: 154052 - DNA, 601 bp, Human; identical to SEQ ID NO: 35002

SEQ ID NO: 154053 - DNA, 601 bp, Human; identical to SEQ ID NO: 35003

SEQ ID NO: 154054 - DNA, 601 bp, Human; identical to SEQ ID NO: 35004

SEQ ID NO: 154055 - DNA, 601 bp, Human; identical to SEQ ID NO: 35005

SEQ ID NO: 154056 - DNA, 601 bp, Human; identical to SEQ ID NO: 35006

SEQ ID NO: 154057 - DNA, 601 bp, Human; identical to SEQ ID NO: 35007

SEQ ID NO: 154058 - DNA, 601 bp, Human; identical to SEQ ID NO: 35008

SEQ ID NO: 154059 - DNA, 601 bp, Human; identical to SEQ ID NO: 35009

SEQ ID NO: 154060 - DNA, 601 bp, Human; identical to SEQ ID NO: 35010

SEQ ID NO: 154061 - DNA, 601 bp, Human; identical to SEQ ID NO: 35011

SEQ ID NO: 154062 - DNA, 601 bp, Human; identical to SEQ ID NO: 35012

SEQ ID NO: 154063 - DNA, 601 bp, Human; identical to SEQ ID NO: 35013

SEQ ID NO: 154064 - DNA, 601 bp, Human; identical to SEQ ID NO: 35014

SEQ ID NO: 154065 - DNA, 601 bp, Human; identical to SEQ ID NO: 35015

SEQ ID NO: 154066 - DNA, 601 bp, Human; identical to SEQ ID NO: 35016

SEQ ID NO: 154067 - DNA, 601 bp, Human; identical to SEQ ID NO: 35017

SEQ ID NO: 154068 - DNA, 601 bp, Human; identical to SEQ ID NO: 35018

SEQ ID NO: 154069 - DNA, 601 bp, Human; identical to SEQ ID NO: 35019

SEQ ID NO: 154070 - DNA, 601 bp, Human; identical to SEQ ID NO: 35020

SEQ ID NO: 154071 - DNA, 601 bp, Human; identical to SEQ ID NO: 35021

SEQ ID NO: 154072 - DNA, 601 bp, Human; identical to SEQ ID NO: 35022

SEQ ID NO: 154073 - DNA, 601 bp, Human; identical to SEQ ID NO: 35023

SEQ ID NO: 154074 - DNA, 601 bp, Human; identical to SEQ ID NO: 35024

SEQ ID NO: 154075 - DNA, 601 bp, Human
gtccccctccctcactctccagatgggacactgagaaacagaaggacttgcccaaggtcacacagccaggacctcagaagccgggtctctttggaaaaaccccgataactgagtttgccgggatctccccagacgcctctggtctgaaaaggcttcagtgtgccccggctgagccccgttcaggagcctgcactgctggccatggctacagtgaccagtctctgtttctttctagtcctgggggagaagacagagaagttgcctctgcagattctaaaccaaacagaggcagccattaatmaataggaaagaaaaactgacatatttgggctcttaaaaaggggtgggggtgcggcagggaagcgccacgtaccaggttgtgaggccagtccattccgccaagctgcaaggtcagcctgcagctgctgcccgcctggaaccccagatgccgccgagagaatggcagcaacaggatggagcgaagcaattatagctcaactgggggctgctgggggagtgagtgggtgggctcgtcatcagctgggagccttgggcccccagctggctgagcctagcgcagtggcaggcggtgaggggcgtg

SEQ ID NO: 154076 - DNA, 601 bp, Human
tgctgaatcgaatggaatgttgattaagagtgggtgggaggaagaggggatgagatgaagctggggagatgggcaagttatgggctaaggatgtcctgtccgcctgcactgcccttctcccctgagccttccctcttccagccatcccccaagccctcctcacacacacacaccctcacccattgccatccacttctccctcccagcaccagagtatcaggaaagcctttggctcacaaggaagaggactcaggcccggcagaagccagactccccaggaatccagagagaagggacagtkcctgcgtgtgaggcagagctcccaggatggaggcacctctgactcctcttaaattgagataggctccatatgttccctgtatgcctcacctcacagccccacagccccatggcccatgcctgctttatccaggctacccagcaagtcttgaccctaggaaacaagtttcagcagagcccctcttggcagaggtatttgctggcacaaaatctgcaacagagattcaagtgctaaattcttcctttttggtcctagattctagtgcagaaaaaatgtctccctaacaataggctctctctt

SEQ ID NO: 154077 - DNA, 601 bp, Human
tggactttacatcatcacagaaagttctggtgaacagtgctattctagagtctcagggtatatgtcatgtggctgaaaaatctctggcctgggtttgtgagtgaggacctcagggtcagccctttccttcatctttggtccttactatgggtcaggcactgagcaaggaagcggagctacaaccaagagaggacgctgctgccatcgttatccagggcaatgggtcttgattcccaaatcgcagcctgctgtgcgccctgatcacgtggagctataagaaatagcacttcctgggcctcaycgctggaggtttggattgggcatgggaatccctaggtgattctgatgccggcactgggaaggcccaggtccagcataagagacagactggaacaccgcatggaagcgccacacctgagaagggcgtccgaggcccacagagcagaggaagtgacatctggggaaagccttgcaggcacttccatggagacttgaagaacaatgagggcagtgctctgcatggatatctcacttaacaagactctgaggtactactgttgcctccatttacattgaggaaactgaggcccagaaaggctaa

SEQ ID NO: 154078 - DNA, 601 bp, Human
agttatcaatgctgaatttccttatctttccttaaaggtggcttaaatgatacctagaagaatgggtgtggctctcaatgtcatgtcacaggctgagtccagaagaagaaccactgcagtctaggagggaaaaaaaatatcggttctctgcctatcccaaacaggaaaactagcaaatatatactggatgttaaagcaagtggcagatacatgtggcatacctccagcatagaatagcatgagagctgtggttcaatctcctgagttggggagataagtaaaaattgagcttttgtcccartcagctttttctctttctttttttcttttttctttctttctttctttttttggatgataatttccacagctctttggaaagacaagacagtcagcactagacaatactgtgcattgtaaaagacccacgatgtttcttcaataatggaaagtgaatgccatcaggtagtggtaaaggaggatcagttaaaacccaaagcctctaccaggcaaaaggatccctgctggcctcaactcttctccctggggagtgtttcttccccagcaccagctgggaagctggtaggggtggggtgcattt

SEQ ID NO: 154079 - DNA, 601 bp, Human
agagacaaaagggaatccactgcaaatctggtcctgggattggggcacaaccacatttactggagctcctaaggcaagttatcaatgctgaatttccttatctttccttaaaggtggcttaaatgatacctagaagaatgggtgtggctctcaatgtcatgtcacaggctgagtccagaagaagaaccactgcagtctaggagggaaaaaaaatatcggttctctgcctatcccaaacaggaaaactagcaaatatatactggatgttaaagcaagtggcagatacatgtggcatacctcyagcatagaatagcatgagagctgtggttcaatctcctgagttggggagataagtaaaaattgagcttttgtcccaatcagctttttctctttctttttttcttttttctttctttctttctttttttggatgataatttccacagctctttggaaagacaagacagtcagcactagacaatactgtgcattgtaaaagacccacgatgtttcttcaataatggaaagtgaatgccatcaggtagtggtaaaggaggatcagttaaaacccaaagcctctaccaggcaaaaggatccctgc

SEQ ID NO: 154080 - DNA, 601 bp, Human
aggcggagacaccaaaaagagtgtgatggtgagggacatgcattttaatttcagttgggtatgtaggtttaagtctggcctccaacacttactaaatctctgaccctgagcaaattattttttattttctaagatttttttaacttgtaaaataggggtaactatagtccctctcagacagtattgactgagtcaaggattcaacgaaacaaggcatgtaaggcataaaaaaacataatacctgacaaaataaacactcaacaggtatgggctattattaggaacaattttaaatcaattmatccatttaagtgataatcattatgtatctgtaaaccaggcccatcgcgagacagtgaagatcccttgctgtgatctgtcgaacccccaaaactgccagtctctgataattagaagcaaggcttgtgttgaggtagaacagataatccacatagctgccctgagaggggacaatgaagatctgaagtcttgggagctactcgggagaaaggtagctactccgagccaactccaacagggacacagaaatctccccctcatttccagccctaccacaggaaaccaataaaacaaggatagt

SEQ ID NO: 154081 - DNA, 601 bp, Human
ggaggttctaatatgaaaatacatataaaacactggaacctaagtgcctaagtattaggacctggcccattcctgtggtcagcttcaagttgtaacgtatgtcagaggaaaacaataactgtaacttatcaaaagttcctacctgtagaattgatggtgactactatttcaaaaacgtgttcttatatgtacttaatataaaaggtaggaaagaccatgttgtgggatttgttgacagtgacaagaaaaatatgcctcccagcagtgcagatggtctggaaaccatttgccctaccaatgycaagtaacagcaatggtagagaggcagaggcggagacaccaaaaagagtgtgatggtgagggacatgcattttaatttcagttgggtatgtaggtttaagtctggcctccaacacttactaaatctctgaccctgagcaaattattttttattttctaagatttttttaacttgtaaaataggggtaactatagtccctctcagacagtattgactgagtcaaggattcaacgaaacaaggcatgtaaggcataaaaaaacataatacctgacaaaataaacactcaacaggtatgggct

SEQ ID NO: 154082 - DNA, 601 bp, Human
cagcatacttattttgtaatggaaaaaaagccttagttaattttaaaatccttgtgtcccacagtaaaacagatagtagcaaaaacactaattaggtgggtaccacttgggtgttggttttattattcataagatggggcattagacttaaaaaaaatattgacccagcaatcccattactgggtatatacccaaagaaatataaatcatcctactataaagacacatgcacacgtatgtttattgcagcactatttacaatagcaaagacatagaaccaatgatagactggataaagaawatgtggtacatatacaccatggaatactatgcagccataaaaaggaatgagatcatgtcctttgcagggacatggatgaagctagaagccatcgttctcagcaagctaacacaggaacagaaaaccagacaccgcatgttctcacttataagtgagagttgaacattgagaacacatggacacagagaggagaacaacacacaccagggcctgttgggggttgggggggtgatgggagggaactcagaggatgggtcaataggtgcagccaaccaccacggcacatgtatacctatgtaa

SEQ ID NO: 154083 - DNA, 601 bp, Human
tgcaaagagggtcctcattgttaaagcagtccaagaattcaagtgatgaatcagtgccagttagcctgatggaatggtgggaaagagaagggctttggagtcctgactgtaaagcgaggaaaataatatctttttcaaaggaatgctgtgaggatgaagcccagattctcaataaatgtgagttcctttagaagctagaatctccctaaatcttctcaggtcaaagccttccacctagtgcctaccttccctctcctttatccctgaaaagtaacttgacttttcatttctttttaggttggtttgattcataccacatatcttaactacctttctacaacaacccaaacacaccttctataaaagaatatgggtaaggaaagaaagggaagagttcgctctttttttctggttccttcttgacaaagcagacaatggtgatgactgattttcttggttacaggcttccatctgtctgtctaaaaacctatacacccgcaactctgctttcattggatagagaggtggttatcaaagcagaggctatttttgattctttggccctgaacttcttcaagttgtattgatagataaaactgca

SEQ ID NO: 154084 - DNA, 601 bp, Human
ccagtttgctctgccttgtagtccagacctcaaagattaggtctatcatacaggagtgcaaagagggtcctcattgttaaagcagtccaagaattcaagtgatgaatcagtgccagttagcctgatggaatggtgggaaagagaagggctttggagtcctgactgtaaagcgaggaaaataatatctttttcaaaggaatgctgtgaggatgaagcccagattctcaataaatgtgagttcctttagaagctagaatctccctaaatcttctcaggtcaaagccttccacctagtgcctaycttccctctcctttatccctgaaaagtaacttgacttttcatttctttttaggttggtttgattcataccacatatcttaactacctttctacaacaacccaaacacaccttctataaaagaatatgggtaaggaaagaaagggaagagttcgctctttttttctggttccttcttgacaaagcagacaatggtgatgactgattttcttggttacaggcttccatctgtctgtctaaaaacctatacacccgcaactctgctttcattggatagagaggtggttatcaaagcagaggct

SEQ ID NO: 154085 - DNA, 601 bp, Human
cacacaaccactggcttatgtaacttcctaaaactgtccgtggtgtgcaagtctaacagaacactcagctgtggtgctccagtcacaccaggcggccatgaagagggccccatggagagtgtggaaggaaggaattgtctcaaagaccacagatgtcttccagtttgctctgccttgtagtccagacctcaaagattaggtctatcatacaggagtgcaaagagggtcctcattgttaaagcagtccaagaattcaagtgatgaatcagtgccagttagcctgatggaatggtgggaaagrgaagggctttggagtcctgactgtaaagcgaggaaaataatatctttttcaaaggaatgctgtgaggatgaagcccagattctcaataaatgtgagttcctttagaagctagaatctccctaaatcttctcaggtcaaagccttccacctagtgcctaccttccctctcctttatccctgaaaagtaacttgacttttcatttctttttaggttggtttgattcataccacatatcttaactacctttctacaacaacccaaacacaccttctataaaagaatatgggtaaggaaagaaa

SEQ ID NO: 154086 - DNA, 601 bp, Human
attgtggtcataagcacacaaccactggcttatgtaacttcctaaaactgtccgtggtgtgcaagtctaacagaacactcagctgtggtgctccagtcacaccaggcggccatgaagagggccccatggagagtgtggaaggaaggaattgtctcaaagaccacagatgtcttccagtttgctctgccttgtagtccagacctcaaagattaggtctatcatacaggagtgcaaagagggtcctcattgttaaagcagtccaagaattcaagtgatgaatcagtgccagttagcctgatgraatggtgggaaagagaagggctttggagtcctgactgtaaagcgaggaaaataatatctttttcaaaggaatgctgtgaggatgaagcccagattctcaataaatgtgagttcctttagaagctagaatctccctaaatcttctcaggtcaaagccttccacctagtgcctaccttccctctcctttatccctgaaaagtaacttgacttttcatttctttttaggttggtttgattcataccacatatcttaactacctttctacaacaacccaaacacaccttctataaaagaatatg

SEQ ID NO: 154087 - DNA, 601 bp, Human
atatgctagtgtaactactagccatgaagttgaatacagaaggtgaatagagaagtaaagataaaacagttagaaaagtaagccaggatcgcaaatagtaatgtgacctaaaatgacgaagagtaaaactatagaaagacagtaaaatgatcagtggttaccagttggggcggggggtaggggaacagggaggggatgaactggtgagtaagcggagcactgaagtggctcagagcagtgaaactgtcctagacgatactgcaatgatagacacatgacatttttcatttgttaagacccrtagaactactcaacaatgagtgagttctaatgtaaactggactctcttcaatgtatcaatattggttcatctattgtaacaagcataccacaccaatgtaaggtgttaataagagaggaaacttgggggtgaggagggagtgagaaagagtctatgggagctctctgtactttgtgcacaatttttctgtaagcctaaaacttctctaaaaaacaaagtctattaattaagaaaggtggggggaagagagagagagaggagagaggcaggcagaaaaatcttttgtctggcagagattaa

SEQ ID NO: 154088 - DNA, 601 bp, Human
ggaaagcactgtcttcactttctttattatctttggtttagccctagacggacagacacaaggtaggaaaaacagcaatgtggaggcagcagtagcccagggcagcattaatcagggcagagtggctgctctgttgtctgaactggagaatcaaagccagctatgtgcattcttccctccccagaacttcatgttaaccattttaaagatgtcattatcaaagggcctgacaagtgatgtggcctgccctgggtcacagtggatgggggaatggactgtggggagcaccctaatcctagcycccgataatggtctgttaatcttcaacagcgttccagacacagataagtacaaatagataacacgccagaagcaagagaatgtggaggagagggacagcactggacaagaggagccctagagagattccattctcaacgagaaaggtcagctgggtctgtgtagctcaaacctcagtcatttgtgcactacctgcatgatatctgacacagcctgcaataaactgtgctgttatttgcttaatattatccttatataaatgtattttaaaagaaaacactatcttagtctcataaattct

SEQ ID NO: 154089 - DNA, 601 bp, Human; identical to SEQ ID NO: 22089

SEQ ID NO: 154090 - DNA, 601 bp, Human; identical to SEQ ID NO: 22090

SEQ ID NO: 154091 - DNA, 601 bp, Human; identical to SEQ ID NO: 22091

SEQ ID NO: 154092 - DNA, 601 bp, Human; identical to SEQ ID NO: 22092

SEQ ID NO: 154093 - DNA, 601 bp, Human; identical to SEQ ID NO: 22093

SEQ ID NO: 154094 - DNA, 601 bp, Human; identical to SEQ ID NO: 22094

SEQ ID NO: 154095 - DNA, 601 bp, Human; identical to SEQ ID NO: 22095

SEQ ID NO: 154096 - DNA, 601 bp, Human; identical to SEQ ID NO: 22096

SEQ ID NO: 154097 - DNA, 601 bp, Human; identical to SEQ ID NO: 22097

SEQ ID NO: 154098 - DNA, 601 bp, Human; identical to SEQ ID NO: 22098

SEQ ID NO: 154099 - DNA, 601 bp, Human; identical to SEQ ID NO: 22099

SEQ ID NO: 154100 - DNA, 601 bp, Human; identical to SEQ ID NO: 22100

SEQ ID NO: 154101 - DNA, 601 bp, Human; identical to SEQ ID NO: 22101

SEQ ID NO: 154102 - DNA, 601 bp, Human; identical to SEQ ID NO: 22102

SEQ ID NO: 154103 - DNA, 601 bp, Human; identical to SEQ ID NO: 22103

SEQ ID NO: 154104 - DNA, 601 bp, Human; identical to SEQ ID NO: 22104

SEQ ID NO: 154105 - DNA, 601 bp, Human; identical to SEQ ID NO: 22105

SEQ ID NO: 154106 - DNA, 601 bp, Human; identical to SEQ ID NO: 22106

SEQ ID NO: 154107 - DNA, 601 bp, Human; identical to SEQ ID NO: 22107

SEQ ID NO: 154108 - DNA, 601 bp, Human; identical to SEQ ID NO: 22108

SEQ ID NO: 154109 - DNA, 601 bp, Human; identical to SEQ ID NO: 22109

SEQ ID NO: 154110 - DNA, 601 bp, Human; identical to SEQ ID NO: 22110

SEQ ID NO: 154111 - DNA, 601 bp, Human; identical to SEQ ID NO: 22111

SEQ ID NO: 154112 - DNA, 601 bp, Human; identical to SEQ ID NO: 22112

SEQ ID NO: 154113 - DNA, 601 bp, Human; identical to SEQ ID NO: 22113

SEQ ID NO: 154114 - DNA, 601 bp, Human; identical to SEQ ID NO: 22114

SEQ ID NO: 154115 - DNA, 601 bp, Human; identical to SEQ ID NO: 22115

SEQ ID NO: 154116 - DNA, 601 bp, Human; identical to SEQ ID NO: 22116

SEQ ID NO: 154117 - DNA, 601 bp, Human; identical to SEQ ID NO: 22117

SEQ ID NO: 154118 - DNA, 601 bp, Human; identical to SEQ ID NO: 22118

SEQ ID NO: 154119 - DNA, 601 bp, Human; identical to SEQ ID NO: 22119

SEQ ID NO: 154120 - DNA, 601 bp, Human; identical to SEQ ID NO: 22120

SEQ ID NO: 154121 - DNA, 601 bp, Human; identical to SEQ ID NO: 22121

SEQ ID NO: 154122 - DNA, 601 bp, Human; identical to SEQ ID NO: 22122

SEQ ID NO: 154123 - DNA, 601 bp, Human; identical to SEQ ID NO: 22123

SEQ ID NO: 154124 - DNA, 601 bp, Human; identical to SEQ ID NO: 22124

SEQ ID NO: 154125 - DNA, 601 bp, Human; identical to SEQ ID NO: 22125

SEQ ID NO: 154126 - DNA, 601 bp, Human; identical to SEQ ID NO: 22126

SEQ ID NO: 154127 - DNA, 601 bp, Human; identical to SEQ ID NO: 22127

SEQ ID NO: 154128 - DNA, 601 bp, Human; identical to SEQ ID NO: 22128

SEQ ID NO: 154129 - DNA, 601 bp, Human; identical to SEQ ID NO: 22129

SEQ ID NO: 154130 - DNA, 601 bp, Human; identical to SEQ ID NO: 22130

SEQ ID NO: 154131 - DNA, 601 bp, Human; identical to SEQ ID NO: 22131

SEQ ID NO: 154132 - DNA, 601 bp, Human; identical to SEQ ID NO: 22132

SEQ ID NO: 154133 - DNA, 601 bp, Human; identical to SEQ ID NO: 22133

SEQ ID NO: 154134 - DNA, 601 bp, Human; identical to SEQ ID NO: 22134

SEQ ID NO: 154135 - DNA, 601 bp, Human; identical to SEQ ID NO: 22135

SEQ ID NO: 154136 - DNA, 601 bp, Human; identical to SEQ ID NO: 22136

SEQ ID NO: 154137 - DNA, 601 bp, Human; identical to SEQ ID NO: 22137

SEQ ID NO: 154138 - DNA, 601 bp, Human
atgcctagacacacacccaaaaaagcagccaggcagcagaacgcggggtcacacttcgacccctcagagaacgatcgctcccaatcaatactacgtgctcaggagctacaactgaagaagcgtgatcacggccttggcatttagggcaggcaccagcgcatctatggaccgcgcacaaattccggggatgccgaatttgggggatgctaaggggagagagtgggtctctagcagcgattgggggctcaggagcagttagtgacaaatgagcacccgaaaagtgaaaaggtgacagcagtcygcaggtgcatctactggcgagccttctccatccccgaacccaaccctcccccgggagaaggtcgcgccaggagagaagccgcgcggcgcttagggcaaggtgcagagggcggcgcggcggtgcagcgagaaagacgcggagagagggcgctgctctgtggctctgcaaccttccgccagctcccacgctttccccgcgcgtccccggcgcctcctcgctcctcttgcttccccgcgacccctgcgttcccgtgcgcgcgcgcccgcttgcctgtttcctgtcgccgtcgttgcccgggcc

SEQ ID NO: 154139 - DNA, 601 bp, Human
aaaaaccaccaccaaaaacaaaacaaaacaaaaacaaaaactccctccgcaggcaggagatgtaaacacgccagctccccagccccacctgtgatacctactggcccacatccctattaggactccctggttctccccagttcctgcaataaaatacagagcaaaatagtgtgaaattgattaaactctactgttatcacttctgccatatgtgactggctcaaaactcaatggatctgactcagcaaaagacaaagtcaaaatttaaagttactgcctcggcattttgcaaatgtcctakaaaaaaattcaacgtcctagaaaaaggtgaaagctagcaagatactctcaacgctgtaggagttgagaaagggagatatgtaacctaaaatcaatgcatagggctgggcttcatttgcacccacaaattcccagcatacgcctgctatttttatttttatcctcattaggttttaagcttccctgctgctttcagagtcttaagcccaagtctaattttttaacggatgaagaatgctgtttaaaggtgctcaaataccttggttggatagtatgctcaatccttataccttggttgatt

SEQ ID NO: 154140 - DNA, 601 bp, Human
ctgtagccccatctactcgggaggctgaggcaggagaatcgcttgaacccgggaggcggaagttgcagggagctgaaatcgcaccactgcactccaccctgggtgacagaatgagtctgtcggtctcacaagaacaaaacaaacaaaaaacaaaaaccaccaccaaaaacaaaacaaaacaaaaacaaaaactccctccgcaggcaggagatgtaaacacgccagctccccagccccacctgtgatacctactggcccacatccctattaggactccctggttctccccagttcctgcaayaaaatacagagcaaaatagtgtgaaattgattaaactctactgttatcacttctgccatatgtgactggctcaaaactcaatggatctgactcagcaaaagacaaagtcaaaatttaaagttactgcctcggcattttgcaaatgtcctagaaaaaaattcaacgtcctagaaaaaggtgaaagctagcaagatactctcaacgctgtaggagttgagaaagggagatatgtaacctaaaatcaatgcatagggctgggcttcatttgcacccacaaattcccagcatacgcctgctatt

SEQ ID NO: 154141 - DNA, 601 bp, Human
ggcgggcagatggcttgaggccaggagttcaaaaccagcctgtgcaacatggcaaaatcccgtctctaccaagaaaaaaacaaaaacaaaaattagccgggcatggtggcatgcacttatggtccaagctactcaggaggctgaggcgggaacatcgcctgtacctgggaagtgaaggttgcagtgagctgagatcacaccactgcactccagcctgggcaagaccccacctcaaaaaaaaaaaaggaatgggttcagttaccaaacaatactaatcccaaatgtctcaatttctcattaygcatttttttgtatttgagattcagaatgacataaacgtataaatgtaataaaataagaggaaattatttgcttagtgtgatagttatgaatatggtctttatatgacaatattgcttgcagttttatgaagtttgtattactttggtaacaataaaaacatcaaagatatgactttaaagaaagttaaaacgtagctcacaatattactatctgacaaataataagcatatggaaatatttttctttctgccccacacccccctttcctaatataggtggctttgttataaacaagaca

SEQ ID NO: 154142 - DNA, 601 bp, Human
tgtttggctaacaggatgttttataaacttaaatcaagtttatgaactttttctaaatgagaaaattcacgtagaaatctagatttctggctctcttaaaaacaaaagaactggcatcatgaactgacgctcccatgtgacacgacaaccagctgcagccaaagagccagctgccccctgatagagcatgtcctgctcctccagtccccaccatccatgcaatgtgtgcaggtttccacaccccttctggccaccagaggcctttgagtttgcctccctgtcactctgggccttctacagmctgtgcgtgagggagtcacaattattaattgggactttggatattgtctctcagaacatccaagagcagtcaatcaatggttacaggggaaaaaaatactgctagaaaagatatctaaccatatataatacaacaaacccatccaaaaagcaccaaagaaatgggttcagaacaggtgtggtggctcacgcctataatcccagcactttaggaggccaaggcgggcagatggcttgaggccaggagttcaaaaccagcctgtgcaacatggcaaaatcccgtctctaccaagaaaaaaac

SEQ ID NO: 154143 - DNA, 601 bp, Human
acagtttcccctgtaagcttaacacagccatgtgcacagccccaaggaaagaaatcccgcagctacccccagacctgaggggcagtaggcccagctactcctgattagtccagaggccatatgcctacgtgttttgtttggctaacaggatgttttataaacttaaatcaagtttatgaactttttctaaatgagaaaattcacgtagaaatctagatttctggctctcttaaaaacaaaagaactggcatcatgaactgacgctcccatgtgacacgacaaccagctgcagccaaagagycagctgccccctgatagagcatgtcctgctcctccagtccccaccatccatgcaatgtgtgcaggtttccacaccccttctggccaccagaggcctttgagtttgcctccctgtcactctgggccttctacagactgtgcgtgagggagtcacaattattaattgggactttggatattgtctctcagaacatccaagagcagtcaatcaatggttacaggggaaaaaaatactgctagaaaagatatctaaccatatataatacaacaaacccatccaaaaagcaccaaagaaatgggt

SEQ ID NO: 154144 - DNA, 601 bp, Human
agaaagtgggatgatttggctgggcgtggcggcccacacctgtaatcccagcactctgggaggctgaggctggtggatcacctgaggtcaggagtttgagaccagcgtgatcaacatagtgaagaccccgtctctactaaaaatacaaaaattagccaggtgtggtggcacgtgactgtagtcccagctactggggaggctgaggtgggaggatctcttgaacccaggaggtggagattgcggtgagccgagattgcaccactgcactctagcctgggtgacagagcaagaccctgtctcaaaaaaaaaaaaagaaaagaaaaaaagaaagtggaatgatttgacaacagttgtcgccccaacagtttcccctgtaagcttaacacagccatgtgcacagccccaaggaaagaaatcccgcagctacccccagacctgaggggcagtaggcccagctactcctgattagtccagaggccatatgcctacgtgttttgtttggctaacaggatgttttataaacttaaatcaagtttatgaactttttctaaatgagaaaattcacgtagaaatctagatttctggctctcttaaaaacaaa

SEQ ID NO: 154145 - DNA, 601 bp, Human
ctgcttcctccgcctcccaagccacaagtgctgggaaagttttatggtaatcagctggaactggcttccttttcagtatttggcaacagatactgacacttgtatgggattacacaagagcagccactcctggtctctctacctctggctgttctaatagggcttatccagagcctgttgcaaggtcagattcctgcagctgaagcaaagatgtcaattccacttgggaggtggaaggaagggggcagatttagggccaagaaacagggtttggaaaatgttaagctcacgatatattatyaggtacccacttacacttcatccatgggaaaaattaagctcttcatgaaactgatggtaatcttaaaacacaaattatgcatattttacattaaaagcaagagatgggctcctaaaagagtgggaggaaatagtattcacttcaggtttgccaaatgaaaggatgaatagaaagtgggatgatttggctgggcgtggcggcccacacctgtaatcccagcactctgggaggctgaggctggtggatcacctgaggtcaggagtttgagaccagcgtgatcaacatagtgaagaccccgtc

SEQ ID NO: 154146 - DNA, 601 bp, Human; identical to SEQ ID NO: 22341

SEQ ID NO: 154147 - DNA, 601 bp, Human; identical to SEQ ID NO: 22342

SEQ ID NO: 154148 - DNA, 601 bp, Human; identical to SEQ ID NO: 22343

SEQ ID NO: 154149 - DNA, 601 bp, Human; identical to SEQ ID NO: 22344

SEQ ID NO: 154150 - DNA, 601 bp, Human; identical to SEQ ID NO: 22345

SEQ ID NO: 154151 - DNA, 601 bp, Human; identical to SEQ ID NO: 22346

SEQ ID NO: 154152 - DNA, 601 bp, Human; identical to SEQ ID NO: 22347

SEQ ID NO: 154153 - DNA, 601 bp, Human; identical to SEQ ID NO: 22348

SEQ ID NO: 154154 - DNA, 601 bp, Human; identical to SEQ ID NO: 22349

SEQ ID NO: 154155 - DNA, 601 bp, Human; identical to SEQ ID NO: 22350

SEQ ID NO: 154156 - DNA, 601 bp, Human; identical to SEQ ID NO: 22351

SEQ ID NO: 154157 - DNA, 601 bp, Human; identical to SEQ ID NO: 22352

SEQ ID NO: 154158 - DNA, 601 bp, Human; identical to SEQ ID NO: 22353

SEQ ID NO: 154159 - DNA, 601 bp, Human; identical to SEQ ID NO: 22354

SEQ ID NO: 154160 - DNA, 601 bp, Human; identical to SEQ ID NO: 22355

SEQ ID NO: 154161 - DNA, 601 bp, Human; identical to SEQ ID NO: 22356

SEQ ID NO: 154162 - DNA, 601 bp, Human; identical to SEQ ID NO: 22357

SEQ ID NO: 154163 - DNA, 601 bp, Human; identical to SEQ ID NO: 22358

SEQ ID NO: 154164 - DNA, 601 bp, Human; identical to SEQ ID NO: 22359

SEQ ID NO: 154165 - DNA, 601 bp, Human; identical to SEQ ID NO: 22360

SEQ ID NO: 154166 - DNA, 601 bp, Human; identical to SEQ ID NO: 22361

SEQ ID NO: 154167 - DNA, 601 bp, Human; identical to SEQ ID NO: 22362

SEQ ID NO: 154168 - DNA, 601 bp, Human; identical to SEQ ID NO: 22363

SEQ ID NO: 154169 - DNA, 601 bp, Human; identical to SEQ ID NO: 22364

SEQ ID NO: 154170 - DNA, 601 bp, Human; identical to SEQ ID NO: 22365

SEQ ID NO: 154171 - DNA, 601 bp, Human; identical to SEQ ID NO: 22366

SEQ ID NO: 154172 - DNA, 601 bp, Human; identical to SEQ ID NO: 22367

SEQ ID NO: 154173 - DNA, 601 bp, Human; identical to SEQ ID NO: 22368

SEQ ID NO: 154174 - DNA, 601 bp, Human; identical to SEQ ID NO: 22369

SEQ ID NO: 154175 - DNA, 601 bp, Human; identical to SEQ ID NO: 22370

SEQ ID NO: 154176 - DNA, 601 bp, Human; identical to SEQ ID NO: 22371

SEQ ID NO: 154177 - DNA, 601 bp, Human; identical to SEQ ID NO: 22372

SEQ ID NO: 154178 - DNA, 601 bp, Human; identical to SEQ ID NO: 22373

SEQ ID NO: 154179 - DNA, 601 bp, Human; identical to SEQ ID NO: 22374

SEQ ID NO: 154180 - DNA, 601 bp, Human; identical to SEQ ID NO: 22375

SEQ ID NO: 154181 - DNA, 601 bp, Human; identical to SEQ ID NO: 22376

SEQ ID NO: 154182 - DNA, 601 bp, Human; identical to SEQ ID NO: 22377

SEQ ID NO: 154183 - DNA, 601 bp, Human; identical to SEQ ID NO: 22378

SEQ ID NO: 154184 - DNA, 601 bp, Human; identical to SEQ ID NO: 22379

SEQ ID NO: 154185 - DNA, 601 bp, Human; identical to SEQ ID NO: 22380

SEQ ID NO: 154186 - DNA, 601 bp, Human; identical to SEQ ID NO: 22381

SEQ ID NO: 154187 - DNA, 601 bp, Human; identical to SEQ ID NO: 22382

SEQ ID NO: 154188 - DNA, 601 bp, Human; identical to SEQ ID NO: 22383

SEQ ID NO: 154189 - DNA, 601 bp, Human; identical to SEQ ID NO: 22384

SEQ ID NO: 154190 - DNA, 601 bp, Human; identical to SEQ ID NO: 22385

SEQ ID NO: 154191 - DNA, 601 bp, Human; identical to SEQ ID NO: 22386

SEQ ID NO: 154192 - DNA, 601 bp, Human; identical to SEQ ID NO: 22387

SEQ ID NO: 154193 - DNA, 601 bp, Human; identical to SEQ ID NO: 22388

SEQ ID NO: 154194 - DNA, 601 bp, Human; identical to SEQ ID NO: 22389

SEQ ID NO: 154195 - DNA, 601 bp, Human; identical to SEQ ID NO: 22390

SEQ ID NO: 154196 - DNA, 601 bp, Human; identical to SEQ ID NO: 22391

SEQ ID NO: 154197 - DNA, 601 bp, Human; identical to SEQ ID NO: 22392

SEQ ID NO: 154198 - DNA, 601 bp, Human; identical to SEQ ID NO: 22393

SEQ ID NO: 154199 - DNA, 601 bp, Human; identical to SEQ ID NO: 22394

SEQ ID NO: 154200 - DNA, 601 bp, Human; identical to SEQ ID NO: 22395

SEQ ID NO: 154201 - DNA, 601 bp, Human; identical to SEQ ID NO: 22396

SEQ ID NO: 154202 - DNA, 601 bp, Human; identical to SEQ ID NO: 22397

SEQ ID NO: 154203 - DNA, 601 bp, Human; identical to SEQ ID NO: 22398

SEQ ID NO: 154204 - DNA, 601 bp, Human; identical to SEQ ID NO: 22399

SEQ ID NO: 154205 - DNA, 601 bp, Human; identical to SEQ ID NO: 22400

SEQ ID NO: 154206 - DNA, 601 bp, Human; identical to SEQ ID NO: 22401

SEQ ID NO: 154207 - DNA, 601 bp, Human; identical to SEQ ID NO: 22402

SEQ ID NO: 154208 - DNA, 601 bp, Human; identical to SEQ ID NO: 22403

SEQ ID NO: 154209 - DNA, 601 bp, Human; identical to SEQ ID NO: 22404

SEQ ID NO: 154210 - DNA, 601 bp, Human; identical to SEQ ID NO: 22405

SEQ ID NO: 154211 - DNA, 601 bp, Human; identical to SEQ ID NO: 22406

SEQ ID NO: 154212 - DNA, 601 bp, Human; identical to SEQ ID NO: 22407

SEQ ID NO: 154213 - DNA, 601 bp, Human; identical to SEQ ID NO: 22408

SEQ ID NO: 154214 - DNA, 601 bp, Human; identical to SEQ ID NO: 22409

SEQ ID NO: 154215 - DNA, 601 bp, Human; identical to SEQ ID NO: 22410

SEQ ID NO: 154216 - DNA, 601 bp, Human; identical to SEQ ID NO: 22411

SEQ ID NO: 154217 - DNA, 601 bp, Human; identical to SEQ ID NO: 22412

SEQ ID NO: 154218 - DNA, 601 bp, Human; identical to SEQ ID NO: 22413

SEQ ID NO: 154219 - DNA, 601 bp, Human; identical to SEQ ID NO: 22414

SEQ ID NO: 154220 - DNA, 601 bp, Human; identical to SEQ ID NO: 22415

SEQ ID NO: 154221 - DNA, 601 bp, Human; identical to SEQ ID NO: 22416

SEQ ID NO: 154222 - DNA, 601 bp, Human; identical to SEQ ID NO: 22417

SEQ ID NO: 154223 - DNA, 601 bp, Human; identical to SEQ ID NO: 22418

SEQ ID NO: 154224 - DNA, 601 bp, Human; identical to SEQ ID NO: 22419

SEQ ID NO: 154225 - DNA, 601 bp, Human; identical to SEQ ID NO: 22420

SEQ ID NO: 154226 - DNA, 601 bp, Human; identical to SEQ ID NO: 22421

SEQ ID NO: 154227 - DNA, 601 bp, Human; identical to SEQ ID NO: 22422

SEQ ID NO: 154228 - DNA, 601 bp, Human; identical to SEQ ID NO: 22423

SEQ ID NO: 154229 - DNA, 601 bp, Human; identical to SEQ ID NO: 22424

SEQ ID NO: 154230 - DNA, 601 bp, Human; identical to SEQ ID NO: 22425

SEQ ID NO: 154231 - DNA, 601 bp, Human; identical to SEQ ID NO: 22426

SEQ ID NO: 154232 - DNA, 601 bp, Human; identical to SEQ ID NO: 22427

SEQ ID NO: 154233 - DNA, 601 bp, Human; identical to SEQ ID NO: 22428

SEQ ID NO: 154234 - DNA, 601 bp, Human; identical to SEQ ID NO: 22429

SEQ ID NO: 154235 - DNA, 601 bp, Human; identical to SEQ ID NO: 22430

SEQ ID NO: 154236 - DNA, 601 bp, Human; identical to SEQ ID NO: 22431

SEQ ID NO: 154237 - DNA, 601 bp, Human; identical to SEQ ID NO: 22432

SEQ ID NO: 154238 - DNA, 601 bp, Human; identical to SEQ ID NO: 22433

SEQ ID NO: 154239 - DNA, 601 bp, Human; identical to SEQ ID NO: 22434

SEQ ID NO: 154240 - DNA, 601 bp, Human; identical to SEQ ID NO: 22435

SEQ ID NO: 154241 - DNA, 601 bp, Human; identical to SEQ ID NO: 22436

SEQ ID NO: 154242 - DNA, 601 bp, Human; identical to SEQ ID NO: 22437

SEQ ID NO: 154243 - DNA, 601 bp, Human; identical to SEQ ID NO: 22438

SEQ ID NO: 154244 - DNA, 601 bp, Human; identical to SEQ ID NO: 22439

SEQ ID NO: 154245 - DNA, 601 bp, Human; identical to SEQ ID NO: 22440

SEQ ID NO: 154246 - DNA, 601 bp, Human; identical to SEQ ID NO: 22441

SEQ ID NO: 154247 - DNA, 601 bp, Human; identical to SEQ ID NO: 22442

SEQ ID NO: 154248 - DNA, 601 bp, Human; identical to SEQ ID NO: 22443

SEQ ID NO: 154249 - DNA, 601 bp, Human; identical to SEQ ID NO: 22444

SEQ ID NO: 154250 - DNA, 601 bp, Human; identical to SEQ ID NO: 22445

SEQ ID NO: 154251 - DNA, 601 bp, Human; identical to SEQ ID NO: 22446

SEQ ID NO: 154252 - DNA, 601 bp, Human; identical to SEQ ID NO: 22447

SEQ ID NO: 154253 - DNA, 601 bp, Human; identical to SEQ ID NO: 22448

SEQ ID NO: 154254 - DNA, 601 bp, Human; identical to SEQ ID NO: 22449

SEQ ID NO: 154255 - DNA, 601 bp, Human; identical to SEQ ID NO: 22450

SEQ ID NO: 154256 - DNA, 601 bp, Human; identical to SEQ ID NO: 22451

SEQ ID NO: 154257 - DNA, 601 bp, Human; identical to SEQ ID NO: 22452

SEQ ID NO: 154258 - DNA, 601 bp, Human; identical to SEQ ID NO: 22453

SEQ ID NO: 154259 - DNA, 601 bp, Human; identical to SEQ ID NO: 22454

SEQ ID NO: 154260 - DNA, 601 bp, Human; identical to SEQ ID NO: 22455

SEQ ID NO: 154261 - DNA, 601 bp, Human; identical to SEQ ID NO: 22456

SEQ ID NO: 154262 - DNA, 601 bp, Human; identical to SEQ ID NO: 22457

SEQ ID NO: 154263 - DNA, 601 bp, Human; identical to SEQ ID NO: 22458

SEQ ID NO: 154264 - DNA, 601 bp, Human; identical to SEQ ID NO: 22459

SEQ ID NO: 154265 - DNA, 601 bp, Human; identical to SEQ ID NO: 22460

SEQ ID NO: 154266 - DNA, 601 bp, Human; identical to SEQ ID NO: 22461

SEQ ID NO: 154267 - DNA, 601 bp, Human; identical to SEQ ID NO: 22462

SEQ ID NO: 154268 - DNA, 601 bp, Human; identical to SEQ ID NO: 22463

SEQ ID NO: 154269 - DNA, 601 bp, Human; identical to SEQ ID NO: 22464

SEQ ID NO: 154270 - DNA, 601 bp, Human; identical to SEQ ID NO: 22465

SEQ ID NO: 154271 - DNA, 601 bp, Human; identical to SEQ ID NO: 22466

SEQ ID NO: 154272 - DNA, 601 bp, Human; identical to SEQ ID NO: 22467

SEQ ID NO: 154273 - DNA, 601 bp, Human; identical to SEQ ID NO: 22468

SEQ ID NO: 154274 - DNA, 601 bp, Human; identical to SEQ ID NO: 22469

SEQ ID NO: 154275 - DNA, 601 bp, Human
gaaaaaaactcattttcttggaatcatatatttttaatatggaagattcatcttttccaaaataactttttatctgaaaactgacacagataagctgaaatttagggtctttaagtagaaactctagaagagactttaatgtgtgttttaagaaggggtaatgccaggcagatacagtgacatatggaataacatgtagtgaaatccttcaaggagtagattttctgaacctgggctcagggtaaccttgctctgccttgaatacttgaaaaggctgtcaaaatcactgtatctctttaaygttttctcctttctaccctaaagttaagttgctatttgctcctattgctacatcacttttctgaatctcttttgatacacttggcttttgctttatttgggagggagaaagtaaaggaaggaggaattggagtagacaaaaaataactttatatgaataaatattcattaagaaaatgaagtggaataattttggactggagagatttgggagaatcatccaaagccattttgcagtaaagcagacagtcaaagagataagatgactttgccaagtttatgttactagttagcttggact

SEQ ID NO: 154276 - DNA, 601 bp, Human
aaagctgtgcattctatatttgaatagtctaagcaacatggagtctgcaccttctcatatatccatttggctgggaatgtatttaagaagatggctgtcttactgtgttcctatggtatagatcaggactattctaagccaaaagttaaaaccataccctggtgtgtgtgtgtgtgtgtgcgtgtgaacttaattgaggtataatttatatacaataagatataccactatgcatgtacattttgatagagttttgacatacttgcatacatgtgtaactgctaccacagtcaagatgtartagaacattatttccatcatcctaaagagttcttgtgtacttaatctcagccaatcttccccacctattgccccctagcaatgatctgcttttggtcactagaggttagatttaatgtttctagagtttcatataaaccgaatcatgcagtatgtcctttctgtgcaccttcttttgcacaggatattatcaaaattaataagtatcagtagctcattccttttgtattgctgagtagtattccattgtatgaatgttatatcaccaaatacacaatttgtgtcgccattcacctgcagt

SEQ ID NO: 154277 - DNA, 601 bp, Human
ccttcttttgcacaggatattatcaaaattaataagtatcagtagctcattccttttgtattgctgagtagtattccattgtatgaatgttatatcaccaaatacacaatttgtgtcgccattcacctgcagtggaactattaacttgggttgtttctggttctttgctctaatgaataaagctactgtgaacatttacataaaatttatatgcatatatatcttacatttttcttgagtcaatacttaagagtacagttatagtacaggtaactgtacttctaagtacatatagtaagtrtatgtttaacttggtaagaagctgcaaaattgcaaactgcttgtaacaaacatttttacatttccaccagccatgtatgagagttctggttgttccacatccttgcaaacaattgtccatgtttttaattttaaccattctagtagatgagtggtagtatcattttggttttgattggatttcaccggtgactaatgatgtttgaagatcttttggtgtatgtattggccacttgtatattttcctttgtgaactgtctgttcaaataatttgtccatttttaattggattgtttgtctt

SEQ ID NO: 154278 - DNA, 601 bp, Human
ctagtagagaagggaagtagaacaagaaacaatattcaatctgaaaaaaaggtaaagaagctgaagaaagaaaacatggaaaagagaagacaagtagcacaaaagtacatagcagcaataagtgcaaatatattagtaattacagtgcatatgagttgaaaaaatcctccacttaacagaaactggttattagatgggataaaataacaaaatatatttatatgctgtttacaagcaataccttaaaaagcatattctcgcttgaaagtaaaaaggatttaaaaagatattcctgacactrctaaccaatagaaatgttgtatggctatatatatcatgtaaagttgactttgaggcagaaaacctgtccgagagagtgagggtcactcaatagttataaaaggaaggtataattttaaataagtgactacctgataatacactttcaaaatacattaagcagaaactaggactgcagaagaaataggtaaatttatcattattatagcttatttaaaataatctctgttaatgtgagaacaagcagaaaaaaattaagaaaaatatagatgattttaataacaggacttacaagcctgct

SEQ ID NO: 154279 - DNA, 601 bp, Human
acctgtataaaactacttcccagaagccttgatgttcccataaagagctaaagacaaaaccaaatcaactgctaacaccttttatgggagatcaacttgtgtgggttatgaggcccaccttgactaagcaggatatgtaggtaaacctgcccagttggaattagtagctgatactctaaaaggagaatggtgaacaggaggccattagcagaaacagcctcattcatttatagagatcatcttgttaaaagggaaatcagcttccctagatcccaagggggtattgaaaatgctaggagaragcctagaaaacttttctgtgcagattgtcagaaaaaggtgaaaatattttcttttactgtaaaaagaaagaaattcttttccttcttccaaagatgccttaccacctttgaaaaagatttttaaaagtctcagagaaaatgaaatatagattcttaaagtggaaagggaccttaaaaatccatctggtctggttcattttatagatagaactgagaacctcaaaaagttatgtaatttggcttacatcacaagagctagtttgaagcagaagctacgattttcttactgtgtccagttg

SEQ ID NO: 154280 - DNA, 601 bp, Human
tagctgagtatctggagtcatggaagagaattaagaatctgtcttgaatgtatattttctagtagcaactgaaaagaaatatagtagttgtaaattgctagaccttactcttacggtacagttgctctggaaatctctttttagcaaaataggattttatttctggatatagaatctttcgtagtgtctgcgtcaaaacaaaattaagttttaaaattgagtaaatcatttattttttctagttttttcagaaatgcttttttactagactaaataacttttcagcatcagtctgataagcatagaattttcaaaattctttacttgctattttagaattctttattttctaagaattatgaagactgtattaggtatttatgtggacttcctttttttcctaccttttattatagcaccaaaattggaattacgctagattattttctctctgctgtttaaatcataagagactcttttattgggtcagggcaattgtctttctagcacaataatcttctttgataatgtcactactggaaattatgtttatccttcataaattaactaatccttatttttgtaataaattatctgatat

SEQ ID NO: 154281 - DNA, 601 bp, Human
taaactatgcaggccataaatggaacaaagatagtttaggaaaatacagtttcttaaataaattacttttaaaaagtatattttctctcagctcttctctccaaaggagttttgtatcataacctctgtagtaaatagtgtcatctttattgtctgattataaaggtgaagtataatttatgggataatttacaaagcaaaaaagaaatacttatttttaaagtttaaaaattttctgtgtagaaaatactataataatgcatgattttaagaatctgttattttggctaaaatatttaaycagccaaccatatatcttatttctttcagttgctagatttctgaatgttagccaaatattttagtatctgggtcacatagtcattacaaacaaatgtaggccaaaatggtttatgcttctcagttgccagctcagttctctctttgactttttattatttgtttctctttgaactaaactttatttacttatattagcacagtactgtgttaattctttgtgtagaactggtcttcttgtgtcgttttgccccaaatcaaggtaacaaacaaataaatgactgtgctcttggctgttatt

SEQ ID NO: 154282 - DNA, 601 bp, Human
tcaggaagacactgcctcagggctactgaggtatgtcatagggccatttgtcctttcaaaaataattctcagtagctattgttgctttgcatttgtataaagtgtctgttttttcaaagcttgatattaattctgatagctactagtgtacagagaagggtgtctgtgaataaagtaagagaaagaatgttcataatagatttgaagagcacttcaatgagtaaagtacttggactttacaatgtttgcttttacttcactaagtcctgccctgtgcccctgctcctgcccctttatgccmtagtctcttttttaacatggtacttggcagtgttccaggtagttattgtaagaaggatgagcttagacttggagctagacaaacatgatgggaattaaaacaggataatttaatagctgtgagaccttaagcaagttcacaactgcaaaatgggtttgtatatactatctctcacggttgtaaggattaaatataatggatatagtttaggaggtattttaacaaatgctagttcctttccttatactttaagataaatgacccacttactttggaaatggtatttgcctattttagtat

SEQ ID NO: 154283 - DNA, 601 bp, Human
aattctcagtagctattgttgctttgcatttgtataaagtgtctgttttttcaaagcttgatattaattctgatagctactagtgtacagagaagggtgtctgtgaataaagtaagagaaagaatgttcataatagatttgaagagcacttcaatgagtaaagtacttggactttacaatgtttgcttttacttcactaagtcctgccctgtgcccctgctcctgcccctttatgccatagtctcttttttaacatggtacttggcagtgttccaggtagttattgtaagaaggatgagcktagacttggagctagacaaacatgatgggaattaaaacaggataatttaatagctgtgagaccttaagcaagttcacaactgcaaaatgggtttgtatatactatctctcacggttgtaaggattaaatataatggatatagtttaggaggtattttaacaaatgctagttcctttccttatactttaagataaatgacccacttactttggaaatggtatttgcctattttagtatgatgctataaggtttaaagggtcagtatccctaaaatatgacagctgttaagatctctttaat

SEQ ID NO: 154284 - DNA, 601 bp, Human
accattgctaaaacaatcttcctgaagtactaattagatttttgagcagagaataaaaccatcctttccagtgttggcaaatattcaacgtactgtcctgaaatacctgtagtacttccaagtttctgctttgtgctcacactgttttctttgacctgaaatgcaatttctatctataaaaatcttagtcattatgaggtctagcaaagatctttttcttctatgaagccttcctatcgaccctaactaaaatctcttctctgagttcccagcgtatactgcttgagctggagcaagactycagtgatccttggaagaaagtgggaggttattttcccagtgcgattccaggaaagtttaatgtcttatagttcagtcccctttagcattccacatacagttagtgctcaaatatttgataattgctctactcacaaatatttttgtgtgaaattgctagctattctctatccaagaagtaatgaagtatataagcttcttcaactctttgttgagcccgggacctcttacttatttctgtatcctatctactcttgagtagtagggtcattggaaagcaaccactgggtttggggataag

SEQ ID NO: 154285 - DNA, 601 bp, Human
cttgagctggagcaagactccagtgatccttggaagaaagtgggaggttattttcccagtgcgattccaggaaagtttaatgtcttatagttcagtcccctttagcattccacatacagttagtgctcaaatatttgataattgctctactcacaaatatttttgtgtgaaattgctagctattctctatccaagaagtaatgaagtatataagcttcttcaactctttgttgagcccgggacctcttacttatttctgtatcctatctactcttgagtagtagggtcattggaaagcaaycactgggtttggggataagttgtgtgtattttagaggaggaagtaaaggtgttactggacttttaaaactgaagctttttctgttttaaagtattttgcttcccgttactgtatttataagatgatactggtatacgtagtgtcttggctatttatctattcccctttctctttaacacaatattccccaactttggtgtgatactgaattgaaatctctgggagtgtggcctaggactctacacttttactaacaatcagttgagatgcttatgaaggtggtggtagtagtgataatgg

SEQ ID NO: 154286 - DNA, 601 bp, Human
gctctttttggttctgtttagttggctttgatgggttcatgatgcccagtggagaatttggtatttagccacaaaaagatatttaagacacataattatgtaaatattgcagatggaggatgatacatagcatttcttttatcaaaatgaatttgaattgacttctttctaaaacaaaattctaccaatagtcatcagtttttaattatataacttctcaatataggaaataatcagtgtctgattggctgtgtatgttggagtgtaatggcttttgttttgaatttggcagtttctactstcagaagaaatgagttgcgaattacagtggtgttagaagaaatgaattggaagttcgaatgagaaaaatttaaataaaagttattgtttatagatatggaaaggaaaataatgtttttagttcaatatgagaaagaaccttttaaatgtagaaataaaatggggtgcctttctacatccattcttaagaatttggcagaagttatgaagaagttaaaaagaaggagttcctgctgatataagtcacgaggattatttgaaggaaatttatgtcacatctcgtaaaatcatcatattgaca

SEQ ID NO: 154287 - DNA, 601 bp, Human
caattctgtcattagggtttgcaagagaatgaatttttaaatctgccaccccttacacatttattagtggaaattcttctgtaagaagaagtttccttcataaattacacctttttgatttatctgaaacaatgtatactggaaagaagcctggtgtcttaaatatcatctgttaatacctagtgtaacattccaaaggtaacttgagatactgcaaggaccacatagcaccttgagtacctattttacatgtgactctgaggactttcacagaataaagatatttcttattttaatgaaygttgtcagtatcaggataattttatgtagtcaacatatatacagtgttggtcctataggagttggagaccttttgccagttttatttggtcaaatacattattttgtgatgaaataactgtgagtgatgagttgagcctcaaagaacatgatacttcattaaatcaacaagctgaacagtatcatctaaccaaagctgtagaataaatggtgataaacttaaattcaggaatgaaacaatcaccatttttgttacaaatttgtccacccgtcatcactaaccccatttttatttaatact

SEQ ID NO: 154288 - DNA, 601 bp, Human
ggaacttaaaatgagatgttagtatggcttagtaatctgtatttgcaggtgaaatgaaaaattcagccctaaatctctgaatatggtaaacttagacttcatcttctgcaggtggaaatgaggcaagggatccattatccacagcatgagtaagtttctagtcagttcctctgtctagggagtttgttttcccttttcgcccttgttggcctgggagactcaaccagcttagtagtcttttcctttcagtaagatttccaactttgggttggtctttacccctttttagctctttttgtcrtattatctgcacttagtactttgtaactgttttcaccccttccccccaaagttagttcaaaggcttacagcatgttgaaaataggaaaattgtttttaaattaagtgagtttttgtgtacacttatttctttagtctaaagttttgttttaaatctctttttcacatttaaacctgattccctgagacaagatataaaattgaattatttgtgaaatgtggaaaggtttttattgcctgtaatcaaagcataatctgtccattaaagcattattttagtgatgaagggtggacatacatc

SEQ ID NO: 154289 - DNA, 601 bp, Human
tattagtattattttatataacatattttcaaactcctcagaacatttgtaggtttttgtttaattttatgtaagtttcaccttaagaatattgactaatcggttaatattcttcttaatcatcgcaattttttaaaatgctttctatgtaccaggacctatttaaggtactacagataatcagtgtgtcaaaaaacaaaaccaaaattcctttcctcatggagttttacattctagtagattgattctactgttgattcatactaaattaatttattaattatagtagattattctgtgrcatttaacagaattcaaagggctacttttctgttgttaggaaatagcatatgccattatcttggaaatacaaagggaggacagaatttccgctggctctaacccattgctttttaatgagtttagctatgtatatatattttaaaatggaatttataattatgatcatttggcaacctacagtttttctgtattttttcaacttctcaacttcccagtgatgggggtggatgttgaactagtcacttaaggttttgggtctaaggagtaatatttgaaacatgcagtatttagaggagat

SEQ ID NO: 154290 - DNA, 601 bp, Human
cgacctctgaggctcaagccatcctcctgtttcagcctcctgagtagctggaaccacaggtgtgcaccaagatgctgagctaatttttctgtgttttttgttgagacgggggtctcatcatgttgcccaggctggtctcaaacccctgagctcaagcgatcctcccaccttggtctcccaaagagctgggactatcaggcatgagccaccatgcccagctgtactatttatattttttatttaaattaaattgtgcttaaagattctaaaatttatagtataaagctcattatagaaaatrgtattgacttctgaaacattatagttttggttttgtttttattccttcggacattttcacttaaggtagttatcactcatgcttttctgctattataaaaagtgaccagattttgcttttttatccaggaagaacagtttgtgaatgccacttgataggccacctgtgttattttccatgggtatttctaacaaataaaaagttatatttttactttgtattcatcaaattattttatgtttaatttagaaaagcttaaattcttcttaggaatatttgcaaatatttgtaaatagtttt

SEQ ID NO: 154291 - DNA, 601 bp, Human
aatgccacttgataggccacctgtgttattttccatgggtatttctaacaaataaaaagttatatttttactttgtattcatcaaattattttatgtttaatttagaaaagcttaaattcttcttaggaatatttgcaaatatttgtaaatagtttttttcaaaaaagttgaggtagatagatattaaatatttttgtgacttctcattaaaagaaactgaagcaattagttgacctcactcaattcattaaaacagtgctaggttcctggttttcgtgacattaaaaacaattcaacatytgtgtgtagacaatgactaaaactttatgattttgtttcagagttttattaccatagatattgtttaaaatagaactttcaaatacatttaagaaccattaaaagtgacttctccctgtgcctgaaagatacatgcatggcttatatctttttgtgtataaacaatttaatgtttaacttttatttcctttaagtttgcatatcaaacactcttagcaatctcatcatttatactggagtacttagactttgaaactttgccacagctacctgccacgtccttgtataggatataagtaa

SEQ ID NO: 154292 - DNA, 601 bp, Human
agcacaataaagacaccttaaaatgagtttgtttataggaaataacctacttatttagtaagactttaatggactgaagtaaatattcatgagatttgggcaggggaaagaaaagaaagatagggatgaggtctgacctgagcacaaacctaggcagggtgccacagggggaaccctgaacatcagagagcaggttgaatgcacctgattttaaaggaagattatgccaaaagagtgacgtaggagctgtaaaggagggacttcacctcttttcgatgctgcctgggactagttatacttstggaaaattttatgtgaagataactaataattctagcactgaatgaaacaaatgcctgagacctactggaacattaaatagacttttatgccagccagttatgattcagtgctatatttagaccacaaaatttgaactaaaatcaaggcagtttattcttatcccatcatgtccatggggtggagaggaacaactaagtaatcatgatcatgcacttcagtttatagcgttttctctagctttgggcattgtcacttaacagacaatacaattttaaaaattaaatgctcaatttcattt

SEQ ID NO: 154293 - DNA, 601 bp, Human
gatgtatttctttttctggaggaaggatccattgcctttatgagtatgtaacagtccagaagaagttaataaaatagctcgagctctcctaacttaaaacttttttattttttattattattatttttttttttgtagagatggagtctcgctctgtcacccaggctggagtgcagtggcatgatctcggctcactgcaacctccacctcccgggttcaagcaattctgcctcagcctcccgagaagcttcatcttgggttttttattattattattattattattattattattattattattatactttaagttctagggtacatgtgcacaacatcttggggtttttttaatgcagtaaattaaaatggggaaattaaaacacgttaaatactttccctttatttcactatttactgatacggtatttaagagataatcctgaaaagtatatcagttgggttgattatataaccagagatagtggctattttatcaattccgtggctttcagtaaaaggacagctcaattgcctttttagatacagaatgtttctgaatatgctatttcaagtagaaattccttcctatttttggaca

SEQ ID NO: 154294 - DNA, 601 bp, Human
tcagtcttcctcttatttgacctggcaacggtgtttaacactccttgtttggccttttagatactatactacactgtcctgtttttttttctcctacccctctggctgctgctttttcaatctcttgctgatttcttcttgcctccccatctccaaattgggaatgctccaacatttggaattttgaggcctttaaaactgcatgttcactcccttagtgacttcatatagtaccatggctttatatgatcatccatttgctaatgatcagaagtcctttagtctttttttttttttttttgatatggagttttgctctgtctcccaagctggagtgagtgcaatggcatgatctcagctcactgtgacctcctcctccggggttcaagcgattctcctgcctcagcctcccatgtagcggggattacaggcgtgtgccagcacacctggctaatttttgtaattttagtagaaatggggtttcaccatgtcggcccggctggttttgaactcctgacctcaggtgatctgcctgccacggcctcccaaagtgctgggattacagatgtgagcctccgtgcctggcccctgtagtcttctt

SEQ ID NO: 154295 - DNA, 601 bp, Human
ctaattatatggtaaaactgttaggtctgcagaagtcatattttatttctgaaataataaaaatacattttaaaacagatgcagaaaatgtgaaaggtagattgctgctggaaattcacatagtctttaaggaataaactatgtacgtgttgactatgaacagactagtctatatttactatattaaattttcaccaagttataaagattcagtatgttatccttttggaaatttaaaaaatagtaaaacacattctttttaagagcaggaacaatgtacttgaagcaacaaatttatgaytgaagattatatatcagtataatccttgcttctctgattgctgtgtacccttttctgcagccgttttttttttaactcttaaagtctgtgctctattacagtgattctttttcttgtttctaaaagaataaatgaatagttttttgttaataattaatgtaggcctctgcttacctgctttatacattctttacctgcctgtacgtagcacttgcctatgcaagtattcatttactgaaaaagttaccaactttgtagccttgaaatcatttaaaaaatatgttaactgacttgaatact

SEQ ID NO: 154296 - DNA, 601 bp, Human
tcaatggtagcttgatggggataacattcaatttgtaaattaccttgggcagtatggccattttcacgatactgattcttcctatccatgagcatggaatgtttttccatttgtttgtgtcctctcttatttccttgaacagtggtttttagttctccttgaagaggtccttcacatcccttgtaagttgtattcctaagtactttattctctttgtagcagttgtaaatgggagttcactcatgatttggctctgtttgtttattattagtgtataggaatgcttgtgatttttgcacaytgattttgtatcctgagactttgctgaagttgcttatcagcttaaggagatttggggctgagacaatgaggttttctaaatatgcaatcatgtcatctgcaaacagagacaatttgacttcccctcttcctatttgaataccttttatttctttctcttgcgtgattgcccaagccagacttccaatactatgttgaataggagtggtgagagagggcatccttgtcttgtgccggttttcaaagggaatgcttctagcttttgcccattcagcatgatattggctgtgggtttgtcata

SEQ ID NO: 154297 - DNA, 601 bp, Human
gtcctacttttacaaaatatcttattttcctctcttttttacacatataatagagaactaacttttataaactaaatgagaagggaatactaatttttaaattatgatgtcacttgtagaatttgttttaaaattgataaaatacacctctttttttattattatactttaagttctaggctacgtgtgcacaacatgcaggtttgttacatatgtataaatggccatgttggtgtgctgcacccattaactcatcatttacattaggtatatctcctgatgctatccctccccactcccyctaccccatgacaggccctggtgtgtgatgttccccttcctgtgtccaagtgttctcattgttcaattcctacctatgagtgagaacatgcggtgtttggttttctgtccttgtgatagtttgctgagaatgatggtgtccagcttcatccatgtccctacagaggacgtcaattcatccttttttatggctgcatagtattccatggtgtatatgtgccacattttcttaatccagcctatcattgatgggataaagcacacctctttaagactgcttatagaatgctatggactcatt

SEQ ID NO: 154298 - DNA, 601 bp, Human
tgtagaatttgttttaaaattgataaaatacacctctttttttattattatactttaagttctaggctacgtgtgcacaacatgcaggtttgttacatatgtataaatggccatgttggtgtgctgcacccattaactcatcatttacattaggtatatctcctgatgctatccctccccactccctctaccccatgacaggccctggtgtgtgatgttccccttcctgtgtccaagtgttctcattgttcaattcctacctatgagtgagaacatgcggtgtttggttttctgtccttgygatagtttgctgagaatgatggtgtccagcttcatccatgtccctacagaggacgtcaattcatccttttttatggctgcatagtattccatggtgtatatgtgccacattttcttaatccagcctatcattgatgggataaagcacacctctttaagactgcttatagaatgctatggactcattggcttggttttttatttccttggtttcagtccaaagtgtaataagcttttcagaaagtttctcctggatgtgtaaagaataccaacagatatcagaaagcatctggctgaaagt

SEQ ID NO: 154299 - DNA, 601 bp, Human
ctactacttctactaatcacgagtatagaaaaatatctctttgatcctgtgtgtgtggtggtaaggttttgggagaagccattatctatgggtggtggaatcacatatattttaaagtcttttcgaccatgttcgttttctaatttttctcaagtaaaagattcttctatacttttaaaaaaattataatttaaaaaaaaatcttattggacttgtttaaattatcagatatttttcagttatgtaattggtttctggcatacatagacttttatcatttgctctgctttaacataccttyatcagttttataaatacagttcgaaaggattgttctaaatatatataaagggaaaacttcatttgaaagcaaaatctgtatttgggatatttgttgtcttttttgccttctaaagggcaatctagaaacactaatattgattggttattttgtttcataatactttatagctgattcttggcaaaaatggttgatttctctttcattgtaatacaataataaaaaagttactcagaatttctccagtgttttaagagctgtccaggttgacatccaaaaatttaagagagcgttagaaca

SEQ ID NO: 154300 - DNA, 601 bp, Human
ggaaaacttcatttgaaagcaaaatctgtatttgggatatttgttgtcttttttgccttctaaagggcaatctagaaacactaatattgattggttattttgtttcataatactttatagctgattcttggcaaaaatggttgatttctctttcattgtaatacaataataaaaaagttactcagaatttctccagtgttttaagagctgtccaggttgacatccaaaaatttaagagagcgttagaacatgggatatctaattgttaattgagactggaattatttctaataatcttagwtgtaaatactaatatcttattagtcttcttatctttgctggtataaaaatggttgaaacatttgaaattattttctcagttacagttttgccctgtgtagaagtgtgattatctaagaagtgattttttttcagatttcaaatatgaagtgttgtttaatactaacatatagttacaaagactatcgtgactatttttggtgttcttgattatgatttaatacttcatactttaggaaagacgatttagttctaaatatatttataagtgagttcctaattttttgtgtgctgtagactt

SEQ ID NO: 154301 - DNA, 601 bp, Human
actaatatcttattagtcttcttatctttgctggtataaaaatggttgaaacatttgaaattattttctcagttacagttttgccctgtgtagaagtgtgattatctaagaagtgattttttttcagatttcaaatatgaagtgttgtttaatactaacatatagttacaaagactatcgtgactatttttggtgttcttgattatgatttaatacttcatactttaggaaagacgatttagttctaaatatatttataagtgagttcctaattttttgtgtgctgtagacttctaagctattgatataattgaatgttaagcattttcattttttatggcttactactttaatgcaaagcagaataaaatactaatttatttcttaccctcagatgatgttgtgctgatgtatattttccagtcttgtcataagctcacaattacctacataatggtcttgaaccaaacgattaaatggaagacaacatttctggtcttccattttaattagtgtggtgcaagactattatgtaggtttttgtgtaaaatgtggaatgtgaatcctcaactctttagtcattcttcctattagatattga

SEQ ID NO: 154302 - DNA, 601 bp, Human
aattgcgtattctggttaatgagtggcttatcacatactgtcttaacaacactaagcactctttattcagtaaaagttcacaccataagaaaatatattgtaatgtatttagtgcttcttcggtgatatataaggtgttctacttagaaatttagatttgtaggaatgctggttaatagaagtttctaatatttactgtcttccatatttcctgatgttttgtttattttaagctattttaaatattttgcatttcatatttttaaccaggcagtatctctgttcctcattctgaacaccyaatatggtactttgaacataatagggtttcataaagtgcttgattcagtaaaaaaaaaaattgaacatctactatgttccaggcattttgctggatttctggactacaatcatgaaaagacagtctattctctcagcctgcttatagtctagtgggaaagataggttgacagacatccctaatatagtataagttcttgaatacaggtaaatacaagagtatagagtacctagtctcttctaggagtgtcaagcaaacttttttagtagaagcagcctctgcaccaaggagggaattagg

SEQ ID NO: 154303 - DNA, 601 bp, Human
atctgtaaagaaatgacatttagatagaaacttaagtggagatctgaacaatgagctggtggtagacagtggtgtaggcagaggctgtaacatgcatgaatgccctggggggataaggtttgtggcagcagtaaagccggagagggaggtagaacccagattatggacagccaagttagggatttcgattttatcctcagtgtaatgaaaaaatcatcaaaaggttttgaatagtggaataatataagatgacttgttttattaaaatattaattatactatggctaatgtgtggagattkgctaagagaacaggtagaatgagtgagtatggggacatcagttacaggagtcatattctcatatccgccacatagtgggcactcattcaccattttgtggttagctgaatgatgactagatcactgcctctgttgtaacatctcaaattatttgcactttaaccatgagttaagttggatatttttgaggaatcatgaagtgttgctgatttgtactaatttttcctcataaaactttagatattttgaactgctgcttcatcttgccaagggtgaaaacaaagcatttattcattcatt

SEQ ID NO: 154304 - DNA, 601 bp, Human
tgcatggatgattgggagaaccttacttagatgggggacaggcagttgtgttagtgagttctagcagatgcaccctccatggcatggaggagtattgtccttttatgccagggtaccttagaagagtatcggtgtgggttgtgacttatgagaggggctacacatgcatgggttgggacaaccatgtggtattaatctaccagtggtttcaagttatattgataaaacaaatacattcttacaatttaagtgtagcctttacacctgaattcaaccatctgctatctagcaaaattcagtrtcttgcaaacttaaggctgtcaggcgtctgctgctaatttaaggatagcttggtggaatttgcatggagggagcagttctcttttctctttctgaaatgaccttcatctctctttttatctgattggtttatctgttaaaacccagcttaggaaaaaaaaagcttagacattgcctccctgctaaagcctttccatttctagaaacctatctccagtgtccatccttgagaaagtcaatccttcttttctctttgttctctacctggattgaagttgtttctgtcaattaaaactaccat

SEQ ID NO: 154305 - DNA, 601 bp, Human
atgacagactccagctgcatccatgctgccgcaaaggacatgatttcattctttttaatggctgcgtagcatttcatggtgtgtgtgtatatatatatacatgtatatatataaatgtatatataaatgtactttttcatgtgagaattcttccaataaaatattgatgactgtggcataggagtgtaaaattagaagtgcttcatatggatacaatgcctacatttcagaaatcttcatgcagctcttctggaatgtgggcaaattagtctcccggttttctctatggtcaaccattttmtattatactcaccttgtcagaagatatttaatttaccacaattaactaaaagcttttgtttaaaaagtatgtcttatggaaaacagaacagaggtgactaattttttgtgtgcagtaaatgtttttaagtaagcatttctacaaccaggtgaaggaaatgattaagtagaaattgggacttgcatgtaattttttaaaagattgtgaaacttgttaatattatgcatgtatccaacttcttttctattttcaaattattccagtaacaaaggtttatgcaataggtatactcccaaaagg

SEQ ID NO: 154306 - DNA, 601 bp, Human
atttgtgtgctcttgattatctagttattttagttgtgatgtcaggttgttaactcgagatctatcttttcgatgtgggcatttggtgctataaatctccctcttaacactgccttagctgtgtcccagagattctggtacattgtctctttgttcccattagttttaaagaacttttttattatgtccttaatttcattatttacccaaaagtcattcaggagtaggttattcagtttccatgtaattgtatgagtgagtgaatttcttagtcttgattttgaatttgattgcactgtgktccaagagactgttaagatttcagttcttttacagttgctgaggagggttttacttccaattatgtgagcagttttagagagaaagtgccatgtggcaatgaaaagaatgtacattctgttgtttttgggtggagagttctgtaaatatctatcaggtccatttgatccagtgctgagttcaggtcctgaatatctttgttaattttctgtctcagtgatctcatattgtgagtagagtgttaagtttcccactattactgtatgagagtctcagtctctttgaaggtctcttaagaagt

SEQ ID NO: 154307 - DNA, 601 bp, Human
taacacaggcatactgcatgttctcacatgttaagtaggaactaaatgatgagaacacatgggcacacagaggggaacaacagacactggggcttaccagtggtggagggtggaaggagaggatcagaagaaataactaatgggtactgggcctaatacctgtgtgatgaaataatctgcacaacaaaccctcatgacacaagtttaactatgtaacaaacctgcacttgtacccctgaatttaaaagttaaaaaaaaaaaaaagccagtgaatctgttgtgaatacttacaggcagaacyttttttttttttttttttttttttttgagacgaagtctcactcttgtcccccaggctggagtgcaatggcataatctcggctcactgtaacctccacctcctgggttcaagcgattctcctgcctcagcctcctgagtagctgggattacagcctgccaccatgcctggctaatttttgtatttctagcagagacagggtttcaccatgttggacaggctggtctcgaactcctgacgtcaggtgatccacccgccttggcctcccaaagtgctgagattacaggcgtgagccaccacgc

SEQ ID NO: 154308 - DNA, 601 bp, Human
tagtggtagcttatagggtcatctgttaattagttactgagataggcagtttatataaattgctcattcagtccttaaaaaatcttataagtagttattattctcccattatatgtgaggaaaatacaagaaactgcttccttttgcaaaccaaacactgcctttaaacttagcatcttagactgccactacctgcagacatgactagaacttattaaatattgtcttttttcagtttaatagttacttagtaatatggcctttatctaaatttcctaattttgccatgttaaaatgtaawcctatttgaactatgaactttgaatttactttaataaaaataatttctaccactgctaatacaatgtaaaatttttaagcttagcttaagattaatgttactttggaaataaattgctacacatttacacacataatttatataggaaataaatcagtctatggaaatatatttagattataagcctttttagctacagaaacaaaattgtttagaatgaacttacatagcaagacaaaattgaaaacagaggctttagaagctagtgtaatataaagtttacaatttacaaaaattact

SEQ ID NO: 154309 - DNA, 601 bp, Human
aaaccatatcaatgaattttatagttacattaaaaaatcactgctctcttgaactttgagtgggccttttacccacttactaatttgcaacatcatgcattagttatttggaagatattggttcactgaattgtccagatcttccaaatgttgacacattccattttacccaatcaaaaaatcactaatagcagcaccaatctcttcagaagggtcttcaaaattaggaaattgcaaaattcaactcagctgcagttaacatgttttccaaaattctcatttacatctgaaagctcaaatkttattggcaacaaatttggccaatttgtcttcctttaaatgacaggcttatttggcttatttttgagaaaatatctgccaaatactcaaacctgaataaccattgtttgtcagttggttattctttcaagttaaatagatgtaccatgaaaaaagcagctacttcggtagcaacttaattccaggagtgattttccataagacatctgttatactttgatgtccagcagaagtgttttgtgtatacatcccattttgttgtacagaacactaaaaagacatacactacagggtcaaaact

SEQ ID NO: 154310 - DNA, 601 bp, Human
agaaagatttgattaagtacttgtcaatgaagtctttaataattcattgggaaccacacttttattctgttttgtttttttgtaaggacttttttttcatttatgggctctactcttctgctgtctttggagagacagcacagtaacctgttcagagcatgtccggagccacatggcctagggtacagtcctggttaccagtactaactggtcaacctttggcaagttatgtaatctaagtcttagtttcattgtctataaaataaggataataaaaattcttcaagtggcttctgtaagkattaatggattcagtgcatataaagcactgaatatgtaataagcactttgtggatcagggttgaagcagggtgcagaagtatacgaggagcattggttgtaagcttttctatatatcagtagtagaaatgtgacaggtcataatttctttaaagtacgtttaaaatacctatttcccacttcatttttatatatggtattaaattttctatttgtttgtgttttccaagaatgtccacttctttcatcacaaagcccacttattctccaaaaagtttatataagaaaatgggtagttagt

SEQ ID NO: 154311 - DNA, 601 bp, Human
ttgcgcttcccaggtgaggcaatgcctcgccctgcttcggcttgcgcacagtgcgcgcacccactggcctgcgcctactgtctggcactccctagtgagatgaacctggtacctcagatggaaatgcagaaatcacccgtcttctgcgtcgctcacgctgggagctgtagactggagctgttcctattcggccatcttggctcctctctgcctatattttcttctaatacttttatggtttcagttttttttctaagttaaagtctttgatttcgtgtgggtttcattttggtgaaagtcwtggggtggggatctgatttttttccaaatgatttttattaaataatgcattttccccccactaatttgcaagactcctatttgtttagggtctattttgtattatattcaagtccattgattgcccatccctgtaatagtacaaatctatttccatttctgtagcttcaagataaagtttactctctggtatatctagtttatgttctcctaccaccaccattactattatttttctgaattttcctgagtattttaatgtgtttgttttctcagataataataccaacagtatgtatca

SEQ ID NO: 154312 - DNA, 601 bp, Human
tatttgatgacttttacatagaatgctagttttcttcatgtaggtcctccatgttttattttaagctttttccttcatgtgtttcatttgtgttgctagtaatagaattttttcctctttcgtgtttttagctggttattgttgattattggaaagctgttgatttttttctgttggaaagatattgatttttttcttttaaatttgtaattaaccatttaccaaatgtccttactgctaatagtttttttattgatttttcctgaattttctataaatgttattctgcaaataattttgyttctcctttctaatatttatactttctcttttattctttttaaaaattggtttattcttgtaaatcattgttaactaatgatgaaactaagcatctttatcttacaaatgcctgtcattcataatcatttattatgatactaacttcagttttcttttcatgcaaaagtatcagcaagggaatggtgaatttttttcaaatgcctttctgtatctatagatgtcgtttgtcctttatgttaatatagtaaaagcacatatattttctaatattaagtaatgtttgcttcattcttttaat

SEQ ID NO: 154313 - DNA, 601 bp, Human
catgtatctgaagatattaaaaaccaccaccccttttgcaggggtaaaatttagaatgattgacttttattggagttatgttttaaaatatattttgaaaatataaaaagagtttatgaagattttacctagagaaggatttaaaaatttcacccaaaatttactgaatcattagaattactaaaatctaacatgttcatggtacttggggtactctaaaaccattatgatacctatttttagattatttaaattaaaattagataatatacacattgttcattattatataacattacakttgtatattacattatatccttcattatacagtaaaatatatatagacagtaagctaacattatcagttcggtcaaaagtcagattaacaaaaatttacagtaaatgcttagtatttatagacaagctcctctttcctggagtaatattatatgcagaagttttctctgatcctatgaattaccacatgacctctccattccattttgtgtacctgtttgcctggtctggttatgactgcagttttgttttcattttcctgaattgttgctaacacttaagtatattgacttgtttcttc

SEQ ID NO: 154314 - DNA, 601 bp, Human
taaaaccattatgatacctatttttagattatttaaattaaaattagataatatacacattgttcattattatataacattacatttgtatattacattatatccttcattatacagtaaaatatatatagacagtaagctaacattatcagttcggtcaaaagtcagattaacaaaaatttacagtaaatgcttagtatttatagacaagctcctctttcctggagtaatattatatgcagaagttttctctgatcctatgaattaccacatgacctctccattccattttgtgtacctrtttgcctggtctggttatgactgcagttttgttttcattttcctgaattgttgctaacacttaagtatattgacttgtttcttcactgagaaaagaaaaaagtgtggtcccatattcagttcagcaaataattctatacctactatgtagaaggcagtatgccagtgactgtatttaggataaaatgtgtgtgtgtgtgtgtgtgtgtgtgtgtgtgtgtgtgtgtgtgtgagagagagagagagagagagagagagagagatgttattgtagtcccaattgatgttaaagaataatgga

SEQ ID NO: 154315 - DNA, 601 bp, Human
atcctatgaattaccacatgacctctccattccattttgtgtacctgtttgcctggtctggttatgactgcagttttgttttcattttcctgaattgttgctaacacttaagtatattgacttgtttcttcactgagaaaagaaaaaagtgtggtcccatattcagttcagcaaataattctatacctactatgtagaaggcagtatgccagtgactgtatttaggataaaatgtgtgtgtgtgtgtgtgtgtgtgtgtgtgtgtgtgtgtgtgtgtgagagagagagagagagagagagggagagagatgttattgtagtcccaattgatgttaaagaataatggatggaaacacttggtcagtgtttccaccgatctttgcatcactcagcattcatgcctaaatttgtggtgttctcagaattgtgctaatgtgtaaaatattcttatacttaatatgagtacagtctgttggctctgtagaacacaactcaaagtgtatgtatttttctagttatttcttaaattatgacaatatgcttatctgatatatgtggaaccagtttgttaaaagtagtctgttagtttttaaggattagt

SEQ ID NO: 154316 - DNA, 601 bp, Human
gacatatgaaaaaatgctcatcatcactggtcattaggagaaatgcaaatcaaaaccacaatgagataccatctcacaccagttagaatggtggtcattaaaaagtcaggaaacaacaggtgctggagaggatgtggagaaataggaacacttttacactgttgtgggtgtgtaaattagttcaaccattgtggaagacaatgtggcgattcctcaaggatctagaactacaaataccatttgacccagccatcccattactcggtatatacccaaaggattataaatcatgctgctataragacacatgcacacgtatgtttattgcagcactatttacaatagcaaagacttggaaccaacccaaatgtccatcaataatagactggataaagaaaatgtggcacatatgcaccatgaaatactatgcagccctaaaacaggatgagttcctctcctttgcagggacatggatgaagccagaaaccatcattctcagcaaactatcacaagaacagaaaaccaaacaccgcatgttctcactcatgggtgggagttgaacaataagaacacatggacataggaagggcagcatcacaca

SEQ ID NO: 154317 - DNA, 601 bp, Human
gtaggttgctaataagtactgaaagtaaaaatgaaagttaatagcattgtgcatcatttgccagtaagcatctccattccgtgtgtgtgtgtgtgtgtgtgtgttgtgtgtgtgtgtgtgtgtgtgtgtgtatttgcctcttactatgagttaaaggcccatcaggaaactcttacagtcaggaaacttaagcttatagtcagctgtgaaacagccttttaaaaatcattccccttacccacacacggacttcactctgcttgtagtgtggctgctcatagtgtggctgtttttccatctygacacgtattttctcattactatattaaagtgacttttttctttattgtattgatatactgaatagacctcctcagataatatttatggaaacataaaaccattctggaaggcagtttaacagtatctacttcataagtcttcccttttactctaaagtttcacccctactaatctgataagtatatataaggaatggccaaaattatacatatttacaagaaaaattatggcattgttgctagtgcttaacacaggcaaaaaaattatcaatagatcataggttgaagtatatctgtat

SEQ ID NO: 154318 - DNA, 601 bp, Human
ttccgtgtgtgtgtgtgtgtgtgtgtgttgtgtgtgtgtgtgtgtgtgtgtgtgtatttgcctcttactatgagttaaaggcccatcaggaaactcttacagtcaggaaacttaagcttatagtcagctgtgaaacagccttttaaaaatcattccccttacccacacacggacttcactctgcttgtagtgtggctgctcatagtgtggctgtttttccatcttgacacgtattttctcattactatattaaagtgacttttttctttattgtattgatatactgaatagacctcctcarataatatttatggaaacataaaaccattctggaaggcagtttaacagtatctacttcataagtcttcccttttactctaaagtttcacccctactaatctgataagtatatataaggaatggccaaaattatacatatttacaagaaaaattatggcattgttgctagtgcttaacacaggcaaaaaaattatcaatagatcataggttgaagtatatctgtatgatagaatgctgtgtagctatccagagggaaataagaaagctttatgtatatagatgccccttgacttatgaatta

SEQ ID NO: 154319 - DNA, 601 bp, Human
tgatatactgaatagacctcctcagataatatttatggaaacataaaaccattctggaaggcagtttaacagtatctacttcataagtcttcccttttactctaaagtttcacccctactaatctgataagtatatataaggaatggccaaaattatacatatttacaagaaaaattatggcattgttgctagtgcttaacacaggcaaaaaaattatcaatagatcataggttgaagtatatctgtatgatagaatgctgtgtagctatccagagggaaataagaaagctttatgtatayagatgccccttgacttatgaattatgatggtgttatgtcctgataaattcatcgtaagttgaaaatactgtgaaatcgaaaatgcatttaatatacttaacctatcaaacatcatagctgagcttagcctgccttaaatatgcctgcaacacttatagcttacagttgggcaaatcataacatgaagcctatgttttaatatgatgttgaatatctcttgtcatttattgaatactgtaccaagggtgaaaaacagaatggtgttgcaccatcataaagtcaaaacattgtaaatcaagc

SEQ ID NO: 154320 - DNA, 601 bp, Human
tttggagcacataaatatgtaaagaaaaaatataactgaagggagaaatagatagcagtacagtaatcataggggtcttcagtgctttcaataatggagaaatcatctagacagaaaatcaataaagaaacagtggatttgaacaacactagacaaaatggacctgatatacagaacattccattcaacagtagcagaatatgcacatttttctcactcaaacatgtaacattctccaggacagattatttgttaggccacaagataagttttaacaaatttaaaattaaaattatatcargtatgttttctgtcaacagtggcatgaaaccataaatccgtaacaggaggaaaattggaaaattcacaaatatgtggaaattaagcaacacactcctgaacaaccaaaggtcaaagaagaaatgaaaggggaagtaaaaaatatcttgaaacaaacaaaaatggaaacataacataccaaaacatggaatgcagcaaaagcagttctaaaagagaattttatagcaataaatgcctacattaagaataaggaatgatcttaaataaacaacttaatattggacctcatggaactagaaaa

SEQ ID NO: 154321 - DNA, 601 bp, Human
cctgagtggtttattggctacctgggaacactttactcctcctatcactgccagtggttgatcctaaggagccagaggacaaatccactggcctggtctcagtttgccaggactcaagcataccacccaggaatatggggatgagatctgtggcctgatctcaagcaggggaggaacccccactgtcagaacacagggaagagtgtggtgtgggtttttcaggtgatacagaagctgggcacccctcccttcatgagaatagactaggaagggtatagcctcatagccttgctttctgctscagggagtcttgcattctggaatgcctgggatggcatggcagtctgggcacaggtggtttgggatttgcataactaattgggccggctgccagggtggacactggagggagacccaccagtcaggggtgtagaagctgagtgggcctcatggccatctgctggaatgaaatcccagggctagccctcttaccctgaaccagctcttgtggcacagaagaggtgcctgcacccctccctagagtgttgttccagctgcctgagaactgcccctacagccctaccaaggtcacgtctgcctc

SEQ ID NO: 154322 - DNA, 601 bp, Human
cactggcctggtctcagtttgccaggactcaagcataccacccaggaatatggggatgagatctgtggcctgatctcaagcaggggaggaacccccactgtcagaacacagggaagagtgtggtgtgggtttttcaggtgatacagaagctgggcacccctcccttcatgagaatagactaggaagggtatagcctcatagccttgctttctgctgcagggagtcttgcattctggaatgcctgggatggcatggcagtctgggcacaggtggtttgggatttgcataactaattgggccrgctgccagggtggacactggagggagacccaccagtcaggggtgtagaagctgagtgggcctcatggccatctgctggaatgaaatcccagggctagccctcttaccctgaaccagctcttgtggcacagaagaggtgcctgcacccctccctagagtgttgttccagctgcctgagaactgcccctacagccctaccaaggtcacgtctgcctcagagagcctgatcacgggctcaccagacccagtcccacccagctttgccccctctagccagccttgggagcagagcatgggatgg

SEQ ID NO: 154323 - DNA, 601 bp, Human
actcaagcataccacccaggaatatggggatgagatctgtggcctgatctcaagcaggggaggaacccccactgtcagaacacagggaagagtgtggtgtgggtttttcaggtgatacagaagctgggcacccctcccttcatgagaatagactaggaagggtatagcctcatagccttgctttctgctgcagggagtcttgcattctggaatgcctgggatggcatggcagtctgggcacaggtggtttgggatttgcataactaattgggccggctgccagggtggacactggagggaracccaccagtcaggggtgtagaagctgagtgggcctcatggccatctgctggaatgaaatcccagggctagccctcttaccctgaaccagctcttgtggcacagaagaggtgcctgcacccctccctagagtgttgttccagctgcctgagaactgcccctacagccctaccaaggtcacgtctgcctcagagagcctgatcacgggctcaccagacccagtcccacccagctttgccccctctagccagccttgggagcagagcatgggatgggaccactgagagctccacacccccca

SEQ ID NO: 154324 - DNA, 601 bp, Human
aggaacccccactgtcagaacacagggaagagtgtggtgtgggtttttcaggtgatacagaagctgggcacccctcccttcatgagaatagactaggaagggtatagcctcatagccttgctttctgctgcagggagtcttgcattctggaatgcctgggatggcatggcagtctgggcacaggtggtttgggatttgcataactaattgggccggctgccagggtggacactggagggagacccaccagtcaggggtgtagaagctgagtgggcctcatggccatctgctggaatgaaawcccagggctagccctcttaccctgaaccagctcttgtggcacagaagaggtgcctgcacccctccctagagtgttgttccagctgcctgagaactgcccctacagccctaccaaggtcacgtctgcctcagagagcctgatcacgggctcaccagacccagtcccacccagctttgccccctctagccagccttgggagcagagcatgggatgggaccactgagagctccacaccccccacccatcaccaagaacactcttgtattccttatcaacaaaggccaagtaaaaatcccactg

SEQ ID NO: 154325 - DNA, 601 bp, Human
aggtagactaggctgaactgtgttgttcagtaggaccggcgtattaaatgcattttgacatgatattttccatttataacggggtttatcaatatttaacctcatcataagtcaaggagtatctatacaggtataaatgtgcatggcatgtgtgaatgtgtgtcaaagaggagtagacaaaccaggaaagggaaatatgattcagttaggcatttactgtgccttcttagaggttgcagtaagatattcccatgaacatatttgaaatggttagaaacacatgggtgtgaatttcaaaaaatacaagtttttgaatttaacacatatgctaaataatcagtccttcagcttaaactatgttatcctgcaaatgatagtaagtcttctggatttttattagaatgaatcacattttccatccttgtttttatttactaggaatttcatcttatgactaaaaagaacaagccataagctcttttggtctaaatttgagatatttgcctttgacttatttttaaattaaactttttattttgacataataatagattcacaaataatacagagaaatcctgtgtaccctttacccagtttcctc

SEQ ID NO: 154326 - DNA, 601 bp, Human
tatttaacctcatcataagtcaaggagtatctatacaggtataaatgtgcatggcatgtgtgaatgtgtgtcaaagaggagtagacaaaccaggaaagggaaatatgattcagttaggcatttactgtgccttcttagaggttgcagtaagatattcccatgaacatatttgaaatggttagaaacacatgggtgtgaatttcaaaaaatacaagtttttgaatttaacacatatgctaaataatcagtccttcagcttaaactatgttatcctgcaaatgatagtaagtcttctggattkttattagaatgaatcacattttccatccttgtttttatttactaggaatttcatcttatgactaaaaagaacaagccataagctcttttggtctaaatttgagatatttgcctttgacttatttttaaattaaactttttattttgacataataatagattcacaaataatacagagaaatcctgtgtaccctttacccagtttcctccaatggtaacataatataatgtcacaacaagcatattgacattgatacagtcaagatacagagcagttctgtcactaacaggctctcgtttc

SEQ ID NO: 154327 - DNA, 601 bp, Human
tatattaccatcatataattacccagttggcatactgtttattattttagtttaaggagacacattgaagcgagaaaaagggggtgctagaggtttgcagacacttagcaaacactagtgtttatcctacagctttgtaaacactttaccaagaatttttaaactgtcattttgctgatggaaagtgtaaaatgagacttcagcagaagttaatctcatcatctacttaaaacagtgttttttacattgatctaaagaggtttgtgcatattttaactgtttttcctatatgatcatcttyatgtactagtatgaaagttaatgagtaaagaaaatctgctgaataaatccacgtgataatccaaggcacttaaaagaaatacatgctataatgggatgcaaagattttacttgattagtgctctatttctcaatttaacaatcaaacctaagagaaatctcaatcaagacttttgactaacatagtgcaatttgattagggtgcagataagtacactatttcggtgtgactgtataagtattctgatcataattatgacatatactctgctactagttagaaaaagaacagtttttaact

SEQ ID NO: 154328 - DNA, 601 bp, Human
aaatctcccccacgtacacaatgatgatccctgctgcattattcgcctggaacatggggagttaggagtaagcaaacttccattaaagctccagtgagtgtagctttaaaaggaaatttagcttttgagacttttgagcagttaaactgtaaaatgatgtcctgcctttgcttttgttacttccttgacttctagggaataatatgctgacaaaatgagcaaaagcattgtacagcagtcgccatcattagttcagaatgttgtcagatcttttttatagcagacttccttctgcagctcrtgaagttaaggaactatagtctgaactcagtaatcagagtaaaaaattcattgaaaacatcctttgttccttctgagcgtccctttttttgtttatatagttgataattttagaaagtttcaaacatggaggataaagataagaggaagcctgaggatactttattcaggatggaaaaatagatagatagatagatagatagatagatagatagatagatagatagatttaaaaatattcagtgtttatattaaatatttgctctctcaaatacatgtatatagtcatttaattctatac

SEQ ID NO: 154329 - DNA, 601 bp, Human
ttttaaaaatatgaaaatgctctttaagaaatgttgtgtcataatatttactttttgagctcatatttccattctatatgcactatagaattttatgcaaacgtatattaattacttcataaacagtaattaattgtaatagcttaatattacttctagaaggaaaagtgttcatcattcagtttcttttttttagcattgaggtacctttattctcaaataaaaagatgaaataaaattttatgttataactgagttgctcagtttttatgcatcttcagctataatgtcaaaagttatktgtcaatgaaaatattttaatgtcctgtcagtatttcttcaattttgttgaaaacaaaaatttaaagccatctaatttgcaaaaagatttgtttcccagtcattacaatcatctattccctcattttctgggacgtataccagaaagactttaccaatagttatttatcaaaggactaatgatacctgttttgggctttaaaatgttttttctcacagtcactttgtttaatgtattcagaaatgattaaggaaactgaaatatgttaatttcagtatcttttatcagtatatttttcat

SEQ ID NO: 154330 - DNA, 601 bp, Human
aagaaattttaaattttcctccttatttcttccttgacccagtggttattcaaaagcatgttgtttaattttcatgtgtgtgtagagtttccaaagttcctcttattattaaaatctatagttgtattactttgtggtctaaaagctacttgatatgattttgatttttaaaaatttgtttgagacttgtcatgggtcccaacatacagtctatcctagagtatgttctgtgtgttgatgacaagaatatgtatcctttagtagttggttaaaatgttctgtaagtgtctcacatccattyggtataaaatgcagtttaaattcagtgtttctttgttaagtgtctttctacatgatctgtctaatgctgataggggtgttgaagtccctaactattattgtattagaatctgtctctccctttagatctaataatatttcctttatatagccaggtactccagtcttgggtacatatatgttaagaattgttatatcctcttactgaattgattcctttgtcattctttaatgaccttctttgtccccttatactgttttgtttactggatttaagagtttatctcattatagctactcc

SEQ ID NO: 154331 - DNA, 601 bp, Human
ctcattatagctactcctgctcactatggtttccatttgcatggacatctttttctgtccctttactttcagtctatatggatctttacaggtgagatgaatttcttctaggcagcacatagctgggtcacagtttttatccattcagccaatctgtaccttttaagtggaaagtttaatccgtttatgttattattattgatatgttagagcctatttctgtcattttgatttctggttgttttgtgtatcatttgttcctttctttcttactgattattattgtggtttgatagttttytatagtggtaacatttgagttctttctctttcttatttgtacttgttctaccagtggattttatattttcatgtgttttcattatggtagatatcttcctgtcacttccatggataagactcccttaaacatttcttgtagggccagtctagtggtcatgaattctctcagcttttacttgtttaggaaagactttatttctctttcatttatgaaggataattttgctgggtatgatattcttggctggcagggtttttttctttcaatactttgaataaatatatcatttctttctct

SEQ ID NO: 154332 - DNA, 601 bp, Human
aagcagtagttgagttaagccgttaaaggctgggtagaatcttagtagtcaaaattatgggaaaacacagtgaaggagtaaggaattatgtaaaccaaagccaaaagataaagaggagcaatatgtgtgcagaaaaccatggctcgctaaatgactgaggcatagacttgtcataaaaaactggtgaagaatcatcttggaaactcagggactataatcttggaatctgtagacttggaatctttattgaggggttaatggggatccttcagaagtttatgaggaggagttgatagaatgsaattcaagcagtgcttttgtaagattaatctaagtatgaagaatacatttgaaatatgtgaaaatgggaatttgataaaccagacagaaagctattataataatccacatttggctgaaaaaactggaagtatttttttaatcatcagattaaagtacattttggaaatatcaaatagaagagacaggataaagtacaggaaaaatcctgtcttctattcaggaccttgttctgttgagtgagctttagacaggttattcagtatttgtggatgcggtttctatatctataaattggaaa

SEQ ID NO: 154333 - DNA, 601 bp, Human
ttagcatttcatagactcacgtgtcacgtgactagatcaagtagcagtgaaagtagaatcaagttacttcagcaccagggccactcacaaatgacagggacaaatggctgcacctctcttgcctcatagagccataagaaatgttgtgaaaaaccttcaacttttagaaaatgtgtgggtttgaggcaatggcgtggaacactctagataaggtaggaagatcttaggggacccagttccacaacaggctccctgcagggttatttggcttacataagaacgtgctgcccaaaattatctycatgagactgcctggagtttctaaaggttcattttgattagcaattatttctgttaaaaagatagaccctcctgcattgtttttccatcttgctccttagacaagtggtagagcacacctctctcttttcaaggagaccgtggaggttaaagaaccctgaagttctggaggatacaattgaaagaccaggttttaaaaatagaatgttagcttttgcttagtgaaacccagaatgagaaaaatgaaggcaaaagatgcagttagtaatgagcgattaattagcaaactaataagttaaaa

SEQ ID NO: 154334 - DNA, 601 bp, Human
atttcatagactcacgtgtcacgtgactagatcaagtagcagtgaaagtagaatcaagttacttcagcaccagggccactcacaaatgacagggacaaatggctgcacctctcttgcctcatagagccataagaaatgttgtgaaaaaccttcaacttttagaaaatgtgtgggtttgaggcaatggcgtggaacactctagataaggtaggaagatcttaggggacccagttccacaacaggctccctgcagggttatttggcttacataagaacgtgctgcccaaaattatctccatgwgactgcctggagtttctaaaggttcattttgattagcaattatttctgttaaaaagatagaccctcctgcattgtttttccatcttgctccttagacaagtggtagagcacacctctctcttttcaaggagaccgtggaggttaaagaaccctgaagttctggaggatacaattgaaagaccaggttttaaaaatagaatgttagcttttgcttagtgaaacccagaatgagaaaaatgaaggcaaaagatgcagttagtaatgagcgattaattagcaaactaataagttaaaaccttc

SEQ ID NO: 154335 - DNA, 601 bp, Human
ggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaacaataagggcactaagagccacaagctaggggaatagtggaaggcaggagttagacctatgataatcaagcctgacagggctaagtttgaactctgtatgaacttttaatgagatatagcagaaccccttatttgcatctcgtccctctaagawgaggtttgctgagcttcggaaatggtttaatgatatactcaagatggaaaagacttgaagtgagtaaattacagttgggcaaatcagtaactgtcaaaagaaggaacgttcctgacctcggcccaagggtatcgctgtgctctggtttgtattagcttcagcaccgctgcaatctcactgaaggtcaagttcccttttaataatgctttatatatccaagtctatctgcagttataaaaatgcttcctaagaggcatttaagagtaaaatggtccagttctgaaccattccctagcacct

SEQ ID NO: 154336 - DNA, 601 bp, Human
caattggaagtgcagcaaggagaagagaagatggttccaggatttccagcttatatactggatggatactggtgctgttaagcacagtgatagaagaacaaaacaaggaatgggaaagccactttatggctagtttgctttggatcagaaagagctttaagcaccaactgacatccaagtgaagttcaccagttgcaccagaaggactgcagctcaggagagtcagaggttggaaagagatttgggaaaagacagggtcaaggatgaatggtgggtaaagtgttagtggtactcttataamctttttcccactaataattttctatagtgaaaatagtattaaatgctccccactgcccctcagtaataatgaagaaaagaagatacctcccaatagtctattttcacctaagtccatgccagataactctgaaaggggcagtcagtccccagaccagcagcatcaacatcacctggaacttatcaatgcaaagtttagggccccacccaggacctattaaattagaaattctgggggtgggtacagcaatctgttttagaaaacctccaggtaatgctgatgcactctcaggtctgcgag

SEQ ID NO: 154337 - DNA, 601 bp, Human
gtaccaactatacaaaatactggggctacaaagttaaaatattgaaaataaaacccagacatagcccctgctataatgaaacttacaaactagcaaagatagtagtcattaaataattacaaaattttaaacacaatcatagtatttaattggggagctataaggaagaaacagttgctgagaaagaatgccagggacagcactgaggaacatttcagaaagaggcacacatatgacacttggtgatcaattggaagtgcagcaaggagaagagaagatggttccaggatttccagcttayatactggatggatactggtgctgttaagcacagtgatagaagaacaaaacaaggaatgggaaagccactttatggctagtttgctttggatcagaaagagctttaagcaccaactgacatccaagtgaagttcaccagttgcaccagaaggactgcagctcaggagagtcagaggttggaaagagatttgggaaaagacagggtcaaggatgaatggtgggtaaagtgttagtggtactcttataacctttttcccactaataattttctatagtgaaaatagtattaaatgctccccac

SEQ ID NO: 154338 - DNA, 601 bp, Human
gaggcagtttgtaaaaagccttacagaccacactgcagagtttcttttttcttttctttttaatttttttatttccataggtttttggggaacaagtagtatttggttacatgagtaagttctttagtgttgatttgtgacttgatcattccatgacgaagggacagcaaagcttttgaaacagatgtcacaactcaaaggaagcctgaattaagaaagtggtatggaaactcattatttctttccttcactcatttgtaccaactatacaaaatactggggctacaaagttaaaatattraaaataaaacccagacatagcccctgctataatgaaacttacaaactagcaaagatagtagtcattaaataattacaaaattttaaacacaatcatagtatttaattggggagctataaggaagaaacagttgctgagaaagaatgccagggacagcactgaggaacatttcagaaagaggcacacatatgacacttggtgatcaattggaagtgcagcaaggagaagagaagatggttccaggatttccagcttatatactggatggatactggtgctgttaagcacagtgatagaaga

SEQ ID NO: 154339 - DNA, 601 bp, Human
ggcatcactcccaagaggtagtgatgtgtgtgaaaatactttagctgtccagaagaggaccggtgtctaccaaaggtagaattttcaccttgaactaaacactgccaattatgcacatgtgacaagaataaatctcaaggagctcacagagagttacaacactaggcaattctctacagcagtggtgtgcattgttattgagggaacatacatgttcttctccaatgctggagggatactcagtgctccgaaggagcacagatgaaggagtaattcattctacctggtggactagaaaacsaaagtttgccaggtgttaaatacttgtcaggacagtgattccaaacaagggagccacatgagtaagagttcagcgatatgaaaaggctgtgtggttacagacatgcgggatcaggtctcatggagagaggttcatgaagatgaggctggagaagcagactgaggcagtttgtaaaaagccttacagaccacactgcagagtttcttttttcttttctttttaatttttttatttccataggtttttggggaacaagtagtatttggttacatgagtaagttctttagtgttgatttgtga

SEQ ID NO: 154340 - DNA, 601 bp, Human
cccccccccccccaccgcttatccacagtttccctgaggttatgtatgtatataacatattctgatgttatatacagaagccctgtgcctggactatagaagatactcaggggttgttagcttcctttggaaaatgcaaacttttcttcattctctaccagggcagtaagaccaacttgtcatttattggagtttagttttaatttttaaccacctcactctaccctatacacacactccactgattttacaaagaatgtttttaaacacaattcatactgtagcaaattaacccaggtgrtctttgttgaaggttttcaaaaagacataggccttagctttaagattactttcacatgaggtgatatttattttgtcaccttacagttaaataaatgacaaggaacagctgatattgtccaagtatcacagtttgagaaacaaaagtggggagaagttatatggagagaagtaaagagatacacgttataaagaaaaggcagtaatatgtgagtggatacactcacagacctgcagagcacggcatcactcccaagaggtagtgatgtgtgtgaaaatactttagctgtccagaagagga

SEQ ID NO: 154341 - DNA, 601 bp, Human
tacaactttttcaagaatgttaatatgtctgagtagattttgcatagttggaagcctaagcccaaaactgtcatttctttatattttccatgattactcaaattgtattgggtttaaaatgaacattcaatgacttacttgaatgagtggagatcaatgctaaaaataatccttgacattatttatcagaagcaggcagcaagttgggtgtgggtggctcacgcctgtaatcccagcgctttgggaggccaaggtgggcagatgactagaggtcaggagtttgaaaccagactggccaacrtggtgaaaccccatctctactaaaaatacaaaaattagccaggagtgatggtgggtgcctgtaatcccagctactcgggaggctaaggcaggagaatggcttgaacccgagaggcagaggttgcagtaaactgagatcgcaccactgcactccagcctgggtgacaaagtgaaactccctcgagagtccaaacaagaagcagcaatagaattggcagtgggggaggtcaatacatgtctacggggtctctgaaggtgtaagcttatgagattaatgcaaacattttaagttaaaaaattg

SEQ ID NO: 154342 - DNA, 601 bp, Human
ctgagcagtgggaatgggaatggagaagggagaaatcaagagggtctttgggggaaataattcataagacttgttgcccatcctgatgaagctgcagacccactccagaattctggctttggtgatggaatataaagaaagttggttgggggaaattaacaagcactagtgacgcctacttacttgatctggaaaggtgttaagtatgtgacaaaccactgacatttctcctgatgccacctgttctcccaacttcattccactctccactctcatactcctcacaccgacaagtgaccaytccagctcagctgattccttcccaattctcagaatttcatttccaaacctctttcctacccccggcactcctgacacaatgaacacttcaaagtgtctaggtaacaggtaactgtcaacctcctactcaacgtgttttgcacccctagccttcaaatgctgaatctgataagatttcccatccaccatgggtagaaaagaaatagctgcatgacttactctcacttggttcaaaagaaaactaatgcctaagtaacataagcattttcaagagtgtacttttgagctagaatgcccggca

SEQ ID NO: 154343 - DNA, 601 bp, Human
taaagactgaagatcatcttccattcaagagtcagaaatattttaaccaactagagaaataaaacatttctaagataagaatacttgaccttaagctttttttaatggtgaaattttttaatgacaaaatttttttttaatggtgaaatatttttaatggcgaaatatcttttaatggcgaaatattttttaatggtgaaattgttttaatggggaagtatttttcgtagcaaaacacttttaatggcaaaaagtatgatgagacaccaccacaaacatgaagggatggctaaaaaagaaraaaataccaagtctcgacaaagatgtgaaacaatcagaactctcatatgtgccaaggggaatttaaactgaaatgaccaccttggaaaaactgttagtacctactaatgttcaatatatccatatgctatgggtcagcaattccattctgggtctataaccaacagaaatgcatacttaggttcatcacaagacatgtgcaagaaaattcatagcagcactgttcattatggccaaaattggagcctcccaaatgctcatcagcaaaatagataattgtggcatactacataatgaagtg

SEQ ID NO: 154344 - DNA, 601 bp, Human
tgttattttcacggctgcagagtgattctgagttagaagataagcaaagagatgaattggttcttgtcctatgctttgaaggaacacataaatgcagtgacaatatactgacccaaaatgaagatttggatggagaagctctttcacttctaaaaaggagagaggggcattctggtatttaaaagagagattaacatgctcattgaaatgtggacccaaattataaatagctatgaacattttccctatatcataaatcttttgctcaagaagatttacacattcttaacaaaaacaagcaaaaaaaaaattaatcacaagccagtgaagagtgttaagtggaaacaataatcctgtatctgttaaattatatatactatagtttaatatctttattattttaaagctggcgctcaatttattcttagaaatggtatacacagtgttgactttattttttcattgggtgaaggtctccaggtttatgcctttctttatttctattatttttcaaagcaaaatatgcctagaatttaaagcaaagtcaatgtaacaagatagataactgaatgaattatttttccatttcagtcaccttaaa

SEQ ID NO: 154345 - DNA, 601 bp, Human
gctttgggaggtgaaggatcacttgaggccaggagtttgagtccagcctgggcaacataatgagatctgcctctttaagaaaaaaaagaattggttcatggtattaatgatgatgtgttcatattgtcccaaccttaaaaagtattttctactttaacaggactctaagtattcaactcaaaaaagaaactaacagttgggacttgagacattgagtcattcaagtaggtggaatattctggggaaacagagacttggggtataactgaaaatcttccagataactgattatctagccaayggaaagagatgactctaccttgtgttgtgaagttagtaacatttacaaaaaattaaatcatcaaaattaccataacactaccccttgccttaaaatatgttttatatataccctccctgaatactctccttctatcataccaggtaagggcctgaaagtggactatttctgcagataggccttctgtaggtgccaccagctccttaccctcacccaccaaagaactcctgatccccaccatcgatactcctccccctagccttcaggctgcaaaataagctgccagagccagtgtttact

SEQ ID NO: 154346 - DNA, 601 bp, Human
gcaaagttactttgtatcttcttttgatcatcatctttccgatgggtgactcttcttcctaggtaccagtgatttcaagactagtttccctggctctctcactctcaactgtttttctacccaggttttccctaaggaatcaactctggccctgaaccttgacacccttcctaaccttgacgcctactgtgatagacttgttacaacagtcttactagaaaactgactggctagtcagtagttaaaaattggggctggacaccatggctcatgcctgtaaatcccagtgctttgggaggtraaggatcacttgaggccaggagtttgagtccagcctgggcaacataatgagatctgcctctttaagaaaaaaaagaattggttcatggtattaatgatgatgtgttcatattgtcccaaccttaaaaagtattttctactttaacaggactctaagtattcaactcaaaaaagaaactaacagttgggacttgagacattgagtcattcaagtaggtggaatattctggggaaacagagacttggggtataactgaaaatcttccagataactgattatctagccaacggaaagagatga

SEQ ID NO: 154347 - DNA, 601 bp, Human
cctgatttactacgttcacttccccagagatgactacagcatttctgcaacctgtgttaactttcttcggccatttggacaggaaaatggaaagatactaaaaaataccgtaatgaaatactggccagtgtaatttttgaaattttctccaacctgagcatctcaaatacctttatctgaaattctactcttctataatatgcctaggatagatgtaccccatcctactcagcactttaaatagaagtaggttattccatcaaaagctcaaatgtgtccaagatacaaaataaatagtgaycatatgaactctctattctatcataacagttcctttcaaggtttcagacaaacatattatttccttgttttttcttcctacagtcactttaggaagggcctgagcataaagagtttgctagcatgcataccacaactactttattttccatataagcataatcagcaagtataactgtttctcaatttgttaaagcctaccataaaatcagttcaagtaactaaccttgactagtacaccatatgtggattacaccattttttccttctttttattgtagtttctctacgtgattttaaa

SEQ ID NO: 154348 - DNA, 601 bp, Human
gatcgttcctaggaatgggaggggcacagccagcatccccatatgcagaaaagtgataagagatcccctgatttactacgttcacttccccagagatgactacagcatttctgcaacctgtgttaactttcttcggccatttggacaggaaaatggaaagatactaaaaaataccgtaatgaaatactggccagtgtaatttttgaaattttctccaacctgagcatctcaaatacctttatctgaaattctactcttctataatatgcctaggatagatgtaccccatcctactcagcaytttaaatagaagtaggttattccatcaaaagctcaaatgtgtccaagatacaaaataaatagtgaccatatgaactctctattctatcataacagttcctttcaaggtttcagacaaacatattatttccttgttttttcttcctacagtcactttaggaagggcctgagcataaagagtttgctagcatgcataccacaactactttattttccatataagcataatcagcaagtataactgtttctcaatttgttaaagcctaccataaaatcagttcaagtaactaaccttgactag

SEQ ID NO: 154349 - DNA, 601 bp, Human
aaagctgaaactggatcccttccttacaccttatacaaaaatcaattcaagatggattaaagacttaaacgttagacctaaaaccataaaaactctagaagaaaacctaggcattaccattcaggacataggcatgggcaaggacttcatgtataaaacaccaaaagcaatggcaacaaaagccaaaattgacaaatggggtctaattaaactaaagagcttctgcacagcaaaagaaactaccatcagagtgaacaggcaacctacaaaatgggagaaaattttcgcaacctactcttcrgacaaagggctaatatccagaatctaaaaaacacattaataaaagctttgaatccacatagatcactctcaacagaaagatgtctccagatggaagatgcagctggagatcaacagtgaacatcaaaggacatattcagtgacctccaatcttccctctgatcgttcctaggaatgggaggggcacagccagcatccccatatgcagaaaagtgataagagatcccctgatttactacgttcacttccccagagatgactacagcatttctgcaacctgtgttaactttcttcggccatt

SEQ ID NO: 154350 - DNA, 601 bp, Human
aaagttcatatggaaccaaaaaagagcccgcatcgccaagtcaatcctaagccaaaagaacaaagccggaggcatcacactacctgacttcaaactatactacaaggctacagtaaccaaaacagcatggtactggtaccaaaacagagatatagatcaatggaacagaacagagccctcagaaataacaccgcatatctacaactatctgatttttgacaaacctgcagaaaaacaagcaatggggaaaggattccctatttaataaatggtgctgggaaaactggctagccatatgtasaaagctgaaactggatcccttccttacaccttatacaaaaatcaattcaagatggattaaagacttaaacgttagacctaaaaccataaaaactctagaagaaaacctaggcattaccattcaggacataggcatgggcaaggacttcatgtataaaacaccaaaagcaatggcaacaaaagccaaaattgacaaatggggtctaattaaactaaagagcttctgcacagcaaaagaaactaccatcagagtgaacaggcaacctacaaaatgggagaaaattttcgcaacctactcttc

SEQ ID NO: 154351 - DNA, 601 bp, Human
ttgatctagatcattttaccacagtgcttagaccagggtttggcaaagagtaggacctcaataaataacactaatttagaaatgaactcactttttcctgctttaagtaaaaaaaaaaagtactaagaattaagaaataaattatctgtcatattcctagggaattcagacaaaattaaaaaactacgagtttgaggcacctgattccaggcagaaatgaacctaagaaatattttagtctcatattttcacgaggtgaattaatttttcaacttctagcaagctatcaaagtatttatcscaagttttccgggaactttatgagatactactacagttcattttaacaattaggctcctgtcttttactttgtcaagaagccttttaaacttatttagacagtaaaggaaaaagatcaaacataaaaaacacattttttatcttaaaatattttaatgtaaaatttatcatataaaaatgtacaaaatatgcttatgtagcattttaaaaatatatgcagtacttatacatttttataacaccagcttaagaaatagaacattaatattcagtttaaatccccctgcattccctccctaa

SEQ ID NO: 154352 - DNA, 601 bp, Human
tattcaggtctctaccaagtgtcacctccccaaagaagctctccctggccaccagtctggaatatcagctgcctggccagtgataattaattctctttgctgttaatctacttgatttgtcttcacagtacttccactatagacattatgcatttattcattcattgtcagttcctccactagcaggaggacttgatctagatcattttaccacagtgcttagaccagggtttggcaaagagtaggacctcaataaataacactaatttagaaatgaactcactttttcctgctttaagtaaaaaaaaaaagtactaagaattaagaaataaattatctgtcatattcctagggaattcagacaaaattaaaaaactacgagtttgaggcacctgattccaggcagaaatgaacctaagaaatattttagtctcatattttcacgaggtgaattaatttttcaacttctagcaagctatcaaagtatttatcccaagttttccgggaactttatgagatactactacagttcattttaacaattaggctcctgtcttttactttgtcaagaagccttttaaacttatttagacagtaaagg

SEQ ID NO: 154353 - DNA, 601 bp, Human
ccattccctcctaaattaacacaacagcctcctaaaccctctctcgctgcttctgctcttggcttcctagcaaaaaaaaaaaaaaaagaaccaccaccccagcagccacagtgatagttacaaaagacaactcaaattacatcactctcacccttattcaaaactccataggcttcccactgcgttccgtaaaattcaaactttgcatgaatttgactcctgcctctcttcaatctccatccttatcactctctgcctcatgtgctgttccagcctcaccaccctcctgttccccaaacasggcaagcctgtagctgcctcagcaccttgtacttactcttccttctgaacagagcacaaaccctcttatctccacttgcctcgttctcctaccttattcaggtctctaccaagtgtcacctccccaaagaagctctccctggccaccagtctggaatatcagctgcctggccagtgataattaattctctttgctgttaatctacttgatttgtcttcacagtacttccactatagacattatgcatttattcattcattgtcagttcctccactagcaggaggacttgatctagatcat

SEQ ID NO: 154354 - DNA, 601 bp, Human
actggggtaaatatatgcaaatgcaaggcaaagtcaataaataggcttcttttatattctagttacataattttctgatgtgtctacataccagctgttgctgagtgttagttttactgaaatttaaaaatggggaaggagttggttttgtcaaactagctattatactcacttgaaagaattctacatttcgtagtcaccacttcctcactttttggttctttcttgaatctaatgagattttcatcccctctattccaaaaaggaataatccttaaagttgtcaatgacctctgttttygcaaatccaatgattcaattccaggccctgtattaccaacctcttcacactcagttgatcattcccttctttttaaaatttcccttctctttcaaattggccagatgcccctgggtttcttctttacttactaatcactctttcccatttctctttgctgctccttctcttcccaatttctaaatgtcaacgaggtgctctgcactcagcccctagacactcatctagtatacagatttaaatactatatgctgatgcctccaaagtctctatcctggctctagactctcccctgatatg

SEQ ID NO: 154355 - DNA, 601 bp, Human
ttgagtgttttacatacagatctagaaaactggggtaaatatatgcaaatgcaaggcaaagtcaataaataggcttcttttatattctagttacataattttctgatgtgtctacataccagctgttgctgagtgttagttttactgaaatttaaaaatggggaaggagttggttttgtcaaactagctattatactcacttgaaagaattctacatttcgtagtcaccacttcctcactttttggttctttcttgaatctaatgagattttcatcccctctattccaaaaaggaataatycttaaagttgtcaatgacctctgtttttgcaaatccaatgattcaattccaggccctgtattaccaacctcttcacactcagttgatcattcccttctttttaaaatttcccttctctttcaaattggccagatgcccctgggtttcttctttacttactaatcactctttcccatttctctttgctgctccttctcttcccaatttctaaatgtcaacgaggtgctctgcactcagcccctagacactcatctagtatacagatttaaatactatatgctgatgcctccaaagtctcta

SEQ ID NO: 154356 - DNA, 601 bp, Human
gaagaacataaagcaaaactgtcttgccatcatgttcttttattcttgacggtttatttccgggaattaaaacaagcatccattgccacactccatcactgcacaaaatggagccatgtgaatgtagaactccattctcatccctaccgcaccccctagtggaaaaacagactaagtgcgttttacaaaaagctgctatagaaaatagaaaattttggtacatttatttcaactatggtttgaaacaaaacctttcttaaataaaggctactttaaagacattaaccaagttgcctgctaraaaaaagattaatgcacttagggaataactgatgaatgaggatcttactataggaactaagataaattatatgaaagatatttctgagccacatatcaatatacaaagttattttggaacggcttatgtatttcaaaaatcactgtaaataccaacaatgatagttgagtgttttacatacagatctagaaaactggggtaaatatatgcaaatgcaaggcaaagtcaataaataggcttcttttatattctagttacataattttctgatgtgtctacataccagctgttgctgagtgt

SEQ ID NO: 154357 - DNA, 601 bp, Human
tcttaggtttatttataggtacttagtggtttctcttgctactgtgaatgttacatttgctcctatctactcttctgacattactgatctagggaatgctattgatttttatttatgtttattgccttttaattatactaccaattttggagggaagaacataaagcaaaactgtcttgccatcatgttcttttattcttgacggtttatttccgggaattaaaacaagcatccattgccacactccatcactgcacaaaatggagccatgtgaatgtagaactccattctcatccctacygcaccccctagtggaaaaacagactaagtgcgttttacaaaaagctgctatagaaaatagaaaattttggtacatttatttcaactatggtttgaaacaaaacctttcttaaataaaggctactttaaagacattaaccaagttgcctgctagaaaaaagattaatgcacttagggaataactgatgaatgaggatcttactataggaactaagataaattatatgaaagatatttctgagccacatatcaatatacaaagttattttggaacggcttatgtatttcaaaaatcactgta

SEQ ID NO: 154358 - DNA, 601 bp, Human
aataaaattgtatgatgtcacattttctaagcatgtaactggtcttggcaactaaaatacacaaggagaaaaacaactgcatgtgcctatataaaagggcatatagatccaaatatttaacaagcagtgcaacatagatatcgaccagtctaaacagactcccacaagtggacataccagcagccctgcacacacctatatatgtgcaatacacatgggcatgtatgattttgggccattacgaaaatacatttttaaattccaaattcactctgatgtccatttttagagttgctgataygcacgagtgtttttaaaactatcacaatacctgaaaatcacgtttcctgctcggtccgccttccaggctttcaccaaagcaaaatcccctgtaattgcttcctccaaaataaagtgctgaccattgaactccctcacctgcagaagagggagaaggcatcatcaggtatttgcataggtcttgattgtgatagaggcactctgatagaggtagataataaggatacaagcctactgagggaaaatttctcagagggaaaagcatcccagagacttcaaagataagcagtgttaggcaagc

SEQ ID NO: 154359 - DNA, 601 bp, Human
ctgaattgaaccacatcaaagtagttatatgtgcaatgctcttcccttaaagaaatcacaaaatctatcacagtaagatcatgaacttcttctgacacatttactgttttccagggattccacatacataaattcatcttgggatttcattcaaggagatctatttcatttaaggatcaaaagacttttataagctggtcccattgcttgattcccaaagagagcattctagtgagaccctatctaaccagaaagctgaagttacagcaaaattttaactattatatatttagatagaatggatccatttccaaaacaaaaaaaaaagctgtcattgttatccataaaacaaatgaactgtggtactttttcttgaattaatacttaacatcaagttaaataattaacaccaagaattcaaaaataacctcttacctctaccactgtggtttctgcagctttgcacattggcaagttgaaattccttgcacttttcctacaggggtggaggagataagaaagtgggggggaaaagacgaaaaataagcatctctgtcacctttaaggttttatagattagaatttctatgaactaagaatc

SEQ ID NO: 154360 - DNA, 601 bp, Human
acaaaactctaacatttgattgtttcaaaatacactgtactgacttcatgaaacattatcttggccttgtaaaaatgaatcaaaagataccacatacaacacctgccatcatgagaaaaatcaatcaggaacctatgtattttcaattccagatcccaataggggtcctataaagccctcccaaggaaaaactacctcaaactcccacgaaaattgggttccaagttgatcctcaaagcctcaagttaagaaccatttgaagtcttctttgaggttcaatatgttacaaccaaaatggcayggttttggtataagcccctgtttctgccctgggtccttaagcctggaaaggctgcagaattatccaagccccttccaaacactgagatacccaaaggacagtcagtgcctgaatttgctctgaattgaaccacatcaaagtagttatatgtgcaatgctcttcccttaaagaaatcacaaaatctatcacagtaagatcatgaacttcttctgacacatttactgttttccagggattccacatacataaattcatcttgggatttcattcaaggagatctatttcatttaaggatcaaa

SEQ ID NO: 154361 - DNA, 601 bp, Human
cacgtctggctaattttttgtagacacagggtttcaccatgttgcccttgaacatctaggctcaagcgatccacctgcctcagccttccaaagtgctgcgataaattaggcctgagccactgtgccataattttaattttataagtcacatgtggctagtggctaccatactggagagtgtagtgaattaggagtggttgcgcacattactgtattgaaagagaccctaatgtgtgtctcggcctaccaggaaagcattctgtgatccatcagagatgtctgttccgggacacaggagggmagcctttattacatttgcaggcttagttaaaggattttctctccttaggccaaaagagagcctctctttcctaatacctgcaatgattcttcaacacaaggttattttctgctcttgtaagaaatgagatgaactgaaaagaaccagattataacaggaaaaattttaaagagaacttcacccaggataatgcataacgcccctctgtactctggaaagaaatactggtttctgacagttttacagaaatacaggaagtcaacagggtgtaaaactattgattattttaagctatgctgt

SEQ ID NO: 154362 - DNA, 601 bp, Human
tcaggcagtaatgctcactcacccaccactcatctcccactgtgcggcccagttcctaacagaccatgggccagtacaggtccatggcctgagggttggggcccttggtctagaacacatctgaaaacaaaactttgccaaaaaggactaatgtttcccttttgcagagtctagaaataagtaacatcaaggacaatttgattttcttttaaattcacaataaacatactcatttacttcttgatgtaaaacatttgctgtaaattatataatttaaaaattataaacaaaaaagcaagakgtatgttcctttgccaccctgcttctaaatccaaaacaaatttaagatgcctaagggaatcttagtactttaaatatttatagttctatcctctttaaaactcaagtcaaaactcaaatcaccagggagaagaaaggttgagaagatgcagcattgtggagtgggaagatgctggcacagagctttaggagacaagctctaatccagattccacaattcaaaagaaaggagatgagctaagagttctttatttaagaaaaaaaaaaaaagacgccgttgactatgttatatagggtgtag

SEQ ID NO: 154363 - DNA, 601 bp, Human
aagtgatcacctctatggttttacacaactcataagtttatctagaaaagtggtccccagcttttttggctggtactagggatcagttttgtggaagacactttttccacagatgggggttgggcagggacgtggttttgggatgaaactgttccacctcagatcatcaggcgttagttagattctcataaggagcgagcaacctagatccctcacatgcagagttcataacagggttcccactcctatgagaatataatgccagggctgatctaacaggaggcagagctcaggcagtaaygctcactcacccaccactcatctcccactgtgcggcccagttcctaacagaccatgggccagtacaggtccatggcctgagggttggggcccttggtctagaacacatctgaaaacaaaactttgccaaaaaggactaatgtttcccttttgcagagtctagaaataagtaacatcaaggacaatttgattttcttttaaattcacaataaacatactcatttacttcttgatgtaaaacatttgctgtaaattatataatttaaaaattataaacaaaaaagcaagatgtatgttcctt

SEQ ID NO: 154364 - DNA, 601 bp, Human
tcatgataaatgtacttgttttgactgaaagctgaagttaactaaaatagttgaaagggccttgggtaaacctttgctgtctcgtaaactagccatggcacaagcctgacagcacaaagaaatccacagcagtgaggttatttcagtcacaggcagcctcagcagcttcagtggctgagtcagacgaccttttctgacagcacgtgcatgccaggctgcttgcaggagacaaagcatcaacagtctcctgagtgaagcactctcatccctccccataggttttctattacaggctccttcaaaaaaaaacagaaataggccatttccagagaaacttagatggtaggttatgcacacagaagactagcagaggggctcatagggagttgagagcttaacacaataacaggattcctcctgagaaacagccaaattagttccctttggaagactcaagagtccttgctactccttgtcatacacatggaaggcaacacccaagagtcattccctggctggttttgcacttgaacttgtaaagtttatcagggaagacttcaccctcactcaaagagagggaggtccagaaataacactgtct

SEQ ID NO: 154365 - DNA, 601 bp, Human
aaagcaccccaaagaaaaatcaccttcactagaaggaagacaggaaggaaggaaagaagaaagaagaccacaaaacaaccagaaaacaaaaaacaaaatggcacgaataagtccctacttatcaataataacattgactgtaaatggactaaactctccaataagacacagtagctgaatggatgaaaaaagttaagacccagtggtctgttgtctacaagagacatggttcacctataaagctacacagagaccaaaaataaagggatggaaaaatatatcccatgccaatggaaacccmcaaaaaaaaaaaaaaaaacaaaacagaacaggagtagctatacttacatcagacaaaatagatttcaagagaaaaactgtaagaagagacaaagaagcttatcatataatgataaaggggtcaattcagcaagaggatacaatgattataaatatatacacacccaacactggggcagccggatacatagagcaaatattattagagctaaagagagacagattaaaatacaacagctggagacttccacaccccattttcagcactgacagatttctcaggaagaaaagtcagagacat

SEQ ID NO: 154366 - DNA, 601 bp, Human
gttactggctttaaagaagaggtagagaaagagataggagtagaaaagtttattcaaagggataacaaaatgtcccaaacctagagaaagataaacattcaagtacaagaaggttatagaacaccaagcaaatttaacccaaggaagactacctccaaagctaccttttgcgagttaatcaaattcccaaaaaatcaatgataaagaattccaaaagcagtaagagaaaagaaacaacagacaacagagctccaacatgtctggcaacagacttttcagtggaaacattacaagccaggaragagtagcatgacatatttaaaggactgaaggaaagaaacttttgccctagaatagtatatatggcaaaatatctttcaagcatggaggagaaataaagaacttccaagacaaccaaaatcagagggatttcatcaacaccagacctgtcctacaagaagtgatagagggagttctttgatctgaaaaaaaaaaaaaaaagaatgttaatgagcaaacaagaaatcatctgaagatacaaaactcactggtaataataagcacacatagaaacacaggatattattaacattgcaactgt

SEQ ID NO: 154367 - DNA, 601 bp, Human
ctctacctttcctctatccaagctctccacatctaaggcctgggcatgttggatagattcctcttccaacataccgtatctcttaatgctatcctcctctccaccactcaagtccaagccaccattcaagctctcacccagatcacatcagtctcctcattggtctgcccctttatgcctctaaagtctgttctacaaacaatacgcaagctaaaattatgacctttccaaatgcacttaaaatccaagctcctacaaatgcctatatacctacctacattcagatttttataattcctayttatacatatccagaaataaagcctcgatattgtcagagcaaccagaaagtcatagagagactcaggacttaatccaagtcttccaagtgtcctttacatgccattcaactgcccagtcatcgagtccaggaaatttatctatgtcagttttctcatttacaatattgtaataaagctgcttctcctccaacttcacctggtgattagaggatccgatgagatactgtatgtgaaagtgatttgaaaagcccaaagcattatgcaaagtaatatcaaacacaagatactgcggaaatggt

SEQ ID NO: 154368 - DNA, 601 bp, Human
aagaataaaaaagtcacagtggttattcagcacaagcaagttttaagcaggaaataactttagtcttcatcccaaaccaaaatatgtgaatcttttgagccaaagtataaaaagagataaaatgggtcattaactaatgctccatatttcaaatacaaaggcagagagaggtcatcaatttgagggtgtacaactcaagctatgaagtgacagatttataagaaccttgctctcgtgaaggtgtccataatattcccctcaagagtcatcacagtttttgcttgatgtaaggtatcagcaygtttaagttgattttatggacttcaaatattggttagttttctgaaggatttaagctaacaatatttttaaaacaaaatttagttttttgatcatgcactaagattttaggaatcggaggcattatggaatttttattttctcagataaagaactttggaagacagggaaaggttacagaggatgtgccttgccagctgccatttacaatgtagttcaatagtcatcatcactgggtcaatgagaacagtcatctaaggtttattaatcaaagcagcgggagggattaaggtgagcatgt

SEQ ID NO: 154369 - DNA, 601 bp, Human
gcctcctctctcatcacatgatctctttgtgcacacccactcctcctccaatttaggccatgagtggaagcagcatgaggccctcaccagacacagctacccagtcttggactttgtacccactaaaatcatgagctaagtaaacttttctttcttaaagaataaaaaagtcacagtggttattcagcacaagcaagttttaagcaggaaataactttagtcttcatcccaaaccaaaatatgtgaatcttttgagccaaagtataaaaagagataaaatgggtcattaactaatgctccrtatttcaaatacaaaggcagagagaggtcatcaatttgagggtgtacaactcaagctatgaagtgacagatttataagaaccttgctctcgtgaaggtgtccataatattcccctcaagagtcatcacagtttttgcttgatgtaaggtatcagcatgtttaagttgattttatggacttcaaatattggttagttttctgaaggatttaagctaacaatatttttaaaacaaaatttagttttttgatcatgcactaagattttaggaatcggaggcattatggaatttttattttctc

SEQ ID NO: 154370 - DNA, 601 bp, Human
cagtatctgaggccctctttatttatgtccccaaaagaacaacagatgtgactttcattcaaaagaagtcatatggctcttgcctcctctctcatcacatgatctctttgtgcacacccactcctcctccaatttaggccatgagtggaagcagcatgaggccctcaccagacacagctacccagtcttggactttgtacccactaaaatcatgagctaagtaaacttttctttcttaaagaataaaaaagtcacagtggttattcagcacaagcaagttttaagcaggaaataactttartcttcatcccaaaccaaaatatgtgaatcttttgagccaaagtataaaaagagataaaatgggtcattaactaatgctccatatttcaaatacaaaggcagagagaggtcatcaatttgagggtgtacaactcaagctatgaagtgacagatttataagaaccttgctctcgtgaaggtgtccataatattcccctcaagagtcatcacagtttttgcttgatgtaaggtatcagcatgtttaagttgattttatggacttcaaatattggttagttttctgaaggatttaagctaacaa

SEQ ID NO: 154371 - DNA, 601 bp, Human
cctctgtgttcagggagttgtatgcccacaggtgaacagaaagcatcagtatctgaggccctctttatttatgtccccaaaagaacaacagatgtgactttcattcaaaagaagtcatatggctcttgcctcctctctcatcacatgatctctttgtgcacacccactcctcctccaatttaggccatgagtggaagcagcatgaggccctcaccagacacagctacccagtcttggactttgtacccactaaaatcatgagctaagtaaacttttctttcttaaagaataaaaaagtcamagtggttattcagcacaagcaagttttaagcaggaaataactttagtcttcatcccaaaccaaaatatgtgaatcttttgagccaaagtataaaaagagataaaatgggtcattaactaatgctccatatttcaaatacaaaggcagagagaggtcatcaatttgagggtgtacaactcaagctatgaagtgacagatttataagaaccttgctctcgtgaaggtgtccataatattcccctcaagagtcatcacagtttttgcttgatgtaaggtatcagcatgtttaagttgatttta

SEQ ID NO: 154372 - DNA, 601 bp, Human
acattctaacagttaagtaactcttggttcctagtcttaggaactgttaactgttttaaaatattccatccaaaaacaaaaagatattttcataattctataaaaattcaataaggcaaagctatcataaggaagaaaagaaaacacttccttccacataacttacattttggaccttaagtccctctgtgttcagggagttgtatgcccacaggtgaacagaaagcatcagtatctgaggccctctttatttatgtccccaaaagaacaacagatgtgactttcattcaaaagaagtcawatggctcttgcctcctctctcatcacatgatctctttgtgcacacccactcctcctccaatttaggccatgagtggaagcagcatgaggccctcaccagacacagctacccagtcttggactttgtacccactaaaatcatgagctaagtaaacttttctttcttaaagaataaaaaagtcacagtggttattcagcacaagcaagttttaagcaggaaataactttagtcttcatcccaaaccaaaatatgtgaatcttttgagccaaagtataaaaagagataaaatgggtcattaac

SEQ ID NO: 154373 - DNA, 601 bp, Human
gcaacctccaactcccgggttcaagcgattcccctgactcagcctcccaagtagccagaattacaggcgtgtgccaccatgcccggctaatttttgtatttttagtagagacggcgtttcaccatgttcatcaggctgctcttgaactccaatccacctgccttagcctcccaaagtgctgggattacaggtctgagccaccgtgcccagcctaattgctccagctttcttttgattaatgttagaataattttttacattcatctctttacttgtaatttgtgtctgtatattaaagtgkatttcttatagacaacatacagctgagtcttgtttttaatccactgtgagtcttaattgttcggaccagtaatgttcaaattatttagtcggattaatatctaccatatttgctactattctcatcattgtccttgttctttattctttttgctctccactcttttctgcattctgtagttttaattaatctttttcatacaattctttttctgctttttttgttacacttgagtttgcaatatacatttacaattaatccaagtactctttcaaataacactatatcacttcacaggta

SEQ ID NO: 154374 - DNA, 601 bp, Human
cttaacacaaacatgaaataaatcgataagtaggtcaaaagttgttaaaccaaaagagagcaaaattaggaaaaggaatccatgtcattctttgtattaagataatttttttttaggagaacatcccctcagtttgtatcagtgacagtgtaccttatttaataatctttcaggagggagtatcatgaacattctaaaaccattaatatgctagtaatgccctctggctcttccttttttgggggggattgggggggcagggggatggagtttcactcgttacccaggctggagtgcagcrgcaggatctcagctcactgcaacctccgcctcccgggttcaagcgattctcctgcctcagcctcctgagtagctgggattacaggcatgcgccaccacaccaactaatttttgtatttttagtagagacagggtttcgccacatttgccaggctggtctcgaactccttacctcaggtgatctgcctgcctcagcctcccaaagtgctgagataacaggcgtgagccaccttcttttttttttttttttaaacacaatctatgtcctcatttgcaacaaaattgttaattattttgtgag

SEQ ID NO: 154375 - DNA, 601 bp, Human
taccttttctcgcttttattaatttttggttgtgtacctggattttcaaggggcctagtaaaaggccagatatttgcatatgttctaatattaggaggctgccatatgctgcatgctcatactacactaatacatggaaaaacgtgtttataagacaaaaattaacaaaaggggtcaatgaatcatatttatcactttttcccacatttcttacttaaatcatttatataagccatgactttaagatgccttcttttagctttgtccttgaaccagaaagatttgaaaagtgactcgtttaaaaaaaaaaaaagaaaaagaaaaaaagcaactaatttttcaaatgaagcaatcttgcataagccctaattatcacttcagtatttgtagactagatctatatttgaagttggaaaaaataccattttttgacaaggtctctggaaggagtaaggaaaaccactattattcttaatcagagtgactttaaaatcataagttatattcttaacacaaacatgaaataaatcgataagtaggtcaaaagttgttaaaccaaaagagagcaaaattaggaaaaggaatccatgtcattctttgt

SEQ ID NO: 154376 - DNA, 486 bp, Human
aataaaagcattgcatcagaagttcaaaatttttattctgtggaatgaggaacctaattttggaaaagctatcagaaatggtaatagctaactgaacaaaaaaggaaatatggcgtccttcacacttcaaaaaattcacaagagagttcactttagctaatgatgctgggacagtctcttctgatwattgtggcttctcacaagaaaaaaatttaacatattggcaattaccttttctcgcttttattaatttttggttgtgtacctggattttcaaggggcctagtaaaaggccagatatttgcatatgttctaatattaggaggctgccatatgctgcatgctcatactacactaatacatggaaaaacgtgtttataagacaaaaattaacaaaaggggtcaatgaatcatatttatcactttttcccacatttcttacttaaatcatttatataagccatgactttaagatgccttctttta

SEQ ID NO: 154377 - DNA, 601 bp, Human
actcaaactctatacttaatcatatcttctgaatctcattatttatagttgacaatagccatcattcggacaatgactgaaatctaccatgagtaaagctgatcgaggtcccaaatccaaaatatcttcctggcatataaactcattcccaaaactcaacaccatatttgaaaacttaagtatgatgattaaaagaagagtaggaatggttgataaagaacagcaatttattgatgtcaatatttagtaagggacattttagtccatatgattctaatgccatgtatttcactgagccttyctatagttaaaaaaaaagacagtatgatataaagaaagtactggatttgaagtcagaagacatcgatttgtggtttcagccctaacatcatctaatactatgttcttacatgaatcacctaaagtcatttcacctttaaaatgaaaaagttgaactgtaaatgaagcctaatattcttcccagcacttgcatgaccgttaagtctatactagttcctagacattctattacaagaccataaagtttgcacattattgtgtagtatctttctaattattctggatattgaacactctagat

SEQ ID NO: 154378 - DNA, 601 bp, Human
tgtactcaaactctatacttaatcatatcttctgaatctcattatttatagttgacaatagccatcattcggacaatgactgaaatctaccatgagtaaagctgatcgaggtcccaaatccaaaatatcttcctggcatataaactcattcccaaaactcaacaccatatttgaaaacttaagtatgatgattaaaagaagagtaggaatggttgataaagaacagcaatttattgatgtcaatatttagtaagggacattttagtccatatgattctaatgccatgtatttcactgagcyttcctatagttaaaaaaaaagacagtatgatataaagaaagtactggatttgaagtcagaagacatcgatttgtggtttcagccctaacatcatctaatactatgttcttacatgaatcacctaaagtcatttcacctttaaaatgaaaaagttgaactgtaaatgaagcctaatattcttcccagcacttgcatgaccgttaagtctatactagttcctagacattctattacaagaccataaagtttgcacattattgtgtagtatctttctaattattctggatattgaacactcta

SEQ ID NO: 154379 - DNA, 601 bp, Human
gggtcacttggcatgccgctgcaacttctgcctttttttcctactaaataattagaaagaccaaacagcactagagataagacccccttaagatcactatctctccttatgaagtaataaactaatcttccttgagtcatatcactacaacatatgatctggtctcatatgaaaaatgttgtagtactgctggaatttctgttcctctatgagtgaaaacttaacttttcaatgttggaatgctaaccccatttgtttagagtgtctcctccgtggctaccctcagactgtactcaaactmtatacttaatcatatcttctgaatctcattatttatagttgacaatagccatcattcggacaatgactgaaatctaccatgagtaaagctgatcgaggtcccaaatccaaaatatcttcctggcatataaactcattcccaaaactcaacaccatatttgaaaacttaagtatgatgattaaaagaagagtaggaatggttgataaagaacagcaatttattgatgtcaatatttagtaagggacattttagtccatatgattctaatgccatgtatttcactgagccttcctatagtta

SEQ ID NO: 154380 - DNA, 601 bp, Human
aaaggtttagctaaccaccagcacaaagactattaaacatgacagaaatattccaaacaccatgctgctatagacacgtgcacatgtatgtttattgcggctctattcacaatagcaaagacttagaaccaacccaaatgtccaataatgatagactggattaagaaaatgtagcacatatacaccatggaatactatgcagccataaaaaaggatgagttcatgtcctttgtagggacatggatgaaattggaaatcatcattctcaataaactatcgcaagaacaaaaaaccaaacacygcatattctcactcataggtgggaattgaacaatgagaacacatggacacaggaaggggaacatcacactctggggactgttgtggggtgcggggaggggggagggatagcattgggagatatacctaatgctagatgacgagttagtgggtgcagtgcaccagcatgtcacatgtatacatatgtaactaacctgcacattgtgcacatgtaccctaaaacttaaagtataataataaaaataaataaataaataaaaagagtcttcctttctctgtttgctgtccagcctcaaagttg

SEQ ID NO: 154381 - DNA, 601 bp, Human
gtttgtgattgcttggcaaacattatatctcaggtaagagaaaagaggagctgcaaggcaataacgtcctcattttttattttattttagtgacaacctcaatctgttatagacacaaaaatggacccaaccctaaatggtgttagcgaaaaattatacacacctgcaaaactctgtgtacgatacaaagtaagggctgttgagggggaggaagagggagactcacattccaggctttcttcctgactcattttaagtttcaaaaaagtttaggaggaaacttcttttgccaaaaagaaargaaaaaaaacagacaacaagcaataatgtctagaatcatgagaaacattaactccaaaagagagggaaaaaaaaaaaaagcagctgtggaagtctagaaaaataaaagggggagacaataagcaataagagaagttacaagttaaatgcagaggtgctctggatgttaaaatgaagtaaaatgagtaaaatgaagaggaaatgtgagtaagacctcacgttcaatagataaataggataactatagttaaaaatctattgtacctctcaaagttcctagaagagaataatttgaatgtgc

SEQ ID NO: 154382 - DNA, 601 bp, Human
aatataaatggctttcagactgtagaaaatgcatgtgcagcatttgtcaaaataacaacactcaacagtattgaaaacgtctatacaaaaatcaaagctttctcagagttggttagcagagttaatagctaagaaagaaaatatttgaagtacaaaccaaaagaagaaaacatgttttcagacaatctatgaaaagagtttaaaaaaaaaaatgaagaggcagaactatcttaatgctagctattgaagggactgacttcagtgccagtttcgtgtgatcttgagaacaataaggaaggarcaatgggaggattaaaaagtctagtgagatcaggcgatttaaacataagcgttaatggaaaacctgatgagaaaatgatgactaaaatgagctggttaggacaaacataaaaataaaagatcccttactaaagatggcagagttttcctcctgaagttagaaatgggtaataaagaataaaggacaaaggaaaagcctcagggcaaagcaatgggcagatgtaagtatcctcaggcaagatcaagatggaagagaggtagctaagaacaacccggacttctccatggcactatgaatagt

SEQ ID NO: 154383 - DNA, 601 bp, Human
agctaagcactactgctacctcttcaactggttggaactttcagccattagggctcattcacatctttccatattcagttttagccttcaaagaagttcttgactttaaaaatgtgtttatacattaatccagtatcctgaggatagacatgaagatttattattcatgaaaacactaatcacaaaatttattataataatgaattgaaaacaactttaatgtcagcaatagggaaatggtcaaataaacatggtgtagccatgtgattaatcaatattatgcactcataatatttaatgatctcataatttcatgtttcataaaatgcaagattttgtataagtaaataaaaatttatagaaatgcactttgggatagacaattatttatatacctacagaaaataaaaggaaacacacggaaatgctaagaattgttatctctgggtaatagtacaagtggtttttgttttccttttacttttataatcaaaactgaaacccacaatgttattttttcagaagatgtgataaacactaagtttctaaaactagaaaatcataagtggagcatgtgataaatctcacaattagtttgaca

SEQ ID NO: 154384 - DNA, 601 bp, Human
agtgaaagcttaaagtgaacatttttaattttttaaaaagtatacacaacttcacatacaacttaggctgcaaacatatgacggaatatggacatatatctatgtatgtatatgtatacatataggtaatgtctatcacacctcctggacccacaaaagagaagaaattaaagtgtatgcgtctgaacagaaaatacagaccattaggctccagaagttagtctttgcttaaaagagtctcagttacaaatttgtcaaatggtttgtcagtacagcagcttgaactttcacaaattgcagytcaactatgcaatgatagcacattccttaaacacagattttctaaattaatgggaaatttatcatatcaaagacaaaaatctgtaataacatctgcttggtcaattgaagagctttttaaatatagatacaaatgctatttgtaacagttgtaaattattcttgttagcttcctaggatcgtgatacaactgcaattgctgaaataatttacttaaagacagataattaattccaatatggaaacttcaaaactgaaatattaattaataactagaaatactcaatttaattagaatcaa

SEQ ID NO: 154385 - DNA, 601 bp, Human
ccctctttccggattgataaacgctttaaattaaacagaaataaattattcgtggttgaggtatgctttgtattttatcactgctgaaataaattttactggaaaaaaagatgagctctctcccattgttatgagacaaatctgcaatataccagatatttaaaaaatactatgggtgatatttgatggtagaaataattctttaggaactaaatgaaagtggtcagatttgtttaaagaggaagatacgctgttcagtctgtttgaagcaaataatctgttactatcacactgtctgctmcttctgttattcttccaactaaattctcctctggtgctcagggattggccagaagaatgaaagaggaacagactttgggaatgtgtttttcagggctgtcagaatgtgtttaccaggtgttgctgctgccaattgcctgtttccacctgcaaagtccagactatttttaccacaaatgcaccacaggaatcatagaaatacccagaaaccagccaggaaactatttcctctattaagtctctttgacacaaactctggctcgtgtttgcaaaagtctcatcctttcttcctgggcccctg

SEQ ID NO: 154386 - DNA, 601 bp, Human
aatgagtatgcaaatgtcaggatagacagaaagtaaatagcactggttatcactaggaattctgagatttgaaaacactcatcttgggtaatctcttttcccaataatctcccattaaatgcaagttgtactgaaatctaatgggtattagaaaatagctaagcaaattattgattgccattttgtttcaagaaggcaaagagatatctgtcatgtatcttgacacctttggattatatgccacattttgtaaaaaaaaaaaaaaaattgattaattaccttaaaagttaccatagactasagatgactcactatgcaagaggtctaatagcctgatcaatatgggaaaagcaaaggctatgtctttgcccgggctcagaaggataaaggataccatacatgccatcctcaaactcaagagcggccctcttgatgattcgttcccttacgtcatctccaggtttagcagatttggcttccccatctccctctttccggattgataaacgctttaaattaaacagaaataaattattcgtggttgaggtatgctttgtattttatcactgctgaaataaattttactggaaaaaaagatgag

SEQ ID NO: 154387 - DNA, 601 bp, Human
atatattctccaatcacccatggcgcattattttgtaatttttcaaaaaaaaagtctctaattagtcagctttttcagtaacattaatatcaaagtagtggcctcagaagctagccatttgtcacattttaacaaaaatgtaagcacattttcattaatgtgctctgcaaatttgggtttatgtattataactgatttattaaacacagcttgacttttaaagaatgattttcactattcaaaactcctgccaaaagtaaagatcgtttttcatcgtctttattgataaatggagttaccrtttttaaattttaaaaaagttttctgacaataccaaaatttctgcctaaaagtatatcagatcctttgggtctctatagtaacattcattggtaactgaattttctatgtgacataaaaagaaaagtggggaggaaattaaatttcagcaaatacaattgagctcatcgataaaggagctgttgttaaggcatcaaagagttaaatgaggttgttgaattgtcttccttaaatgatcaaaacaggagtgatgatgattactactcaatggtgtgggttcaatcctgcctatcaacatagg

SEQ ID NO: 154388 - DNA, 601 bp, Human
tgaaatatctcattcttcattaagactggattttagaaaacaaattttcatcttaccaaacccagaactccattttcactttgaagatgaacagttatatttgggctgataaaattgctggccaggagagggattcctatgcccaaattagctggaaaaaaaagatgttaaggtccagcatataaaaggtagagaagttataccataaatcttctacatatacagatctgaacagaagctttatttaaaggtggcttactctgaatgtaataaatgaatatattctccaatcacccatggygcattattttgtaatttttcaaaaaaaaagtctctaattagtcagctttttcagtaacattaatatcaaagtagtggcctcagaagctagccatttgtcacattttaacaaaaatgtaagcacattttcattaatgtgctctgcaaatttgggtttatgtattataactgatttattaaacacagcttgacttttaaagaatgattttcactattcaaaactcctgccaaaagtaaagatcgtttttcatcgtctttattgataaatggagttaccgtttttaaattttaaaaaagtttt

SEQ ID NO: 154389 - DNA, 601 bp, Human
tcaaacaatgtccctgtcctaaagtagaaaccttactcttcagtttctcactctgaggcttacttaattttatttaacatagaactattgacaaccttcattatcttgtccaacaacagaaggatgagaaatagtttacacaggaaatcatgaggtctctctgaatcaggttccacatgggagacgcagtcagaaagccagagtcaggaacgtaccatctactacataaaatacaatactacattgcttacattttaagggaaaaattaaatattttatcatgataaaaagaaaaataagsttgggcactttatgcaacaactcagatttcactatgtgggacggatccactaaaatctcaggtttcagcattatacaatttatccatgtaaccaaaaatcacttgcaccctaaaagctattgaaataaaaaaatttaataaaaaatttcacaacatgaaatatctcattcttcattaagactggattttagaaaacaaattttcatcttaccaaacccagaactccattttcactttgaagatgaacagttatatttgggctgataaaattgctggccaggagagggattcctatgccca

SEQ ID NO: 154390 - DNA, 601 bp, Human
ttaaaatgtcatacaggaagtaaaaaaatatgattttattatactaatgaaaaaatatggcctaactaagaaaactgagctcatctggatgcttaatcttaaggaagaaaaaaatttaaccttttggacagtagagcttcaaaaggagaatgagatgagaacttctacagctttttgaggcaatcaactcaaacaatgtccctgtcctaaagtagaaaccttactcttcagtttctcactctgaggcttacttaattttatttaacatagaactattgacaaccttcattatcttgtccarcaacagaaggatgagaaatagtttacacaggaaatcatgaggtctctctgaatcaggttccacatgggagacgcagtcagaaagccagagtcaggaacgtaccatctactacataaaatacaatactacattgcttacattttaagggaaaaattaaatattttatcatgataaaaagaaaaataagcttgggcactttatgcaacaactcagatttcactatgtgggacggatccactaaaatctcaggtttcagcattatacaatttatccatgtaaccaaaaatcacttgcacccta

SEQ ID NO: 154391 - DNA, 601 bp, Human
aaaataattcggttgtgtccatggctctgtttcttatgttagtcttttctatactaaagttgtgattgggcaaatgaaaaatattttctaaaaattaccagtttgaaagaaatgctatactattagaaatacaagtccataaaacaaaaagtaattatttagtccctactatgaaaatgtattagaaatataggtcggtaaaactaatgtaggccagggcagtggctcatgcctgtaatctcagcattttgggaggctgaagcaggaggatcacttgaggccagttcaaaaccaggctggycaacatagtgacaccccattctcttaaaaatataaaaatcaaagaggaaaaatttagtacctactatgcagccaatgttattcaaaaacttttctgtgaggattaatgaatacaaactacatcacattatttggctagaaggacctggagaggcaaagttttagctttctgatttgtaaaatgtaggcctgaatttgggtttctaatcttactcctcactacatctaagttttgatatacttatgtccttatgttccttttgcacagctactctcagtaaagtttttaaatttttccata

SEQ ID NO: 154392 - DNA, 601 bp, Human
catggttattctttctaaagcaactttaatcaaaagttaagtcatttaaaatactgtatattaaaataagaaaacattaagaaatgaagaatgcaaaatgcacaatacagaagcaaaaatatgagacttagaaatttcacaactgcattgggttactctaggttagagcccagatcttgatgggacctctggaacattcctagcactgctgtctgcacctctgtgcaagtcaggtcatcagcagatataactcagtgtatagagaaaaaggccaggggtcacaagcaggagactgggtatraactcagtccctagcaatgttatcttgaacccatcacttcaattttctggacctcagtttcccaatttgtataacaaggtttcatttgaggttccaatggtataatacatgtgaaaaagtatgctctaagccatgtaaaactatacaactggtagttcatttttacataaccttatgagacttttttaaaagagatccttggaaatagttatattattattttgaatttttatcataccaattatatccagaaacataactctttgtattcaaagagatttccataaaatgctttcaaac

SEQ ID NO: 154393 - DNA, 601 bp, Human
tacctcagaccggttttatggaagacaatttttccacagactgggggatggggatggtttcaggataaaactgttgttccacatcagcttatcaagcattaggttatcataaggaacgggcaacctagatccctcatatgcacagtttacaatgggttcagtcgggcttctatcagaatctaatgctgctgatgatttgagagaaggccaagcttagatggtaatgctcgtttgctcgcctgctgctcacctcctgctgtgcagcctggttcctaacaggccatggaccggtactggtccrcagcccaggggttagggacccctgttctacaggaaatgcacccctctattgtccatacctctccagcctctcgccatccccattcccttcacaatcctctgctaaatactacttaggaatgaggaggaaggaagttctggggtaacacctgtcagaatctaatgctactgtaagtcactgagacagagagactgtggaatcaacatgaacataagaaggaatgcaattttgaagggaatgacacaggagatgcaccgcagtttctttttttaatcaacaaataacttcagtgataagaat

SEQ ID NO: 154394 - DNA, 601 bp, Human
taagaggtttcttccttgatttaggtcactattaaatgacaactgtgcatttcatattaaatgacaactgtgcatttcacaaggatattaaactctcacaggttttgaattccatagcagaggacaatgattatttatggggtcacatgaccaatcaagatgatttcaatcactgattaatagaattaacaattagcaaagttaattaacaacgctaacaaacttgttaattgttcttcctagtttaaaattttagttatggtaaatatttgtatttcttattttcagagtataattagcyctttttctgttttttaagtcttctctaacttggtttcttctaagcaagaggtttcggctctgaccttgcctacttttagtcccaaatgcacagtaaattggcaaagctgaatacttctcagtgcttacttaattaaaatttgattctagtaagaaatatatattaaaatatttcatttttaaagaatcgtgatctcatggccctttttcttagtatttaaaatataattattctgatccaaacataattcagaataaaaaatgtctacttacaggtatcatccagttagccaggtcacca

SEQ ID NO: 154395 - DNA, 601 bp, Human
acccaggaccactgagcaaattgatttcaaaaatcattagtctagagaaatagatgtatttaaaaccctattgcttttgttcataggacccaatgcttttctcttctttgccaggtatccgcaacttcttttttattttatttatttatttttttttttatgagacggagtctcgctctttcgcccacaggctggagtgcagtggcgcgatctctgctcactgcaagctccgcctcccgggtgcacgccattctcctgcctcagcctctcgagtagctgggactcaagcgcatgccaccaygcccggctaattttttgtattttttagcagagacgaggtttcaccatgttagccaggatggtctcaatctcctgacctcgtgatccacccgcctcggcctcccaaagtgctgggattacaggcgtgagccactgcgtccggcccgcaacttcttataagaacaataacctatttaccaggtactaagtgtcaagctctgtgctatgtactttgtatgcattgtcacatgtattccttcatatagtcctataaagtaggtactgttatatgattcccatttttacagatgaggaaaaatag

SEQ ID NO: 154396 - DNA, 601 bp, Human
cctacaaataactacatagtgtacactaccactatgagagcttccagccttactacatgctaaatcataatataaacaaatcttatactgatatgaagatgcccatgttccccgaagggaagaagatatttaacacatttctgcttcatacccaggaccactgagcaaattgatttcaaaaatcattagtctagagaaatagatgtatttaaaaccctattgcttttgttcataggacccaatgcttttctcttctttgccaggtatccgcaacttcttttttattttatttatttatttwtttttttatgagacggagtctcgctctttcgcccacaggctggagtgcagtggcgcgatctctgctcactgcaagctccgcctcccgggtgcacgccattctcctgcctcagcctctcgagtagctgggactcaagcgcatgccaccacgcccggctaattttttgtattttttagcagagacgaggtttcaccatgttagccaggatggtctcaatctcctgacctcgtgatccacccgcctcggcctcccaaagtgctgggattacaggcgtgagccactgcgtccggcccgcaactt

SEQ ID NO: 154397 - DNA, 601 bp, Human
ccattcctttgggaactcgtgggctccaagttatattgagaaaagtataaagtaataaacatttgtattttaatcattcacaggaatcttaacaggatatgtaaaaatatggtacgcattggaaaagctttcctacaaataactacatagtgtacactaccactatgagagcttccagccttactacatgctaaatcataatataaacaaatcttatactgatatgaagatgcccatgttccccgaagggaagaagatatttaacacatttctgcttcatacccaggaccactgagcaaaytgatttcaaaaatcattagtctagagaaatagatgtatttaaaaccctattgcttttgttcataggacccaatgcttttctcttctttgccaggtatccgcaacttcttttttattttatttatttatttttttttttatgagacggagtctcgctctttcgcccacaggctggagtgcagtggcgcgatctctgctcactgcaagctccgcctcccgggtgcacgccattctcctgcctcagcctctcgagtagctgggactcaagcgcatgccaccacgcccggctaattttttgtat

SEQ ID NO: 154398 - DNA, 601 bp, Human
gaacacttcttatgcttaatttttctcaactagacttccatgatgttcctacagaactccagagttgttcatcccactaggtccattcctttgggaactcgtgggctccaagttatattgagaaaagtataaagtaataaacatttgtattttaatcattcacaggaatcttaacaggatatgtaaaaatatggtacgcattggaaaagctttcctacaaataactacatagtgtacactaccactatgagagcttccagccttactacatgctaaatcataatataaacaaatcttataytgatatgaagatgcccatgttccccgaagggaagaagatatttaacacatttctgcttcatacccaggaccactgagcaaattgatttcaaaaatcattagtctagagaaatagatgtatttaaaaccctattgcttttgttcataggacccaatgcttttctcttctttgccaggtatccgcaacttcttttttattttatttatttatttttttttttatgagacggagtctcgctctttcgcccacaggctggagtgcagtggcgcgatctctgctcactgcaagctccgcctcccg

SEQ ID NO: 154399 - DNA, 601 bp, Human
ccacattttctttattcagtctataattggtgggtatttaggttgattccatgtctttactattgtgaacagtgcagtaatgaacataacacacacgtttctttataacagaatgatttatgttcccatgggtatatacccagcaatgggattgctgagtcaaatggtatttctgcctctaggtctttgaggaattgccacactgtcttccaaaatggttgaattaatttacactcccaccaacagtgtaaaagtgttcctttttctccacaatcttgccagcatctttttttttttttttaatttttagtaatagtcattgtgactggagtgagatggtatctcattctggttttgatttgcatttctctaatgatcagtgatgttgagcttttttttttttttaaatggagtcttgctctgctgcccaggctggagtgcagtggtgtgacctcagctcagtgcaacctccacctcctgggttcaagtgattctcctgcctcagccttccaagaagctgagattacaggtgcatgccaccatgcctagcaaatttttgtatttttgtaaagatcgggtttcactgtgttggccaggctgg

SEQ ID NO: 154400 - DNA, 601 bp, Human
aaaaagaaatcaaaactgaaattacaagctacccagaaattaatgaaaataagaactttctcaaagattatgacatgcaattaaaattatattcagaaaaacacagagccttaaatgattttataataaggactgcaaataaagtaaacatttgaatttacaaatgtagaactagtgtaacattaaaaagtgagtaaaagtaaagaaaattagtaagtctgaacatctacagcattaggataaagagaagatataataacagtctgaggaaattaaaggtatacaagaatatgacatgttytgggtgaatgaatttgaaaatccaaaagaaatggatgctttttggaaaatgcaaattaacaaaattgccacaagaagtgagaaaatttgagatgaaaaggcacgagaataacttaaaaattgttaaaaattgactatttgtattaaaaaactgattcaacatcaatttaaataatgacattgataaattcagggtgaagaactgtgattaaacagatggaaacatactgactacattcaactgccattcagtttaaaaactataagcaaaggagtaaaggcaaactgttagaacagtata

SEQ ID NO: 154401 - DNA, 601 bp, Human
ttctatgacaaatgatgtaccatttctattttttaatattcttatttttcttgttatgatctactttgttcatactgaacatattttaatcaactcaattatataaagatagtcctcatcacctaaaatgtgcttgtagaatgtgtaacaagctctcctttacaaaaaaggggccgggtgcggtggcttatgcctgtaatcccagcactttgggagggtgaggtgggtggatcatgaggtcaggagttcgagaccagcctgaccaacatggtcaaaccccgtccctactaaaaatacaaawattagccgggcatggtggcatatgcctgtaatgccagctacttaggaggctgaggcagaagaattgcttgaacccgagaggtggaggttgcagtgagccgagatcgtgccactgcactccagcctgggcgacaaagtgagactctgtcttaaaaaaaaccgttcaatgaagaaaagctaaatacatcacctgaagtcacagaacaagtcagaaaaaaaactggctgaagtcttttccccagcctccagaaagaggtaatcgaatccccataaaagatgcttcctattttaaaatgtccat

SEQ ID NO: 154402 - DNA, 601 bp, Human
gttctatgacaaatgatgtaccatttctattttttaatattcttatttttcttgttatgatctactttgttcatactgaacatattttaatcaactcaattatataaagatagtcctcatcacctaaaatgtgcttgtagaatgtgtaacaagctctcctttacaaaaaaggggccgggtgcggtggcttatgcctgtaatcccagcactttgggagggtgaggtgggtggatcatgaggtcaggagttcgagaccagcctgaccaacatggtcaaaccccgtccctactaaaaatacaawaattagccgggcatggtggcatatgcctgtaatgccagctacttaggaggctgaggcagaagaattgcttgaacccgagaggtggaggttgcagtgagccgagatcgtgccactgcactccagcctgggcgacaaagtgagactctgtcttaaaaaaaaccgttcaatgaagaaaagctaaatacatcacctgaagtcacagaacaagtcagaaaaaaaactggctgaagtcttttccccagcctccagaaagaggtaatcgaatccccataaaagatgcttcctattttaaaatgtcca

SEQ ID NO: 154403 - DNA, 601 bp, Human
cagttatacaacctttctaaagatactgattcaagtatcctcaattcacaagtatttactcagaatctattataaaccaggcaccaagataggaattagaaataaaagatgaatatgatgatccacttttttctagaaaatagatttaagctgaaatcaataatttcacctattttgatcctatttcctaatactagaattttaaagaaagtaagagaaaaactattataaattcagtaacattaaaaagtcaacacatcaaagtatcaatattacattgtactccaaaaaaaaaaaaaaacaacaacaacaacaggaattcaagttgtaaacatgatctttggtgatattttaaggattttacaaaaaggaaaaatgaatgcatttgaatggttctgtgaaatgctgtttaaaataaagtacaaaacacactgaaaatcattcttgccgttacctttatcattagtacataaacagtaatggctcatttccagatgttacctctaaatattctggtcttaagtgagaaacaatttataatatatagaaacaattttaaaagcattttaaagtaatgctatatgccatagtagaaagtgtg

SEQ ID NO: 154404 - DNA, 601 bp, Human
ccccaaaattcaacatcctaattcaacatacagaacaagaagctgataaaatggggagattaaggagctaaaaatatatctttaaataagtcacagagggaaagtgatacttggggaaaataggcctataatgaagaagagcttctgggaatgattgaagcattgggccagcatgacacaaagtatggctttctttaaaatctcatcagcaaacatacatttcttaaaggatgcaactctagttctgaaatgcgttctggctagcataatggagagatgattgctggatgctcatttcatrgccaactcatctttttgctgttaaggattgaccctgatagcaagtatggaaagattctgcaataaaatgagctagcaatgccgcatgctccatcacaacagttatacaacctttctaaagatactgattcaagtatcctcaattcacaagtatttactcagaatctattataaaccaggcaccaagataggaattagaaataaaagatgaatatgatgatccacttttttctagaaaatagatttaagctgaaatcaataatttcacctattttgatcctatttcctaatactagaattt

SEQ ID NO: 154405 - DNA, 601 bp, Human
tatagaggccctgcagggtacaaaccagtgtgctggcaagaatataacacactatgaaacatggtagaccaagcatgtctgtttttgttaaaaacactcttgactcaatataagtgaatagccttcactcaaagagattcagctggcttgatgtctcatttccaaagcacatgttacaacctttaaagcactattttgattcttaaatttaatgcttgtttccaagagtgaaaaatgcacaagattagatgcagaacacctgagatctagcctgttaactatgagtcaatggcaaaacacyaaatctctctgaatttgtgttcattatctgtacaccaggaataagaatatctgtcctaccatagagctgtggtgagcactgtatgagatgatgtatgcaaacgtgtaataaatagagtttataaatgtattcacttatcttcaatcaattcaacttactgaatgtctagtataagtgttgctgtatactagggtgctagagtcagatcaaaacaaggtccttctcctggaaaagcttgttgcctatggaaggaaaagtatccatgaatactaaaagactcagactacacttccttcctct

SEQ ID NO: 154406 - DNA, 601 bp, Human
ttagatgaatctgatttatacattttaaattactgtcaattagtttagaaatatgtatagaggccctgcagggtacaaaccagtgtgctggcaagaatataacacactatgaaacatggtagaccaagcatgtctgtttttgttaaaaacactcttgactcaatataagtgaatagccttcactcaaagagattcagctggcttgatgtctcatttccaaagcacatgttacaacctttaaagcactattttgattcttaaatttaatgcttgtttccaagagtgaaaaatgcacaagatyagatgcagaacacctgagatctagcctgttaactatgagtcaatggcaaaacaccaaatctctctgaatttgtgttcattatctgtacaccaggaataagaatatctgtcctaccatagagctgtggtgagcactgtatgagatgatgtatgcaaacgtgtaataaatagagtttataaatgtattcacttatcttcaatcaattcaacttactgaatgtctagtataagtgttgctgtatactagggtgctagagtcagatcaaaacaaggtccttctcctggaaaagcttgttgccta

SEQ ID NO: 154407 - DNA, 601 bp, Human
acaacaaaaagaaagtctgaaagagttttttccaaatagacattattttccagaaaagatttggatttgatttgcatgcttggcatcctcttgcctctgaaatgaagtattttggatgctttgcaaggcattctcagaagtcacctgtgctggtaccatttctattattccatatttatgcaccactgctcacctcccactgtttactcaatttatgataacacatatttatagctgttttcacaacaaaatcattttgtggcatacatttctctgtaaccaaactttcccaggggaagcrggtgggatgtgaatcttctagttccgtgctttaacataatgctgcatcactaaacaaaaagagggcaaatgaactgtcatttccactcagattagcaggtctcaaagtgagaagaggtagattttaaaactaagaatgataaagaataaaggaggatgaagagaaggcaaagaagatgaagaaagcattcaatatcaacttttaaaatcagtagaagccaatgggttcaggttaggaaggcaattaagctcagttcgtccaaagacactgagtcaggaacaaggaagaaacttacactga

SEQ ID NO: 154408 - DNA, 601 bp, Human
ggagccactgagtgaaaaatagtacttggtaccaaagattcagatggcaccttagaaggctgcagagcagagggcattataaagagttctggagggaacccataaaggaaggaatggggaatctatctatggatacaagtggtggagggagccactgagtgaaaaatagtagttggtaccaaagattcagatggcaccttagaaggctgcagagcagagggcattataaagagttctggagggaacccataaaggaaggaatggggaatctatctatggatacaagtggtggaggcagctytgcaacccgcagcacatggtttacaggtttgtacccaaggctgctgctgcagtcaaggcctttatcagacagagggggcatagaaaatttaatgcaattggctttaactttaaagacatacctcagaaattacatacatcataaatactcaaatcccactgacccaaacttggtagcatggatgtatctatgcacaggaaggctaggaaatgtagccagtcactgggtttatctgtgtgcccagataaaacagggaggagtctaatgcaaaaaggaagaaatggagataggtattagaag

SEQ ID NO: 154409 - DNA, 601 bp, Human
tttttaacactaataagcttaaggtaatccaaattaaaaaacacaaggtttattctttcattcaccaggtttattctcaacttcataacaattattctttttatcccttcagaatccagacctcctattgtaatacaaaaatctaaacctgttttagtaatagagttctcattttgtctccaaaattaagaaaccaagctttgtttgttgccattaaatgacaacagtaactgaattcctttgtttttgtggtctgaaagttatacttaggaacacgtttcccgtacatgatattgagaasaaaacagattcttcatgttgttagtggtaatggtgcttgccagcagaaaagcttaacaaaaggaaaaggaagcccagaggcagaatgcatggactctgggcttggttttactttttattttattgggttacttaacctctatgaaattctgcctctagaaagaaaatatcaagaaccatctcatgagagggttataatgataaaatggagacagaagcatgtaacaacttggaaaagttagaagtgctttctatatgttcaaggtggattacttgaaaaattaattcaacaagtatgtat

SEQ ID NO: 154410 - DNA, 601 bp, Human
ccacctccattagatgctgagctcactaagctaagactatttttcttcatatgtacagccatgagtagaacattaggcaaactacagtgatcaataaaggctgcatttctgattcaaggaactccagaggggagctataaaatgccatgtgactaatgtctatggaccactaggggctgcctttctagttctaagataggtactcgtacattcctagtatctctgagctcactagaagcagcacagctagcagaagcacatgacggggcttataagactttgggaagacagataaaggtgygataaaaggaagcagcaaagacactttaggactgtagcccaaaacatacaaatgtgaaagttaagagagaaacagtgaattatagttattttacctcttccacctgctcccttctaaagcttaaaggcacttgccataatttgctgaaaagaaggactacaagggcttcttttaatttaatattcttggcaagagaatattaaatactttgtctggtagaacaaggaagccaatggcaggtctatctttgggcttgccaaaatatcatggatgaagcctgattatcaacacccttgctct

SEQ ID NO: 154411 - DNA, 601 bp, Human
agagaaggcaagttctgggatttgcctgctcctaaaaagaccaagcctttcagcttttgttcatgctgcctgttagctggaacacataccaccacatacctcatcaccccagattcaaacggcaacacccttcctattcaggagttggctcagacaccatcttccctaggaaaaccttcatccagcatcctcatctggtgctgcagtcatgttcccatgggtgtccccagtgtgtggccctcctaggtgctcctgtgcttcctcctcccttcacatgttgacctcttgccaccacctccaytagatgctgagctcactaagctaagactatttttcttcatatgtacagccatgagtagaacattaggcaaactacagtgatcaataaaggctgcatttctgattcaaggaactccagaggggagctataaaatgccatgtgactaatgtctatggaccactaggggctgcctttctagttctaagataggtactcgtacattcctagtatctctgagctcactagaagcagcacagctagcagaagcacatgacggggcttataagactttgggaagacagataaaggtgtgataaaagg

SEQ ID NO: 154412 - DNA, 601 bp, Human
tctttaattctttagatgtctgaataaaatcctgggcctaagttctgcagtattaaacaactctagttaaatagtaataaatccctttgctatcataacaataagtttcatgttattgcaatgaacttaatcccaaatccaaataagctctttatcacaacagaatgatttcttgcatttcatgtcaatacattcacctgaaatctttaagactgtgctttatacaaaacctcatttcatgctcatcttttctgttaagtgcttgttaaatgtggctgcaatacacacacacacacacacctagacacacacacacacatagacacacacacacacacacacacacagacacacacgtgtgcacgtattttttctctcagtactttctttggcaaagccctaatgatcaactacagagaaggcaagttctgggatttgcctgctcctaaaaagaccaagcctttcagcttttgttcatgctgcctgttagctggaacacataccaccacatacctcatcaccccagattcaaacggcaacacccttcctattcaggagttggctcagacaccatcttccctaggaaaaccttcatccagca

SEQ ID NO: 154413 - DNA, 601 bp, Human
gtcaactgtaactatgatattttggtgaggataaatgccaactccctaatcagcaattagttgtggaacagtgttgatgccagaaaataaatgagcattgaccatggatggcatttgttactactgcaaccagttttttaaaaactacctcccttttgttaagtctaacacttttggtcaaaggtcaattagtgattaataatgatttgaacaaagaaaggaatgaagaaagagggagagagaaagggaatatttggaaggtgaaagcacatgaatgacaggaaaaaagtttataaatgayattgggtaaagaattacaggaaacagaagaaggtgctctgaagtgtctaggagtaattataagaggatagctaccctggtcctgaaagacatgcaagtaactgtttaaaatattctccttaagtcctgtaaaacatatagtctcaaaaagagagcatgggaatctccctttgctatgcaaatcaaatgaagatgcttatatttagggcaagcaccagaaagccaatcttacctgaaacattccatcattctggtctgtaacatcaggtgttggtagtgccaattggtatggcttgacctc

SEQ ID NO: 154414 - DNA, 601 bp, Human
gtcaactccaaaaatgatcacaaattaatggttcatgtcctgcaaacacccattaatcaagcctataatataagacaagtgtctggatttgttcacagaaatacttactgcaaaatcacacccagtactcttctgtacgtcatccactgtcaggccttcccagagctcaatcagagtcaaccctttcttcttgtccacatcaaacacagcctgtcagagtgggaagaaaaaggacaatgacaatttccatcaaaataattattatatggcacaaaacagaaataacctcgcaagttcgacraggtcgggtgtggtggctcaggcctataatcccagcattttggtaggcttaggtgggtggatcacaaggtcaggagatcgagaccatcctggctaacacggtgaaaccccgtctctactaaaaatacaaaaaaaaaaaaattagctgggcatggtggcaggcacctgtagtcccagctacttgggaggctgaggcaggagaatggcgtgaacccgagaggcggagcttgcagtgagccgagatcacgccactgcactccagcctggacgacagagccagactctgtctcaaaaaaaaaaa

SEQ ID NO: 154415 - DNA, 601 bp, Human
cagcaatgaaggctacccttgtgggaggcctgggtttctctggtgctgcctacactggggagccaaagcctctgtatctgtggggttcacaactgaaaagcctgctgtggctgtacacctaggccacatccctcactctagcctgtataatagtaatacttttacctctacctgttcagctcctttctctcaagggattcagcactcaatccccaagaaacagcaaagtccctatcgtcatagcatctacattttaagggagagtaatcatatggttggcttctctagctgtaaacagctmctgaccagaatcttattttgggtgtgtgaaccttcaggttccagaaatataatcaatatttgcatttctacaacaaaatttccacagcctctaccaagttccagacatatatgaccttcaagatactgccctccgatggaaaactccaactttcagttgatacaaaatcatgaacaaaactgtgacagtcattacaggttttttaaagttatgtttcatgtgattaaaaatcatattttttccacttttttattatggctaataacactatgatatatatgaaaaagtcttagtaattct

SEQ ID NO: 154416 - DNA, 601 bp, Human
aatgtctactaaaagaataaataagaataaacaataataataaagttcagcatgatttggtatatagcttatggtaaatgagaacgcattatgacttatttctaagagtagacatacagacaaaataaacagaataagtagacaaaaagtaacatcacacatacgcacagattttcaactctactaataataacatttagtatttagataagtatatctcacagttcattttctttcttttttttaaacaacagagcatctgtggaaataatttagtgaaactttttttttttttttttttgagacggagttttgctcttgttgcccaggctggagtgcaatggcgcgatcttggctcaccgcaacctccgcctcctgggttcaagcgattctcctgccttagcctcccaagtagctgggattacaggcatgtgccaccatgaccagctaatttttgtatatttagtagagacggggtttctccatgttggtaaggctggtcttgaactcccgacctcaggtgatccacctgcctcagcctcccaaagtgctgggattacaggcgtaagccaccgtgcctggcccaatttagtgaaacttt

SEQ ID NO: 154417 - DNA, 601 bp, Human
ttgttaacatgaaaagtctttcatcactcaaaaagtggtgggtgaaagttggaggtatagataatatttgtacctctttttggtgctttttccttctcccagagggaaacaatacggttcaaggactggttatgtttccataaaactaagcatctttactaaagtacactacggcttatctcagagctcaatgtcaccagccgaactttatattagcattacatattttctgaatggcaaatttggggttaatccaaaacaccaacagtatccgtaattgcacacacacacacacacacaaacgcagacaaacgtgcactgaacttgctgcccggacgttcctccattgccccaggtgggggagtgtccagggctgaggctgggcgcttcccgtctcccggcgccgaagactggggtgggggcgatccaggaacgcacgcgaggctgcgcagtctccctccactgggttatctgaaccggcaaaccccgccggggagggctggggacaccgccgctccctttcaattctgcaccctgccacttccctaaactccccgcacaggccggcccgaagaagcgggaggagggatgccggcggggg

SEQ ID NO: 154418 - DNA, 601 bp, Human
tatgagacctcaataattaatgtcgttactatatgcaagaaactagtttctgaaaacaatgaaccaaaacatgttgcctttcattttttaaggctatgttattcagttgtaatgtatttttgcttacacgttaaaaaaaaaaaaaaaaaaccaggccaggcgtggtggctcatgcctgtgatcccagcactttgggaggccaagacaggtggatcaccttaggtcaggagttcgagaccgccctagccaacatggtgaaacccatctctactaaaaatacaaaaattagctgggcgtggtrgcgcgtgcctgtaatcccagctactggggcggctgaggcaggagaatcgtttgaacccgggaggcggaggttgcagtgtgccaagatcaccccactgcactccagcctgggcaacaagagcaaaactcaaaaatatctcaaaaaaaaaaaaaaatctcaaaaaaacaaccaaccaaccaaaaaacaactaaaatgcttatcagcttacctaaaggttaactgttcattacggattcacaaaccaacaatgtatccattattcctaatattaccatttatatagagtactgaaattttgaa

SEQ ID NO: 154419 - DNA, 601 bp, Human
actgttcattatgaatcaggattaggaaccagtaaaatgaaaaaaccaaaccgagaagattttacccacagattttccaattccgctcctcctggctgctcttataaccttttacaaaatgaaataattcatttaaaaaactgaacaaaaatatgagacctcaataattaatgtcgttactatatgcaagaaactagtttctgaaaacaatgaaccaaaacatgttgcctttcattttttaaggctatgttattcagttgtaatgtatttttgcttacacgttaaaaaaaaaaaaaaaaaaccaggccaggcgtggtggctcatgcctgtgatcccagcactttgggaggccaagacaggtggatcaccttaggtcaggagttcgagaccgccctagccaacatggtgaaacccatctctactaaaaatacaaaaattagctgggcgtggtagcgcgtgcctgtaatcccagctactggggcggctgaggcaggagaatcgtttgaacccgggaggcggaggttgcagtgtgccaagatcaccccactgcactccagcctgggcaacaagagcaaaactcaaaaatatctcaaaaaaaaaa

SEQ ID NO: 154420 - DNA, 601 bp, Human
ggcctatatccaggctttttgttatgtgagaaaaacatcctcttatttatttaagccactattagctgttggtttttcctctaaagctgaaagcattactgacagatacaagaagctgatctcactttggcatcaatttaaaataggcatcgatgtctgattattctttagttgtgacatatgtgaacgtatccttttctcagatgctactgaaacaattaacattcaattctacaggtgtgactaaaagaaatctattattttactgctgacacaagatatattcatggtgaacaattcygaaaacaaacgttaagtacaatcaaaataacaatcgccacccaaaaacaaaccatactaatagttttttctatgcaaaaagaaagtaattttccctcatttatccagcagacattcatttagtgactataaagatatgagatattgtagatgagtaacacaattttagaaataattagtacagactgtagggttcaaagagtaatagaggataaggccagataaaaacctgaatactaagttaagttatacacttggatctaatataagtgatcaagtaatgtcaagagaattttatatg

SEQ ID NO: 154421 - DNA, 601 bp, Human
ctagaacctcttcccccttcctcatctccatgatgactttgctccctgtattagacaatatgaaattgatataatgagtacatacacattttccctccctcacctcatctataaaccttctataactccactttatctcctgttactaggatgagcatctgtgctcctatgctatcctaatccacctatttttatactgaatcccaattcttttaatgtggtgaatgccacaacacagattttgcctcaatctaagaagcactttgtaacaactacagctgtcaaaaaatgaaataaatcrtatcacaaagtaacagccattcctttgattaaacagatttctacagtaactggaagtaactccagataaacaatgagcactctctcagctttaaaattcaatggttttagaatatataaagttataaatattcttgtataagttatagtattaactggaatgtacatacttttctcacccttggcaacccttgttaaattcctcaagggataggtaagtctttggggaaggaataacaatggaatggaagaatgatagactgccattttccactactttttagaaatgtgtctagccctt

SEQ ID NO: 154422 - DNA, 601 bp, Human
agtcagggactgtctgtattcaccttctattactccgtccagtaccctgattccaacaaatctttgaccccactgagatctacaacccactaatgttaccaccttttttcactgcccttcagcctccctcatatccttcttcctgtaacttaaccaccttagatcccatggtccaccattataatcactcctttgactatatcctcaattctcttgtcccccacttccctcttttgtactcacctagcaaaactccaaatgggcaaaaattcaactctttcagcagctaaccttgagtggrcccttaatactgcctggcaatactctcacactgcctgaatccatccatttcatgccttttcctagaacctcttcccccttcctcatctccatgatgactttgctccctgtattagacaatatgaaattgatataatgagtacatacacattttccctccctcacctcatctataaaccttctataactccactttatctcctgttactaggatgagcatctgtgctcctatgctatcctaatccacctatttttatactgaatcccaattcttttaatgtggtgaatgccacaacacaga

SEQ ID NO: 154423 - DNA, 601 bp, Human
ctgtttggatatggttattcaactggtactttgggcaaatactagagtcatgcaccatcacttgataaaaggattcaagtttttcatcattttcttgtgagtatgttgacaaactaaggactagccaatcgtataggtaagaggctctgaagttggctgaatacccaaacagtgtgattgaaataactgccaacaatcttattcattttagaagattaacctagggaccatgacccattaagcactttataaatggtttagaatcatatttttcaaacttcaaaacctttgacactttaayagacttatcaaatgtgctgacagccaacttactagatccccagtataaaactcaaaatatgattaagagctaaaatgaacaaaatggaatctgcactttaaaggtttgctctccaaagtgcaagtatggaatggggcttaaagctggcggcaagagatacaaaaaagacctgtatattcaaattgcccatgaattcatgaatcggtaactttctattggttagaaagctaatgtaatcttaaactgtactgatgagacagaagtatgtctcaatcaaagaatgtagtaaaattgtgttct

SEQ ID NO: 154424 - DNA, 601 bp, Human
ctgtagtcccagctactcaggaggctgaggcaggagaattgcctgaaccgggcaggtggaggttgcagtgagccgagatcgcgccactgcactccagtctgggtgacagagtaagacaccatctcaaaaaaaaaaaaaaaaaattagctgtacgtggcctgtaatttcagctactcgaaagactaaggcacaaaaatcgcctgagcccaggagaaggaggttgcagtgagctgagatcgagccactgcactccagcctgggtgacacagtgagactctgtctcaaaaaaaaaaaaaaaaaaccaaaattatttgtggaaagagtggcaagaaagattcagattttctttatgctaatatgaaagactccatcaaagtttagtacataaaggatttataaagacattaaaggaaatatataacaacagtaattttcttagtgatgacccatctaagcaattttctctggacccagactgctttctgtggttaattaagaaacaaattttaaattccactgcttataataaagaatctcttctatcagtgtacatctcaaatgtcattacatctacactccaaagctttatgtgaccaaaaag

SEQ ID NO: 154425 - DNA, 601 bp, Human
aaggcaggcggatcacaaggtcaggagttcaagcctggtcagcatggtgaaaccctgtctctactaaaaatacaaaaaattagctgggcttggtggcgcgtgcctgtagtcccagctactcaggaggctgaggcaggagaattgcctgaaccgggcaggtggaggttgcagtgagccgagatcgcgccactgcactccagtctgggtgacagagtaagacaccatctcaaaaaaaaaaaaaaaaaattagctgtacgtggcctgtaatttcagctactcgaaagactaaggcacaaaaatygcctgagcccaggagaaggaggttgcagtgagctgagatcgagccactgcactccagcctgggtgacacagtgagactctgtctcaaaaaaaaaaaaaaaaaaccaaaattatttgtggaaagagtggcaagaaagattcagattttctttatgctaatatgaaagactccatcaaagtttagtacataaaggatttataaagacattaaaggaaatatataacaacagtaattttcttagtgatgacccatctaagcaattttctctggacccagactgctttctgtggttaattaaga

SEQ ID NO: 154426 - DNA, 601 bp, Human
tgattagattccaacaatgatgttacatgtatattatttgtatgagaaaaggcaataaagagtaaattaaaatgtttatgcatggtgaaataatatcacaaataatgaatgctgtatgtattgcaaaccacatctaagtacagattataaaacgttacctccattgtgtgtgtcttcccagaggatgtttgtccatatgcaaatattgttccattatatccttcaagtacatctatgagaaaagattttatagttcaggggattttttccttaagcaagattcctaagaaattacttaaaytacaggatgacagggtagagaaaaggttaaaaaaaaaattacttaatgttacaggaaaatatcagatgtttattcctagtgaggtataaaacaccctaaaacacacacacacacacacacacacacaccctcttcctaacccttgcatactaaattctgtataataaaatattgtgggagtggctgggtgcggtagctcactcctgtaatcacagcactttgggaggccaaggcaggcggatcacaaggtcaggagttcaagcctggtcagcatggtgaaaccctgtctctactaaaaat

SEQ ID NO: 154427 - DNA, 601 bp, Human
aaaatataatctttcctcaaggaatttaccttaatatgaaattccaaattttcatccatggagtaaatataattaaaaatatcttgcactattcttggaataattcccatgccttctggatcatgaagtttaccctaaacaaaaaacaaaactagacttcttaaataaattataaaatatgaagtaaaaacaaagagtttcaatctacaacttatagtcaagaaaggacaggaactatatttttgtggaaacggctctgtaaatacctaaaaaatccaattcaactattacacatacacastactgtacatcaaccacatgggttaccaacagatcttaacccttcatttaatcactagatttagattatccatgcttgtaaaatgttcattgtaaaatgaacataattaaaaaggttttagtttctttccatataattctacattgttccttctacttcgaggcaaattcatgcaaatactaggatgtccttgttctctatgactttatgaaaatcagtaatatgaatcacactaaaagaagcagtcatttacttaatatagtacactcaaataaatgataaaaacagatgctctttagc

SEQ ID NO: 154428 - DNA, 601 bp, Human
gaatcagactgtatagaattgtaataatgaaacaataatccaaaggaaagaaataagtccaaccaaaccagaaaagactaatcgagagttaccagttttaatagggaccccactgccaatatggataaaatacgtatcaaaaattagaaaagggatatctaataaagtttataacaacatatgctgaaccagttctcactatgaacatatcttaagtcatagaaaccacttatgggttgaactagagtatggtcaaacaacagtaacttggaactgattattcagctgatatcatcataargcactggcatcagcggttacaaatctcaggttaccaaatccagtttggtaagtaagatgcaacaatgaaccctgcgtaactcccaactcaaactaaagtttacaaagatgcttaaatatttgtcaaaatacatgaagactttaccttttcactaccagctaaatcaaccagataaagttttccactcagcttttgttccgtttgtgtgttctcttgtttgacattaataagaaatatactgtgactcctagagctatgttcattcatatctgcaaggaaattacacaaacaaatataaac

SEQ ID NO: 154429 - DNA, 601 bp, Human
tggtatcattgaggctcccaatgacccaatgccaaattttcattagaacaggggtccccaagcccccaggccacaaagcagtactggaagcctgttaggaaccaagaagcacagcaggaggtgagcagcaagcattaccacttgagctccgccttctgccagatcagcagcattagaatatcattaagagcgcgaactctattatcagctgtgcatgcaagagatctaggttagaggatccttatgagaatctaatgcctgataatccaaggtggaagtttcatcccaaaaccatctcccygacctgatccacggaaaaactgtcttccctgaaaccagtccctggtgccaaaaaggttggggactgctgccttataaagttcttttagcttaaaaagagggggaagaaaagatacatgctcatacagtttccacacagaaattgaaattatgactttttattttgttaatacaataatttttacaagattaacagaaatcaaggaagatgcataaagatcctaagtgcccacagcactgaaatgagaaaagttagaaaataaaaacacccatgtcaatagtatcctaatataaagcagac

SEQ ID NO: 154430 - DNA, 601 bp, Human
cacccatgaagcttcaccatttgtcaagaacaaatggagtgaaatatggatggtattcagtgtggcaacatttattcattaaacagatttactaaatgtcaactatgtgcaggcactgtgctggatgctgcaaggcagaaagaaaatcaaagactgtgtttaaggaacacagtagaagagaagataggcacatgaataagtgcagtacaagatagaaggtcagaaccataagagagggacaggacagataaagtgcttagtaatacaggaaagagtattcattcatggagaagttggctargagagatcgactgcagtcacatgcaaattaatgtaataaaggaaaatggcattctacaagagttgcttaaaaatttagatttgggccaggcggggtggctcacgcctgtaatcccagcattttgggaggccgaggcgggcggatcacaaggtcaggagtttgagaccagcctgaccaacatggtgaaatcccgtctctactaaaaataccaaaaaattagccaggcgtggtggcgggcgcctgtaatcccagctactcgggaggctgaggcaggacaatcacttgaaaccagaaggcaga

SEQ ID NO: 154431 - DNA, 601 bp, Human
cttctggtagatgccaaaagctataggacagaaaataatttattttccccaaaagtatacaggttttaaaaaacacccatgaagcttcaccatttgtcaagaacaaatggagtgaaatatggatggtattcagtgtggcaacatttattcattaaacagatttactaaatgtcaactatgtgcaggcactgtgctggatgctgcaaggcagaaagaaaatcaaagactgtgtttaaggaacacagtagaagagaagataggcacatgaataagtgcagtacaagatagaaggtcagaaccrtaagagagggacaggacagataaagtgcttagtaatacaggaaagagtattcattcatggagaagttggctaggagagatcgactgcagtcacatgcaaattaatgtaataaaggaaaatggcattctacaagagttgcttaaaaatttagatttgggccaggcggggtggctcacgcctgtaatcccagcattttgggaggccgaggcgggcggatcacaaggtcaggagtttgagaccagcctgaccaacatggtgaaatcccgtctctactaaaaataccaaaaaattagccaggcg

SEQ ID NO: 154432 - DNA, 601 bp, Human
cagtactgaatgttaacttcaagctaactgtaactttgtagattaaaaagagaaaaggaactcataggggcaggaaaccttttaaaagcattattttgtactgttgactgctttcttttagacaagttaatgtgagcagggaaataagtggtggacatgggtcctgagtgcaactctagatgctgatttctaaacaagaagctagcattaaccacaacaaaaccacaaaatagctcctccatgatgatgttgaaacattcatagctatgtattatttctgtcatcattgttggaggttggygatgtctgtcctgtatcaattttcagcaagtaaaaatctccatctagtcgccaggcacggtggctcacgcctgtaatcccagcactttgggaggctgaggtgggtggatcacctgaggtcaggagctcgagaccagcctggccaacatggtgaaaccctgttgctactaaaaatacaaaatgagccgggcgtggtggcgggcgcctgtaatcccagctactcgggagactgaggcaggagaatcattgaacccaggaggcagaggatgcagtgagccaagattgcgccattgcactccag

SEQ ID NO: 154433 - DNA, 601 bp, Human
gatgccatcattccaactgcttatttcttatggtagttcgtcatttccttaagtttctgagtatcagtagagtatgtatccacccaggttaatctacaatatgataccaattatcttcaagtctcataatatagcatgcttctaccataattgtttaaattaccagacactctctaactgaacagcaacactgtctaagcatataaacagatgctaaacactagggatttctaactcctattatcaatgtaatgctgatagatttcagctccacaagtgaaacataaatataactgtcttraagactaaaatcagcggccaaggaccacctttcagagttgtaaaaaactcctgttattctttcatacaacaattagctttgttaataatgcaactcagtaagagttagttataatggtgtcttagatctgtacagtactgaatgttaacttcaagctaactgtaactttgtagattaaaaagagaaaaggaactcataggggcaggaaaccttttaaaagcattattttgtactgttgactgctttcttttagacaagttaatgtgagcagggaaataagtggtggacatgggtcctgag

SEQ ID NO: 154434 - DNA, 601 bp, Human
tcaagttttacaccaagcccttacgaaaccatgtcttttctgctttcatttttcttgaactatctaccaggttctgggctcccagctcaaacttaaaatatattttagacctaataggctatggtaaaagtagccacattgttttcaattaagagcaggcagtttctgttatttcactaaattcctgggattgaataatattttctgtctaaaaatgggaagcctcaaatttaactagatttgattatcacttattactatattatgtcttatctttagaaagtgagtcagcaaattaacrttacaatgacactcttttctagatggttagtatgctttcttcatctactttctatatacttactcactggaaagaatccatgtgataatactatgatacaggcaattatccaggagctagtgttaaagtaatattatctgagtttaatgactatcattataaatctcaaatcatagctggcttaacagctacaaaatcaccaaattttgaaaagtccaacccagtttggtgcccactttaaaataactcatatggcagaacagatacaaggtgagcatccccactccgaagtgctcgaaa

SEQ ID NO: 154435 - DNA, 601 bp, Human
aacccaaaacaaaaagtatagttaaatctactacatgaaaattcaaatcaaatactcatcggtgtttcaagttttacaccaagcccttacgaaaccatgtcttttctgctttcatttttcttgaactatctaccaggttctgggctcccagctcaaacttaaaatatattttagacctaataggctatggtaaaagtagccacattgttttcaattaagagcaggcagtttctgttatttcactaaattcctgggattgaataatattttctgtctaaaaatgggaagcctcaaatttaaytagatttgattatcacttattactatattatgtcttatctttagaaagtgagtcagcaaattaacgttacaatgacactcttttctagatggttagtatgctttcttcatctactttctatatacttactcactggaaagaatccatgtgataatactatgatacaggcaattatccaggagctagtgttaaagtaatattatctgagtttaatgactatcattataaatctcaaatcatagctggcttaacagctacaaaatcaccaaattttgaaaagtccaacccagtttggtgccc

SEQ ID NO: 154436 - DNA, 601 bp, Human
cttttacgtcagttccaactctggttaacagactgggctttttagtaggctctcaatataaacccaagtgtatatgctctctttgtattgtaattaggctttaatcaaaaaggtaaagtctaaacagctactgcaacatacaaatctttcatgttatatgcatggtttttcagttaagagtcttagtttggttctttggtcttagtttttaaatctaccaccaagtcaaatgcctaatgctaacaaccaatattagtatctttaaaaagattaggacaaagaggtataaagaaaatatggmcatattttgaaaactgaaaactctagagttcattgtattattctctctactattatgtttgaaatttttcacactaaaataaaaaagaattaagaaagcagtgctcatctttaacttttctttaaatatttaaagcaaccacaagcccattcattataaatttattccctgagctaatcttttttttttttttttttccagatagggtctcactgttgctcaggctggagtgccatggcacaaacatggttcacagcatctttaacctcctgcctcagtctcttaaaatagctgggacta

SEQ ID NO: 154437 - DNA, 601 bp, Human
aaagacgacttattttcaaactgctatggtatagtggaaaaaaaaatctagtagtcatggaacctggatttcatccctctgccactaaacataaaccatttccactctctctttacactttttaacttaaatcataattatttgaacataaaatataagatttgtctaaaaagttgcaaatctacaaagcaaatcttgaacaacatctctctggtgttctgcgatatgaaataaatgtacttttccatcctagagatttctctacatctcacattacttcaccataaacagaatagggccraaatgttcagactgatggtgaagggaaagcaagtcaagtggccccatagtgagtccactgaagaaataacatatgaagagaagagtcatgagaatccttgcctccatcaacaaacagtaacttttattttgttgattttatcttttattctttttgtattttttaaaaatattttttcttcatttttaaactgaagaatcagttaacagcaaacagcaacattaaacaatacaaaagatggaaatgtgtactccatattgaaaacttttacgtcagttccaactctggttaacagactgg

SEQ ID NO: 154438 - DNA, 601 bp, Human
ggtgaaactccatctctactaaaaatacaaaaacaaaattatccaggcgtggtggcacacgcctgtaatcctagctactcgggaggccgaggtgggagaatggcatgaacccgggaggcggagcttgcagtgagccaagatcgcactactgcactccagcctgggagacacagtgagattccgtctcaaaaaaaaaaaaaaaaaaaaaaaaaaagtaacgctctaacagagcttatatatgatgagaggaaaagaattacttgttaatgacaaaaatactgaggatcctttttttttttttaattagaataactatttgcaaagacgacttattttcaaactgctatggtatagtggaaaaaaaaatctagtagtcatggaacctggatttcatccctctgccactaaacataaaccatttccactctctctttacactttttaacttaaatcataattatttgaacataaaatataagatttgtctaaaaagttgcaaatctacaaagcaaatcttgaacaacatctctctggtgttctgcgatatgaaataaatgtacttttccatcctagagatttctctacatctcacattacttca

SEQ ID NO: 154439 - DNA, 601 bp, Human
ctgctctaacatcattttctggttttggctgacgaaagaaaaaaataattaacacagtatcaatatcacagttttctcaatgtcatcattaaaatttccaaacttttaaattctataatctcatcaaggacttttctgttatcctgtaccctatggaggaaaagaggaaagggacctggctacttgtggacatacaaaatttttcgtattttggtttgaaatcatgattctgttctcctctgtctttcatcttcctgaatccttatgcctacttccatcaggtattcatagtaagacctasgccccaaacctcatcattattttgttatgttattctcttcttggttcctactcaaattgttgcaaactctgacttccataaactctatgtatgtgcacatggttatggaggcagggaaattgcttctagataaactaagatgacaacttaaaaaaaaaaaaacctttgaaaatccatagaatttccagaaaagtttttcccagttaagaattttgagtcagggtctcgctctgtcacccaggctgtagtacaatcatagctcacttcagcctcagattccaatactcaagcaatcctcgt

SEQ ID NO: 154440 - DNA, 601 bp, Human
actggctatatccaaaggtaatgcctataatcctctaatttagcttttatttttaaactttaattaaaaacaattactcacgtaagttcatgtagttttctgctcttttcctgatctgtggctttcaacttctcatgttctactcttagacgttcctgctctaacatcattttctggttttggctgacgaaagaaaaaaataattaacacagtatcaatatcacagttttctcaatgtcatcattaaaatttccaaacttttaaattctataatctcatcaaggacttttctgttatcctrtaccctatggaggaaaagaggaaagggacctggctacttgtggacatacaaaatttttcgtattttggtttgaaatcatgattctgttctcctctgtctttcatcttcctgaatccttatgcctacttccatcaggtattcatagtaagacctaggccccaaacctcatcattattttgttatgttattctcttcttggttcctactcaaattgttgcaaactctgacttccataaactctatgtatgtgcacatggttatggaggcagggaaattgcttctagataaactaagatgaca

SEQ ID NO: 154441 - DNA, 601 bp, Human
taatacagaaagctccagaaagagagagagagagagagagatagtatattgtgtagtatctctagattttttctaatttgtgactgttttatgccctacaaagaacagatattacttatataattataaataaaactcagaaatctgttagtaagctgggctcataagcaatttggtgcagtctttctagaaaccaatgtgttaatatgtagcaagagccttaaaaatgttcatatttccttgtaattgcatttctgggaaccttctggaaataatctctaacaggttagggaatacaagragatgtttcaggtcgggcgcggtggctcacgcctctaattccagcactttgggaggccgaggcgggcagatcgcctgaagtcaggagtttgagaccagcctgaccaacatggtgaaacccctcgtctctactaaaaacacaaaaattagccaggcatggtggcaggcgcctgtaatcccagtttgggaggctgaggcaggggtatcgcttgaacccaggagccagaggttgcagtgagctgagatcacgccattgcactccaggctgggcgacaagagtgagattccatctcaaaaagaa

SEQ ID NO: 154442 - DNA, 601 bp, Human
cctatgcatttagaaaagcaacctatttaaagtactatgcaaggcagaagactagtcatgtaaaactgggaactaaaagtatcagtattataaatgtcatcctttccaaaaataaacacagtgacttgaaatgtttttcttaacattaaaaaaatttctcgccgggcacagtggctcacacctgtaatctgagcactttgggaggctgagggaggcagatcacctgcggtcaggagttcaataccagcctggccaacatggcaaaaccccgtctctagtaaaaatacaaaaaccttaggcrggcgtggtagtgggcgcctgtaatcccagctactcgggagggtgaggcagggagaactgcttgaacccgggaagcagaggttgcagtgagccgagatcctgccactgcactccagtgcaaattatttaacatttaaacaatttatcacttaagtgaatcatatactccccaatcatggtttaagatagattataagagtttgaaaactaagaaccactatctttggaccagcatcaaaacaaacctgtaaataattgtatttttacatcataactttcaagtcttgaaaacctagtttgg

SEQ ID NO: 154443 - DNA, 601 bp, Human
cttaacatttgagtgccttgttgaaaataaatccccagaaacagcagcacatttccacagaaaactcataaagatgcaccctatgcattttcttatctcttttcaaagtttagattctagggctctgtatattgccatgtggattaacattgtcatgtactttgctgctaagaagaccttgagatgctaatcctacaggaaacttccagagacaagcagaaaagtaactgactcacctggtcgtgtactgtgctgtgaggatgcttatttctaaaatgcagattgcaactgcaaagctccrgcaggctgacatgctgctcttgctgggtggctgcgagtggggtggcagggcaggtctggtaaggcatttatttgcaaagggccagaggacagggaacaagcattgtttgtctgcattcagagtttttgtcaatttgggtggcctgggtactgaagtccaaccaaaggagaatcattttgtaattcttggcctcctgctttctcatattgacaagtagatatggggcaatgggcctgtgaatgctaaagtccctaagatgggcagcagtgctgtgtgaaaatggaaacaaaggccgggcgc

SEQ ID NO: 154444 - DNA, 601 bp, Human
ctttgcctaatgtggaggcaaaagggtgatgtatccaaatgttaaaggtgtcaggcattgaagcagagtgagggaaagattaatttccttaattttaaacttctcagacatcaggcactaataaacccaggttcatcatacactggtgaaaacaagctttattttataattccagatatttaaagaatacctcaatcttaacatttgagtgccttgttgaaaataaatccccagaaacagcagcacatttccacagaaaactcataaagatgcaccctatgcattttcttatctcttttcraagtttagattctagggctctgtatattgccatgtggattaacattgtcatgtactttgctgctaagaagaccttgagatgctaatcctacaggaaacttccagagacaagcagaaaagtaactgactcacctggtcgtgtactgtgctgtgaggatgcttatttctaaaatgcagattgcaactgcaaagctccagcaggctgacatgctgctcttgctgggtggctgcgagtggggtggcagggcaggtctggtaaggcatttatttgcaaagggccagaggacagggaacaagcatt

SEQ ID NO: 154445 - DNA, 601 bp, Human
tttatttttgatctttgaaccatgtgcatattttgttatttacaagttagagagaaaaggtaatgatagctacactcacagagcacttcctgtttgcctggcactgtgctaagcatgttgtctttgttatctcaggtattcctcacagcaggacacattattattcccatttagcaggtgaggtacaggtttagagaagttaaggaatttacttaaggcgcagagccagtaaattgtggagctgggatcgaacccaggccacctggctccagaagcaacgctctgagctactattctactstcatggtggttttaaacattgatgctctaccttgagaaacataagagatgatgtccccctcatggccagttctcatgggcacattaatctttgtaaaaaaataaaagaaaaaagaaaaaaacaatagttagaaatccctgacagttctccagtaataataggtcactgtagctgtggcatgagatgtcttcaagccatgggagagccctgaaggctagctgtaattccaacccttccgtcctaaacaagaaagatagcaaagtgaaagcacaggaaggttattattttttttaaatacct

SEQ ID NO: 154446 - DNA, 601 bp, Human
atataatatgatatcatttgcaaaagactgggagagaataagattacgtatgagtctatggtttaacctacaaaataagtactggaagaatactcagaaacttatatatgtgacaacctgtagaggtaggatgaggtgggagcgaagaagtgtttttaaactctttatatatactttacatataataacacaaatctcacggaaagttatgagtagggaaagtaagatactcaatgtataccttgttttatttttgatctttgaaccatgtgcatattttgttatttacaagttagagagraaaggtaatgatagctacactcacagagcacttcctgtttgcctggcactgtgctaagcatgttgtctttgttatctcaggtattcctcacagcaggacacattattattcccatttagcaggtgaggtacaggtttagagaagttaaggaatttacttaaggcgcagagccagtaaattgtggagctgggatcgaacccaggccacctggctccagaagcaacgctctgagctactattctactctcatggtggttttaaacattgatgctctaccttgagaaacataagagatgatgt

SEQ ID NO: 154447 - DNA, 601 bp, Human
ttttgactcagatcactctgggaattaatcctcaggtacacctaaccacttacaaaatgatatataaacaaggatattcattgcaacattatttctagtgcgaaagattggaaacacccaaatgttcatcagtaagaattaatcagctatgacaatgaggaagttcccacatattgactcagaaagttatccaggacatgccatgaagtaaataaaaaaaaaaaggaaagtaaaagaaagtaaaaaatagtatatataatatgatatcatttgcaaaagactgggagagaataagattacrtatgagtctatggtttaacctacaaaataagtactggaagaatactcagaaacttatatatgtgacaacctgtagaggtaggatgaggtgggagcgaagaagtgtttttaaactctttatatatactttacatataataacacaaatctcacggaaagttatgagtagggaaagtaagatactcaatgtataccttgttttatttttgatctttgaaccatgtgcatattttgttatttacaagttagagagaaaaggtaatgatagctacactcacagagcacttcctgtttgcctggc

SEQ ID NO: 154448 - DNA, 601 bp, Human
ttttttaacctatgaagttgacaaatatcaaaaggttggcctgtggttcctgtcgcaaggctgtgagaaacaagtactcttactctgctggtgaaagtgcaaaataatacaaatagggcaattttagcactgtcacaaagtgattatcttttgactcagatcactctgggaattaatcctcaggtacacctaaccacttacaaaatgatatataaacaaggatattcattgcaacattatttctagtgcgaaagattggaaacacccaaatgttcatcagtaagaattaatcagctatgasaatgaggaagttcccacatattgactcagaaagttatccaggacatgccatgaagtaaataaaaaaaaaaaggaaagtaaaagaaagtaaaaaatagtatatataatatgatatcatttgcaaaagactgggagagaataagattacgtatgagtctatggtttaacctacaaaataagtactggaagaatactcagaaacttatatatgtgacaacctgtagaggtaggatgaggtgggagcgaagaagtgtttttaaactctttatatatactttacatataataacacaaatctcac

SEQ ID NO: 154449 - DNA, 601 bp, Human
gattgttgagataaattgaattaaaataaattaaataatagttgctaacatttgtgagtgcttatatgtgtcacgaattcttcccttaagcctttgtatttatcatctcacttaattcttatatcatcccttagatatctactactattattattattattatactttaaagatgaggacctgagccacagagatggtaaggaattgccctcagattagacagcagctacttggtggcagagttggaattgaaacccggacaacttctctccagagcccaggtaactagtcactttcaggycttctaaaccccaatctagtactccttagttatttaaaaagtgaagaataaattaaatatgaaagtaactccactaaaacataccacataaagtcaaaggaagaatgacaaactgggaaaaatatgtgtaattcatatcagagacaaagactaatttatgaagtgatcatagaaatatgtaagagaaagacaggagactcaatagaacaatggacaaaggaaatgaatagttcgcgaagaaaaacatatatatggcctttcaatgtatgaaaaaaatgtgcaatctgactcaataagaga

SEQ ID NO: 154450 - DNA, 601 bp, Human
atacagatgtgagagttgtcagagtctaagtggtatttcatcataggtatagatgtggggatgtcggcgtataagtggcgtttcaccatagatatagatgtgatgttgtcagaatataagagggtatttcataccacgagaccggatgcaagggagtgggtctagagtaaagtggagaaatgtgccatttttttttaagttaaaatatgtttgtatgtcattgagattgattcagtaaaagggaggtattgatgctgcaggagaaaagtggcagcattattggagcaaagtgctcgattasgctagagcagaggaagctggtatgcaagtggactggtgaagcttcacaggagcatcacaggcctcacttggctgaggtgcaacaagggaacttgactgagttgtaattgccatttccttgttagcattcctcactagattgtaagcccagtgagggcagggaccctccgtaatgtgttcaacattatactgcaattcctgacacaacgtctggctcattcgacaaagttgataactgtttgctgtattaaatggacaaatacacaaattatcctatttggccaaatgtagttcataaata

SEQ ID NO: 154451 - DNA, 601 bp, Human
gaaatataagccaattaggactacatttttaaccaatggatttggcacagtttctttagttcatgcaactcgtcaagatgaaaagataatataacagcagtgtcaaacacttaagtttttaacgaacctttcctgatttctcaagtcttatttcagagcttctctcatgtgctttaaatgagccaagggtcaccaacctttactgaggaactggtacatgtcggaaattgttctagtggctaaggttgcaagacagaaaatgtccttgtcatcatgaggcctacactctagtgggtgagatataataagcaagtatgctagaaaatacaacatgcaatatttcttaagacatgtgagttatgaaggaaaacaaagcagaccgggtaagaggatagagactgccctaggactggagttgggagggagggcagtgaaagaatcctctcgcaggtggtgtggtgcttttaaaatatgtccagaaattctttgacactcttcccatcaaaagtagggtttatgtgtgcttctattgaagttggctgggcctttgtgacagccttgatgagtagaaggcagaggaagtaacactgtatgaatttta

SEQ ID NO: 154452 - DNA, 601 bp, Human
atcctttgagcccaacaccccctcctcagcccacttaactcactcagcagatcatcttttgtagttcaaggactgcatatgtacaacacttaccacctgcctattaccctgctgtgctattaggctgagtggagaagtatttgtaaagcactttctggattcttagatgaaatgtgtttatcaaataaaacgtatctccaagtgtttcaatctcagcttgaaagtcacttcctagatcaaagtgatgtacatcaacatggcaggagatctacctctgggccagaaatgcatcaaatgaagrgtcattgatatacgcctggtcctattatcctgccatgaagaaaagtttccagttttagaaaaagaaagcctcagtagcacctcaaattccaggatactttgtggtaggcccagacaggaaagcacttactttatgaaggaatcttttggtcaataaatatgataatgtggcttctttgaggggagaaatataagccaattaggactacatttttaaccaatggatttggcacagtttctttagttcatgcaactcgtcaagatgaaaagataatataacagcagtgtcaaacacttaagt

SEQ ID NO: 154453 - DNA, 601 bp, Human
gttcttttttatagatgggaaactaaaaatggagaattacactacttatccaaagttgaacagttagtagaaaactgggtctagactcgacaactcttagctcttagttcagtgcaatgtttccctgtctcctgtgctggctttttcccccaaacctaaatcctctttgaaataagctgagtggtcatagcatatttagtaacttctgcatctaatagcctcatgccttttagacatcttgagatacagcaagtggacaagaatgcaagtatttttaaacatatagcagccccaggcaaarcacgtcagtgggacagcctgacgcttgcctggacctactttaagcttacacctaaatgatgtcaaattaggcaaaaataaattgaaaattgttttaacacctggttgttttgccttcactgtgccagctacctggctcactggaagcacagtgaaggcagaactcatgggaatttttagcagagaataacaagtcatgcaaaaagaatatattattgaaagaatatgctgcataaatactaagaaagaacataggtgatcttgaatagcttcttctgtctttcatcctttgagcccaaca

SEQ ID NO: 154454 - DNA, 601 bp, Human
aatttatttttttgcaattctagaggctagaagtctgaaatcaagatatggttgtgttgactccttctgaggtcccactccttggcttgtagatggccatcttctccctgtgtcttcacatggccttccctggtgtctgtgttcaaatttcctcttcttataaggacaccagtcgtattggattaaggcccaccctaatgacctcattttaacttaattacctttttaaaggccttaactgaatatacagtcacattaataggtattgggggttagaacttcaacatatgaaatggtggtrgtagtggcagaggatggggggagatcagcccataacactcataaatgattttgattaagtaaacccttatatttgtctattcattttactagacaattttcaaagctcattttctcattaacctttactctaccttttcttggtaaactttgtaagcattactagttcttttttatagatgggaaactaaaaatggagaattacactacttatccaaagttgaacagttagtagaaaactgggtctagactcgacaactcttagctcttagttcagtgcaatgtttccctgtctcctgtg

SEQ ID NO: 154455 - DNA, 601 bp, Human
ggttcttacatatcactctcttgccctgggactaggacttacattctctggatgttaagctcagtgtatgagttttctagggccaccataacaaagtaccacagactgggtgccttaaacaacagaaatttatttttttgcaattctagaggctagaagtctgaaatcaagatatggttgtgttgactccttctgaggtcccactccttggcttgtagatggccatcttctccctgtgtcttcacatggccttccctggtgtctgtgttcaaatttcctcttcttataaggacaccagtcrtattggattaaggcccaccctaatgacctcattttaacttaattacctttttaaaggccttaactgaatatacagtcacattaataggtattgggggttagaacttcaacatatgaaatggtggtggtagtggcagaggatggggggagatcagcccataacactcataaatgattttgattaagtaaacccttatatttgtctattcattttactagacaattttcaaagctcattttctcattaacctttactctaccttttcttggtaaactttgtaagcattactagttctttttt

SEQ ID NO: 154456 - DNA, 601 bp, Human
gtttttgttttgttttgttattttgaataccattgtaaccccctgcatagctaataataggaaattaataaatatttgatgaatgaataaatgagtgaataagtgagtaaatacttaattaaatgaaatatgagacaagatgctatgtacatagaaaactaaattacactaggaggtaaaggaatctcattggaacatcattggtttcaggaattgctctaggctctattaacatttctatgaatctttttaatgtctgatttctccagtgttagtgctgttgttgccttgaactggattwtctgtttttgtctattacttttgtatttgtcgtttacttagatgaatatgttaacattttgtttcaacatttccccaagatagattacttccttggttccagaaacctcatctttctcacctgccactcagacaagcctcagtgaatgctggttcagaggatactgtacagactggagaatcatgcatggaaggtaaaactcactgcaaatactccagagtgagttacagtccattactggataaatctagaacccaaccagggctattcatctttcccacacgtaagtgactagaccct

SEQ ID NO: 154457 - DNA, 601 bp, Human
tagtaatttgttacagctgtgataggaaacaaaagcacaatgccttgagagctctacatggcctatccctttcctaattctccaactttactttactccacttaagctccagctacactgaacattaaaatttcaagacaagccactttttctcatgtcttcaggcttttaaccatgctattcactattcactacattgatctcatcttggacacacattatatttttctgggaatccaccttaacctccccgtgtaatttagttttctatatacatattcttatagcatcttgttctcayatttcattgaattaattattcactcatcatttatctattcatcaaatatatattaatttcctattattggctaagcatgggagttataatggtgttcaaaacaaaacaaaacaaaaaacatgatccccaaagtaagagtttacattttagctaaaaataccagtgagcttggggactttcctgttttgttcagcttgaatatcaaatacctgaaacataataggtactcaggaagggtttttttttaaatgaataattgaataattgaaagaggaggaaggaagtccttagtcatggggt

SEQ ID NO: 154458 - DNA, 601 bp, Human
gtgcacctgcaggcccaacaccatgtggaagccaccaaggcttgggtttgtaccctctgaagcaatggcctgagctgtacttggccccttttaggcacagttggagttggagcagctgtgatgcagggtgtcatgtcccaaggctgcacagagcagtggggccctgggcctagtccatgaaatcatttttacctcctagatatccaagcctgtgatggaaggggctaccacaaaggtctctgaaatgccctggaggcattttcccctttgtcttggctattaacatttggctcctctttayttttgcaaatatctgcagctggctggaatttctccccagaaaatgagtttctcttttctaccttatggtcaggctgcaaatttcccaaacttttacacattccttcccatttaaatataagttctctttgcttatgcgaatgagcataggattttagaagcagccaggccatattctgaacactttgttgcttagaaatttcttctaccagataccttaagtcatctctctcaagttcaaagttccacagattcctagagcatgggcacaataccaccagtctctttgataaaatatagc

SEQ ID NO: 154459 - DNA, 601 bp, Human
gcctgtaaaatcaaaaacaagttaattactcccaaggtacaggcatagggtaaatgctccctttccaaaaaagagaaatcagccaagagataggggctacaggcaccatgcaagtccaaaacccagttggacagtcattaaatcttaaagctccaaaatgatctcttttgactccactaatcatgttcagggaatgctgatgcaaggagcagctctgcttctgtgccgctgcctgtatagaccctgcagctgctttcatgggctgacattgagtgcctgcagcttttccaggtacacaggscaagttggtggatctaccaatctggggtctggaggatggtggcccttttctcacagttctactaggcagtgccccagtagggactctgtgcaggggctcaaacctgacacttttcctccacattgcccaagtagaggttctccacaagggcaccgtccctatagcaaacttctgcctggacatccaggcatttctatacattctctgaaatctaggttgaggtccccaacctcaactcttcccttctgtgcacctgcaggcccaacaccatgtggaagccaccaaggcttgggtttgtac

SEQ ID NO: 154460 - DNA, 601 bp, Human
aggctgtatgggaggcatgactgggaaggtctcagaaacttacaatcatgtcagaagggtgaagggtaagcaagtacatcttcacataacatcaggagagagagagtgacgggggaagtactacacagtttttaacaaccaggtctcatgagaactccatcatgagaacagcaaaaaggaagtccagccccacgatttaatcactttccgacaggctcctccttgaacatgtggggattacaattcaacgtgggagatgagtggggacacagtgccaaaccatatcattccaccctggctygtccaaaatctcatgttcttctcacatttgaaaacacagtgatgccttcccaacagtcccctagagtcttaacttattccagcattaactaaaaagtccaagttgaaagtttcatctgagacaaggcaagtcccttctgcctatgagcctgtaaaatcaaaaacaagttaattactcccaaggtacaggcatagggtaaatgctccctttccaaaaaagagaaatcagccaagagataggggctacaggcaccatgcaagtccaaaacccagttggacagtcattaaatcttaaagctcc

SEQ ID NO: 154461 - DNA, 601 bp, Human
acccaatgtaaatgacgagttaatgggtgcaacacaccaacatgacacatgtatacatatgtaaccaacgtgcacgttgtgcacatatgccctagaacttaaagtataataaacaaaaaaggaaaaaaaaaaaacacagaaaagactaggtgatgccaatctctcctcaaattctctagatcccagctccccttagagactctgattcattgaatatctccttccttttaaactctccctctctactatctcctttccatttgtaatataaagtgttcaagcttgtgatattaaacataawaagccaaggaatgaacaaatcatgcaccatccctgattacacattttcttccaaccactaccatctccctcctgcccttcacaataacacttcttagaataaatgctggaagcacatttatgtctttctgacatccaaagaacaagtcttatctccttcaaactctacatgcccttttagttacttctaaattctcttttcttttagccaagtttcttgagaaagtagtgagcaccctcgtctcttgtttcctacatcccaacacttctcaaccctcctgccctgtgaacgctgctcttg

SEQ ID NO: 154462 - DNA, 601 bp, Human
tacccaatgtaaatgacgagttaatgggtgcaacacaccaacatgacacatgtatacatatgtaaccaacgtgcacgttgtgcacatatgccctagaacttaaagtataataaacaaaaaaggaaaaaaaaaaaacacagaaaagactaggtgatgccaatctctcctcaaattctctagatcccagctccccttagagactctgattcattgaatatctccttccttttaaactctccctctctactatctcctttccatttgtaatataaagtgttcaagcttgtgatattaaacatawaaagccaaggaatgaacaaatcatgcaccatccctgattacacattttcttccaaccactaccatctccctcctgcccttcacaataacacttcttagaataaatgctggaagcacatttatgtctttctgacatccaaagaacaagtcttatctccttcaaactctacatgcccttttagttacttctaaattctcttttcttttagccaagtttcttgagaaagtagtgagcaccctcgtctcttgtttcctacatcccaacacttctcaaccctcctgccctgtgaacgctgctctt

SEQ ID NO: 154463 - DNA, 601 bp, Human
atacccaatgtaaatgacgagttaatgggtgcaacacaccaacatgacacatgtatacatatgtaaccaacgtgcacgttgtgcacatatgccctagaacttaaagtataataaacaaaaaaggaaaaaaaaaaaacacagaaaagactaggtgatgccaatctctcctcaaattctctagatcccagctccccttagagactctgattcattgaatatctccttccttttaaactctccctctctactatctcctttccatttgtaatataaagtgttcaagcttgtgatattaaacatwaaaagccaaggaatgaacaaatcatgcaccatccctgattacacattttcttccaaccactaccatctccctcctgcccttcacaataacacttcttagaataaatgctggaagcacatttatgtctttctgacatccaaagaacaagtcttatctccttcaaactctacatgcccttttagttacttctaaattctcttttcttttagccaagtttcttgagaaagtagtgagcaccctcgtctcttgtttcctacatcccaacacttctcaaccctcctgccctgtgaacgctgctct

SEQ ID NO: 154464 - DNA, 601 bp, Human
tacctctacttgcctgacctgacactgatccttcctatagttaggcctcttaaaccacagaaaaggctagctgaacaggaacagctcgtttacagctcccagcgtgagtgacggagaagtcaggtgatttctgcatttccaactgaggtaccgggttcatctcactggggctcatcagacagtgggggcaggacagtgggtgcagcccactgagtgtgtgctgaagcagggcaaggcatcgcctcacccgggaagtgcaaggggtcagggaattccctttcctaccaaagggaaggggtgrcagacagcacctggaaaatcgggtcacttccaccccaatactgtgcttttccaacggtcttagcaaacagcacactaggagattatatcctgcacctggctcagagggtcccaggcccatggagacttgctcattgctagcatagcagtctgagatcaaactgcaagggcagcgaggctggggaggggcgcccgccattgctgaggcttgaatatgtaaacaaagcagccaggaagctcgaactgggtggagcccaccacagctcaaggaggcctgcctgcctctgtagagtccacctct

SEQ ID NO: 154465 - DNA, 601 bp, Human
caggacttattcctgatctttctgagttttaacatcatatattttggcacttatgcctccctttccacccctaggcccactgctcagcaaggcttttctggctttgaactttcctttctccgttggttcaccatttgagtctcttctggttgaaacatcacccaggataattacaaaaaaaagaaaacacatcagaaccagaaaccacccaacaagaatcctacaaattccctacctctacttgcctgacctgacactgatccttcctatagttaggcctcttaaaccacagaaaaggctrgctgaacaggaacagctcgtttacagctcccagcgtgagtgacggagaagtcaggtgatttctgcatttccaactgaggtaccgggttcatctcactggggctcatcagacagtgggggcaggacagtgggtgcagcccactgagtgtgtgctgaagcagggcaaggcatcgcctcacccgggaagtgcaaggggtcagggaattccctttcctaccaaagggaaggggtgacagacagcacctggaaaatcgggtcacttccaccccaatactgtgcttttccaacggtcttagcaaac

SEQ ID NO: 154466 - DNA, 601 bp, Human
ttttttgtgtgtcttccttcccatccaccataccccacccctcccaagaatctggtgaggctaagttacctcattctcttgcaaatttaagccagccagcccaggcccagccattcctgtagcgggcacctcataaatcaggtttcccctctctggtattctgtatgccctaaactggatgccttgccacttcacacttcacttcaggacttattcctgatctttctgagttttaacatcatatattttggcacttatgcctccctttccacccctaggcccactgctcagcaaggcttttctggctttgaactttcctttctccgttggttcaccatttgagtctcttctggttgaaacatcacccaggataattacaaaaaaaagaaaacacatcagaaccagaaaccacccaacaagaatcctacaaattccctacctctacttgcctgacctgacactgatccttcctatagttaggcctcttaaaccacagaaaaggctagctgaacaggaacagctcgtttacagctcccagcgtgagtgacggagaagtcaggtgatttctgcatttccaactgaggtaccgggttcatctcac

SEQ ID NO: 154467 - DNA, 601 bp, Human
tttagtattctgtacaacataaagatttcctggaaaagttagcaacatacatttaaatgtttatctctctttctgggtttggaactcagttgtggggctccctgcctcataatcatttttctggagaggctagcaatacagtttccatttggggaggtcagtggggaagggagatgaacacttaccatttgtctgagacaaggatcgcattgtgaccattcactccaggggctcattctgcagtctatgtgtgatgcagagccactgctttctgttagctctgggtcataactaagataayagaacatcccagtttataatgaccattgtgtatatctgtttccaagaagtcttcataaacacagttcattttgtactttatcccctctcaaattataccacttatctttttactatatctctcatttcaccctcaattgcatgctgttttgtattttcaactcatctttttgttaattcttgtctgtattgtaagttaacttttaacttcccaggaatgcaaatatttgaaacaacaaaacaacggcaatgaggaaaactagcaaagcatctttccaggtgttttacatagattaatctt

SEQ ID NO: 154468 - DNA, 601 bp, Human
attaattaataattagccaatgtatccacctaccaagtatttactgagcacctactatgacccaggcacaggaattatgagcataaagagacacattacattataggtgaggaaataaagccatataccatctctttcaatatactactgggtggaagaatgaccatgtctttgttggggacaattttccaacaaatccacctttaccaaaaatagcaacaaatccacctttaccaaaaacagctcagagtgagtaagagaggctgtgtagtagatattcctaggatgccctctgactatrtatggaacagaacagaatagaaccgaatctctctgcatatagtctctattctgtataatcctgagttctaaactccaagacatcccatctgagcttacagccatctgtccagagcccctaggttttgtatggaaaatgagtgaaatgtcagctctctataatgagaaccagaacctcaacataatcatcctctggcatcaaaactacttcctctgatcacattcctcctgggtcagctccagaatgctggaaactcccaagatccaggagaagttccaatggaagacagccttcccagca

SEQ ID NO: 154469 - DNA, 601 bp, Human
cactgcaagctgtgcctcctgggttcacaccattctcctgcctcagcctcccaagtagctgggactacaggcacccaccaccatgccctgctgattttttgtatttttagtagagatgggttttcaccgtgttagccaggatggtctcgatctcctgacttcgtgatccgcctgcctcggcctcccaaattgctgagattacaggcgtgacccgccgcagatatcgtcaaatgtctgctgggggaaaaattaccactgattgagaaccactgccttacccttctaccagccttgctcttamcatcacccctgtcttttttcctctcctcatctccatacccgggactggagtcctatccgggaaaagaaattcagtcttacatgatgccaattgacaatattttagaaagtagttaaaggatattcattaattaataattagccaatgtatccacctaccaagtatttactgagcacctactatgacccaggcacaggaattatgagcataaagagacacattacattataggtgaggaaataaagccatataccatctctttcaatatactactgggtggaagaatgaccatgtctttgt

SEQ ID NO: 154470 - DNA, 601 bp, Human
ttcagctctactagaactaatcagtcaaatggccttatttatttcactcagttcttatctataaaatgaatataatacctcctctaacaatctcccagtattatttggaaaatctatggagatacagtgtggaaaaatattttgaaaagtttaaagtattatgcaaatgaaagtcgtcatagaacaataggtttcatgaagactaaatttaacataggttattactcatggtaatggggaatttaattaaaaaatgttgatggactgattctatcaagacctacttcattttccatttctkcagctgacctttccccatagctagggcaccaccttcttacacagccttgaagactcagctgtgggatggttcctaacaccaaccctgactgtggtaaagcgtgaggtatttaagaattcctagctagccctgcttcattatgaaactctctgacaaatgctatgcaacaaatttttcttttccctgaacaaaggaaaccaatagattatgaatgattgtttttcagctaaatgggccaatatttctatattcttttcctataagacaaactataaatttgcattgaatgagaataaataa

SEQ ID NO: 154471 - DNA, 601 bp, Human
gatattaattgaaatttaaaaatattaaatactctttgaccatagggtctaagtattaaaaattctttattaatagtgccatatataggtatcttaaatttttaaaaatcattactgtaagtaaaattttattggaaagctatcttaatgaaatgaatgagtcttctttttaaattaatatgttggttcccacatccatgaatgaatattacttcattcattcattcatggtgctaggaagagacagtgttcagtatcaatttgagtcctacttttcatttttatagttgtaagtgctgaraagttttactcacataaataagtagataagaataaaagaaattttattataacaatgtcacacaattttaatccctttttctgagttatataccaaaaagagatcccatagttagtgatctttcatcaaaaattatttttatgctccattatctaaaagttgattaggtaatctttcagtgttgataaaaagaattagagatcacaaaacttcaaggtgtcagagtccagttgagtgctaacatttggagttgtgtcttgttttttttttcctctctatagtaaaatgtgagtgtgagat

SEQ ID NO: 154472 - DNA, 601 bp, Human
attgaaagggtttcctactggtagtgggttagttaaaaacaacatctttatataaatagcacattttacataaactttgaatctacgaagttccaaagtgaatctaaaatggttcaactttaatggaaggcaagttaagaaactgatgcatgaatatcttcctcaaggctgacatatagataaaattgaccacctcccactgcctgtcccaccaaaatacctttcatgaaaaatgctatggccttaaagttctaatatagggtcaaaaattagacctattaatttgaatatgagaaaaaakaaaaaaacattatatatttgatttatttttttaaacaccttattcctcatgataaattaaaatttttgtcccaatcctttacccatctctgcatgtacacccttgccatgacctcatcaccggcaaagtatacttccctccctagtggctttgtgcttggccatgtgacttactttaagccaatggcatgtagttgagagtgacagtgggccagttcaaagcatgggaatgaagaggcctcattcattgcttttgctttcgtgtatttgtgccattgccttgaaaagggcttctaatggg

SEQ ID NO: 154473 - DNA, 601 bp, Human
aggagaggcttatgaactcttttaggcaactaaggcactgtttagagtgcaatgaaagaaatgcaataagtaaggcacatgggaccatctggttcctggagttttaacttcactgctgtaactcttacctaacctcccttagtgaaccaataactgatgctgtaataccaactatttaaattatttgagaacagagcatctcagggggccaatataacatgtgcatgtaatttttcatctatgaatcaacattggggctttctctcactcaccccattctctttaaacttaagccttttcytccagctgtctcattgcttgtcaagaacctcattccctccaggcttatattattcccgttatgctctccaagatgaacacaaaaattttagcatcctggcaaggcattctcaaaagttctattttttcccatagcaaaatatttttatttggcaagctttcattcataaatataaattttatttagcttttaaaaaagtttaattttacttgtaggcttagaaacaatatatgaactagaagcagttatttccttgtgaaatatacctctgttcattggaggaacacagtcattgctgtc

SEQ ID NO: 154474 - DNA, 601 bp, Human
gatttaagaagaattataatgaacacctgaaacctgatttaggcttacaaattgttattcaacaacaaaagtgaagaaacaaccaaagaaaagtaagtagaaaaggacctaagttataaacgcaatcatcactcccccctcccctttttacttctacagttgttcttggtcattactgctaatttataaagtggtcagtaagtcttgacctgctgtgtgaccactaattatgtacctagctttggctaagtctttaactaattatactctaaaatgaataatagctaatatttactgaggrcttgctatatgccagtgactttctgagtgtttcacatatttagacccatttatctccatgaggtaggcattattatttctattttatagataaagaaactgaggcacaatgatgataagtaatttgcctgagattttacagcactaaggggcagaggtgggatttcaacctaagcagagtggctctagaaccacagcccattagagacaaaagaccctaaatgagagagtatgaatggatgagaataagatgtcattatttaggtgcattcccatgttatgatggaccagtataattctg

SEQ ID NO: 154475 - DNA, 601 bp, Human
aatgaattgaagttgagaaaagctagaggctgtaaactaagaacactattttgagtcattcctacatgagaagtgatgggagcttaaggcagtggcagtgggaatggggaataagaaacagatttaaaggagattataataatagaacttgaagattgattggatattgtgggttttgagggaaatgagtctgtaaagaatgtcttaaggagggatttcaggttttgagtttgatgactaggttgatattatttccacttaccaagacagagaattcaagagcaagaagcaggaaattggragtaagattggttatcagctgtaggtatgttgactctgtgacaatggcagacaactggatatacaagcatctagttcagagagagatgtgggctggaaatataggatttgcatgcaatcagaatagagtgaaaactgaagccataggagaagaggaaaaggaaatcactcaagaagaatatatagagagaaatcagtgaagcaatgtaggaactctggaaagagttcaatactatttaaggattctccaaaagggagctcaaaataagcttgagatagacttgaagagggttgaaaaatg

SEQ ID NO: 154476 - DNA, 601 bp, Human
cctcaaactcaaaattaccagcattcgaatcattatcttcttagaacccactccttctttggtagatttcctgcacatccaacttcccacatctcttttgatggcctataattcactggttgtttgtgtggggttttttttctttccatttttatagggtccatctatagaaaatttagtttgtgataggcactattctaatcacttcacagttattaacacatttaatctttctgaaaccctgtgaagtgtatactattatcatacgattttatcatggaaattgagatccaggaaatgwaactaagttgcctaaattcacataggtggtaagtggaggaagttaccaaaatttaaacccagagaatcttaattcagaaccttgtgattgatcatatgctatactgtctccaatttattaataatttcttaattcttaaatatgctggattttatctcttcttcttcatctctactattacagacccagattagccttttgtcatctgcttcttggaccataaaatagcctccttctgttctcattacctctggtcttgttcccttaaaatttatttccacaaaacacaaagttctaaaa

SEQ ID NO: 154477 - DNA, 601 bp, Human
aagttatcctgtttaagaatttgttcatataatactccttgaaaagaaataaacattgcttatggcactaaaaatggaagagatagacacgatcaagaaatatttcagagttcaagttgtggaggtttggagagcagttgtaaatagagagtaagtagagaaaactgttgaagatgtcattaaaattttatttgtacaaatggataataaaaccataaaccacatattagttattattatcaaagccatctctcactaattgagagaagaaacctatgaacaacagattcattgtaacctyttgaggcacccctctgccagaaccatctagccaagctactgtcacattcttaaccctttagccattaagttttggggtaatatgacagtaaaggataacaagtacaatccatctctattatctatagaatattttttctgtgcctaaatcttaaacgtttgtgtgctctaggacttcagtctctatgttcttctcttctccctcattgtacacttctttggtaatctcaggcaccctcaagaatgcaatgatcgccaggcgcggttgctcacgcctgtaatcctagcactttgggaggcc

SEQ ID NO: 154478 - DNA, 601 bp, Human
gttggagaagctagattcagagagagaagatcaaggggcttgcatgttctaggaggccagacatattataagggtcagttgaagttatcctgtttaagaatttgttcatataatactccttgaaaagaaataaacattgcttatggcactaaaaatggaagagatagacacgatcaagaaatatttcagagttcaagttgtggaggtttggagagcagttgtaaatagagagtaagtagagaaaactgttgaagatgtcattaaaattttatttgtacaaatggataataaaaccataaaycacatattagttattattatcaaagccatctctcactaattgagagaagaaacctatgaacaacagattcattgtaacctcttgaggcacccctctgccagaaccatctagccaagctactgtcacattcttaaccctttagccattaagttttggggtaatatgacagtaaaggataacaagtacaatccatctctattatctatagaatattttttctgtgcctaaatcttaaacgtttgtgtgctctaggacttcagtctctatgttcttctcttctccctcattgtacacttcttt

SEQ ID NO: 154479 - DNA, 601 bp, Human
accaatacttgtaaccatcatagagagaaaagcaaaagtcttggacgagagaccaaggggcaagattacagaaagcagaaaaacacaaagatggaagcaagtttctttatgagtactgaataaacagatgttggagaagctagattcagagagagaagatcaaggggcttgcatgttctaggaggccagacatattataagggtcagttgaagttatcctgtttaagaatttgttcatataatactccttgaaaagaaataaacattgcttatggcactaaaaatggaagagatagacacsatcaagaaatatttcagagttcaagttgtggaggtttggagagcagttgtaaatagagagtaagtagagaaaactgttgaagatgtcattaaaattttatttgtacaaatggataataaaaccataaaccacatattagttattattatcaaagccatctctcactaattgagagaagaaacctatgaacaacagattcattgtaacctcttgaggcacccctctgccagaaccatctagccaagctactgtcacattcttaaccctttagccattaagttttggggtaatatgacagta

SEQ ID NO: 154480 - DNA, 601 bp, Human
atcagtactacaaaaagtctcccatgaaagaaaagcccagaatctgaaggcatcagtgatgaagtctaccagatatttaaagaagaactaatcctagactttcttaaaatattccaaagaattgaagaagagggaatatttccaaattcattttataagaccagcattaccctgatatcaaagccagacaagaacactgcaagaaaagaaaattacaagccaatatccctgatgaacatatatgtatatatatcttcaataaaatataaacaaactaaattcagaaatatattaaaatgawcatacacaatgatcaagtgagatttatatctaggatgcaaagatagtttaacatatgcaaatcaataattgtgatacaccacattaatggaatgaaggataaaaattatatgatcatctcaatagatgtagaaaaagcagtcaataaaattcaacgtcatttaaagattagaaaaactctcaacaaattaggtatagaaggaatgtatctcgacataataaaggccatatacaacaagcccacattgaccattatactcagtggttaaaactgaaactttttatcagacgtcaggaacaa

SEQ ID NO: 154481 - DNA, 601 bp, Human
tctagagatgatttaaattatactggaggctgagcatagggtatatgcaaataccacaccatgttatatgagcatctaaggatttagctatttgtgagtggtcctgggaccaattcctcatagatactgagggacagctgtacaactgataccacagaaatataaataaacataagatattactatgaaaaattatgcacaaagaaattgaataacctggaagagatggatacattcctagaaacatacaatctatcaagactgaattatgaagaaatagaaaatgcagaccaataatgaytaaaaagattgaatcagtactacaaaaagtctcccatgaaagaaaagcccagaatctgaaggcatcagtgatgaagtctaccagatatttaaagaagaactaatcctagactttcttaaaatattccaaagaattgaagaagagggaatatttccaaattcattttataagaccagcattaccctgatatcaaagccagacaagaacactgcaagaaaagaaaattacaagccaatatccctgatgaacatatatgtatatatatcttcaataaaatataaacaaactaaattcagaaat

SEQ ID NO: 154482 - DNA, 601 bp, Human
caatggttgcatttgtactgaacatgtacaaactatttcccttgtcattatcttctaaacattacagtataacaactatataaatagcacttacatcacttaggtattctaagtaatctagagatgatttaaattatactggaggctgagcatagggtatatgcaaataccacaccatgttatatgagcatctaaggatttagctatttgtgagtggtcctgggaccaattcctcatagatactgagggacagctgtacaactgataccacagaaatataaataaacataagatattactrtgaaaaattatgcacaaagaaattgaataacctggaagagatggatacattcctagaaacatacaatctatcaagactgaattatgaagaaatagaaaatgcagaccaataatgactaaaaagattgaatcagtactacaaaaagtctcccatgaaagaaaagcccagaatctgaaggcatcagtgatgaagtctaccagatatttaaagaagaactaatcctagactttcttaaaatattccaaagaattgaagaagagggaatatttccaaattcattttataagaccagcattaccc

SEQ ID NO: 154483 - DNA, 601 bp, Human
ccaattttatgtgcatgtgtataatttcatagcatcatttctttagagacacagtttgtagttaataaacagtgatcattctaggtaaggcattgcaatgaattaccagaattcttcagtataattcttcattaaaattctgatgatcatataaattgaatggtatattaccacaatctcagtcaaaaaatgctctaaattcttaatacgcattttctgctcactaccaccaaacatattattcatttaccactgccaaagattctatcagacttttctccagttagtattctttctgacrtgctagctacatatttgagaatttgatccatgtttcttttcctttttatgatttctatttgctcaaaatacttaaagagtctgggtagtttggaacctttctatattcctatattaactgttttgtcttaccttctttgaagaatatgacaaaaatagttggtaagtttcatttttggaatatgaaaaccgaaaactacccttgccatgtaaagaaattgaggaggctgtttcctcacaacattgttcagctttatttgtttcagtgggtgtaaattttagagatatagctgcattaaaa

SEQ ID NO: 154484 - DNA, 601 bp, Human
catgccacctacaggcatccctgctttccttcatgttactctaattttccttgtatcccacagaacttaatactttctaaataccatattacttcttttttgctattatatgtattatttttggctgtctctttctgtggagttttcaactccatgaggacacaaattttcatcagcttggttcacaaatatattctaagtacctaggccagataggtcacaattaaatatttgttgaatgatttaaagaattttccacctgtacacttgagtgggtatgcatgtaaatagagaggtaatktacagacccatacaaaacaattacatagttaggcatcatataagtactaagagtgaattattattgttaatgtgggagaagcttgtctaaataagtgactgtggtatcagaaaaggaagaatgagcattttactggcgtcatgctgattacagagagtatattttatatttattccaagagtggtagaacaaacttcaaaatctggttcaaatattttaaaaatcacattttcaaagtctcaaacgtatgattacaaaataatcagaccaattttatgtgcatgtgtataatttcatagc

SEQ ID NO: 154485 - DNA, 601 bp, Human
aggctgaggcaggagaattgcttgtacctgggaggcggaagttgtggtgggccaagatcacaccattgtactgcagcctgggcaacaagagcaaaaatctatctcaaaataaataaattaaattaaattaaattaaattaaaattaaaaaccctcaagtgacctcccatgtcactcagaaaaaaagccacactgagtggacttttaagttcttcatgatctgattcaaggtaacttttctaactttttatccttctgattcaatttgactaacttttatcacaccaggtttttcctacatyagagacttctctaacagttccttccgtcagataaataatctgaaatcttactctttggctatctcctctcctccaaagctttggttacttctcatctccatgaagctaagcctgagcttcctttttaatcatgccacctacaggcatccctgctttccttcatgttactctaattttccttgtatcccacagaacttaatactttctaaataccatattacttcttttttgctattatatgtattatttttggctgtctctttctgtggagttttcaactccatgaggacacaaattttc

SEQ ID NO: 154486 - DNA, 601 bp, Human
gcagcattagtcagaatagcttaaaattgaaaacatctcaaatgtccatcaagagagaaatcaataaacaaccatagcatattaatacaatggaatactaatcatcaataaaaaggaaaataaaactactgatacatgtaacaacataaataaatctcaaaaatattatactgagtaaaagaagtcagacatagaggagtatatcctatataattccatttatatgaagttctagactaggcaaaactaagctgtggtcagataaatctggtcagtggtcacctcttaggtggtagggaayggaaaagggcataaggaatttttcttggggtaagaagcctgagtgtctcttcatgatggaattttcttggtgtgatgttctttaactcaatgtattttaaacatagatcttaaataatttccatctaaatatgctgctgtgtcttctatgttaaaacatttaaaatattctcttgctaaaggagatggctactctaatgtacataattatcaaaactcatgaaactatacacttaaaatctttgcattttattttatgaaattatacctcactaagttgttttaaaaacaacagtggaag

SEQ ID NO: 154487 - DNA, 601 bp, Human
aaaatttagaacaatattttccctccaatattgaagtatactctggaagataactgtgatatagaaattgaactagtctattgattaagaagtaggttatacaaattatgtctgtactttctttcaccttttgtttagtatttcactaaaagtaccaccttctaatagatgtgaagctgcaatacaatggatccatctctcagtgctactgttgagtagagtatgaccaagtcagcttgtttgagatggaagtcaatttgctatttaacagggttttaggtgccaaagggcaggaagagaktcctctcaaaggagcaggttacagggctttgtattcttaagactttaaccattgaaacaggttggtgaacaaaataatgtttggtcaaaacagtatttgaagtcagagctctatttctaggcatacctttccgcttcatggaagctttatccaaaacatatattagttcatagagtcctcctagagacccagagctactgtagtgagttccataggtttccaaaaaggcaaaatattctcccttttcataggtagttggcaaagcttttatatcatccacaaaagttgttgtgagcacaa

SEQ ID NO: 154488 - DNA, 601 bp, Human
cgaaccctttaggccaggctgataactatgtatcagtaggcctatcttctacccatgacagacattgataattaaccatggcccttttccccatgatttccccatgaccagaaacctacttaacatgagcccaattcaaccaccaccatataatgagaagtgtcatcacatgaggtaaaactaattttccacccttgctttaagatgttagatttatatgataacactgcttcttcttttccctctaaaagaaaatttagaacaatattttccctccaatattgaagtatactctggaagrtaactgtgatatagaaattgaactagtctattgattaagaagtaggttatacaaattatgtctgtactttctttcaccttttgtttagtatttcactaaaagtaccaccttctaatagatgtgaagctgcaatacaatggatccatctctcagtgctactgttgagtagagtatgaccaagtcagcttgtttgagatggaagtcaatttgctatttaacagggttttaggtgccaaagggcaggaagagagtcctctcaaaggagcaggttacagggctttgtattcttaagactttaac

SEQ ID NO: 154489 - DNA, 601 bp, Human
ttacgtcacagttacattccacccttcacttaacacctgataccttgacactgaccccgtaaaagccattaaagtggtttttagcaacgctttcctccctaagagacacacctatagttacaagggcagagaggaagcatcctggcatccatcacctccttaaggaatattataactagccataattactcacaacatgaatgattacaacttattaatatagtcactttgcatttacttttttcttaaaagacttagacgaaccctttaggccaggctgataactatgtatcagtaggcytatcttctacccatgacagacattgataattaaccatggcccttttccccatgatttccccatgaccagaaacctacttaacatgagcccaattcaaccaccaccatataatgagaagtgtcatcacatgaggtaaaactaattttccacccttgctttaagatgttagatttatatgataacactgcttcttcttttccctctaaaagaaaatttagaacaatattttccctccaatattgaagtatactctggaagataactgtgatatagaaattgaactagtctattgattaagaa

SEQ ID NO: 154490 - DNA, 601 bp, Human
tgtgaaagtgtaagctaagtaacattacattccactcccccccgggaaagcttctctctgcccaaaacaagactgaggcatcaagaccagctggttctggctatgtcatgttttgttatccataaagtatttgctgaccttggggagaatatcaggcttttacgtcacagttacattccacccttcacttaacacctgataccttgacactgaccccgtaaaagccattaaagtggtttttagcaacgctttcctccctaagagacacacctatagttacaagggcagagaggaagcatcytggcatccatcacctccttaaggaatattataactagccataattactcacaacatgaatgattacaacttattaatatagtcactttgcatttacttttttcttaaaagacttagacgaaccctttaggccaggctgataactatgtatcagtaggcctatcttctacccatgacagacattgataattaaccatggcccttttccccatgatttccccatgaccagaaacctacttaacatgagcccaattcaaccaccaccatataatgagaagtgtcatcacatgaggtaaaacta

SEQ ID NO: 154491 - DNA, 601 bp, Human
catagaaaagggacaacaatgtctaacatatattgaatgcttatcatgtgtctggcatccttctaagcattttgtgtgctttaactaatttaatcctcacactggccttatgaagtaagtccatattgtcctcattgtacagatgaaaatatggaattgcagagcagttgaataacctactaatggctcattactcagctagtaagtttggatttgaacccagagttgtctagctactaagcacttctctgtatcaacttcataatttggatgagatacatcaacatctcctgatcctctytggaagactcagttcatccttaatgtagctggttcatcgctttggacagatggctgatgtatgtggtcactttgttttcatcctatgaatgctacttggtagatatcagtcttggaagctgactcattatggtgtgtagatgcccaaacagttactagaaagaaaaatcctaatattttcaaagtctatcagttattatctgtttttgcaattcataaaaaaaataattattcctctattttaagggtaaacatcccagaccacagttcactgacaatgtcagtttttgccgttatttat

SEQ ID NO: 154492 - DNA, 601 bp, Human
gaactaatacagcttaacatatagacatatgagtggttgagggaaatgggaaaggagaactgagaacagaaaaagcaagatggaggcaaaagcaacaaaaatgaactacattcatgccaggaggacccatccatttgcatgaagtaggtcacaaatttagcttcattttctagtgcattgagtaagacacaggtgaatttactgatctcatgcatttcttaccaatcaggtagaagaactcacctgattcccaagagaaacaaaatgagattaaagagtaatatttcttatgagtctcatraagaggacacagcattacataacaaccttttagtaaataaaacagtagattacataactttgtttctaataatggaaaaacaaaactttacaggaagccaatattgtagctgtactcatcttgctgctattgctctagaagaaataataatctttatatcttccaggcaatctataataaatgtaatttctcttagctgacattttaataactaatttgtagcagtaggtttaagaggaaaacaaagtgcagctattctgttgagttaaactgtagaaccacttgtgttaacattcaggc

SEQ ID NO: 154493 - DNA, 601 bp, Human
atctgtatcaaaaacaccattaaagatgaaattctttagtgggagaagatatttgcaaaactttagttgtgaatatgctcatatatggaatatatcaagaacttctacaaagtcagcataactgttcaccagtgtagtcttttatgaattagtatatagtatataggattcagatttcaaccatgtcatatttatttgaaagaaggaaacctctcaccaacattgtcacattggcacaaacaacataggcatgtggtagaattattttgatttttttttaaagaaattcatcttgttatayccttcaaaggaaagtcaaggccagacagtctaagatacaggaatagagggtcatgaaggaaatacaatttggattaaatgtataaacagtgttggaagagttaaagatgaaggacatgcaatggcaatagtttcagaggagcttcaaatcctggagttaaaaattccacaggaggacaaaggaaaattaaaatgtactttttgaagttttcctgaagggttccatctttttctgatgaacttttatcttctattaagtaagaaaatgattttactttttctcctatactacataactcta

SEQ ID NO: 154494 - DNA, 601 bp, Human
acttgtgaaatttgtacaaaacctgtgctttagctaattactcagtgtgaattttctgattttgataattttactatgcttatgtaaattactaacattaggagctgggagatgaagcttataagtgaattctctctactatttctgcaatattactctctgtactattctgcaatattacttctgcaatactacttctgcaatattactatctgcactatttgtgtaattttgctgtgtctaaaattagttcaaaataaaaagtacataagaggacatctgtatcaaaaacaccattaaagatgaaattctttagtgggagaagatatttgcaaaactttagttgtgaatatgctcatatatggaatatatcaagaacttctacaaagtcagcataactgttcaccagtgtagtcttttatgaattagtatatagtatataggattcagatttcaaccatgtcatatttatttgaaagaaggaaacctctcaccaacattgtcacattggcacaaacaacataggcatgtggtagaattattttgatttttttttaaagaaattcatcttgttatacccttcaaaggaaagtcaaggcca

SEQ ID NO: 154495 - DNA, 601 bp, Human
gactagataaacaaactgtttaatctatatcatggaactacatataatggaatactactgagcaatgaaaatgaaaggaactactcatacatacaagaatgtcgatgtgtgaatgtggatggatctcaaatgtgtaacactaagtgaaagaagccaaattcaaaaagttacatgattacatttatatggcagtaaatagatcagtggttatgtagaagtggggcaggaaagaggagttgattgaaaatggacatgatagaactgtgtggtagaaatgttttatgtattggttttcatggtrgtttcatgattgtaagtgtttgtggaaacctagggccctttacactaaaaaaaataaattttactttacataagtaatgtctatttttaaaaatctaattacattaaaatgtatctatatactactcactaaaaaccaagatataaaattatattatatgaattcaaattggctaactatacctctgataaagactctgatgactggaaaatgtacactaaaatattaacattatgatatctatttcacttgtgtttttggattatattagaaaaggtttgttaggttagagatttttat

SEQ ID NO: 154496 - DNA, 601 bp, Human
gtatgcacccaatgacagaactttaaaatacataaagctcaaactgatagaactgaaaagagaaataataaatatacctagacatttcaaagttctgctctctataattgaaagagtaagggcacaggaaaagaagtcctgggctgtgctatcaactaattgacctaactgacatttacagagcattctacccaacaacagcagaatacatattcttttcaagtgcacataggcatatctatgccttaaaaatactcaatatattgagaataatgaaaataatacaaagtatgtcctcagmccaaacaaaatgaaagttgaaataagtaacagaaagctatctgaaaaatccccaaatatttaccccattaattaccacatttctgaataacccatgtgtagaagagaaagtcacaaaaaattagaaaatattttaaattgaatgaaaatgaaaacacatcaaaacttgtgggacacagttaaagaaatgcttaaaggtcaatttacagcacaaaatacctatattagacaagaaaaaaatatctaaaatcaataataacagcacccagcttaagaaactagaaacagaagaaaaatttaa

SEQ ID NO: 154497 - DNA, 601 bp, Human
cagaatttagaaggaactcaaacaactaacaacaacaaaataaataatctgattgaaaaataaacaaatgatctgaagagccattttgcaaaagaacacacataaaaggccaaaaagtatatttaaaaatgttcaatatcaaacggataaaaataaacaatgctggcaaggatgtggaaaaaaaaggaactcataacactgttggtgggaatgtaaactagtatagtcactatgtagaactatatgaaggttcttttgaaaactataaacacaattatcacatgatccagcaattccaatrctggcatttatccaaaggaaagaaaataagtatataaaagagacatccgcacccttctgtttattgcagcattattcacagtagccacatggataaataaataatgtattttttctttttaaagaaaataatgtatgtacacaatggaatactattaagccataaaaaagaacaaaatcttgtcatttgtggccacatagatggaactggaggatattatgttaagtgaaataagccagaaagagaaagctaaacaccgcatgttttctcttatatgtggaagctaaaaaaaaaactgat

SEQ ID NO: 154498 - DNA, 601 bp, Human
agaagcaaaaatacacaaatggtttatatccaattgaaaagcttctgtacagcaaataaaacaatcaacacgtgacctgcagaatggggaaaaatattttcaaactatgcatctgacaggagactaatatccagaatttagaaggaactcaaacaactaacaacaacaaaataaataatctgattgaaaaataaacaaatgatctgaagagccattttgcaaaagaacacacataaaaggccaaaaagtatatttaaaaatgttcaatatcaaacggataaaaataaacaatgctggcaakgatgtggaaaaaaaaggaactcataacactgttggtgggaatgtaaactagtatagtcactatgtagaactatatgaaggttcttttgaaaactataaacacaattatcacatgatccagcaattccaatactggcatttatccaaaggaaagaaaataagtatataaaagagacatccgcacccttctgtttattgcagcattattcacagtagccacatggataaataaataatgtattttttctttttaaagaaaataatgtatgtacacaatggaatactattaagccataaaaaa

SEQ ID NO: 154499 - DNA, 601 bp, Human
aatatagtgtatttgttttacactatacataaggcagcataatatcatttgaaggcagactatgataaattaaggatgtatattgtgaatcatatgttatagagtaaaaaatatatattttttttttttttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgsgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgtaaaaaatattttttaaaagagacatgagtaatatatcaatactggaaataaaatggaatcatataacatactgaataaaaaagaatagtcaggacaagaaaggaacaatgtaatgaataaacaagatttaactgaaatgttaaagggagagtgctg

SEQ ID NO: 154500 - DNA, 601 bp, Human
tagtattttgaaagtagactaaatttgactttactagatacaatcaataatattataaagagtcaaatggaaatgtaaaaaataaaaagcatgataaaagagatgaaaaatatctttgatgagtttgtcagtagatttgacacagcaaaagaaagaatcagtaaacttgataaaagggtggtagaaattagccaaattaaagtgcaaagagataaaagaattgaagggagggaacccagaactaagcatccaagagtgtggggcaatatgaaagagactagcacatgtgttactggaatcmttgaaaaaagtgaagaggttataagaaggggttgagagggggagagaaagagaatgtgattgtggcagaagaaatatttgaagatataatgaccaagaatttttcaaaagtaattaaataatcaaaccatagactccagaaatttagggaacttcaagcagaataaatatacatctcattcaaactgtggaaaaccaaagattaaaatgaaatcttcaaggcgatgacaacaaagggaaatgctacaagcagaaggtcaaagataagagttacagcatactgcttatttaaaaactatgc

SEQ ID NO: 154501 - DNA, 601 bp, Human
atatatgtttgaaatatacaaaattaccccaggcatcaggctactcctataataattttacgtacagtatttagcccacagtaaaaataactaggcacacaaggaaataacacaacatgaatgagaccagtggaaattatggaaaatagaaacagctatggtggctgccaatgtttgtgctatcagacttcaaacaattatcagactttaaaccaactgtttgcataaacagggagataagagacaagtctgaaaattttagcaaagaactggaagttattaaaaatagatttgaaaaaaagaaacaaatattagaatacaaattagtgaattagttaaatagcaaatgtgataaaactgaagcaatttaatgaattgcaatataggtaagaagaaaatattgacaataaagcatgaagagacaaaaggataggatatacagaaagagggaaggaaacataagtgatagtgtgggaagggaaaagatccatatattttgagccccagaaggagaacaaaggacagaataaataagaagcaatatttgaaaaactaatgactgagaatattccagacctggtgaaaaacaacaagatatctt

SEQ ID NO: 154502 - DNA, 601 bp, Human
taacttaaaaatacaatacagaatctcagctttcaaaaacacaaatacagttaaaaatgcaaaataaaaatctagtgaatatcatttatataaaatttaaaaacatacaaaacaatatcacatatttttcattggtacatacatatttagtacaagcacaaaaatatgaactggaaagatacataccaacttaatgaaagtgactgtatctgagtagtagaagagagaaaaggcaatagaatttttttggggggcggggatgtggtacaaagtaattaattggatgtattattgttgcttsttaaaaaagggttttaaagtatatatgtctacgtctatacacataaacacatatatatgcaaagtgtatatgatatatatgtattaacattcatcaattctatatagtgaatacctgatgtttgttgtatttctgtaaaccttctataagaatatttttataaagagtaatacaataattataatttatttatttataattctatcttaatatatacaagtagaatatgtcagaatgacacataaaggctgatttacccattttcactattcactcaatctttatcttctgtttatataa

SEQ ID NO: 154503 - DNA, 601 bp, Human
ttcctagattttcctctaggatttttatagtttcagatcttacatgtaagtctttaatctatctcaagttaatttttgtatatggtaagagaatagagatgatttctcaaaaaattaaaaataggactaccactcaacagtcccactactgggtatctaccgagaggaaaataatctttatatgaaaaagatgcctgcacacatatgtttactgcagcacatattttgatgtgcaatagcacatatttacaatacatatttacaatagcaaagtcatggaatcaactttcatgtccatcartggatgattggataaagaaaatgtggtacatatgtaccatagaatattattcaaccatgaaagagaatgaaatcatgtcttttggagcaacatggttggagctggaggtcattatcctaagtgaaataacccagaaatagaaaatcaaataccacatgttctcgcttataagtgggagctgaacaatgggtatgtatggacataaagaaggaaataatagacagtggggactccaaaaatggcgaggatgggagggggatgagggttgaaaaattacctgttgggtacaatgttcactat

SEQ ID NO: 154504 - DNA, 601 bp, Human
tactgggaatagaatgtggtgtaaggtacaaggcacattttcataccagaaagggctatttgtcttgtatacagagagtcaatgtgattagtgctggaaaaacagagggaaagttctcaggcagcatagatagagaactgattcctggagaaattggagaaggtttcatcaaagatatgctaattggactgggttcaaaatagaggtttttaaccctggctaaagattagaataaccagtagattttttaaaaattcaaaaaacaaaaaacccatgcccaggcaggatctaccatggctgyttttgtttaattggcttaggatagacatctgttttgttttgtttctttttttttttttcctttaaggaagtgagccagatgaatccaatgaccaacctggttgagagccattggtctaggagtagaaacgcacacaaggaataagggagaaggaggttcggttagttgagggagagaaagttggaagcatttcaagctaagtaaatggtatagaaaaagaaagatgatgtgttacggttttcaatctcatcatgggtgtaagctagtgtaaattggaaactagaacattctatgtcaaca

SEQ ID NO: 154505 - DNA, 601 bp, Human
actttgttccttaataaaaaggactactctaattcctattacccaaatacaaatggcaagaataactcataaccacactaaactccctaaactacttataaaagaaacctggtaattgataaagctcccaacccaagatttaatattcacttggattataaactagtaactatcattttaagaagtcaatataaaagaaaaatctctgatgaaaccgcagacaatacactctttattttcataaagtcattgtcactagaaaagtaaaaattattcctattggtcaggctaaaagaaacargaaaataagagtaattttgccaaaatggtgaatctgaaaataagtgtctaaatatccagtctaatattagccttctcaaagctttttcatacctattggtaaaaagaaacgaacagaggaacacctgaatcattagtttaacactgtatacctgtacctagacacatggggaggcactctatgaatgactgtggaatttaactgcaataccaggtaagagttgtggcttgcccaatgtactgttttgtcttaaagatcagcagaaactttgtgaccggtcacctttgctgaaaaggttgg

SEQ ID NO: 154506 - DNA, 601 bp, Human
tactgaacacctactacagactagatgtcaccacaaaaatgaataaagcttcctaaccttaaggaggttacatgttaagtgctattacatgaatcatcttcttcctttctcaactggctccttttgccttttattatccagaccagatagcagttccaattcaagaatcctgggactccttctttttcttcatcccctcttttctagccctacttcactgcctcagcatctctctcctggactaccacatgagtgtcctcattggtctccctggttctggtcctgtaccatgtgatatatkactatatatatgactattcctgtcacttacatgatatccaactcatgtttctagacaagcacacaaagctttccatgatctgatgcatgcctacctcttcagattacattcctaccatatccctttacattttgaaccactactagagaactaattgaagttttctgctcaacactcacttctccagctttattcttcttattgtccatttgcaacaacaacaacaacaaaacactggaacacattctttaagatttagctttgggattacttcttccaagaagccttctctagtccctg

SEQ ID NO: 154507 - DNA, 601 bp, Human
cttctctcactctgaacaatatgtataagaagtttatcttacaaggatgaaaaagtaacatcccccaacccccaatcaagttgctttaccaaagaatcaattcacagacaagagggttaacctaagtgtctccaaaagatgtcaaatattccaggcttaagacacgcataccccaaagattaaataagaacaacaagaaggatgggcgcagtggctcactcctgcaatcccagcactttgggaggtcaaagcgggtggatcaactgaggtcaggaactcgagaccagcctggccaacatgrtgaaactccatctctactaaaaatacaaaaagtcagctaggcgtggtggtgggcacctgtaatcccagctactagggaggctgaggcaggagactcacttgaacccagtaggtggaggttacagtgagctgaggttgcagtgagccgagatcgtgccattgcactccagcctgggcaacaatagcaaaactccatctcaaaaaaaaaaaaaaaaaaaaagaatgaaaaacagtctatagtctggacagtggaaaaaagaacttagtcatactgatataagaaatatactgaaaacactaa

SEQ ID NO: 154508 - DNA, 601 bp, Human
tcagtatcttaccgatggctttgaacacaaagaatttgttatatataattcctttcatgttgagaagcagtctctagtatagcttgattgagtactgttacatcatttccataatctaacaattcatatgactaatagtaataaattaacacttcaaattatctggtctaaaattttacagcagagctacctgatgtattctgtaatcttttcaatgaagattctaagaaatagttaagccttaatgtcctgaggtatccactgtatgtaataaatttacttctctcctgtgcatctagartactattatctagaatagtactacaggttgagtatcccttatctgaaatgcttgggaccagaactgtttcagatttcagatttttttttgattttagaatatttgcatatacatgagatgataccccactgggacaggacccaaatctaaatatgaaattcatttaaatttcatatacatcttacacacgaagcttattttatataatagtttaacaattttgtgcatgaaacaaagttagtgttaagcacttatgtgtggaatttttcacttgtggcttcatgtcagtgctcaaaccgt

SEQ ID NO: 154509 - DNA, 601 bp, Human
aaagcagctataaaactcctttagcagtgaatgagagttccagtttgctacatttttgtgaacccttgttattttccacctttttaatttttagccattctgttgattatgtaacaaacaaaattattatggataatatgaaactccagataatagcaaatctctcacaagattaaataatgagaagaagtatgtagctttttaaaacaacatagatataatagcgttataaaaaactcatttcactaataaaatggtagggggaagtaaacacttattaaagaacagaccaaaaaattgmtcaattacggagccaccaaataatccttaatagtggggggaaatagaagaaaagacagaaagtaggaagcatggtgagtaagtgaccaatggtctggaaactataacctacagcttgagttctctcattaaatgttatggtccatccttttctataaagacaatagctattttatttcaggagtacgagtttcagtaaatttttaattaaaaaataatataaaaatatatttcggcaagaacttagggaatagctttcgtatgtgccacagtgtgtatatgatttcctatctgtaccatg

SEQ ID NO: 154510 - DNA, 601 bp, Human
tacagatggagcaatggtgagcacacacttggacaagggaggggaaggggttctcatccctgacgcgggtggcccctgctgctgtgttgttcccctattggctagggttagaccaaacaggctaaactaattccaactggctaatttaaagagagagacaaggtgagtggtttggtgggagtcagggtagatcagaatgagtcagggtggagcaggtaatcggaatgagtcagggaggagcaggtaattggaatgagtcagggtggagcaggtaatcagaatgagtcagggtggggcaggygattgaaaaaggttgctttacgaggaagttaagtttaaaagtagaaggcaaaaaattgaacatactgacatattgattctttgaaaagaaatttaaaactcatatctaatatatatgacagacagtttcatgtcagtatatatatagagctctaccttatttactgcataatattctttactgggccatagtttatgtaactttcacttttgatgaacatttattttgtaacattgttttgactgaatttccctgatttctagtaaggttaatcatctttttatgtatctgtacttcttt

SEQ ID NO: 154511 - DNA, 601 bp, Human
cccctcccatgcctgttaaaaagcatgaggatagggcctggaaaattgtatttaaaaagaaaaacaatcccggtttgacacatagtcagaatcaagaactactgatttggtaaatatacttttgtagaactatagagtcaaacttgtttatgctgtttaacataagtactttagatagcactatatcataaaaattgaggttactgaagaaaaatgaaaactgggtagatgagaaaggcagcaaaaatgggagtatgtacatggatgtaatatgtgtgtgtgtttatgtgtaagtatgcargaagtgtgttattagaaaatataatgtatctatagttatcaactataaggaagaataattcatttatttgcacgtttgtacatgaaaatttattaagctgactcttgcctgatgactgagtcatatgtcactttaaaacttagtgttttactattaagctcataaaaccaactatatgtcaagcattgaaagatagtacatttagatattctttaaaaaacggttataaacttatggaatataaaagtttgagagtttaaagaggtttattttaatcaggggagttgcttttcataaaaa

SEQ ID NO: 154512 - DNA, 601 bp, Human
gatctcggctcactgcaaccttgcctcgcaggcacaagcaattctcctgcctcagcctcccaaatagctaggactacaggcatgagctaccacgcccagctaatttttgtatttttagtagagacggggtttcatcgtgttggccaggctggtctcgaattcctgacctcaagtgatctgcctgtcttggcctcccaaagtactgggattacaggcaggagcccaccgcacccagcctatccttttatcatcacttcttttaatccttctctagttggatgaggggcagtatcaaaaggcrtattttcctatatgattaaaacatttttaaatctttttttttctctttttgttcttgggattgtcttttttaaagggtatcctttcaagttactaatctgctaacagtcctccataaaaatgtgatcccatttctacttttgatggaagacagctctgataccatctgtcagttctgcatttatacttgcaactggacacctttgttgagtaccccaccaacttaaacaattctgtcaggtgttttacatagaggcagacatatagtagtggctcaataaaatatctgcttctgagtgaa

SEQ ID NO: 154513 - DNA, 601 bp, Human
tctgttttcctttactcaggaaatcaccaataacttttacacacagatgtatgatactgagacaattttttgtaacaattaatagaaatttgtgtgtgtttatgtactgcatgtattcttcccggaagaaagtgcacttctttgaggaagtaaagtaggtataggtttcctttaaaggatttcagtttataatatatatatattattagacaacatttagccacattgaaatctggaagcctgtttttttctgtgtaacttcttagttttctcttttattaaaatatccctacatcccttstacttccttctgaaccaaatagaaccaacctttgatggattgaacggaatacccaggtatgaagagcctcggaaaccacagcgatttagatttgatcctagaaaataaaagcatgtgcttatttaaagtacactttatttttgcacagattctaaagcagtttaattacacaatctttcagaaacagactattttagtctccattttcatactggctaatgctgaatgcttaccatgtgccaggtccattctaggtgcttatgggaatttcctcatttaatttccatatgagtcacaaaa

SEQ ID NO: 154514 - DNA, 601 bp, Human
ctggtttacagcttaaggcagaggaagaaagctgaagtagtacctctatcaaagtatgtcatcttcttcaacattactgctatttattccaaaaatttgaagctgattacggaaaaactggtagctctccacttaccttgcaagtggatactcagcccaacaagatactggcttataaccattacataagcaggctggccccatcagggaaaaagtttctatggtgtgaggccgctttagaaaaaatgatgcttttctccactttctactgtagaaaaatacttgtattttgtgtacatayggaacacctacaaagtttcttctgggtctgctcctttgaagaagaaataaagctcctccctctgttaggactcactgtttttatattggcatgtgctggtatcaaggcctttggatataaccatgaagaagttctgcatattctaataaaagtcattaaaataatcactacctaggtcttcaatcactgcctttagaagggctttttcttttattcctaagaaatgtgagctaaatgtagagtctttctataaacacaacaaagtttactggcttcttacacagcaggtatcaaaacact

SEQ ID NO: 154515 - DNA, 601 bp, Human
cactggcttgcttaatgttcctaatcctagaaaatgaagatattagtacatcacaaggttattgtgacgattaagtaagttactgtctaaaaagctgttacttatcttaatggtgactaagtgcaaggcaaatatcagacggaccactagttctttggagtcaagatccaagggtcttgaaaccacccatgaatcgtaagattttcttgcatacttaccttctatggttcctcacagaatgaatttgaatggtgttcactaccctttttataataatctgaacccaccccacctacccacstttagatacacatttttttttttgagataggctttgctccgtcacccaggctggagtgcagtggcacaatctcgctcactgcaacctccgcctccaaggctcaagcaatcctcctgccctgcctcagcctcccaggtagccgagactacaggcacctgccaccacatccagctaatttttgtattttatgtacagaacaggtttttcccatgttgcccaggctggtctcaaactcctgagatcaagtgatccatcctcctcatcctcccaaagtgctgggattgcaggtgtgagccactg

SEQ ID NO: 154516 - DNA, 601 bp, Human
atatagtactaattaatgaagtgaaatgaaaacttatttcattaagaaatctgacataaggttttagtaaatagtaaaattaaatatggcttatactgatttgtatagacatcttattgagaaaaacaaatctccattttatgtatgtctcaatatgaatatgattgcacaggctacttaatctttaaattctttgatacctcaggcattatggaagtagttatgatattcaggtaaagcaaattatgtattacttatttttttggatttttttttttttttttttttttttttttttagkaacagggtcttatctgtcacccaggctggactgtagtggtgcaatcatagctcactgcagtctccaactcctgggctcaagtgattctccggcctcagcctccagagtagctgggactacaacaggcacaaaccaccatgcctggctaaattatttaaacctcaaacttaatcacgctatcacttataatttaagtcttataaagtcagaaaagcatatagccttccagaaaaaaagatttctaaaacaaaacttattttatatagcacaaatctaaatgaaataccacagtagtgatca

SEQ ID NO: 154517 - DNA, 601 bp, Human
ttaaatgcaactccattcttcttaggaactcacaggcattttcattttgaaatattgcctatgaaaagttgaattaacagcctaaaatattctaacagcctcaaaataatctataaaatgaaaaacttcatatttgggaaataataaacctggaatgcagaagttttatttctccttttatacagagatgacacagtagagcaaaggatagttctggctaagactaagctttccttactaatgccaataaaaagatgagagaaatagtctcaccaaagataacataatcttccagtttgcktgtcaggactctctactaactcctgctagaataggctgtcaatattcgactttcagattttacttatttttcttttaagtcaaccaatccctttcttataaagatactgcttctttaaataaaatcatattaaattttaatggccaaggagtcaatctgcactttaagattatttctttattgtgttctgatacacaatttaccaaaaagcaatcttaatgctcttatttacaaattgttggcggaagagatgagacatacactataatacagccctcatgtaccagcaaaaacaaccta

SEQ ID NO: 154518 - DNA, 601 bp, Human
aggatgactaaggaagaataatctcaaatgaaaatacaagggacactgaaaaaaggagaaaacatccaagagaataaaaatgagataagtcaaaaaggtcaaagagaaagtggctgaaaagaaggtcaggcaaaaaaataagaacagacactaaaatggaattcctaaaaagaaaaaaaagaaggaaaaaaaaaaaaagcaaatgcaaaataatggactagaactaggggtcagcaatggcccaaaggctaactctggcctgcagtctggatttgtatggccctcgagttaagaaaatggwcaattacactcataataaaagaaataataaaatgaaaaatcatgagaggagggcagcaaaattaaaaatatactgaaatatcacttttcgactaccagaaaaaaaggtaaaaacaaaaaaagtataacgctttttattggtgaggctatgtgaaaacaggcactctcttatattggtaggaaaacaaactggtctatcctttttggagagaaaatgggcaatctctaataaaattacatatgcatttaccttttgatcaggcaattccactaccagaaatttaccctgaagatgtatcta

SEQ ID NO: 154519 - DNA, 601 bp, Human
taaaagctaaaaacagatgaacaaacaatagaaataaaaagagaaatagtgttagaaaagaaatagaagaaaaagacaaaataagaaataaattttaaattacaggatgactaaggaagaataatctcaaatgaaaatacaagggacactgaaaaaaggagaaaacatccaagagaataaaaatgagataagtcaaaaaggtcaaagagaaagtggctgaaaagaaggtcaggcaaaaaaataagaacagacactaaaatggaattcctaaaaagaaaaaaaagaaggaaaaaaaaaaaaagcaaatgcaaaataatggactagaactaggggtcagcaatggcccaaaggctaactctggcctgcagtctggatttgtatggccctcgagttaagaaaatggtcaattacactcataataaaagaaataataaaatgaaaaatcatgagaggagggcagcaaaattaaaaatatactgaaatatcacttttcgactaccagaaaaaaaggtaaaaacaaaaaaagtataacgctttttattggtgaggctatgtgaaaacaggcactctcttatattggtaggaaaacaaactggtctat

SEQ ID NO: 154520 - DNA, 601 bp, Human
aatagggaaataataataataataaatgaataaataagttgccaatgaactaagttttttaggtctctttaaattttatttctcctttacatcttccaaaatatgcgtttttccccatggagaagtagaattaggcattttcaaatacctgattttctcttcttattcaccaagccaaatcactaaatgcatacactaggcacattctgagaatagattattcaaagttatctacatattcaatccctactcaataaaagctccaaaccttactcctttaccattgcaagtatacgtgagytggaggaaaatgtaaggatttcatactgatagaacattataaacatgaaacaagtctattctgaggcagtctggggtcactgagaataatggtagccattattgggtaccattatttgaatctccccacatacactccaaaatcaaaacagaagaagaacaataaaactttgaaatctcaaatcttagcaaagcaagaagacacactcaagcttcagattacctgtctacagaaaaagaaacatcaaatcccagcaagccgtctattgcaactctacacacctttgcagagagcaagggt

SEQ ID NO: 154521 - DNA, 601 bp, Human
attctcccatatacttgtcatccaaattcttcttactcttgccctggttacgtcaggcccacatacagatgcaggagcaccagcccttcacagacttatccaccacagtcacaatctggcaggtgactgtgtctggctttctagatttccctgtatggcctgacttgtccacctgtgccactgtttcaggagacttgtcagtgattttccctgaccctccaactaccccttttaggttcttctccatcttcttccacacttgtgtataaaatcatatttctattacagcctttattctttmatactcatagtggttttacctctctgagttctgactaagacaaaaatgtctattctcagagagttgatatggggattcaatgagactgtatgtaaagtatcagatggtagtgggcaaacagcagctggttaataaatacattattttcctcttagtctgtagatcagggattataagttgctaatttatggaggacaactggtgtaactggcaaattaaaaacaaaaactgaaaaggagattaaaattaaactcaaaattccagattgctggcttcccccaggccaaaaaaattttttta

SEQ ID NO: 154522 - DNA, 601 bp, Human
gatgctggtagagtccagcttgccctcattctcccatatacttgtcatccaaattcttcttactcttgccctggttacgtcaggcccacatacagatgcaggagcaccagcccttcacagacttatccaccacagtcacaatctggcaggtgactgtgtctggctttctagatttccctgtatggcctgacttgtccacctgtgccactgtttcaggagacttgtcagtgattttccctgaccctccaactaccccttttaggttcttctccatcttcttccacacttgtgtataaaatcmtatttctattacagcctttattctttaatactcatagtggttttacctctctgagttctgactaagacaaaaatgtctattctcagagagttgatatggggattcaatgagactgtatgtaaagtatcagatggtagtgggcaaacagcagctggttaataaatacattattttcctcttagtctgtagatcagggattataagttgctaatttatggaggacaactggtgtaactggcaaattaaaaacaaaaactgaaaaggagattaaaattaaactcaaaattccagattgctggc

SEQ ID NO: 154523 - DNA, 601 bp, Human
aaccaactcattttgttgaacactattaagggaaagaattcagtatttatctgtccttctctgtacaaagtatatctcagggtaaggtaaaattcttctttaaaaaacaatgctagttaataaattgagaaggaatgaaagaataccactgttttgtaacctcttaatgccataattgatttaagcaatgatccttaatgcctgttaaaactattccataaaaagttggtagttactatagactagcaatgaacaatccaaaaggaaattaagaaagcaatttcatttacaagagcatctraaatgattaaatactgagaatttaatcttaacaaaaaggtgaaagatttgtatgttgaaaactacaaaacattgctgaaagaaattgaagaccacctatataaatggaaaagcatcctgtgctcatggataggaacactcaacagtgtcaagatatcactactacccaaagggatctacagattcaatgcaattcccatcaaaatttcaaaagacttttttgcagaaatgggaaagtcaattaccagattcatatcaaattgcaaggggctccaaatagccaaaacaatcttgaaaaaga

SEQ ID NO: 154524 - DNA, 601 bp, Human
aactaactataacgggtaacaatttgttggaaaagtgagaggctaaatcttaatttctcatagttgggaatcatcaataatgtctaaaggtgataagaagtcagtctgtgatttaaagttatggtaatgtccacaagaattaaaacatttttaaaaagtttaaaagtggttgccttcagaaagctgtcaaagactactgacgtcaaataaaaaagacttgggacaacttgaaagggttcttatagactaaagataggacaatttaagcattatatgtgtgtgtgtatatatatatatataagtcatatataactaatatatattatatataatatatgactaaaaaatgttaaaatctatgtgttcacaatgattctcaaaaaaaaaaaaaaaaaacccaaactctaaaatctaatattttattggaaaggctgaggggatggtagggaaccaactcattttgttgaacactattaagggaaagaattcagtatttatctgtccttctctgtacaaagtatatctcagggtaaggtaaaattcttctttaaaaaacaatgctagttaataaattgagaaggaatgaaagaataccactgtt

SEQ ID NO: 154525 - DNA, 601 bp, Human
ttaattaataaaatataaggaaaaagacttttttgaatcttgatgttaggaatattttccatcagtggcacactggtcattacataaaaatgaaaaaattataatagtaacactgcacttggcttagcaataaacaatattttcactatcccataataagtgttgattactggtttttaaattttagaatcaacctataggcaaaggctgaaagatgtgattattaatattgaacaaatatatgaatgtgtcctaacttaacattataaaaataaaggtaaccttatatagcattggaagrtagaagatgaggaaaatattcagaactaactataacgggtaacaatttgttggaaaagtgagaggctaaatcttaatttctcatagttgggaatcatcaataatgtctaaaggtgataagaagtcagtctgtgatttaaagttatggtaatgtccacaagaattaaaacatttttaaaaagtttaaaagtggttgccttcagaaagctgtcaaagactactgacgtcaaataaaaaagacttgggacaacttgaaagggttcttatagactaaagataggacaatttaagcattatatgt

SEQ ID NO: 154526 - DNA, 601 bp, Human
tggtcttgaactcctgacctcaagtgatccacctgccttgacctcccaaagtgttggggttacaggcatgagccactgtgcccggcctatttaatgacttctgaaaagagtaagaactgattcccttcaggattgggagtaatttattatacttagttcaagtcatgactaataatcctaacggctttggatggcctaaataattctcttctttggaaaggacccattcagaccatctacattattgctgcaaatgaaataaaacattactaagtaaaatatttgggaaaaaatgcacacyattcccatgcatcttgataataaactctttcatttatactctctaataccctaaatttatcctaagcttacacaatataccttttaaaaaatattatttaatgtaactttgcaactggatatattttctatcatatgccttttctgataaagatgcttgaagatctattcaggaaataaaggttgttctgattcacaaagaaaataattacctggatgactgtctggccacttggcaaatccccctacaaggcgatcttgagttgataagatgtaatttctatttttctcaaagttagtg

SEQ ID NO: 154527 - DNA, 601 bp, Human
aggtgggagaggagccaaattttggaagggccttgagtgccatgccatttatattgtctgaatctgttgaaatttggagaacaagagtatgggaagtgagaaacacatatattcaggatttgaaatattttatttaatgacttttttttttgagacaaagagtctcgctctgtcacacaggctggagggcagtggtgcaatctcggctcactggaacctctgcttcctgggtttaagtgactctcctgcctcagactcccgcatagctgggactacaggcacgcatcaccacacctggctratttttgtatttttagtagagtcggggtttcaacacgttggccaggctggtcttgaactcctgacctcaagtgatccacctgccttgacctcccaaagtgttggggttacaggcatgagccactgtgcccggcctatttaatgacttctgaaaagagtaagaactgattcccttcaggattgggagtaatttattatacttagttcaagtcatgactaataatcctaacggctttggatggcctaaataattctcttctttggaaaggacccattcagaccatctacattattgctgcaa

SEQ ID NO: 154528 - DNA, 601 bp, Human
gggcagcgatcctcttctattaaagtggccaatgaaatcacatggccattcctgcctaggagtcttatgtagacttctgaagagctcagagctttgcagttataggaacattaaaaagacagttttgtaccagtcaaaatttttttctatttttgaattggccgacatttatggccttaagagctattaaagttcaaaacaggctgggtgtggtggctcacacctgtaatcccagcactttgggaggccgagaagggcatattccttgagccacaggagttcgataccagcctgggcaatrcggtgaagctccatctctacaaaaaatacaaaaattaccaggtatggtggcgtgcgcctgtagttccggctactcgggaggctgaggtgggaggctcacctgagcctagggaggttgaggctgcagtgaggcatgattatatcactgcactctagcctgggcaaaataatgaaaccctgtctcaaaacaacaacaacaaaaagttcaacacatcttaccacatcaaactttgtcaaaagagttaaagaaaaagctttacttacaacagtatcacttatttttcaaaacagaaatgacaaa

SEQ ID NO: 154529 - DNA, 601 bp, Human
ataaaaggagcttatgcaaaaataatccattctggaatgctgtgccatatttaatcctcctatttagggtaatgtcagtcattgtaaaaatatctgatctgacaataaaaacaaactcacattctatttggttgaaataatatgagtgctcataccatgacaattctgcactggctcactagtttcccatctttcagggggcagcgatcctcttctattaaagtggccaatgaaatcacatggccattcctgcctaggagtcttatgtagacttctgaagagctcagagctttgcagttayaggaacattaaaaagacagttttgtaccagtcaaaatttttttctatttttgaattggccgacatttatggccttaagagctattaaagttcaaaacaggctgggtgtggtggctcacacctgtaatcccagcactttgggaggccgagaagggcatattccttgagccacaggagttcgataccagcctgggcaatacggtgaagctccatctctacaaaaaatacaaaaattaccaggtatggtggcgtgcgcctgtagttccggctactcgggaggctgaggtgggaggctcacctg

SEQ ID NO: 154530 - DNA, 601 bp, Human
cttgggggatagggttaacaattactgagtagagtccagggatgcgtttaacctcctacaacacacaggacggcctccaacaacaaagaattactcagcaatggtaccaggtttgagaaaccctggtctagctagaaataacagttgcgaatcacaagcagctcccatttccttattatttggctattcatacacaaagctaaacaggcaacatctcattcagtaatttttccccaattgttagcactggctttaaactgttgtccaacaagcaacaagtcatttacccctaagccacaaygggaaaagttagcaaagacagaattctacttagtgataaggaggccaaacaatttagctgtccttggggaatatatcacttccacactcgctgtttctattctaacaggacattaattacagcattttcttcactggacaatttaacaaaaggatgctccattacaagacatgagagagagaaaggggagctgggatctatgttaagagtatgtctacaattaatacctcactatttaacctctctgactggccctgcttccttcccactcaaagtgattagatttaagggtggaacttt

SEQ ID NO: 154531 - DNA, 601 bp, Human
aggaattaataccgccagacaactgcttcacaggtctagctcagtggatctcaactgggagtgattttgctcccctgtcattcagcaatgtctgcagacctttcgggttgtcacaacttgggggatagggttaacaattactgagtagagtccagggatgcgtttaacctcctacaacacacaggacggcctccaacaacaaagaattactcagcaatggtaccaggtttgagaaaccctggtctagctagaaataacagttgcgaatcacaagcagctcccatttccttattatttggcyattcatacacaaagctaaacaggcaacatctcattcagtaatttttccccaattgttagcactggctttaaactgttgtccaacaagcaacaagtcatttacccctaagccacaacgggaaaagttagcaaagacagaattctacttagtgataaggaggccaaacaatttagctgtccttggggaatatatcacttccacactcgctgtttctattctaacaggacattaattacagcattttcttcactggacaatttaacaaaaggatgctccattacaagacatgagagagagaaa

SEQ ID NO: 154532 - DNA, 601 bp, Human
ttaaaacagggaagcgcagacaaggctgtgcctgcaacacaaataggaattaataccgccagacaactgcttcacaggtctagctcagtggatctcaactgggagtgattttgctcccctgtcattcagcaatgtctgcagacctttcgggttgtcacaacttgggggatagggttaacaattactgagtagagtccagggatgcgtttaacctcctacaacacacaggacggcctccaacaacaaagaattactcagcaatggtaccaggtttgagaaaccctggtctagctagaaatarcagttgcgaatcacaagcagctcccatttccttattatttggctattcatacacaaagctaaacaggcaacatctcattcagtaatttttccccaattgttagcactggctttaaactgttgtccaacaagcaacaagtcatttacccctaagccacaacgggaaaagttagcaaagacagaattctacttagtgataaggaggccaaacaatttagctgtccttggggaatatatcacttccacactcgctgtttctattctaacaggacattaattacagcattttcttcactggaca

SEQ ID NO: 154533 - DNA, 601 bp, Human
ggagcgcagcggtgcaatcatggttcactgcagcctggacctcctgggctcacctcagcctccagaatggctggaactacaggtgcataccaccacactcagctaagttttgtagagatgaggtttcaccatgttgccccggctggtcttgaactcctgggctcaagcagtcctcccacctcagcctcccaaagtgctgggattacaggcttgagccaccgcacccggccaaatcctatttaaaacagggaagcgcagacaaggctgtgcctgcaacacaaataggaattaataccgccaracaactgcttcacaggtctagctcagtggatctcaactgggagtgattttgctcccctgtcattcagcaatgtctgcagacctttcgggttgtcacaacttgggggatagggttaacaattactgagtagagtccagggatgcgtttaacctcctacaacacacaggacggcctccaacaacaaagaattactcagcaatggtaccaggtttgagaaaccctggtctagctagaaataacagttgcgaatcacaagcagctcccatttccttattatttggctattcatacacaaagcta

SEQ ID NO: 154534 - DNA, 601 bp, Human
ctctggagcgcagcggtgcaatcatggttcactgcagcctggacctcctgggctcacctcagcctccagaatggctggaactacaggtgcataccaccacactcagctaagttttgtagagatgaggtttcaccatgttgccccggctggtcttgaactcctgggctcaagcagtcctcccacctcagcctcccaaagtgctgggattacaggcttgagccaccgcacccggccaaatcctatttaaaacagggaagcgcagacaaggctgtgcctgcaacacaaataggaattaataccrccagacaactgcttcacaggtctagctcagtggatctcaactgggagtgattttgctcccctgtcattcagcaatgtctgcagacctttcgggttgtcacaacttgggggatagggttaacaattactgagtagagtccagggatgcgtttaacctcctacaacacacaggacggcctccaacaacaaagaattactcagcaatggtaccaggtttgagaaaccctggtctagctagaaataacagttgcgaatcacaagcagctcccatttccttattatttggctattcatacacaaa

SEQ ID NO: 154535 - DNA, 601 bp, Human
cttccccaaagcatacacacaattaactcgaggggagccataaaattctaatgaaggccatgaagaaactgaaactgaggaatgtggcatgctcagtttctctaatcctggagaacattttgaagtcagcagctgtcagctgactggcacaagctttgcaagcttccccctggcgcgcagtaagacactatctatctaattaatcaatcaatctagcaggcagtaagagtctatctattttgtgacacagggtctgttgctctggagcgcagcggtgcaatcatggttcactgcagcctgkacctcctgggctcacctcagcctccagaatggctggaactacaggtgcataccaccacactcagctaagttttgtagagatgaggtttcaccatgttgccccggctggtcttgaactcctgggctcaagcagtcctcccacctcagcctcccaaagtgctgggattacaggcttgagccaccgcacccggccaaatcctatttaaaacagggaagcgcagacaaggctgtgcctgcaacacaaataggaattaataccgccagacaactgcttcacaggtctagctcagtggatctcaac

SEQ ID NO: 154536 - DNA, 601 bp, Human
gctgaaaaaacaagcttccccaaagcatacacacaattaactcgaggggagccataaaattctaatgaaggccatgaagaaactgaaactgaggaatgtggcatgctcagtttctctaatcctggagaacattttgaagtcagcagctgtcagctgactggcacaagctttgcaagcttccccctggcgcgcagtaagacactatctatctaattaatcaatcaatctagcaggcagtaagagtctatctattttgtgacacagggtctgttgctctggagcgcagcggtgcaatcatggytcactgcagcctggacctcctgggctcacctcagcctccagaatggctggaactacaggtgcataccaccacactcagctaagttttgtagagatgaggtttcaccatgttgccccggctggtcttgaactcctgggctcaagcagtcctcccacctcagcctcccaaagtgctgggattacaggcttgagccaccgcacccggccaaatcctatttaaaacagggaagcgcagacaaggctgtgcctgcaacacaaataggaattaataccgccagacaactgcttcacaggtctagct

SEQ ID NO: 154537 - DNA, 601 bp, Human
gaaacaggtatgtctggaatattttccactaacaatttatcccttaaacattaatacctgctttctgtatttgtatttgtgagtatcttacttgtgtacattttacatatttattctgaaaatcaaggtgtttgattagtctcactaataatcctccgagatcttgtatttgaacagacacatcacacctctgcctaacagggaaacagaaaggtcaatttcatttggtacttactggcccctactatattccaggcactgtacttggccctgaagacatgaaaacagtgtccacttcagyacatcaacacaagtttgcacagtagccttgcccctttcctggttgagccttttctgtttgctttttttattattattgcttctggttacagacacatctaaacttagtttctggctgaagtaaacttaacaacttacttagaaatgctgaaaaaacaagcttccccaaagcatacacacaattaactcgaggggagccataaaattctaatgaaggccatgaagaaactgaaactgaggaatgtggcatgctcagtttctctaatcctggagaacattttgaagtcagcagctgtcagct

SEQ ID NO: 154538 - DNA, 601 bp, Human
caggagagcacattcaaggtttacatcctcaaatgtgagcccacttaaagccagctgaactggaaaagcaaacactctgctctctccctccaccactctggttaaacagtgagggacctgcccatgccagcttgttcctggtttgtgcttgattttgcaggaacagccggccacatgatatggagtgaggaagcagtcctaccctgcccgccccagccagacagcttattgctcctgctgcaacaactgtcccactgcagctgctccccctggctttgctgtccccaacatagcagggggaaaaaaaaatgagtacttgacaatagaaatgttttcaaactacagagaagaggcaacacgctatatctccattgtgagaaaagggaaagggacccagctaatctcctgatatgattttatagtcatcaaaggggttgccttcaggaattggtgatacaagaagtcctcagcagttcccctttacacatggagacatatcgagggtgaggagagaaagctgccaaaaataacaatgtccacatttttctctaacaagaaaagatgtcaatagatcacaaacaaaaaaaatatacaaccaaat

SEQ ID NO: 154539 - DNA, 601 bp, Human
tcatgaataataaggtactcccggctgggcgtggtggctcatgcctgtaatcccagcactttgggaagccaaggcaggcggatcacctgaggtcgggagttcgagaccagcctgaccaacatggagaaaccccatctctcctaaaaatacaaaattagctgggtgtggtggtgcatgtttgtaatcccagctactcgggaggctgaggcaggagaatcgcttgaacccgggaggcggaggttgtggtgagccgagatcgcaccattgctctccagcctgggcaacaagagcaaaattccayctcaaaacaataataataataatagtaataataataagatactccatgtcctaccaatcacaacagcaggagagcacattcaaggtttacatcctcaaatgtgagcccacttaaagccagctgaactggaaaagcaaacactctgctctctccctccaccactctggttaaacagtgagggacctgcccatgccagcttgttcctggtttgtgcttgattttgcaggaacagccggccacatgatatggagtgaggaagcagtcctaccctgcccgccccagccagacagcttattgctc

SEQ ID NO: 154540 - DNA, 601 bp, Human
cggctgataaccatgcaaactaggaactattacgcccatttacagaccagagagctcaagttcaggatttagagcatctggctgagatcccatcggagggagccaagcgctactgctaagataggatgctctgcactcagcctgggggcagttaggcaaggggaaaagcttaatccagacttcaccggaggctcattcttgaacgtcccctactagctagtgacatgaaaatgttacgtagcagttactctaagtccaaactgttgaaactcatgaataataaggtactcccggctgggcrtggtggctcatgcctgtaatcccagcactttgggaagccaaggcaggcggatcacctgaggtcgggagttcgagaccagcctgaccaacatggagaaaccccatctctcctaaaaatacaaaattagctgggtgtggtggtgcatgtttgtaatcccagctactcgggaggctgaggcaggagaatcgcttgaacccgggaggcggaggttgtggtgagccgagatcgcaccattgctctccagcctgggcaacaagagcaaaattccacctcaaaacaataataataataatagtaata

SEQ ID NO: 154541 - DNA, 601 bp, Human
ctgcaccaggagtactgacattccattcaccaagggccactggttcttaatttcaaagtacggttactgtgaccaagcctttgttattactcacctactatgtgccaagggctctgtaagtcctctctcaaattcggctgataaccatgcaaactaggaactattacgcccatttacagaccagagagctcaagttcaggatttagagcatctggctgagatcccatcggagggagccaagcgctactgctaagataggatgctctgcactcagcctgggggcagttaggcaaggggaaamgcttaatccagacttcaccggaggctcattcttgaacgtcccctactagctagtgacatgaaaatgttacgtagcagttactctaagtccaaactgttgaaactcatgaataataaggtactcccggctgggcgtggtggctcatgcctgtaatcccagcactttgggaagccaaggcaggcggatcacctgaggtcgggagttcgagaccagcctgaccaacatggagaaaccccatctctcctaaaaatacaaaattagctgggtgtggtggtgcatgtttgtaatcccagctactcg

SEQ ID NO: 154542 - DNA, 601 bp, Human
agaataaagagagagttacaagatcagaaaaccttgaaaaccagactgaggaatgtggacttaattttataagcaataagaacatgctttagacagagttctggaaatacaaaatctgccagaaatgtacaggctgaaaaagagaaaacaaataaatgcaacgcaccacaggaagctacctcagaacaaaaagctctaaggtcgagatttccctgcaccaggagtactgacattccattcaccaagggccactggttcttaatttcaaagtacggttactgtgaccaagcctttgttattmctcacctactatgtgccaagggctctgtaagtcctctctcaaattcggctgataaccatgcaaactaggaactattacgcccatttacagaccagagagctcaagttcaggatttagagcatctggctgagatcccatcggagggagccaagcgctactgctaagataggatgctctgcactcagcctgggggcagttaggcaaggggaaaagcttaatccagacttcaccggaggctcattcttgaacgtcccctactagctagtgacatgaaaatgttacgtagcagttactctaagt

SEQ ID NO: 154543 - DNA, 601 bp, Human
ctctggtgtaggatcacgtgcgagaaaagaataaagagagagttacaagatcagaaaaccttgaaaaccagactgaggaatgtggacttaattttataagcaataagaacatgctttagacagagttctggaaatacaaaatctgccagaaatgtacaggctgaaaaagagaaaacaaataaatgcaacgcaccacaggaagctacctcagaacaaaaagctctaaggtcgagatttccctgcaccaggagtactgacattccattcaccaagggccactggttcttaatttcaaagtacrgttactgtgaccaagcctttgttattactcacctactatgtgccaagggctctgtaagtcctctctcaaattcggctgataaccatgcaaactaggaactattacgcccatttacagaccagagagctcaagttcaggatttagagcatctggctgagatcccatcggagggagccaagcgctactgctaagataggatgctctgcactcagcctgggggcagttaggcaaggggaaaagcttaatccagacttcaccggaggctcattcttgaacgtcccctactagctagtgacatga

SEQ ID NO: 154544 - DNA, 601 bp, Human
actttcttcatctatggattgggtataattatagagcctttcccatagggttgttcaagggattaaatgagtcactaaatgtgaagtgccagcaacatgcctggcacatggtaagtacagttgtccctatgtatctatagggaactggttccaagaccttccccagataccaaaatccatggggaaaagtctacatgttcagtacagatgcaatttttttcttgaatattttcaatcagaggttggttgaatccagagatgcagaacccacagatactgagtacagggctgactgtactcragaaacactagccatatttattattgtcttcaaagaactgtaagatacttcataatcaagggaaaaagttagaagcatctccccttcccgccataaaataatctgaaaataaccattatgcaaggattgaatctcaaccatgaggacatttcaatgccaaggaagtgatgaaacttacttacaaataagatatttaacctcgcaaggctgtttactcatttgaaaaggggagagggtttgtaaagcatgtaaagcctctagctaacagcagtaaatccctcctaacaagaccaagacaga

SEQ ID NO: 154545 - DNA, 601 bp, Human
catcaacaggacagaaaagcatggcagtgaagaactctctgtggctctggacacagcctgtctgggttcaaatcctggctatcgttttccagctgtgtgacactgagtcagttacttaacctctctgtgcctcactttcttcatctatggattgggtataattatagagcctttcccatagggttgttcaagggattaaatgagtcactaaatgtgaagtgccagcaacatgcctggcacatggtaagtacagttgtccctatgtatctatagggaactggttccaagaccttccccagayaccaaaatccatggggaaaagtctacatgttcagtacagatgcaatttttttcttgaatattttcaatcagaggttggttgaatccagagatgcagaacccacagatactgagtacagggctgactgtactcaagaaacactagccatatttattattgtcttcaaagaactgtaagatacttcataatcaagggaaaaagttagaagcatctccccttcccgccataaaataatctgaaaataaccattatgcaaggattgaatctcaaccatgaggacatttcaatgccaaggaagtg

SEQ ID NO: 154546 - DNA, 601 bp, Human
tttcaacatttctagggtgtggactacttgttttcctaaactcccatgcagttttccacttgaaaatcatttaataactgcccacttttagggcatttcatcagagagcctagagaagatgacgcaagtttaaggcaaaggacatcaacaggacagaaaagcatggcagtgaagaactctctgtggctctggacacagcctgtctgggttcaaatcctggctatcgttttccagctgtgtgacactgagtcagttacttaacctctctgtgcctcactttcttcatctatggattgggtakaattatagagcctttcccatagggttgttcaagggattaaatgagtcactaaatgtgaagtgccagcaacatgcctggcacatggtaagtacagttgtccctatgtatctatagggaactggttccaagaccttccccagataccaaaatccatggggaaaagtctacatgttcagtacagatgcaatttttttcttgaatattttcaatcagaggttggttgaatccagagatgcagaacccacagatactgagtacagggctgactgtactcaagaaacactagccatatttattatt

SEQ ID NO: 154547 - DNA, 601 bp, Human
ggcatgagccactgcacccggccaaatcagtggcatgttcaaaagctgatgaacattttcctgcggagttttcaacatttctagggtgtggactacttgttttcctaaactcccatgcagttttccacttgaaaatcatttaataactgcccacttttagggcatttcatcagagagcctagagaagatgacgcaagtttaaggcaaaggacatcaacaggacagaaaagcatggcagtgaagaactctctgtggctctggacacagcctgtctgggttcaaatcctggctatcgttttcyagctgtgtgacactgagtcagttacttaacctctctgtgcctcactttcttcatctatggattgggtataattatagagcctttcccatagggttgttcaagggattaaatgagtcactaaatgtgaagtgccagcaacatgcctggcacatggtaagtacagttgtccctatgtatctatagggaactggttccaagaccttccccagataccaaaatccatggggaaaagtctacatgttcagtacagatgcaatttttttcttgaatattttcaatcagaggttggttgaatccaga

SEQ ID NO: 154548 - DNA, 601 bp, Human
aggaaacagaaggcgcttggctttcccaaaaaaagcaaatcaaataaaaattagtggcatgttttttttttggtttttttttgagacggagtcttgctctgtcacccaggctagagtgcagtggcgcgatctcagctcactgcaagctccgcctcctgggttcacgcccttctcctgcctcagcctcccgagtagctgggactacaggtgcccgccaccatgcccggctcattttttgtatttttagtagagacgggggtttcaccgtgttagccaggatggtctccatctcctgacctcrtgatccgcccacctcggcctcccaaagtgctgggattacaggcatgagccactgcacccggccaaatcagtggcatgttcaaaagctgatgaacattttcctgcggagttttcaacatttctagggtgtggactacttgttttcctaaactcccatgcagttttccacttgaaaatcatttaataactgcccacttttagggcatttcatcagagagcctagagaagatgacgcaagtttaaggcaaaggacatcaacaggacagaaaagcatggcagtgaagaactctctgtggctctg

SEQ ID NO: 154549 - DNA, 601 bp, Human
cacacatttttagaaggaaacagaaggcgcttggctttcccaaaaaaagcaaatcaaataaaaattagtggcatgttttttttttggtttttttttgagacggagtcttgctctgtcacccaggctagagtgcagtggcgcgatctcagctcactgcaagctccgcctcctgggttcacgcccttctcctgcctcagcctcccgagtagctgggactacaggtgcccgccaccatgcccggctcattttttgtatttttagtagagacgggggtttcaccgtgttagccaggatggtctcsatctcctgacctcgtgatccgcccacctcggcctcccaaagtgctgggattacaggcatgagccactgcacccggccaaatcagtggcatgttcaaaagctgatgaacattttcctgcggagttttcaacatttctagggtgtggactacttgttttcctaaactcccatgcagttttccacttgaaaatcatttaataactgcccacttttagggcatttcatcagagagcctagagaagatgacgcaagtttaaggcaaaggacatcaacaggacagaaaagcatggcagtgaagaac

SEQ ID NO: 154550 - DNA, 601 bp, Human
atcgataagctaacaagcaaatgataggtgatatgaagaaactccaacaaagcactcagaatctttaactgaaaaagaagattctatcaaaaaacctcaagtaacacttcactaattaattgacagctggaattagggaaacaaatgagtcccacattttcttttaataaacacttctcaaatcatcttgttttctaagtgctttattttgttttaatatttttattattactattacaattttggagacagtctccctctgtcacccaggctggagtgcagtggctcaccgtaatcttcrcctcccggattcaaccgattctcctgcctcagccttccaagtagttgcgattacaggcccatgtcaccacgcccagctaatttttggattttattagagacagggtttcactatgttgcccaggctggtctcgaactcctgacctcaggtatccacctgcctcggcctcccaaagtgctgggattacaggcatgagcacatggccctaagtgctttagtatgtaaaccttcctactatcctcatgaagttgggacaaccagctttagaaaccacactttatgggccgggcatgacggctc

SEQ ID NO: 154551 - DNA, 601 bp, Human
gtatcgataagctaacaagcaaatgataggtgatatgaagaaactccaacaaagcactcagaatctttaactgaaaaagaagattctatcaaaaaacctcaagtaacacttcactaattaattgacagctggaattagggaaacaaatgagtcccacattttcttttaataaacacttctcaaatcatcttgttttctaagtgctttattttgttttaatatttttattattactattacaattttggagacagtctccctctgtcacccaggctggagtgcagtggctcaccgtaatctycacctcccggattcaaccgattctcctgcctcagccttccaagtagttgcgattacaggcccatgtcaccacgcccagctaatttttggattttattagagacagggtttcactatgttgcccaggctggtctcgaactcctgacctcaggtatccacctgcctcggcctcccaaagtgctgggattacaggcatgagcacatggccctaagtgctttagtatgtaaaccttcctactatcctcatgaagttgggacaaccagctttagaaaccacactttatgggccgggcatgacggc

SEQ ID NO: 154552 - DNA, 601 bp, Human
attttaatccttaagagcaggcagggagtcggactgggtgaaggtagagctattagttggacaattcccatatgtttctcccttgttctagctgtatttcaacagatgtgttgtggctttgtccccaaaactctaatgtcttttcctgtaactggcagcattagatgacatgatgtcatgtgacatgaggtgctagatttactttaggcctggtggaaatattttctgaacacctcttagcaaggcagcaaaatgttttattcaaggaatgctcttgggaaaacgacccaatgtcctgtcmataactgttccatgggtatcgataagctaacaagcaaatgataggtgatatgaagaaactccaacaaagcactcagaatctttaactgaaaaagaagattctatcaaaaaacctcaagtaacacttcactaattaattgacagctggaattagggaaacaaatgagtcccacattttcttttaataaacacttctcaaatcatcttgttttctaagtgctttattttgttttaatatttttattattactattacaattttggagacagtctccctctgtcacccaggctggagtgcagt

SEQ ID NO: 154553 - DNA, 601 bp, Human
ggcctcccaaagtgctgagattacaggcttgagccaccgcgcccggcctttaactgccgtaatttaaaatgcttttatacggaggcaattttaatccttaagagcaggcagggagtcggactgggtgaaggtagagctattagttggacaattcccatatgtttctcccttgttctagctgtatttcaacagatgtgttgtggctttgtccccaaaactctaatgtcttttcctgtaactggcagcattagatgacatgatgtcatgtgacatgaggtgctagatttactttaggcctggyggaaatattttctgaacacctcttagcaaggcagcaaaatgttttattcaaggaatgctcttgggaaaacgacccaatgtcctgtcaataactgttccatgggtatcgataagctaacaagcaaatgataggtgatatgaagaaactccaacaaagcactcagaatctttaactgaaaaagaagattctatcaaaaaacctcaagtaacacttcactaattaattgacagctggaattagggaaacaaatgagtcccacattttcttttaataaacacttctcaaatcatcttgttttct

SEQ ID NO: 154554 - DNA, 601 bp, Human
gtcacaagcttcagatcagcctggtcaacatgatgaaaccccgtctctactgtaaatacaaaaattagccaggcatggtggcacacacttgtaatcccagctacgtgggaggctgaggcagaaggattgcttgaactcgggaggtggaggttgcagtgagccaaaattgcgccactacactccagcctgggcgaaagaggaagactctgtcccagcaaaaaaaaaaaaaagaacaatctaagaaccacaaagaaaggttctccaccttggtattactgtccgtaaaacaaactattgtgayaatcttgactctaaccacataacaagtgagtttgctaaaatatggacaaaaaaatagatttatgaaaaatatactatggagtatacgtatttattactcatgaaacatcaacagaacacccagacataggcaactgtaattaaattcactcatgtttgatattttgctgactttcagcaataaaacccatagctttaaacatgtttgttgattctgccctaatgacagatgtatttgtccaggcagagtagaagccattttatttaccaatttgtaagcatggtttataacttttaaatg

SEQ ID NO: 154555 - DNA, 601 bp, Human
aggctagtggatcaattgaggtcacaagcttcagatcagcctggtcaacatgatgaaaccccgtctctactgtaaatacaaaaattagccaggcatggtggcacacacttgtaatcccagctacgtgggaggctgaggcagaaggattgcttgaactcgggaggtggaggttgcagtgagccaaaattgcgccactacactccagcctgggcgaaagaggaagactctgtcccagcaaaaaaaaaaaaaagaacaatctaagaaccacaaagaaaggttctccaccttggtattactgtcygtaaaacaaactattgtgacaatcttgactctaaccacataacaagtgagtttgctaaaatatggacaaaaaaatagatttatgaaaaatatactatggagtatacgtatttattactcatgaaacatcaacagaacacccagacataggcaactgtaattaaattcactcatgtttgatattttgctgactttcagcaataaaacccatagctttaaacatgtttgttgattctgccctaatgacagatgtatttgtccaggcagagtagaagccattttatttaccaatttgtaagca

SEQ ID NO: 154556 - DNA, 601 bp, Human
acttccggaggccaaggctagtggatcaattgaggtcacaagcttcagatcagcctggtcaacatgatgaaaccccgtctctactgtaaatacaaaaattagccaggcatggtggcacacacttgtaatcccagctacgtgggaggctgaggcagaaggattgcttgaactcgggaggtggaggttgcagtgagccaaaattgcgccactacactccagcctgggcgaaagaggaagactctgtcccagcaaaaaaaaaaaaaagaacaatctaagaaccacaaagaaaggttctccaccwtggtattactgtccgtaaaacaaactattgtgacaatcttgactctaaccacataacaagtgagtttgctaaaatatggacaaaaaaatagatttatgaaaaatatactatggagtatacgtatttattactcatgaaacatcaacagaacacccagacataggcaactgtaattaaattcactcatgtttgatattttgctgactttcagcaataaaacccatagctttaaacatgtttgttgattctgccctaatgacagatgtatttgtccaggcagagtagaagccattttattta

SEQ ID NO: 154557 - DNA, 601 bp, Human
caggccatctctagacttagattaagaaaagaacaatctggccaggtggggtggctcacgcctgtaatcccagaacttccggaggccaaggctagtggatcaattgaggtcacaagcttcagatcagcctggtcaacatgatgaaaccccgtctctactgtaaatacaaaaattagccaggcatggtggcacacacttgtaatcccagctacgtgggaggctgaggcagaaggattgcttgaactcgggaggtggaggttgcagtgagccaaaattgcgccactacactccagcctgggcraaagaggaagactctgtcccagcaaaaaaaaaaaaaagaacaatctaagaaccacaaagaaaggttctccaccttggtattactgtccgtaaaacaaactattgtgacaatcttgactctaaccacataacaagtgagtttgctaaaatatggacaaaaaaatagatttatgaaaaatatactatggagtatacgtatttattactcatgaaacatcaacagaacacccagacataggcaactgtaattaaattcactcatgtttgatattttgctgactttcagcaataaaacccatag

SEQ ID NO: 154558 - DNA, 601 bp, Human
acaatgtcagtaactactgtcctgcctcagcaaagcaggccatctctagacttagattaagaaaagaacaatctggccaggtggggtggctcacgcctgtaatcccagaacttccggaggccaaggctagtggatcaattgaggtcacaagcttcagatcagcctggtcaacatgatgaaaccccgtctctactgtaaatacaaaaattagccaggcatggtggcacacacttgtaatcccagctacgtgggaggctgaggcagaaggattgcttgaactcgggaggtggaggttgcagtragccaaaattgcgccactacactccagcctgggcgaaagaggaagactctgtcccagcaaaaaaaaaaaaaagaacaatctaagaaccacaaagaaaggttctccaccttggtattactgtccgtaaaacaaactattgtgacaatcttgactctaaccacataacaagtgagtttgctaaaatatggacaaaaaaatagatttatgaaaaatatactatggagtatacgtatttattactcatgaaacatcaacagaacacccagacataggcaactgtaattaaattcactcatgttt

SEQ ID NO: 154559 - DNA, 601 bp, Human
aagaggataatttgaatatccctagcataaagataacaatttaaggtaatggatatgccaatgaccctgatgtgattatatgaaagcatcaaatgatcacatgtacctggaaaacgtaaatctaatatgaaaaattaacaataaatatttttttcaaagtttccaatttgggagaatttcaaattttggattttcagattacggatattcaacctggataatgaaactaaaatactttgtagtacttcttaaaatcaataatctatcatatgcaatctcattctttttttaatgtaaataktgctgtatgaatttcgctgacaatgtcagtaactactgtcctgcctcagcaaagcaggccatctctagacttagattaagaaaagaacaatctggccaggtggggtggctcacgcctgtaatcccagaacttccggaggccaaggctagtggatcaattgaggtcacaagcttcagatcagcctggtcaacatgatgaaaccccgtctctactgtaaatacaaaaattagccaggcatggtggcacacacttgtaatcccagctacgtgggaggctgaggcagaaggattgcttgaactc

SEQ ID NO: 154560 - DNA, 601 bp, Human
tacctaaaagaggataatttgaatatccctagcataaagataacaatttaaggtaatggatatgccaatgaccctgatgtgattatatgaaagcatcaaatgatcacatgtacctggaaaacgtaaatctaatatgaaaaattaacaataaatatttttttcaaagtttccaatttgggagaatttcaaattttggattttcagattacggatattcaacctggataatgaaactaaaatactttgtagtacttcttaaaatcaataatctatcatatgcaatctcattctttttttaatstaaatattgctgtatgaatttcgctgacaatgtcagtaactactgtcctgcctcagcaaagcaggccatctctagacttagattaagaaaagaacaatctggccaggtggggtggctcacgcctgtaatcccagaacttccggaggccaaggctagtggatcaattgaggtcacaagcttcagatcagcctggtcaacatgatgaaaccccgtctctactgtaaatacaaaaattagccaggcatggtggcacacacttgtaatcccagctacgtgggaggctgaggcagaaggattgct

SEQ ID NO: 154561 - DNA, 601 bp, Human
tttgagtgtcatttcggcactcagtagagtggctatggttaacattaactgattgtacatttcaaaatacctaaaagaggataatttgaatatccctagcataaagataacaatttaaggtaatggatatgccaatgaccctgatgtgattatatgaaagcatcaaatgatcacatgtacctggaaaacgtaaatctaatatgaaaaattaacaataaatatttttttcaaagtttccaatttgggagaatttcaaattttggattttcagattacggatattcaacctggataatgaaaytaaaatactttgtagtacttcttaaaatcaataatctatcatatgcaatctcattctttttttaatgtaaatattgctgtatgaatttcgctgacaatgtcagtaactactgtcctgcctcagcaaagcaggccatctctagacttagattaagaaaagaacaatctggccaggtggggtggctcacgcctgtaatcccagaacttccggaggccaaggctagtggatcaattgaggtcacaagcttcagatcagcctggtcaacatgatgaaaccccgtctctactgtaaatacaaaaa

SEQ ID NO: 154562 - DNA, 601 bp, Human
tggtgataaatcacaatatcagcaataatgactcacatagactgcctggttatctcttatccagaagtcttgctgccaaaagtgtttcagaatttggaatatttgcaagacaccagttcagcatccctaataaaaaatccaaactccaaaatgctccaaacagcattttctttgagtgtcatttcggcactcagtagagtggctatggttaacattaactgattgtacatttcaaaatacctaaaagaggataatttgaatatccctagcataaagataacaatttaaggtaatggatatsccaatgaccctgatgtgattatatgaaagcatcaaatgatcacatgtacctggaaaacgtaaatctaatatgaaaaattaacaataaatatttttttcaaagtttccaatttgggagaatttcaaattttggattttcagattacggatattcaacctggataatgaaactaaaatactttgtagtacttcttaaaatcaataatctatcatatgcaatctcattctttttttaatgtaaatattgctgtatgaatttcgctgacaatgtcagtaactactgtcctgcctcagcaaagca

SEQ ID NO: 154563 - DNA, 601 bp, Human
ccgtgtccggcctcagttttctttataacatacacagcattgaaaagttataaagaacctcagaaatacctgatttaagaaatggtgataaatcacaatatcagcaataatgactcacatagactgcctggttatctcttatccagaagtcttgctgccaaaagtgtttcagaatttggaatatttgcaagacaccagttcagcatccctaataaaaaatccaaactccaaaatgctccaaacagcattttctttgagtgtcatttcggcactcagtagagtggctatggttaacattaaytgattgtacatttcaaaatacctaaaagaggataatttgaatatccctagcataaagataacaatttaaggtaatggatatgccaatgaccctgatgtgattatatgaaagcatcaaatgatcacatgtacctggaaaacgtaaatctaatatgaaaaattaacaataaatatttttttcaaagtttccaatttgggagaatttcaaattttggattttcagattacggatattcaacctggataatgaaactaaaatactttgtagtacttcttaaaatcaataatctatcatatgcaa

SEQ ID NO: 154564 - DNA, 601 bp, Human
gcctcagccttcccaagtagctgggattacaggcgcctgctaccacatctggctaacttttgtatttttagtagagatgaggtttcaccttgttggccaggctggtctcgaactcctgacctcaggtgatccacccgcctcggcatcccaaagtgctgaggtaacaggcatgagccaccgtgtccggcctcagttttctttataacatacacagcattgaaaagttataaagaacctcagaaatacctgatttaagaaatggtgataaatcacaatatcagcaataatgactcacatagamtgcctggttatctcttatccagaagtcttgctgccaaaagtgtttcagaatttggaatatttgcaagacaccagttcagcatccctaataaaaaatccaaactccaaaatgctccaaacagcattttctttgagtgtcatttcggcactcagtagagtggctatggttaacattaactgattgtacatttcaaaatacctaaaagaggataatttgaatatccctagcataaagataacaatttaaggtaatggatatgccaatgaccctgatgtgattatatgaaagcatcaaatgatc

SEQ ID NO: 154565 - DNA, 601 bp, Human
tcctgcctcagccttcccaagtagctgggattacaggcgcctgctaccacatctggctaacttttgtatttttagtagagatgaggtttcaccttgttggccaggctggtctcgaactcctgacctcaggtgatccacccgcctcggcatcccaaagtgctgaggtaacaggcatgagccaccgtgtccggcctcagttttctttataacatacacagcattgaaaagttataaagaacctcagaaatacctgatttaagaaatggtgataaatcacaatatcagcaataatgactcacayagactgcctggttatctcttatccagaagtcttgctgccaaaagtgtttcagaatttggaatatttgcaagacaccagttcagcatccctaataaaaaatccaaactccaaaatgctccaaacagcattttctttgagtgtcatttcggcactcagtagagtggctatggttaacattaactgattgtacatttcaaaatacctaaaagaggataatttgaatatccctagcataaagataacaatttaaggtaatggatatgccaatgaccctgatgtgattatatgaaagcatcaaat

SEQ ID NO: 154566 - DNA, 601 bp, Human
tgcagtggcacgatctctgctcactgcaagctccgcctcccaggttcacgccattctcctgcctcagcctcccaaatagctgggactacaggtgcccaccaccacacctgactaattttttgtattttttagtagagacaggttttcaccgtgttagtcaggatggtctcgatctcctgacctcgtgatccgcctgcctcggcctcccaaagtgctgggattacaggcatgagccactgcacccggcctatcacttactattaataatattagcaaaagtttcccaaaacccaaacagaartaatttggccattacacttaacaaatgttttgaataattttagagaaaacttttcctcaatcagaaaggacctggatgtgaaacatgcaacaaaagtaataattgaagaaaatatttaaaaatcagaatgaaataaaacatctgcatgactgagaaggaaaagattcacatagacctaatccccaaacatttcacatagaccattttctggccaatatgcattatggtacacgcattacggtatactcctgggttgcccaggcaacagagtaagtaagagtaggtggtgcaatctcggct

SEQ ID NO: 154567 - DNA, 601 bp, Human
cacacccctgcacatcaaaatggcaaaaaaataagtaaatatgcagaaactcctcaaataaagtacaaatcatggtcgtgggtggaaagtgatattaactttgaatttctattggcaggagttatttggtatcaactatcactttatcactttttttttttttttttttgagacagagtctcactttgtcacccaggctggagtgcagtggcacgatctctgctcactgcaagctccgcctcccaggttcacgccattctcctgcctcagcctcccaaatagctgggactacaggtgcccrccaccacacctgactaattttttgtattttttagtagagacaggttttcaccgtgttagtcaggatggtctcgatctcctgacctcgtgatccgcctgcctcggcctcccaaagtgctgggattacaggcatgagccactgcacccggcctatcacttactattaataatattagcaaaagtttcccaaaacccaaacagaaataatttggccattacacttaacaaatgttttgaataattttagagaaaacttttcctcaatcagaaaggacctggatgtgaaacatgcaacaaaagt

SEQ ID NO: 154568 - DNA, 601 bp, Human
gttttctagaaacaacctaaaattgtcatataattgatgatacagccacaggaagaatgggcagactactcttggaccctcacacccctgcacatcaaaatggcaaaaaaataagtaaatatgcagaaactcctcaaataaagtacaaatcatggtcgtgggtggaaagtgatattaactttgaatttctattggcaggagttatttggtatcaactatcactttatcactttttttttttttttttttgagacagagtctcactttgtcacccaggctggagtgcagtggcacgatctckgctcactgcaagctccgcctcccaggttcacgccattctcctgcctcagcctcccaaatagctgggactacaggtgcccaccaccacacctgactaattttttgtattttttagtagagacaggttttcaccgtgttagtcaggatggtctcgatctcctgacctcgtgatccgcctgcctcggcctcccaaagtgctgggattacaggcatgagccactgcacccggcctatcacttactattaataatattagcaaaagtttcccaaaacccaaacagaaataatttggccattacac

SEQ ID NO: 154569 - DNA, 601 bp, Human
atgtagtgtattttcacctggcactaaactcttcttttttttttttgaggcggaatctcgctccgtcgcccaggtggagtgcagtggcacgatctcagctcactgcaagctccgcctcctgggttcatgccattctcctgcctcagcctcccaagtagctgggactacaggtgcccaccaccacgcccggctaatttttttgtatttttagtagagatggggtttcactgtgttagccaggatggtctcgatctcctgacctcgtgatccacccgtctcggcctcccaaagtgctgggatyacaggcatgagccaccacacccggccacctggcactaaactcttatttcaaagtccagaaagatttcctaggttaataaataataagccttaaacacgcccatacacacacacacacacacacacacacacacacacaccctaacatcctggccacctaacatgtgaaccaccacgacatagtaactgttgttgcctagggttaactcacaaggatactaaaatgcaaagaaataaaaatcaaaaaattggccaagtgcgatggcttgcacttataatcccagcactttaggaggccaaa

SEQ ID NO: 154570 - DNA, 601 bp, Human
gtgattcaaggccagggaggctgctcagaatcctaccatatgcaggacggccaccaccgccctcacccaccactgcaacaaagactgatctagccaaaaacgtaaagggggccgggcacagcagctcccacctgtaatcctagcattttgggaggctgaggcaggtggatcacctgaggtcaggagttcgagaccaccctggccaacatggtaaaccccatctctactaaaaatacaaaaattagccaggcgtggtggtgcgtgcctgtaatcccagctactcgggaggctgaggcaggcraatcactggaacccgggaggcagaggctgcagtgagccaagatcccaccactgcactccagcctgggtgacagagcaagactccgtctcaaaaaaaaaaaaaaatcaagggtgccagggttcagaagatctgaaaaaagggcacatgtgcccacatctgagaatccgagggggaaaacttccagagggctgcacaccttggcccttagctccaagccgcctgcaatgatcagataatcagatgttaagagaatccagcttgtgatagcaaagtttcagagagataaaacaacaacagtaa

SEQ ID NO: 154571 - DNA, 601 bp, Human
aaaaaaaacgaaaacagtggagatgaggaagatcgaaaaaatactatcaagtttcatctgtggccttaagagtatagacatgatacagttgttctcaactgggagcaattttgcctcctagtgatgtctgaagacagttggttgtcacaaccaggaggtgagggtatgatcctggcatctagtgattcaaggccagggaggctgctcagaatcctaccatatgcaggacggccaccaccgccctcacccaccactgcaacaaagactgatctagccaaaaacgtaaagggggccgggcacrgcagctcccacctgtaatcctagcattttgggaggctgaggcaggtggatcacctgaggtcaggagttcgagaccaccctggccaacatggtaaaccccatctctactaaaaatacaaaaattagccaggcgtggtggtgcgtgcctgtaatcccagctactcgggaggctgaggcaggcaaatcactggaacccgggaggcagaggctgcagtgagccaagatcccaccactgcactccagcctgggtgacagagcaagactccgtctcaaaaaaaaaaaaaaatcaagggtgccaggg

SEQ ID NO: 154572 - DNA, 601 bp, Human
aggtgacagagcgatactccatctcaaaaaataacataagataaaataaaataaaataaaataaaataaacgtataccagaataacaccatccaagatatatgtgggagaaggcagcagatgtaatttaccttgacataacttgacatgccctcaaagctttgcgagagaatacgaccttctttttcctagtggagaacaactgtcagtttaattactcagtataataaatatttctctaacactctagggaaaggaactaaaaaagcacttagggggtgaggggtctgagaacggggacmaatgaaagccttagcgcagtggttccagctggccaggaatattctaactaggctgaacaactgaacacatgactcagacagtaaataatgattgtaaatgcccaaaccttatggggagagtttggatcccaaagaataaaatttccacactgataaatgtgtggtctcccacacatttactactgtgaaaggccattaggaaacagtagatctggtggaattcagggtctggaaaaaagaaaaggaaaaagaaaaaaaaaaaaaacgaaaacagtggagatgaggaagatcgaaaaaata

SEQ ID NO: 154573 - DNA, 601 bp, Human
aagatcgcaccactgcactccagcctaggtgacagagcgatactccatctcaaaaaataacataagataaaataaaataaaataaaataaaataaacgtataccagaataacaccatccaagatatatgtgggagaaggcagcagatgtaatttaccttgacataacttgacatgccctcaaagctttgcgagagaatacgaccttctttttcctagtggagaacaactgtcagtttaattactcagtataataaatatttctctaacactctagggaaaggaactaaaaaagcacttagrgggtgaggggtctgagaacggggaccaatgaaagccttagcgcagtggttccagctggccaggaatattctaactaggctgaacaactgaacacatgactcagacagtaaataatgattgtaaatgcccaaaccttatggggagagtttggatcccaaagaataaaatttccacactgataaatgtgtggtctcccacacatttactactgtgaaaggccattaggaaacagtagatctggtggaattcagggtctggaaaaaagaaaaggaaaaagaaaaaaaaaaaaaacgaaaacag

SEQ ID NO: 154574 - DNA, 601 bp, Human
ataggccgggtgcggtggctcacgcctgtaatcccagcactttgggaggctgaggtgggcgaatcacttgaagtcaggagttccagaccagcctgaccaacatggtgaaagcccatctctactaaaatacaaaaattagttggggcgtggtggtgggcgcctgtaatcccagctactcggcaggctgaggcaggagaattgcttgaacctgagaggtggaagttgcagtgagccaagatcgcaccactgcactccagcctaggtgacagagcgatactccatctcaaaaaataacataagataaaataaaataaaataaaataaaataaacgtataccagaataacaccatccaagatatatgtgggagaaggcagcagatgtaatttaccttgacataacttgacatgccctcaaagctttgcgagagaatacgaccttctttttcctagtggagaacaactgtcagtttaattactcagtataataaatatttctctaacactctagggaaaggaactaaaaaagcacttagggggtgaggggtctgagaacggggaccaatgaaagccttagcgcagtggttccagctggccaggaat

SEQ ID NO: 154575 - DNA, 601 bp, Human
aggtgagcccaagggactgtcatggaacagttctatattgtgactgctggtggttgtacaagtctacacatgtgataacactgttcagaatcacacacacataaaaaatgcatgtatgcaaaactggtgaaacatgaataaggcctgtagactgcaggaatgtcaatttcctgattttgacactgtattttgttatgtaagatgccaccaccagggaatggcaggtacacagaaagggcctctctgtactatttgggtgacttctgaatctagacttctttttaaaatggataccagaatwggccgggtgcggtggctcacgcctgtaatcccagcactttgggaggctgaggtgggcgaatcacttgaagtcaggagttccagaccagcctgaccaacatggtgaaagcccatctctactaaaatacaaaaattagttggggcgtggtggtgggcgcctgtaatcccagctactcggcaggctgaggcaggagaattgcttgaacctgagaggtggaagttgcagtgagccaagatcgcaccactgcactccagcctaggtgacagagcgatactccatctcaaaaaataacataagata

SEQ ID NO: 154576 - DNA, 601 bp, Human
agaaaaaagaagtaggtgctgggggttagagggagggaggctggggtgccaccaaaggtgagcccaagggactgtcatggaacagttctatattgtgactgctggtggttgtacaagtctacacatgtgataacactgttcagaatcacacacacataaaaaatgcatgtatgcaaaactggtgaaacatgaataaggcctgtagactgcaggaatgtcaatttcctgattttgacactgtattttgttatgtaagatgccaccaccagggaatggcaggtacacagaaagggcctctctstactatttgggtgacttctgaatctagacttctttttaaaatggataccagaataggccgggtgcggtggctcacgcctgtaatcccagcactttgggaggctgaggtgggcgaatcacttgaagtcaggagttccagaccagcctgaccaacatggtgaaagcccatctctactaaaatacaaaaattagttggggcgtggtggtgggcgcctgtaatcccagctactcggcaggctgaggcaggagaattgcttgaacctgagaggtggaagttgcagtgagccaagatcgcaccact

SEQ ID NO: 154577 - DNA, 601 bp, Human
aataacaaaactatagagaaggagaaaaaagaagtaggtgctgggggttagagggagggaggctggggtgccaccaaaggtgagcccaagggactgtcatggaacagttctatattgtgactgctggtggttgtacaagtctacacatgtgataacactgttcagaatcacacacacataaaaaatgcatgtatgcaaaactggtgaaacatgaataaggcctgtagactgcaggaatgtcaatttcctgattttgacactgtattttgttatgtaagatgccaccaccagggaatggcargtacacagaaagggcctctctgtactatttgggtgacttctgaatctagacttctttttaaaatggataccagaataggccgggtgcggtggctcacgcctgtaatcccagcactttgggaggctgaggtgggcgaatcacttgaagtcaggagttccagaccagcctgaccaacatggtgaaagcccatctctactaaaatacaaaaattagttggggcgtggtggtgggcgcctgtaatcccagctactcggcaggctgaggcaggagaattgcttgaacctgagaggtggaagttgc

SEQ ID NO: 154578 - DNA, 601 bp, Human
gcaaaggcactgagtgaagaaagtccgtctcaaaagaatatgtactgatcgattccatttatacaatactctcaaataacaaaactatagagaaggagaaaaaagaagtaggtgctgggggttagagggagggaggctggggtgccaccaaaggtgagcccaagggactgtcatggaacagttctatattgtgactgctggtggttgtacaagtctacacatgtgataacactgttcagaatcacacacacataaaaaatgcatgtatgcaaaactggtgaaacatgaataaggcctgtaractgcaggaatgtcaatttcctgattttgacactgtattttgttatgtaagatgccaccaccagggaatggcaggtacacagaaagggcctctctgtactatttgggtgacttctgaatctagacttctttttaaaatggataccagaataggccgggtgcggtggctcacgcctgtaatcccagcactttgggaggctgaggtgggcgaatcacttgaagtcaggagttccagaccagcctgaccaacatggtgaaagcccatctctactaaaatacaaaaattagttggggcgtggtg

SEQ ID NO: 154579 - DNA, 601 bp, Human
ccagctactcgggaggctgaggcaggagaatcacttgaacccaggaggcggagactgcggtaagctgagattgtgccactgcactccagcctggcaacagagcgacattcagtctcaaaaaagaaaaaaaattagctgggcttggtggcacatgcctgtaaacccagctgcttgggagtctgaggcaggagaatcacttgaacccgggaggcagagactgcagtgaaccgacattgcgccactgcactccagcctgagtgacagagcatgactccatctcaaaaaagcaaataagataaacaaaataaataaaagtgttcctgaacaatgcaatattacttaataataaaaaaggaacaaaaccggcacgtgtaccaacatggatgggcggcaaaggcactgagtgaagaaagtccgtctcaaaagaatatgtactgatcgattccatttatacaatactctcaaataacaaaactatagagaaggagaaaaaagaagtaggtgctgggggttagagggagggaggctggggtgccaccaaaggtgagcccaagggactgtcatggaacagttctatattgtgactgctggtggttgtaca

SEQ ID NO: 154580 - DNA, 601 bp, Human
agtcccagctactcgggaggctgaggcaggagaatcacttgaacccaggaggcggagactgcggtaagctgagattgtgccactgcactccagcctggcaacagagcgacattcagtctcaaaaaagaaaaaaaattagctgggcttggtggcacatgcctgtaaacccagctgcttgggagtctgaggcaggagaatcacttgaacccgggaggcagagactgcagtgaaccgacattgcgccactgcactccagcctgagtgacagagcatgactccatctcaaaaaagcaaataagataaacaaaataaataaaagtgttcctgaacaatgcaatattacttaataataaaaaaggaacaaaaccggcacgtgtaccaacatggatgggcggcaaaggcactgagtgaagaaagtccgtctcaaaagaatatgtactgatcgattccatttatacaatactctcaaataacaaaactatagagaaggagaaaaaagaagtaggtgctgggggttagagggagggaggctggggtgccaccaaaggtgagcccaagggactgtcatggaacagttctatattgtgactgctggtggttg

SEQ ID NO: 154581 - DNA, 601 bp, Human
cctgatacttctaaatatccccggtgaggcaaaagtgcctccagttgagaactaccattctatgcaaaccagtaactctagcaggacatggtgggtcatgcctgtattcccagcactttgggaggctgagaggggaggagaggatcactggaacccagaagttcaagaccagccagggcaacacagggagacccatctctacaaaaaaaaaaaggaaaaaaaaaagaaaaaatcagatgggcatggtggcacacatctgtagtcccagctactcaaaaggccgaacgggggagaatctctygagcccaggaggtccggggtatagtgagctgtgattgcatcactgcactccggcctaggcaaaaaagcaagaccctgggtccaaaaaaaaagtaattctaacctatgtatccatcccttgataacttccaggctacatactttacaacaaagaatatttctgctgatctaaccatgctagccactttctttttaaactacagaatacgtattccataggaataaaaaatattagcagctgccaagtagcaccaccttaactaaatcacagccttcaaaagctggtttaaatgtaaaccat

SEQ ID NO: 154582 - DNA, 601 bp, Human
gattcatcactgtggctggcaagaaaacaataggcttgatgaaaattaagaagaaaaaccacacacttactcatcaaaattgggagaaacggaaaagaaaaaagatatgaattcactggtaaaggttcacgtaccccattcaaagaggctgcctcttgcattatcagggttggtaacaaaaatgttggtaattaactaaaataattagatgacacgaagaggtccaaagaatatagtgtagattgctaacgtcagccccttcaatctttctttcatctcagaaatatacaaatcaggtccrtattgtctgttccttcgcttcttaggatcagtggaaactcaaagttgagaaggcctagaaataaaaatggcttaatatcccaactattaaccaatgctgcagaaatcaatgttggaataaataaaacaaacatataactatagatctagatatttaatataaccaagttgtactaaatataatgccggtattaaaattaataaaaatcagattaatgcatcattcacacacaccccgaagagtacactatggaaattactttaggaataatgattttatttagaaaatgcagcatattaa

SEQ ID NO: 154583 - DNA, 601 bp, Human
gcctgctgattcaactgccctcaccaagcttttagagtgattcatcactgtggctggcaagaaaacaataggcttgatgaaaattaagaagaaaaaccacacacttactcatcaaaattgggagaaacggaaaagaaaaaagatatgaattcactggtaaaggttcacgtaccccattcaaagaggctgcctcttgcattatcagggttggtaacaaaaatgttggtaattaactaaaataattagatgacacgaagaggtccaaagaatatagtgtagattgctaacgtcagccccttcwatctttctttcatctcagaaatatacaaatcaggtccgtattgtctgttccttcgcttcttaggatcagtggaaactcaaagttgagaaggcctagaaataaaaatggcttaatatcccaactattaaccaatgctgcagaaatcaatgttggaataaataaaacaaacatataactatagatctagatatttaatataaccaagttgtactaaatataatgccggtattaaaattaataaaaatcagattaatgcatcattcacacacaccccgaagagtacactatggaaattacttt

SEQ ID NO: 154584 - DNA, 601 bp, Human
tcctgcctgaagatttgatgagagcagcaagggtgtgaacctataagcagccttccatttattttcagcaaataaaaaagttttgcctgctgattcaactgccctcaccaagcttttagagtgattcatcactgtggctggcaagaaaacaataggcttgatgaaaattaagaagaaaaaccacacacttactcatcaaaattgggagaaacggaaaagaaaaaagatatgaattcactggtaaaggttcacgtaccccattcaaagaggctgcctcttgcattatcagggttggtaacamaaatgttggtaattaactaaaataattagatgacacgaagaggtccaaagaatatagtgtagattgctaacgtcagccccttcaatctttctttcatctcagaaatatacaaatcaggtccgtattgtctgttccttcgcttcttaggatcagtggaaactcaaagttgagaaggcctagaaataaaaatggcttaatatcccaactattaaccaatgctgcagaaatcaatgttggaataaataaaacaaacatataactatagatctagatatttaatataaccaagttgtactaaat

SEQ ID NO: 154585 - DNA, 601 bp, Human
ctcctgcctgaagatttgatgagagcagcaagggtgtgaacctataagcagccttccatttattttcagcaaataaaaaagttttgcctgctgattcaactgccctcaccaagcttttagagtgattcatcactgtggctggcaagaaaacaataggcttgatgaaaattaagaagaaaaaccacacacttactcatcaaaattgggagaaacggaaaagaaaaaagatatgaattcactggtaaaggttcacgtaccccattcaaagaggctgcctcttgcattatcagggttggtaacmaaaatgttggtaattaactaaaataattagatgacacgaagaggtccaaagaatatagtgtagattgctaacgtcagccccttcaatctttctttcatctcagaaatatacaaatcaggtccgtattgtctgttccttcgcttcttaggatcagtggaaactcaaagttgagaaggcctagaaataaaaatggcttaatatcccaactattaaccaatgctgcagaaatcaatgttggaataaataaaacaaacatataactatagatctagatatttaatataaccaagttgtactaaa

SEQ ID NO: 154586 - DNA, 601 bp, Human
agggtcagctaatgctcagcaaattatccacttagtaaattcatttcaccgtcaacagatagtggtgcagactcgtgttctaacaaattaaatatcccattcggagttctgaggagtctttttaagttattcccaatcaataagaaaagcacacatgacactaaagctcctctagaaagatggctcatttctcttccaatgtcaaaaagccatgaagtaaaaaaaaaaaaaaaaaaaaaaatcagattacattaaattacttgctttttttctcctcttgctaggaagggaaaagaggagwggagaagcatggaaagaactcactcctaaatcacagattaaatccaggaagtttaagatgatccaatttcatttccctcctgcctgaagatttgatgagagcagcaagggtgtgaacctataagcagccttccatttattttcagcaaataaaaaagttttgcctgctgattcaactgccctcaccaagcttttagagtgattcatcactgtggctggcaagaaaacaataggcttgatgaaaattaagaagaaaaaccacacacttactcatcaaaattgggagaaacggaaaagaaaa

SEQ ID NO: 154587 - DNA, 601 bp, Human
cacgtcagggtcagctaatgctcagcaaattatccacttagtaaattcatttcaccgtcaacagatagtggtgcagactcgtgttctaacaaattaaatatcccattcggagttctgaggagtctttttaagttattcccaatcaataagaaaagcacacatgacactaaagctcctctagaaagatggctcatttctcttccaatgtcaaaaagccatgaagtaaaaaaaaaaaaaaaaaaaaaaatcagattacattaaattacttgctttttttctcctcttgctaggaagggaaaasaggagaggagaagcatggaaagaactcactcctaaatcacagattaaatccaggaagtttaagatgatccaatttcatttccctcctgcctgaagatttgatgagagcagcaagggtgtgaacctataagcagccttccatttattttcagcaaataaaaaagttttgcctgctgattcaactgccctcaccaagcttttagagtgattcatcactgtggctggcaagaaaacaataggcttgatgaaaattaagaagaaaaaccacacacttactcatcaaaattgggagaaacggaaa

SEQ ID NO: 154588 - DNA, 601 bp, Human
catcgctgaagtctcattaccgacccatcaagcccagatttccaccatgaaccatctccagagaccttcgttccgccacgtcagggtcagctaatgctcagcaaattatccacttagtaaattcatttcaccgtcaacagatagtggtgcagactcgtgttctaacaaattaaatatcccattcggagttctgaggagtctttttaagttattcccaatcaataagaaaagcacacatgacactaaagctcctctagaaagatggctcatttctcttccaatgtcaaaaagccatgaagtaaaaaaaaaaaaaaaaaaaaaaatcagattacattaaattacttgctttttttctcctcttgctaggaagggaaaagaggagaggagaagcatggaaagaactcactcctaaatcacagattaaatccaggaagtttaagatgatccaatttcatttccctcctgcctgaagatttgatgagagcagcaagggtgtgaacctataagcagccttccatttattttcagcaaataaaaaagttttgcctgctgattcaactgccctcaccaagcttttagagtgattcatcactgtggctgg

SEQ ID NO: 154589 - DNA, 601 bp, Human
tctttctgctgagtctactacttttgttttgcctatttgtaaatactaatttttctagccccagatatgtctttcctacatttaagggagtcctagacaaaacatgccttccactgggtaccccagacatgaaaataaccttgagatttaatcactgcctagtatgggatcgtatcgcactagaaaaagtccaaatattttataaggtcactgccagtccttggaaccggcaagccacctggccgtgagagcagtgataagctcttgagacatcaacttgtaagagaagaaatgaacacasaagctctgggggagccaagaaacttgggatcccatctggctgtgggactttgcaagggtggaactttcgcagctgattagaaattaatattgtaatatacatacatcacaagattaaaagtataaccttaaataaacggaaatttcccagaaatgccaaagtcaccagcagcaaagaaaaaggctctggattcatgaacaagctcttcaaagctgggcaagggacttacatcttggggtgaagattctgtctacaaaatgaagaggtgagaatagatgatcgctaatggccaactgcaaa

SEQ ID NO: 154590 - DNA, 601 bp, Human
accttaatgttccagcatggtactgcaagctgggccaagggttcaaggtggcatttcttcctacagtacctacgggaagctgggtagagaccagggtgttttataggaagtgcgggcggcttggctgagtgcccactgccagagccagctctgccgatcccaacagctggccatgccgccttccttcgctgccattccacatgattcctgcctgtgacaaacttcccaaggaccttcaggagcttctgctggaatacactaagaagcctgcaagcccattcttataagaacctaacatgcrttatcagtatcagatagcggtcagcagaacagatcaatatgccccatgacctcactgggatcagtgatatctgacagaacctacgtggcccacctatgccactgttaattctgcagacctgttctttctgctgagtctactacttttgttttgcctatttgtaaatactaatttttctagccccagatatgtctttcctacatttaagggagtcctagacaaaacatgccttccactgggtaccccagacatgaaaataaccttgagatttaatcactgcctagtatgggatcgtatcgc

SEQ ID NO: 154591 - DNA, 601 bp, Human
atactacactcagccccttttatgggatttcagttaagacaagaaacaatacaacacagctaacctgggctcctccctggaaacacacctgaagataccaacttcagtggtggggcaggaaaagcaaaggaacatgagcaagtctgtccgatcctgaccaaatgataaagaccttaatgttccagcatggtactgcaagctgggccaagggttcaaggtggcatttcttcctacagtacctacgggaagctgggtagagaccagggtgttttataggaagtgcgggcggcttggctgagtrcccactgccagagccagctctgccgatcccaacagctggccatgccgccttccttcgctgccattccacatgattcctgcctgtgacaaacttcccaaggaccttcaggagcttctgctggaatacactaagaagcctgcaagcccattcttataagaacctaacatgcgttatcagtatcagatagcggtcagcagaacagatcaatatgccccatgacctcactgggatcagtgatatctgacagaacctacgtggcccacctatgccactgttaattctgcagacctgttctttctg

SEQ ID NO: 154592 - DNA, 601 bp, Human
gatactacactcagccccttttatgggatttcagttaagacaagaaacaatacaacacagctaacctgggctcctccctggaaacacacctgaagataccaacttcagtggtggggcaggaaaagcaaaggaacatgagcaagtctgtccgatcctgaccaaatgataaagaccttaatgttccagcatggtactgcaagctgggccaagggttcaaggtggcatttcttcctacagtacctacgggaagctgggtagagaccagggtgttttataggaagtgcgggcggcttggctgagygcccactgccagagccagctctgccgatcccaacagctggccatgccgccttccttcgctgccattccacatgattcctgcctgtgacaaacttcccaaggaccttcaggagcttctgctggaatacactaagaagcctgcaagcccattcttataagaacctaacatgcgttatcagtatcagatagcggtcagcagaacagatcaatatgccccatgacctcactgggatcagtgatatctgacagaacctacgtggcccacctatgccactgttaattctgcagacctgttctttct

SEQ ID NO: 154593 - DNA, 601 bp, Human
gacctggatcacgtgggatactacactcagccccttttatgggatttcagttaagacaagaaacaatacaacacagctaacctgggctcctccctggaaacacacctgaagataccaacttcagtggtggggcaggaaaagcaaaggaacatgagcaagtctgtccgatcctgaccaaatgataaagaccttaatgttccagcatggtactgcaagctgggccaagggttcaaggtggcatttcttcctacagtacctacgggaagctgggtagagaccagggtgttttataggaagtgcrggcggcttggctgagtgcccactgccagagccagctctgccgatcccaacagctggccatgccgccttccttcgctgccattccacatgattcctgcctgtgacaaacttcccaaggaccttcaggagcttctgctggaatacactaagaagcctgcaagcccattcttataagaacctaacatgcgttatcagtatcagatagcggtcagcagaacagatcaatatgccccatgacctcactgggatcagtgatatctgacagaacctacgtggcccacctatgccactgttaattctg

SEQ ID NO: 154594 - DNA, 601 bp, Human
tctgagctccaagaacaacaggccaggcaaagactagaccaccatgtggcaagagagggaggaggttaggatacagttgctcgagacaaaaagacaagaaggagagggagccaagaggcaccaggaggaggaatgacctggatcacgtgggatactacactcagccccttttatgggatttcagttaagacaagaaacaatacaacacagctaacctgggctcctccctggaaacacacctgaagataccaacttcagtggtggggcaggaaaagcaaaggaacatgagcaagtctgtccratcctgaccaaatgataaagaccttaatgttccagcatggtactgcaagctgggccaagggttcaaggtggcatttcttcctacagtacctacgggaagctgggtagagaccagggtgttttataggaagtgcgggcggcttggctgagtgcccactgccagagccagctctgccgatcccaacagctggccatgccgccttccttcgctgccattccacatgattcctgcctgtgacaaacttcccaaggaccttcaggagcttctgctggaatacactaagaagcctgcaagcccatt

SEQ ID NO: 154595 - DNA, 601 bp, Human
agaggaaaaaaaaaatcatgcttggcatttaaaggtgctaaaaactcaaagacaaagatacaagccactgccaaaattctcttaacactcctgtcaggtcattttaaaaaatcaaatcttgagtaatagtcaagtctcctctagcaataaagcacagagatgcatagttggtaatgctagaaggaatccaagcctttagggtatgaattgcatatgaacatttcaaactacaatcttctgcttctccttgtatatacgtgtatggctgtctaaagctcaagactgaatgattaattttggytttcaccctggtatcgcagaatttccttcttctcaagtttgtgaatgaagtcacttttgcaaaactgcatctgccactgtggaggtggccagtgcccagagtgccagggaaggctggcagtggaagacaggctactgacctgcctgcttacagaaacacagccaaccccaggcagtggacaaagcaagcgtaggtgtgcaatgtggggtttgggtgtggctaggagcctgcaacatcttgagtcagaacaagagagacaagtgagaaccaggatacgtaagtatgagctgaagttcagaa

SEQ ID NO: 154596 - DNA, 601 bp, Human
ccagcagtttaggaggccgaggtgggtggatcacctgaggtcaggagttcgagaccagcctggccaacatggtgaaaccccatctctactaaaaatacaaaaattagccgggtgtggtggtgggcacctgtaatcccagctacttgggaggctgaggcagaattgctttaacctgggaggcggaggttgcagtgagccaagatcatgccattgcacttcagcctgggcaacaagaacgaaattccgtctccaaaaaaaaaaattaggttgtttgtttgtttgtttgtttttaagctcatcrgtcgtcttattgttagtgttagtatattttatgtgtggctcaagacaactcttcttccaatgtggcccagggaagccaaaagattggacaccctgatctaaagactttaagccacagccaagttttgttcggcccactaggtaaaaaccaaaacattttatgttacttgtcaacattttgcaaattgcaacatttcacagaaatctaggtttctgatctctctttaacaactagaaggcctggcaacactgagccctaattcttccaggtcagtgagctccggtgagccacagtccccac

SEQ ID NO: 154597 - DNA, 601 bp, Human
gtcttagaccaacaacaacaacaaaaattggccagccgcggtggctcatgcctgtaatcccagcagtttaggaggccgaggtgggtggatcacctgaggtcaggagttcgagaccagcctggccaacatggtgaaaccccatctctactaaaaatacaaaaattagccgggtgtggtggtgggcacctgtaatcccagctacttgggaggctgaggcagaattgctttaacctgggaggcggaggttgcagtgagccaagatcatgccattgcacttcagcctgggcaacaagaacgaaaytccgtctccaaaaaaaaaaattaggttgtttgtttgtttgtttgtttttaagctcatcagtcgtcttattgttagtgttagtatattttatgtgtggctcaagacaactcttcttccaatgtggcccagggaagccaaaagattggacaccctgatctaaagactttaagccacagccaagttttgttcggcccactaggtaaaaaccaaaacattttatgttacttgtcaacattttgcaaattgcaacatttcacagaaatctaggtttctgatctctctttaacaactagaaggcct

SEQ ID NO: 154598 - DNA, 601 bp, Human
tactgaattgtacatttagaaaaggttaattttgttatatgaatctcaccttaaaaaataaaatttttaaaaatcagagctgaaaatcctgaaacaatccagtttgtctttgtttttgtttcttttttccctgtttacatccaggaaatttgagttgagtccagaaagactgacttgcccaagtttgcacagctgacaaatgaccaggtcagagatccacccaggtcttctgccctttattccatagtgtgacatctataaaatgggaatcataatttgttcttcatagagttggaaggamcacgtgaaaatgatgtgaaaatacctataacaatgtcctacactaaaggggctctcagatattttattataattagtaaaaactagtaatagaaactaaactacctaatgctttttcagtgctcactaggcatccatcactcctctaagcatttttaatgcattcaccatttcattccctagcgaccctgcgggatgggtacagttaagattaaacccatattacaaaagggagcctgaggcacagcatgggggtgtggcttccccaaggtcatatccccagcaagcatcagagcagtgt

SEQ ID NO: 154599 - DNA, 601 bp, Human
tgtggtggtgcacgcctgtaatcccagaaatcaggaggctgaggcagcagaatcgcttgaacccaggagacggaagttgcagtgagctgagatcacaccactgcactccagcccagccaacagagcgaaactccaactcaaaaaaaaaaaaaaaaaccatcagaccttgtgagacttatttaccatcactattgcgagaacagcacagaaaaaccctgcccccgtgattcaattaccttccactgggtccctccaacgacacatggggattatgggagctacaattcaagatgagatttgrgttgggacacagccaaaccacatcagacatgatttgtttagccctaccaagtcgcatgttgacatctgatccccagtgatggaggcgggcctggtgggaagtgttcatgatcgtgggggcagatccctcatgaatagcttgcaggaactcattcttacagggaagagtgaattctcactcttagttcctatgagaactggttgttgaaaagagcctggcactctcccctctctattgcttcctctctcaccgtgtgatctgcatacggagactcctctttggcttttgctctgagtggaa

SEQ ID NO: 154600 - DNA, 601 bp, Human
gggaggccgaggtgggcggatcacgaggtcaggagttcgagaccagcctgaccacatggtgaaaccttgcctctactaaaaatacaaaaaattagccagctgtggtggtgcacgcctgtaatcccagaaatcaggaggctgaggcagcagaatcgcttgaacccaggagacggaagttgcagtgagctgagatcacaccactgcactccagcccagccaacagagcgaaactccaactcaaaaaaaaaaaaaaaaaccatcagaccttgtgagacttatttaccatcactattgcgagaayagcacagaaaaaccctgcccccgtgattcaattaccttccactgggtccctccaacgacacatggggattatgggagctacaattcaagatgagatttgagttgggacacagccaaaccacatcagacatgatttgtttagccctaccaagtcgcatgttgacatctgatccccagtgatggaggcgggcctggtgggaagtgttcatgatcgtgggggcagatccctcatgaatagcttgcaggaactcattcttacagggaagagtgaattctcactcttagttcctatgagaactgg

SEQ ID NO: 154601 - DNA, 601 bp, Human
cctttataaaaccatcaaattggccaggtgcggtggctcacgcccgtaatcccagaactttgggaggccgaggtgggcggatcacgaggtcaggagttcgagaccagcctgaccacatggtgaaaccttgcctctactaaaaatacaaaaaattagccagctgtggtggtgcacgcctgtaatcccagaaatcaggaggctgaggcagcagaatcgcttgaacccaggagacggaagttgcagtgagctgagatcacaccactgcactccagcccagccaacagagcgaaactccaactcaaaaaaaaaaaaaaaaaccatcagaccttgtgagacttatttaccatcactattgcgagaacagcacagaaaaaccctgcccccgtgattcaattaccttccactgggtccctccaacgacacatggggattatgggagctacaattcaagatgagatttgagttgggacacagccaaaccacatcagacatgatttgtttagccctaccaagtcgcatgttgacatctgatccccagtgatggaggcgggcctggtgggaagtgttcatgatcgtgggggcagatccctcatgaatagct

SEQ ID NO: 154602 - DNA, 601 bp, Human
cttgaagacattatgcccagtgaaagcagccaaacacaaaaggtcacctattgtgtgactacatttacatgaaatatccagaacagataattccatagagacagaaagcaacttggaggttgtcaggggctgggaagaagggagaataaggagtgactgctgaacaggtgctatgtcttggacattgtattagtccattttcatactgctatgaagaaatacctgagactgggtaatttataaagaaaaagaggtttaatggactcacagttccacatgggtggagaggcctcacaatcayggcagaaggtgaaggaggtgcaaagggcatgtcttacatggtggcaggtaagagggcatgtccaggggaactgccctttataaaaccatcaaattggccaggtgcggtggctcacgcccgtaatcccagaactttgggaggccgaggtgggcggatcacgaggtcaggagttcgagaccagcctgaccacatggtgaaaccttgcctctactaaaaatacaaaaaattagccagctgtggtggtgcacgcctgtaatcccagaaatcaggaggctgaggcagcagaatcgcttgaaccca

SEQ ID NO: 154603 - DNA, 601 bp, Human
aagaaagaaagaaaagcatctatattcaggaacccacaagaacatcgccatttctggtagccacttgaaacattttatatcctgtttctttacttgcctctttgttaacttttatttattaaatgttggagccaggattcaaaactgaagtaattccagggcacacgctcttgtaattatactacactgcctctcaaatgggaggcagagaatgagccaacaaaggaaaccaaaaataatggtttcagcacaacagactcagaagacccaaggagaaggcatccaacactatggaaaagamtaaaagtccccactgatcaccaagtctgctgatcaacaggtcacgggagattgcatttccctttagagtgatttattgaaaaaaagaaaaaaaaggttacacaaaaggacaatttcatccatcctgaaatgagcccgggcactaacaatgtccgaaaggattatgcagacaatattaaaaaatatttttcattacaggatttacataaggagacatatgcttcctctttaagaaactacccacagaatacacaactcactgtgggaaaagggcaagcaaagtgtatttatggtttggttt

SEQ ID NO: 154604 - DNA, 601 bp, Human
gtcccagctactcgggaagctgaggcaggagaatcacttgaacccggaaggtggaggttgcagtgagccaagaacatgccactgcactccagcctgggcgacagaatgagactccatctcaaaaaaaagaaaagaaagaaagaaagaaaagcatctatattcaggaacccacaagaacatcgccatttctggtagccacttgaaacattttatatcctgtttctttacttgcctctttgttaacttttatttattaaatgttggagccaggattcaaaactgaagtaattccagggcacaygctcttgtaattatactacactgcctctcaaatgggaggcagagaatgagccaacaaaggaaaccaaaaataatggtttcagcacaacagactcagaagacccaaggagaaggcatccaacactatggaaaagaataaaagtccccactgatcaccaagtctgctgatcaacaggtcacgggagattgcatttccctttagagtgatttattgaaaaaaagaaaaaaaaggttacacaaaaggacaatttcatccatcctgaaatgagcccgggcactaacaatgtccgaaaggattatg

SEQ ID NO: 154605 - DNA, 601 bp, Human
tctagagagaagagagctactgcttcttcaggcccaggaacatcccacctggaaacaactttaaatcattaactaccaagggctggatgtcagaagccagcatggccaaaaccactttagcatcatcatctctccaacttcctccttctctatgcctatctcgaaggtcactgcaatcactaggttggccaaaaaggacagtctcaacactttcatcccccacatccaagaagtgccagaagttacccttctgcagtaatgtctcctgacccatccccttgcctctcaagccccttggctratgtggagaagaaagaaaagtatctggccaggcacggtggctcacgcctgtaatccgagcactttgggaggccgaggcgggtggatcacctgaggtcaggagatcgagaccatcctggctaacacgatgaaaccccgtctctactaaaaatacaaaaaaattagccaggcatgatggcacacgcctatagtcccagctactcgggaagctgaggcaggagaatcacttgaacccggaaggtggaggttgcagtgagccaagaacatgccactgcactccagcctgggcgacagaatgaga

SEQ ID NO: 154606 - DNA, 601 bp, Human
aggccgaggcgggcagatcaagaagtcaggagatcgagaccatcctggctaacacggtgaaaccccgtctctactaaaaattcaaaaaattagccgggcgtggtagcgggcacctgcagtcccagctactcgggagcctgaggcaagagaatggcgtgaacccaggaggcggagcttgcagtgagccgagatcacaccactgcactccaggctgggcgacagagcaagactccatctcaaaaaaaaagaagtgtgttgtgaaagtttagtagaagaaactcagtttacttattcctctacmtcctcagagctcagattgctgagtttaatactgggactaaatcacccaaagcacaaactatatcagaacaacccagtgcctctactcagtgagtcttgcatatgtaacacaccgaacatcaggcagcaaatctcgcttgatgcggagggcacgctgcatcccttgttctagagatggtatggcgaactgtaagctacccagcacacaggtggcttcccaagcttctgaaggaaagcacctccaagaatggactcggtattccacaaagactcaacctcccatccttgtctgggctcattc

SEQ ID NO: 154607 - DNA, 601 bp, Human
ctcaacctgtggggtctgacgccgggtagacagtgtcagaactgaactgaatgaggggacgcccagctggtgtctgctgcagaactgattgcttgcctggtgtctggggaacccctcaccccacaacatctggtgtcagcagtgtgttgtgaggctgggcgcggtggctcacgcctgtaatcccagcactttgggaggccgaggcgggcagatcaagaagtcaggagatcgagaccatcctggctaacacggtgaaaccccgtctctactaaaaattcaaaaaattagccgggcgtggtarcgggcacctgcagtcccagctactcgggagcctgaggcaagagaatggcgtgaacccaggaggcggagcttgcagtgagccgagatcacaccactgcactccaggctgggcgacagagcaagactccatctcaaaaaaaaagaagtgtgttgtgaaagtttagtagaagaaactcagtttacttattcctctacctcctcagagctcagattgctgagtttaatactgggactaaatcacccaaagcacaaactatatcagaacaacccagtgcctctactcagtgagtcttgcatatgt

SEQ ID NO: 154608 - DNA, 601 bp, Human
gcaggagaatcacttgaacctgggaggcggaggttgcatgcagcgagctgagatcgtgccattgcactccagcctggcgacagagcaagactccatttcaaaaataataataataataatgctcccatcttacagacatgggaaacgaggcatggagcagataaagaacttgcccacggtcccagagctaacaggtggtaaacgggttcagtttttctcctctttttgaaatagctttactgattggctttcataagccactttcctattaatattttacaaatgcagataataagcatcmgtccacaaagcagctaagaggttaaataagggaacaaatattagaaaatagtccagcctagcacctggcatagagaactgctcaacagcctgaaaaaggaatagaagccagcctgctctcaaacagtttaatcagagaaaaaccttgtaaataacagaaagtggccataataaagtgcagagaggaatgacataagaagtgcacataaaatacaaagggagattatgggcttagatgggagtgaggacctgcgttccatgagctgaagtatttgaaaatgacaggctgggttgtggggta

SEQ ID NO: 154609 - DNA, 601 bp, Human
ccccttgcttaaaatcttttttattctaacaaaattcctccggagcagcctgtagactgtgcatgatctggctcctgcctgcccctccagcgttgtctcagcccccctctcccgagactcttctcagctctcacccaggctgagctcattctcaccccagcctgttgctttgccagcaacaccaatgcatcctctggcttcggcattcacatacattacctcctctcagaggccctcgctggcctgctgggcgcccctcctccgtcagtcagcttgctgcatgtacctttgtccccaggtrccagccctccctgccagaccacccgtgctggttctactctccatcccagcacacaaggtggtgcccagcaaagaaggcaggaaggaggatttccaacaacccaagaacctggtgaacttcagtataaactccacccatctggaaactttgccagaagagcgtatttgtctcttaccagccctgccctattaacaatgaccttcacctttcgcgtccaactcacttccccaagcttacctctacggcatttaaataggtgagaagactccttttacagattctacagttcccatttataga

SEQ ID NO: 154610 - DNA, 601 bp, Human
aatctagtgcaacatccacttatctccacggcctccatttacaggctaccctgacagctctccctgcgggtgtgccgtcatgggctacaagatctagcgtgattgtaggggggcagagccaaaagggttgaaacccctccaagaggtttgtttaaaatgcaagagtatcctagaaaaagtagcaacagcaaacaatgcctaagtggctagcagaattcagaaccattctcgccaaccaactgcttttgagcatttcaagagtgttactcaaactctgcggaccctaatcatctcaagaacyccttgaactcttttgttctaagaaagagctggtctgcaggcctgcgtgccctcttgctgtcatcaaccccaggctgggagataagcactgctggcaggtaggagggtcccagcagctggaccaagtatggacagttctacttggggaaaagcagcgagaatgaccacaagcagctcacagggccccagggataaagctttcgggagcccccaggtcagcgtctttcaaccagagttgctgggcagaaataaggcaagccacatatgtaattttaaattttctaataatcacattaaaaaa

SEQ ID NO: 154611 - DNA, 601 bp, Human
gaaagaccagtcattttaaaagataccatttaaaaattattttagaagttcccacagaagtatacataacaaaactggcttgctaagtaaatatcgcctgaaatttacacttcgtaaaaaaaaaaaaaaaaagtcctttatcagcatgattcagaaactctgcaacgccaccacagatactccaataaaataccacagcatcctagtccaagacatccaagacctatgcaaagacgtacgccctactggtgtttgaaacaagcatccctagatgaacccacgtaaaaatctgtgttgaagygcataccttggcttttcaaagggcaataaatcttccttgcagacttctacagaatgcagatgtgctgctctctctcaccaacaccagcaaactggaaggcctcctgagtcccacggtctaaactctttgttctctgtgcaaatgccacagaggtttgtcaacagacaatgaaaatctagtgcaacatccacttatctccacggcctccatttacaggctaccctgacagctctccctgcgggtgtgccgtcatgggctacaagatctagcgtgattgtaggggggcagagccaaaagggt

SEQ ID NO: 154612 - DNA, 601 bp, Human
ggaaatcatataaattttctgtcaaggaaacaacgcattgctcctgagtaatctactacaaaatgctggtatatacacctctgtggctatgatttattccaataattaatgctcactgcaattcaagtatttgttttgaaactgtttagttgaaagaccagtcattttaaaagataccatttaaaaattattttagaagttcccacagaagtatacataacaaaactggcttgctaagtaaatatcgcctgaaatttacacttcgtaaaaaaaaaaaaaaaaagtcctttatcagcatgaytcagaaactctgcaacgccaccacagatactccaataaaataccacagcatcctagtccaagacatccaagacctatgcaaagacgtacgccctactggtgtttgaaacaagcatccctagatgaacccacgtaaaaatctgtgttgaagtgcataccttggcttttcaaagggcaataaatcttccttgcagacttctacagaatgcagatgtgctgctctctctcaccaacaccagcaaactggaaggcctcctgagtcccacggtctaaactctttgttctctgtgcaaatgccaca

SEQ ID NO: 154613 - DNA, 601 bp, Human
aggaaggaaggaaagaaggaaatcatataaattttctgtcaaggaaacaacgcattgctcctgagtaatctactacaaaatgctggtatatacacctctgtggctatgatttattccaataattaatgctcactgcaattcaagtatttgttttgaaactgtttagttgaaagaccagtcattttaaaagataccatttaaaaattattttagaagttcccacagaagtatacataacaaaactggcttgctaagtaaatatcgcctgaaatttacacttcgtaaaaaaaaaaaaaaaaartcctttatcagcatgattcagaaactctgcaacgccaccacagatactccaataaaataccacagcatcctagtccaagacatccaagacctatgcaaagacgtacgccctactggtgtttgaaacaagcatccctagatgaacccacgtaaaaatctgtgttgaagtgcataccttggcttttcaaagggcaataaatcttccttgcagacttctacagaatgcagatgtgctgctctctctcaccaacaccagcaaactggaaggcctcctgagtcccacggtctaaactctttgttc

SEQ ID NO: 154614 - DNA, 601 bp, Human
gaagaaggcaggcaggcaggaaggaaggaaagaaggaaatcatataaattttctgtcaaggaaacaacgcattgctcctgagtaatctactacaaaatgctggtatatacacctctgtggctatgatttattccaataattaatgctcactgcaattcaagtatttgttttgaaactgtttagttgaaagaccagtcattttaaaagataccatttaaaaattattttagaagttcccacagaagtatacataacaaaactggcttgctaagtaaatatcgcctgaaatttacacttcgtaaaaaaaaaaaaaaaaagtcctttatcagcatgattcagaaactctgcaacgccaccacagatactccaataaaataccacagcatcctagtccaagacatccaagacctatgcaaagacgtacgccctactggtgtttgaaacaagcatccctagatgaacccacgtaaaaatctgtgttgaagtgcataccttggcttttcaaagggcaataaatcttccttgcagacttctacagaatgcagatgtgctgctctctctcaccaacaccagcaaactggaaggcctcctgagtcccacg

SEQ ID NO: 154615 - DNA, 601 bp, Human
aagaccagcctggacaatactgtgagaccttatctctatatttaaagaaatggtcttggccaggcacggtggctcatgcctgtaatcccagcactttgggaggcctaggtgggtggatcaacggaggtcaggagttggagaccagcctggccaacacggtgaaaccctgtctctactaaaaatacaaaaattagctgggcatggtagcacatgcctgtaatcacacctacacaggaggctgaggcagaactgcttgaacccaggaggcagaggctgcagtgagccgagatcgtgccactgygctccagcctgggcaacaaagcaaggctccatctcaaaaaaaagaaaagaaaaaggaaagaaatggtctagaaaggaggctctcacccctgtctttacagcagaatcagacagtacccaggcaccaatccagctgtgcagaagtggaatgacaggagctggatcttagcagcccccccaggattctggggtgcagtggggtggcagggcactcctgcactgagccagtgctccagagggtgaggtcagggccttctgggtggttaccaaaaacacaagggtgccttccccacctcttgtc

SEQ ID NO: 154616 - DNA, 601 bp, Human
agttattcattacttgagatctctctgcacaaaatgagttgacacctagcttatctgatacataacacaaaaagatcacatgagacggctaaccaaaatgcttcaagccatggggttgccgggcacggtggctcacgactgtaatcccagcattgtgggaggctaaggaaggcaggtcacttgaactcaggagttcaggatcagcctgggcaacatggtgagacccccgtcactacaaaaaaattcaaaaattagctgggcatggtggcatgcgcctatagtccaagctacttggaaggtkgaggtgagagagtctcctgaaccaaggaggcggaagttacagtgagccaagactgcgccactgcactccagcctgggtgacagagcgagagcctatctcaaacacaaacaaacaaacaaaagatgccataggtcttcaacccaacaaagcagtacctgtatttggggtcttgctgctggcaccttactgggtcacatccagatggctttcagccctcatattgctttaatttaactctcctctcaaggccttgctacagaaccaaagaatgcacaggcctcgttcaaccaacgcaccaca

SEQ ID NO: 154617 - DNA, 601 bp, Human
atcatatttatatcatttgtattatgggaggcagaaatggattttacttgctgtggaatcctcagcacctagaacagggccagacttattgctccgttgaatggtaaatgcatctacagaaaccatgctaccaagagagagaggcagggctgctggaaggtttcagtatgaggttacagaaatggcactgggtgctcccctagaagacagggactcaagctccagctcttctacccatagctcagcacagttattcattacttgagatctctctgcacaaaatgagttgacacctagcttrtctgatacataacacaaaaagatcacatgagacggctaaccaaaatgcttcaagccatggggttgccgggcacggtggctcacgactgtaatcccagcattgtgggaggctaaggaaggcaggtcacttgaactcaggagttcaggatcagcctgggcaacatggtgagacccccgtcactacaaaaaaattcaaaaattagctgggcatggtggcatgcgcctatagtccaagctacttggaaggttgaggtgagagagtctcctgaaccaaggaggcggaagttacagtgagccaaga

SEQ ID NO: 154618 - DNA, 601 bp, Human
taaaaagcacagaggtaaactatgcccactctaatgcccttcctatctgttctctctgttccatagggaataattacataatataaacaataggccaggccaggcaatggtgactcatgcctggaatcccagcacttttgagaggctgaggtgggaggatcgtttgagctcagaagtttgagactagcctgggcaatatggcaaaaccctgtttctgcaaaaaacataaaaattagctgggcatggtggcacatgcctgtagtcccaactactcagcaggctgaggtgggaggatggcttragcccaagaggcggaggttgcagtgaggtgtgattgtgcctctgcactccagcctgggtgacagggcaagaccctgcctcaaaatttaaaaaaatttaaaaaaaaaaaaaaaaaaccagcctggccaacatggtgaaaccccatctctattaaaaatacaaaaattagctaagcatggtggtgggtgcctgtaatcccaggcagtcgggaggctgaggcaggagaattgcttgaacccaggaggcggaggttgcggtgagccgagatcacgccactatactccagcctgggcaacacagc

SEQ ID NO: 154619 - DNA, 601 bp, Human
tgaattaaataaaatagttctggctctaaaaagcacagaggtaaactatgcccactctaatgcccttcctatctgttctctctgttccatagggaataattacataatataaacaataggccaggccaggcaatggtgactcatgcctggaatcccagcacttttgagaggctgaggtgggaggatcgtttgagctcagaagtttgagactagcctgggcaatatggcaaaaccctgtttctgcaaaaaacataaaaattagctgggcatggtggcacatgcctgtagtcccaactactcrgcaggctgaggtgggaggatggcttaagcccaagaggcggaggttgcagtgaggtgtgattgtgcctctgcactccagcctgggtgacagggcaagaccctgcctcaaaatttaaaaaaatttaaaaaaaaaaaaaaaaaaccagcctggccaacatggtgaaaccccatctctattaaaaatacaaaaattagctaagcatggtggtgggtgcctgtaatcccaggcagtcgggaggctgaggcaggagaattgcttgaacccaggaggcggaggttgcggtgagccgagatcacgcca

SEQ ID NO: 154620 - DNA, 601 bp, Human
gaggcctgcctgtgctcattaccataaagttcacagaccaatttgtcccatgtttttggtccttcccagctctctagtgcaccggatgggaaggatcgaatagcacccacattccttccccttatcctgcccacagtgtcaaactctgtcaccactaggaatagcagctttcatccagaggataacatgaaaagtttacgatagtaagaggtggagaggaaaagaaagcggtaaaaggtatcaccaacaatacactaatctttggtcaatgttccaaaggaaaagatacaaagattcaccrccatcccacacttccaatcaaaatcaaaaccaaaatgaactatgctaaatggcaggatgcctcaattataaatgtgtgattctgtaaagagtttattcccatagttatgggttccaacttgccaactgattgagtcctgagttttattattattattatttttagatggagtctagctccgccgcccaggctggaatgcagtggcatgatctcggcttactgcaatctctgccttctgggttcaagtgattctcctacctcagcctcccaagtagctggggctacaggtgcgcaccacca

SEQ ID NO: 154621 - DNA, 601 bp, Human
ttgccactgaagaccacagtgttccaaatactaataaacacacctaaaaaaaacacagtagggttgtaaactgaggcctgcctgtgctcattaccataaagttcacagaccaatttgtcccatgtttttggtccttcccagctctctagtgcaccggatgggaaggatcgaatagcacccacattccttccccttatcctgcccacagtgtcaaactctgtcaccactaggaatagcagctttcatccagaggataacatgaaaagtttacgatagtaagaggtggagaggaaaagaaagyggtaaaaggtatcaccaacaatacactaatctttggtcaatgttccaaaggaaaagatacaaagattcaccgccatcccacacttccaatcaaaatcaaaaccaaaatgaactatgctaaatggcaggatgcctcaattataaatgtgtgattctgtaaagagtttattcccatagttatgggttccaacttgccaactgattgagtcctgagttttattattattattatttttagatggagtctagctccgccgcccaggctggaatgcagtggcatgatctcggcttactgcaatct

SEQ ID NO: 154622 - DNA, 601 bp, Human
gggcacagtggctcctgactgtaatcccagcactctgggaggctgaggaaggcggatcacttgagatcaggagtttgacaccatcctggtcaacatggtgaaaccccgcctctactaaaaataccaaaattagctggatgtggtggcacgggcttgtaatctcagctacttgggagtctgaagcatgagaatcgcttgaaccagggaggcagaggttccagtgagccaagatcgtgccactgcactccagcatgggtgccagagcgagactccatctccaaaaaaaaaaaaaaaaacaaarcaaaaacaaaaaaacactattgccactgaagaccacagtgttccaaatactaataaacacacctaaaaaaaacacagtagggttgtaaactgaggcctgcctgtgctcattaccataaagttcacagaccaatttgtcccatgtttttggtccttcccagctctctagtgcaccggatgggaaggatcgaatagcacccacattccttccccttatcctgcccacagtgtcaaactctgtcaccactaggaatagcagctttcatccagaggataacatgaaaagtttacgatagtaaga

SEQ ID NO: 154623 - DNA, 601 bp, Human
atttgtaacactactgcggctgggcacagtggctcctgactgtaatcccagcactctgggaggctgaggaaggcggatcacttgagatcaggagtttgacaccatcctggtcaacatggtgaaaccccgcctctactaaaaataccaaaattagctggatgtggtggcacgggcttgtaatctcagctacttgggagtctgaagcatgagaatcgcttgaaccagggaggcagaggttccagtgagccaagatcgtgccactgcactccagcatgggtgccagagcgagactccatctccaaaaaaaaaaaaaaaaacaaagcaaaaacaaaaaaacactattgccactgaagaccacagtgttccaaatactaataaacacacctaaaaaaaacacagtagggttgtaaactgaggcctgcctgtgctcattaccataaagttcacagaccaatttgtcccatgtttttggtccttcccagctctctagtgcaccggatgggaaggatcgaatagcacccacattccttccccttatcctgcccacagtgtcaaactctgtcaccactaggaatagcagctttcatccagaggataacat

SEQ ID NO: 154624 - DNA, 601 bp, Human
catttctcaagcttgcctatgggctaaaagatcatttgtaacactactgcggctgggcacagtggctcctgactgtaatcccagcactctgggaggctgaggaaggcggatcacttgagatcaggagtttgacaccatcctggtcaacatggtgaaaccccgcctctactaaaaataccaaaattagctggatgtggtggcacgggcttgtaatctcagctacttgggagtctgaagcatgagaatcgcttgaaccagggaggcagaggttccagtgagccaagatcgtgccactgcactscagcatgggtgccagagcgagactccatctccaaaaaaaaaaaaaaaaacaaagcaaaaacaaaaaaacactattgccactgaagaccacagtgttccaaatactaataaacacacctaaaaaaaacacagtagggttgtaaactgaggcctgcctgtgctcattaccataaagttcacagaccaatttgtcccatgtttttggtccttcccagctctctagtgcaccggatgggaaggatcgaatagcacccacattccttccccttatcctgcccacagtgtcaaactctgtcaccac

SEQ ID NO: 154625 - DNA, 601 bp, Human
gatcacctgaggtcaggagttcaagaccagcctggccaacatgatgaaactccgtctctactaaaaatgcaaaaaattagctgggcgcagtggtgggtgcctgtaatcccagctacttgggaggctgggcaggagaatcacttgaacccggaggacagaggttgcagtgagccaagatcataccactgcactccagcccaggcaacagggcaagactctgtctcaacaaaaacaacaaaaaaaaacggcgggggttggggggtggtggcatcatcacaggtataaaatgagtatgacaaaygcagcgctaacgcgagccacaaggatgagggagcactgtgagctggggcacaaccctaagattcagaaatgaaggggaaggtgaaatctaagacttctcccctgcagagacagccaccctcagcaggggacctgaagtggtagcagccagtccccaagcatccctggacacccaggcatcccccatagcagtcggtggccttcataggtccttgccatagagtactcaaacagagtagggcacccacgacagctaaatgagtccctctgactcaattccttgtcttgagactacagggtt

SEQ ID NO: 154626 - DNA, 601 bp, Human
tcactccagcctgggagactctgtctccaaaaaataaaaataaaaaataaaaagacacagaggtcaaataactttgtaatgcataagataaattaatatggctatttaaatctgcagtaaattcaacagccaaaagaaagttttcctctttttgcctgcaatgactcagtgaagaagtcacctggtttaggagatctctaatgtagggcctagggagtggggatattggttcttgatgaactgcagaaacgggttgtgagcaccaaggacttaagcagcactttttctcctgttttcgtctttttttttttttccttctgttggaagtaggagttatctttccaacttaccagatgctttttttttctgattcttattactcaaagacacatcaaagcacacgtggcttttataacatgaagttgtaatacaagtttctccacctcggtgctattgacattgtggactagatgattctttgttggggactgcaggatcattctagttgagaatcactattctagagtaatacagtgttctagagccatggccaaactgaaggtgtttacaaaaccattcactgtcagtgacctagttaatt

SEQ ID NO: 154627 - DNA, 601 bp, Human
ggactttaaataccattctgtacagcatgttctaattacaggttcacgaaaaagagaacattctttagccaaacatacaacttagtctcagccccggaacagggcactgtgcctgctcatctcccacagctgtttctctcgcctatgttaagtacctcagttcaggattctctggccacctacatgacaaactcaaaatttgctcttgaaatgtgatctgctttttcctttttaaagatgcagagggctggcacagtgcctcatgcctgtaatcccagcactctgggagaccgaggcaggyggattacccgagcccaaaagtttgagaccagcctgggcatcctggagagaccctgtctcttattttaaaaatgcaaaaaataagccaggcgtggtggtgcatgcctgtggtctcagctacttgggaggctgaggtgggaggatcacctgaggctgggaagtaaagggtactgtgagccatgattgcaccacctcactccagcctgggagactctgtctccaaaaaataaaaataaaaaataaaaagacacagaggtcaaataactttgtaatgcataagataaattaatatggctattta

SEQ ID NO: 154628 - DNA, 601 bp, Human
attgacacacaaagttgctgacctctgctttaagataaagaggatagtatcaccatcacaaattttaacctcctgttgcccttttaaaaactattacatttctcttctgatttcaaaaatgattttctttcctgaactctgattgaaaaaataagtttaaaaataagttagagaaacaaccctaaaaagagatgacagtggactttaaataccattctgtacagcatgttctaattacaggttcacgaaaaagagaacattctttagccaaacatacaacttagtctcagccccggaacasggcactgtgcctgctcatctcccacagctgtttctctcgcctatgttaagtacctcagttcaggattctctggccacctacatgacaaactcaaaatttgctcttgaaatgtgatctgctttttcctttttaaagatgcagagggctggcacagtgcctcatgcctgtaatcccagcactctgggagaccgaggcaggcggattacccgagcccaaaagtttgagaccagcctgggcatcctggagagaccctgtctcttattttaaaaatgcaaaaaataagccaggcgtggtggtgca

SEQ ID NO: 154629 - DNA, 601 bp, Human
ccagagtaggaaagcccaatcacatttctgtaactgagcaacagaggtgttgagaaacatatcaaaaccaccacaaccccataatgatgaaattcaagggccatgttgaattcattaagtctctgctctccagtaacatagactagaggggctaacagaccacgcaggagacttgcccaagctaatctaaggatgaggttgtgatggattgtaccatggtgtcattgtggacaattatccccttccctggaagaaaatcataaaaccctggccaacggcctcctgcttggtgatacctccycatctggcccattcatcacctattatctatgactccttcccactccaatggcaaagtgaagctgctgcacaaggcctaaaatattgacacacaaagttgctgacctctgctttaagataaagaggatagtatcaccatcacaaattttaacctcctgttgcccttttaaaaactattacatttctcttctgatttcaaaaatgattttctttcctgaactctgattgaaaaaataagtttaaaaataagttagagaaacaaccctaaaaagagatgacagtggactttaaataccattct

SEQ ID NO: 154630 - DNA, 601 bp, Human
gctcactgcaagctctgcctcccaggttcacgccattctcctgcctcagcctcctgagtagctgggactacaggtgcccaccaccacgcctggctaattttttgtatttttagtagagacgaggtttcaccgtgttagccaggatggtcttgatctcctgaccttgtgatccacccgcctcggcctcccaaagtgctgggattacaggtgtgagccaccgcgcccggccatcatttttaaaaaattgttttcccagcctacgtatttctcaaatgcacatgaacattcttaaccattccasagtaggaaagcccaatcacatttctgtaactgagcaacagaggtgttgagaaacatatcaaaaccaccacaaccccataatgatgaaattcaagggccatgttgaattcattaagtctctgctctccagtaacatagactagaggggctaacagaccacgcaggagacttgcccaagctaatctaaggatgaggttgtgatggattgtaccatggtgtcattgtggacaattatccccttccctggaagaaaatcataaaaccctggccaacggcctcctgcttggtgatacctccccat

SEQ ID NO: 154631 - DNA, 601 bp, Human
ctgactttatcaaatgttggtgaggatgtagagaaactgagaatgtaaaatggtacatctgctttggaaaatggtttggcaatttcttaaaaagctaaacataatcttatcatatatgtcccaacaatttaactcctagttgtttactcaaaaaaaaatttttttaagtcttgtgtgcaaatattcatagcagcaatattcttaccagcaaaaatactggaaacaattcaaaggtctagtaactggtatagagatactcagaataaatccatacaatgagactcctcagttatttaaattaaaaaaaaaaatcactgatacattcaccaacaaagatggaccatacacatcatggtaagtgaaagaagccagatacaaaaggctacatattgtgtggttccgtttatatgaagtttctggaaaaggcaaatccatagacacagacaatagatgaatggctacccagagctgggtgcgggagggacagtgactgagtgaaaaaggtggaaatctgtcctaacactgccctgtggtgatggctgcacaattatatacatgtgctgaaaatcattctactgggcacctataatgggtgaatttc

SEQ ID NO: 154632 - DNA, 601 bp, Human
gaggcaataccgtccctttcttcaaacgtaaggttcacagaggttccattttctactgccaacaatgatttcctggatataataaaaggggctgactttatcaaatgttggtgaggatgtagagaaactgagaatgtaaaatggtacatctgctttggaaaatggtttggcaatttcttaaaaagctaaacataatcttatcatatatgtcccaacaatttaactcctagttgtttactcaaaaaaaaatttttttaagtcttgtgtgcaaatattcatagcagcaatattcttaccagcaaaaatactggaaacaattcaaaggtctagtaactggtatagagatactcagaataaatccatacaatgagactcctcagttatttaaattaaaaaaaaaaatcactgatacattcaccaacaaagatggaccatacacatcatggtaagtgaaagaagccagatacaaaaggctacatattgtgtggttccgtttatatgaagtttctggaaaaggcaaatccatagacacagacaatagatgaatggctacccagagctgggtgcgggagggacagtgactgagtgaaaaaggtggaaa

SEQ ID NO: 154633 - DNA, 601 bp, Human
gagtgggaaagaaaaatttgcccaccgtatgcaaactattacattcagtcattgttaaataaggctgataatttaatacattatataggcaacctagcatatggaaaaggctcacaatttgattaaaaaattgcctttataagcaggtggaacaagtttgatcataacatacacattttattaaaacgtggacaagtttgcatcttaatttctgagacaaatatgtgagtgttaatataatggctaaaaatttttctgtacataatcaccagaaatgtttctgcaatataaagcacttatrcataaattcctatccccctttgaactttaaagcaatcctataagacagagaggcaataccgtccctttcttcaaacgtaaggttcacagaggttccattttctactgccaacaatgatttcctggatataataaaaggggctgactttatcaaatgttggtgaggatgtagagaaactgagaatgtaaaatggtacatctgctttggaaaatggtttggcaatttcttaaaaagctaaacataatcttatcatatatgtcccaacaatttaactcctagttgtttactcaaaaaaaaatt

SEQ ID NO: 154634 - DNA, 601 bp, Human
tcactagcattgttttcattaaaaaggatttcacacacctgtttcccaatcaaaattgtctatttagtaagaatgaaattgagattatgcaacattatcaaattaatataaactgtcagcaggattaatatgtacccttttggcttccacaggccatccagaacatattttttcactccagcgtgcagtttctttgacttagcatctcactgtgggtctctttaccctttcgtttgaaagtactacaaaagccctttgttgacacagtgctttatgatcaaatacacagttcagctcctgyagtccaaaggtcttctccaacaggtgtgaagaactgctgataagcaacttttacaaaatccagcccagatttcaaatccacagcccattggccagttttcctaggtctatcacaaacagctgtcttccacaggtgggaagggaaatgcattcaaaacaccccctttgttctttgaaaaagtattaactggcaattttcatagaatcggaattgcaaagttaaactgctgaaataggtattttttacatagattgttcctggtgctttctctgagaccccaatctttctacttccactcta

SEQ ID NO: 154635 - DNA, 601 bp, Human
catgtcagggactgcaatatttgaaagcttttaaatatacacctcccaacacacatacacgcccatgctcgcagcaatgaaaatgttcaaagtgatataaggcaagaacttttactcattaggttaaaatcaggaaacaataactcccagtgtaactccaacccagaacccctagtccaaagctttctgtgtattgtgaccatcactagcattgttttcattaaaaaggatttcacacacctgtttcccaatcaaaattgtctatttagtaagaatgaaattgagattatgcaacattatsaaattaatataaactgtcagcaggattaatatgtacccttttggcttccacaggccatccagaacatattttttcactccagcgtgcagtttctttgacttagcatctcactgtgggtctctttaccctttcgtttgaaagtactacaaaagccctttgttgacacagtgctttatgatcaaatacacagttcagctcctgcagtccaaaggtcttctccaacaggtgtgaagaactgctgataagcaacttttacaaaatccagcccagatttcaaatccacagcccattggccagttt

SEQ ID NO: 154636 - DNA, 601 bp, Human
tctttctcaagcaaagaacaaatcttcgcaaagcatcatccacaggctttactatccacaagtgtgactgagagtcccatcagacatagaaggcaaagagggactaagaaaatagtagctagcccctgtgttctcaccatgcaactgatttaggtggattacgtcatttgagatgatgaagcaggcactatgaccattcccattttacagatggagaaccagaggcctagaggtaaactaacttgcccagcatcacaaagactgagcgagtgcatgacaggcagttgggctccagaaaccrgaagtttaactaggtctcaacaagccttcaccctctttgagaactcttcagaaactaatggctcccattctcttaggtcaaagtccggtacacttgcccacttggaggacattagaccactcccttgactcctacttataccaaaatccatgtgtaaactggactctccaaaagaggaactgaagtttctaatatttatcagaactcagtccaccagcacaaattttgttaggattacatgagacacctaatgaacttcaaagttcaggattgtatcttaaaagatggcaacttccagat

SEQ ID NO: 154637 - DNA, 601 bp, Human
agaaagtaacaagttaatcagtcagcaaatatcatatacttgaacttttgctcaaattacttgcatcctctacttctgatagctgaaaaagatgaaagaaggcagaaaagatacccaggagggaaaccaggccagtgccatgcccttctgtccccacactagttggaatatttgctgtgttccatttgagagaactgtattgtatctattacacacacatggtttacattctacattcccactgggattttgaattatcacttaggaaaaaaatgtaaagcgtgtgtatgtgtaggggggycaagcacacatgccctgggcacgaatagctacaaagcagaccatggatgttgggaagctgcagggacttgttctcacctgaccatagtctgtccggaagacgacgatgccttctgcacaggaatttacagtacttggaaaatgctggccattttctctcagccagacccgtgttccctgtaaacaaaacaaacaagactgaactgagtttggattgcattttgtggcgaaactgtactgtcgaaattaccctaactcctatattcctttaaaaaaaatcttcttgaaaagtaaatgtctt

SEQ ID NO: 154638 - DNA, 601 bp, Human
ttaactacagcttatcaaatcaagaactaagaatggttccaccaagtagaccgcccctgctaagaagttttgataaccaagtagcccgtctgcctcaaattatggaaactggccctgaagcttttattctcaacacaacaacttacaaactcaattcataaactatgtggttttggccagggatggtggctcactttgggaggccaaggtgggcagatcactcgaggtcaggagttcaagaccagcctggccaacatggtgaaatgaaaccccatctctactaaaaatacaaaaattagtygggtgtggtggcaggcacctgtaatgtcagctactcaggaggctgaggcaggagactcacttgaacccaggaggcgaaggttacagtgaaccaagatggtaccactgcactccaggctgggcaacagagcaagaatccatctcagaaaataaaaaaataaataaaaataaaaacataaactatgtgttttagatccttgcatttgactatcttttatttccttaagtcttaaattttaatatgtacctctgaggtagaggccaatttataacattaaattagtttccttagtaaaatgga

SEQ ID NO: 154639 - DNA, 601 bp, Human
caatagaggaaaacccaagctctagtccaaaaaaaattgtgtatttattcattttcctttcaattcaaacgtgggtatttgccgaagaaactagtaatagcaaatccttcagacacccagcagaaaaagtgaaaaccccaaaaggaatacaaatgttacagctgtgagcaaatgcacatacgcaacggcaccagcgttaaagctggcagactattttagggatacgctttgcctctcaactggactgcggaaaaacatttgtattttgttgagccatactgtcatcagacagaagagtcaycagaaaaatcctatctttgagccatgaacaacagatcaatgataagctaaaagataccacattaaaatggagggccattaacttgctattaggctgaaccatatgtgattgccgatctctaaccctttatggcctctagaaacggcaatttcatatggttcacaggaacccagaggttaattgggttggaggcagcagttgcaatacaagagacatgtaagactcaggggctacagccatgatgcaaatgacctcctgtttctttcctcttgagagaaaaaggggtaagatgtctccact

SEQ ID NO: 154640 - DNA, 601 bp, Human
acaaaaattagccaggcttggtggcacacacctgcagtcccagctacttggcagactgaggtggggggattgctttagcctgggaggcggaggttgcagcgagccaagattgtaccactgcactctagcctgggtgacaaagtgagaacctgtctccaaaaccaaacaaacaaaaactcccaccatgattcttctgctatgtggctattttttttttttttttttgtcacttgtggtccttttaagacttgtaacttccttatgaaaatgccatatgatcacagtcttaatgaagcatgcrccattctgatgacttatttggcttcatgctgattacaaatggagcttcattcatccattcagtgttcattataaggggcctctctgggccaggctcggctccgaggtgctgatgacaagtccccattctaagagaccttggtgaggagagacagaaaaaaatctaacacacacacatgatacaggtggtggctctttgaaagggggcctgaataggtgtgtgaatacacaccttgtattcagagccttgtgtattcagctagagcctgcatatttgcgttcgtgcatttatccctgaagg

SEQ ID NO: 154641 - DNA, 601 bp, Human
ttactttgggaggccaagacaggaggatcattgcagctcaggagttcgtgaccagcctgggcaacaaggcaaaacttcatcactacaaaatatacaaaaattagccaggcttggtggcacacacctgcagtcccagctacttggcagactgaggtggggggattgctttagcctgggaggcggaggttgcagcgagccaagattgtaccactgcactctagcctgggtgacaaagtgagaacctgtctccaaaaccaaacaaacaaaaactcccaccatgattcttctgctatgtggctattttttttttttttttttgtcacttgtggtccttttaagacttgtaacttccttatgaaaatgccatatgatcacagtcttaatgaagcatgcgccattctgatgacttatttggcttcatgctgattacaaatggagcttcattcatccattcagtgttcattataaggggcctctctgggccaggctcggctccgaggtgctgatgacaagtccccattctaagagaccttggtgaggagagacagaaaaaaatctaacacacacacatgatacaggtggtggctctttgaaagggggc

SEQ ID NO: 154642 - DNA, 601 bp, Human
agcatagtatttatttaagcattcaaataaaagaattacgtttgattccgtccgttttctattttattccagtcacaaattactgcctggtcggagcttagcatccagtattaattagcggattattttcagtattcacagggaccaaaaatacaagacagtagcccacttaccttcaatttaaattttcaaagctaaccacaaaatcgaaagcaaccacaggggtcaatagcaccaaacatgagcccttttctttgtgcccaacaccagcactgcaagaccaggaggcttgccagtcatrggaaaaatctggacatacaacaggcttacacaggactaagggggctgagctacctagaagctgagtctggaatctggaagtcaaacaaagactggaaggataggccggtcagaggcatgcttgagtccagataaacagacagattctaagggttgggaagaagaggtgtagtctacagacccagggaggaaaaaggaggccaaagtctaggaagatccactaagaagaaaatcaacaaatggacccaaaggagaacaggaaaccaaagaaggtcacgacccagggcacaggccatttgct

SEQ ID NO: 154643 - DNA, 601 bp, Human
tattttgatacgatggccatttcatctatgaaatagttctgaacctggttgctcattaaacagcacccaggaggcttttaaaaaacataccatggcctgagtctcacctgagattctgatttcattattctgaggcagagccaaggcccttggtagaagcttcccagtgaattattacgtgcagtcagggttgagaaccaccctgtcaagggcgcagcgtggaagctgagattgtgaatacaagactagggaacatttttttttttctttaaattggcccttccatttccctacagcaatwaaaaaaaaaaaagtgaagaaaaaaagcagccaggcgcagtggctcatgcctgtaatcccagcactttgggaggccgaggcaagtggattacctgaggtcaggggttcgagaccagcctggccaacgtagtgaaatcctgtctctacaaaaataaaaataaaaaaattagcaaggcatggtgggcaggcacctgtaatcccagctacctgggaggctgaggcaggagaatcacttgaacccaggaggcggaggttgcagtgagctgagatcgcgccatggcactccagcctgggcaacaag

SEQ ID NO: 154644 - DNA, 601 bp, Human
gccgatgaatgggcatggctgtgttccaatataactttattaaatttgaatttcacatgattttcacgtgtcaaaatatgcttctcgtgagtttttccagacatttagaaatgtaagaaacaatctcagcttgtagaccatacaattcaggctgtaggcaagggctgcagtttgctgcccctgttcagtcgcacactggagtcgtcacataagctttacacaggaatgctgtgttgataacatctgtcacttcaacatacacacacagctgctttcaaaaaagctagatgctacttttgtaaaaaaaaaaaaaaaaatcgaggtttaatttgcatgcaataaaatacacagctttgatgaatcacgcagaacaatatattgagcatttctgttacctttgaaaattcaatcctccgaggtaaccatttagtctgattttttagatgtctgttatctttaaaatggcagcacaatcatatggtttgaaataaaagctgaaagttcaggcttccattgcagttctacgtaacacacagggccgggtgcagtggctcatgcctgtaatctcaacactctgggaggccgaggtgggcgggtaacg

SEQ ID NO: 154645 - DNA, 601 bp, Human
gtgtaaccagaactgggaaccctggaagatcccctgaagcactaaatatcatatcagaagtaattggggtaaatgagcctttagatcaggcttggcaaactttttctgctaaaggactgacggtccatacgtgaagctttgcaactcctcagctgtgccacaaaagcatctgcagggacaaagaccatagcaaggcctttccacaagacgctacctgctgtgaacgcagtcacagataagaggccgatgaatgggcatggctgtgttccaatataactttattaaatttgaatttcacatkattttcacgtgtcaaaatatgcttctcgtgagtttttccagacatttagaaatgtaagaaacaatctcagcttgtagaccatacaattcaggctgtaggcaagggctgcagtttgctgcccctgttcagtcgcacactggagtcgtcacataagctttacacaggaatgctgtgttgataacatctgtcacttcaacatacacacacagctgctttcaaaaaagctagatgctacttttgtaaaaaaaaaaaaaaaaatcgaggtttaatttgcatgcaataaaatacacagctttgatg

SEQ ID NO: 154646 - DNA, 601 bp, Human
ttaagtagctcctcaagtcattccaatgtgtaaccagaactgggaaccctggaagatcccctgaagcactaaatatcatatcagaagtaattggggtaaatgagcctttagatcaggcttggcaaactttttctgctaaaggactgacggtccatacgtgaagctttgcaactcctcagctgtgccacaaaagcatctgcagggacaaagaccatagcaaggcctttccacaagacgctacctgctgtgaacgcagtcacagataagaggccgatgaatgggcatggctgtgttccaatayaactttattaaatttgaatttcacatgattttcacgtgtcaaaatatgcttctcgtgagtttttccagacatttagaaatgtaagaaacaatctcagcttgtagaccatacaattcaggctgtaggcaagggctgcagtttgctgcccctgttcagtcgcacactggagtcgtcacataagctttacacaggaatgctgtgttgataacatctgtcacttcaacatacacacacagctgctttcaaaaaagctagatgctacttttgtaaaaaaaaaaaaaaaaatcgaggtttaatttg

SEQ ID NO: 154647 - DNA, 601 bp, Human
cctgggctcacctccagggaggctgtaccatttggtgtggcatagtggcccaggaatctcattaagtagctcctcaagtcattccaatgtgtaaccagaactgggaaccctggaagatcccctgaagcactaaatatcatatcagaagtaattggggtaaatgagcctttagatcaggcttggcaaactttttctgctaaaggactgacggtccatacgtgaagctttgcaactcctcagctgtgccacaaaagcatctgcagggacaaagaccatagcaaggcctttccacaagacgctrcctgctgtgaacgcagtcacagataagaggccgatgaatgggcatggctgtgttccaatataactttattaaatttgaatttcacatgattttcacgtgtcaaaatatgcttctcgtgagtttttccagacatttagaaatgtaagaaacaatctcagcttgtagaccatacaattcaggctgtaggcaagggctgcagtttgctgcccctgttcagtcgcacactggagtcgtcacataagctttacacaggaatgctgtgttgataacatctgtcacttcaacatacacacacagctg

SEQ ID NO: 154648 - DNA, 601 bp, Human
acagactcatcctggctggtcgcactggttgcaaagagtcctgggctcacctccagggaggctgtaccatttggtgtggcatagtggcccaggaatctcattaagtagctcctcaagtcattccaatgtgtaaccagaactgggaaccctggaagatcccctgaagcactaaatatcatatcagaagtaattggggtaaatgagcctttagatcaggcttggcaaactttttctgctaaaggactgacggtccatacgtgaagctttgcaactcctcagctgtgccacaaaagcatctgcrgggacaaagaccatagcaaggcctttccacaagacgctacctgctgtgaacgcagtcacagataagaggccgatgaatgggcatggctgtgttccaatataactttattaaatttgaatttcacatgattttcacgtgtcaaaatatgcttctcgtgagtttttccagacatttagaaatgtaagaaacaatctcagcttgtagaccatacaattcaggctgtaggcaagggctgcagtttgctgcccctgttcagtcgcacactggagtcgtcacataagctttacacaggaatgctgt

SEQ ID NO: 154649 - DNA, 601 bp, Human
gtcatgcatgaccctgagtgagtggttcttaaaagtttccacccaagggcctccccttgcctcagccttcttctggccatctttctggttccttcatgccaggtggcatggacaatgggataaaagaccatattagaaatctatggaaactttgggagttccaacagaagcatttaaataggaatcgagcttagaaaacaagcaatatgtatcagcctatcatggcaaatgataagttaacgatttaactgatcttccatgttaaaaataggcattatatgtgtcaattaggttagtatawgcacaatcaactcgctttctgaaatacttcgaggaggagagcttccttggaaatgtgctgggctctgatgaacacacaacacacaggcttgtcctcattttgctgtccctgaaagcagctctcccttaagccaacccagaaaacaacactgggttacagactaagccactggcaggtgttagtatttaaaactaagcactcaagactacatatggtttctgacacaatactgctcaataaggattcctttacggcagcagcagttgaaaaaggtactcaggctgtgaaagtgaccacctg

SEQ ID NO: 154650 - DNA, 601 bp, Human
gatcattccaggagactgaaatgctcactgaattctcaagggttagctacctgttaccctcactggaagacctacgctattattaattatcccaaaatgattcccagaaccatctgtaacatccaaacagcagccagatgaacgacggactttaacgtctgaaacgaagcaactgcatttggaacttctaacacaggccacgagctgaatttacaaatggaacagtattgttttctgtgagattgcacacgcctgcattcaagtcttcatctaggaaaccctctggggatttcttttcccytaaaaattcattagaataatcaatcgtatgacacatcacagcttgtactgcagccgtctcatctttaacaagttcaggaaaatgtgtcaacacagatatttgcaaattctaaagaaagacctgttcaagaccaggcactgtggctcacgcctgtaatcccagcatttcaggaggctgcatcatttgaggccaggaattcaagaccagcctggccaacatggcaaaaccccatctctactaaaaatacaaaaactagctgggcgtggtggtgtacacctgtaatcccagctactcaggagg

SEQ ID NO: 154651 - DNA, 601 bp, Human
ctcagctcagccagttaacatctgtcattagctctgtttgcaggagcaaaagcagatgcttggaacaaggcactgtgaactctgacgtggcggggagatggatgcattttagaacagcagatcattccaggagactgaaatgctcactgaattctcaagggttagctacctgttaccctcactggaagacctacgctattattaattatcccaaaatgattcccagaaccatctgtaacatccaaacagcagccagatgaacgacggactttaacgtctgaaacgaagcaactgcatttgraacttctaacacaggccacgagctgaatttacaaatggaacagtattgttttctgtgagattgcacacgcctgcattcaagtcttcatctaggaaaccctctggggatttcttttcccttaaaaattcattagaataatcaatcgtatgacacatcacagcttgtactgcagccgtctcatctttaacaagttcaggaaaatgtgtcaacacagatatttgcaaattctaaagaaagacctgttcaagaccaggcactgtggctcacgcctgtaatcccagcatttcaggaggctgcatc

SEQ ID NO: 154652 - DNA, 601 bp, Human
cagcgtttctattttaaataatgaaaatgtttcaacatctattgtagtgataatttcacaattctgtgactatactaaaagccactgaattggcagtttaagtgggtgaattatatcacaatcaaactgttcaattaaaacaaaacaaaacaaaacaaaactattggccgggcatggtggctcacatctgtaatcccagcactttggaaggctgaggcaggtggactccctgaggtcaggagttcgagaccagcctggctaacatggtgaaactctatctctactaaaaatacaaaaattrgccgggcgtgcgtggcgggcacctgtaatctcagctactcgggaggctgaggcaggagaactgccagaacctgggaggcggaggttgcagtgagccgagattgcgccattgcactcagcccagacgacaacagtgagactccatctcaaaaaaaaaaaccaaaaaaactgttgctttgtatttcagaccatcactcaagctaatgcaagttgttaacgaatcaaatcctaggtgctaaaatgtggctttagctgcttttcctcttgtagctaaaagtaacatctgcaaactattttaaaa

SEQ ID NO: 154653 - DNA, 601 bp, Human
cagggttacagcgtttctattttaaataatgaaaatgtttcaacatctattgtagtgataatttcacaattctgtgactatactaaaagccactgaattggcagtttaagtgggtgaattatatcacaatcaaactgttcaattaaaacaaaacaaaacaaaacaaaactattggccgggcatggtggctcacatctgtaatcccagcactttggaaggctgaggcaggtggactccctgaggtcaggagttcgagaccagcctggctaacatggtgaaactctatctctactaaaaatayaaaaattagccgggcgtgcgtggcgggcacctgtaatctcagctactcgggaggctgaggcaggagaactgccagaacctgggaggcggaggttgcagtgagccgagattgcgccattgcactcagcccagacgacaacagtgagactccatctcaaaaaaaaaaaccaaaaaaactgttgctttgtatttcagaccatcactcaagctaatgcaagttgttaacgaatcaaatcctaggtgctaaaatgtggctttagctgcttttcctcttgtagctaaaagtaacatctgcaaacta

SEQ ID NO: 154654 - DNA, 601 bp, Human
gccaagaggccagctatttattgtcaaaggctgtcaccccatctgctgttgtgccatcctatacttagggggcctcagtgtcactttgccctgtgtgctatcatctctcccgtccaggatgacatccattcttcacagtgggagagaagagcgggtccacactgtctacgtaagtgtgttcatcaaacctctgctttcaacctcctatcctcctcctggctacagaaccctttccctgagctcctgtcacagagcccgttttctaagccttccttatctttcaatcttctcaggactattwaaaaaaaaaagctgtgctcattttcagatatgagactataactagaaatagtgcctaagagtctacggccttactatcctgaaggttcgtgatctcgtctgatctcgtgaagctaagcagggtattgggcctggttaatactcggatgggaaacatagtcctaagacagacaatctaaactgattttttctaacagcatgtaagaattatctcactgctcttaactatatttctgatcttaagtatatataatatcactcttacttttagaaatatgaaatgcatggcccaatattaatg

SEQ ID NO: 154655 - DNA, 601 bp, Human
aggggcttaatcgtagatgtatagaaaaagttcttctccccatgcatatgtaaattaactcagtcatcagttagggtcttattttcagtttttatcctaaatgcattcattcagaagagttttttggccagcagatataaacaaattaactgaccttttttttgcctctggcttttagacactaatcaaatttcttaacggttttgtgaattcctgtcatgattccctaacctgctggctgactactcaagggttcgtctgtattattttccaggcccagactagctggacctcattaccytcaagcagaagatagcccgcaaaaattgaatgaggcctgatccatacatgagaagccctcttttctccctattcttctgttttctcatgtgactttgatcaaagcgctctggactaagcctggtcacacgtaaatgacacagcaaaactaaatgatctggaaagtcctttcctgcccccaaattccctgagtttaacagacacccaataaatgcttgaattaaaatgccccacataaacctcatgggaatttcttccaggaattcctcaaaagcctttgccaagaaggcacagagaaatt

SEQ ID NO: 154656 - DNA, 601 bp, Human
aggcgggcagatcacgaggtcaggagttagagaccagcctggccaacatgatgaaaccctgtccgtactgaaaatacaaaaattagctgggcatggtggcaagtgcctgtaatcccagctactcaggaggctgagacggaagaatcgcttgaacctgggagttggaggttgcagtgagccaagatcgtgccactgcactccagcctgggtgacaaagcaagactccatctcaaaaaaaaaaaaaaaaaaaaaaaagaagacttactgatcactgggaaggaaagaaggaaggaaggaaggragggaaggagggagggagggtggttggttggttaactgaacaagcccagtaaaaagactgtgtataactttaggtacattaaaaggacaatatacaattgagagtacaggctaaaaaaaaaaaacaggcacaaagaaacaaaaagtatagattctaggtcaccagtgacatttattattgctgtcactgaatgtgcaaaggggcttaatcgtagatgtatagaaaaagttcttctccccatgcatatgtaaattaactcagtcatcagttagggtcttattttcagtttttatcctaaat

SEQ ID NO: 154657 - DNA, 601 bp, Human
cataatgtgagctcactgtccttttgaggatgaaggatgtgaaaccttcatcatggtttcacatttatttgccatgctaagtcctctgcgaagatcaaaccaaataatgcaaacttaaaatgatgtcaattaatatataaattaggatatcacttgttaatttaattgaagaaagacttaatggccgggcgtggtggctcatgcctgtaatcccagcactttgggaggccaaggcgggcagatcacgaggtcaggagttagagaccagcctggccaacatgatgaaaccctgtccgtactraaaatacaaaaattagctgggcatggtggcaagtgcctgtaatcccagctactcaggaggctgagacggaagaatcgcttgaacctgggagttggaggttgcagtgagccaagatcgtgccactgcactccagcctgggtgacaaagcaagactccatctcaaaaaaaaaaaaaaaaaaaaaaaagaagacttactgatcactgggaaggaaagaaggaaggaaggaagggagggaaggagggagggagggtggttggttggttaactgaacaagcccagtaaaaagactgtgtataact

SEQ ID NO: 154658 - DNA, 601 bp, Human
ggagatacttgttcgcaaaatacttgaactagtaaacttagttgtgggggaaacaaaaatcaatgtattttgttctttcccaacttggtttgaaatcttttcaacatttcaaagcagctaaaatatccgccaacccatacaaaagaaattaagatggcaggctgcatacatctgctttgacccaaaaacaaaaagccattttgcgctgtctttagagccagcataatgaaagcacaaaagcccagatggcttagatttttctttacacaaagtaactgagaggactgacatctaaactatytattcagcaagtctgatcctaatggcaactttagacccggaatttctataagacaaagaggaatgcttttaggcaagtaaaaaatttattggtctacactgatatccttcagtgtattcgtatttgtccactgtgcctggagatattagggaaaatgtcttcatcaaatggcaccatcgattcattctgctattctttatttacaatgccttaacttattaaatctgacactccaacctccagttgcttatttatttatttatttttatttattttgagatggagtctcactctgttgtc

SEQ ID NO: 154659 - DNA, 601 bp, Human
cagttggccggcgccatcgtgacgccccccagctaaaattttgttatttttagtagagacaggttttaccatgtaggccaggctgatcttgaactcctgacttgaggtgatccgcctgcttcggcctcccaaagggctgggattatagccatgagccatcgcacctggctaaacacatttctttactgcagaaattaagatcaaatgctgctctgattttctaaaaataataatgatgatgtcgcctttctcaaacttaatttaatccacccccctaccacccacttctcccaacatcacktggggtttgtgttccctccaagagtctttgggaaacgctcgtcgttatggctgccattagtaaacacctggcgatacctccccgctacggatggacggcagaagggctagtctctgctcaacaattcaagaggctagtttgtctacagcggcaccatcaccaacactgctggtctcagtggctataattggaaacactgccttagggtgttaagtcctgaggatagagaccatcttcagctcttcacagcacctacataacctgtaggcacataagtttttccaactacatttgtaaata

SEQ ID NO: 154660 - DNA, 601 bp, Human
aaaaattagccaggcatggtggtgcacaactgtagtcccagcttcttgggaggctgaggtgggaggatcgcttgagcttaggaggttgagactggagtgagtcgtgattgtgccactgccctccaacctgggtgacacagtgagaccctgtctcaaaaaaaattgctgggcactgtggtgcacaactgaagtctcagctactcaagaggctgatgcaggaggactgcttgagcccaggagtttgaggctgtagtgctttataattgcacctgtgaatagccactgcgctccagtctgggcracatagcaagaccctgtctctaaaaaaataataaagttactttaaaatactagaacatccaaatggtactcacatgcaagtgatagcctagagaagacaaggttgatattaactgattaacattggtaataagaacccaaatgaaaacagcaaccacaaaaaaggaagcatcacctagccagcagttcccaaagtgaattaaggtgaatgggcactgattttatgaacagcttctctggcagtttgggaagcatgattaagcaaagaactacacatttcttttttttttttttttttgtg

SEQ ID NO: 154661 - DNA, 601 bp, Human
aaaaatgtcttttaggctgggtgcagtgggctctcacctgtaatcccaacattttgggaggctgaagcaagaggactgcttgaaagaaggagttccgcaccagcctgggcaacaaagcgagactcacgcctcttaaaaaaatgtaaaacttagccggcgtaatggtccacacttagagtcccagctactccagagttgaggcaggaggattgcttgagcccaggagctctcatggcaccactgtactccagactggatgacatggtgagaccctgtctcttgaaaaacaaaacacatcttkaaagatgaaaataagctgggcacggtggctcacacctgtaatctcagtactttgggaggccgaggcgggtggatcacaaggtcaagatattgagaccatcctggctaacatggtgaaaccccatctctactaaaaatacaaaaattagctgggcgtggtggcacgcacctgtagtcccagctactcgggaggctgaggcaggagaatcacttgaaaccaggaggcagaggttgcagtgagccgagatcacaccactgcattgcagcctggtgacagagcgagactctgtctcaaaaaaaa

SEQ ID NO: 154662 - DNA, 601 bp, Human
gagataatttctcataaagtttaactccttccattttaaagagctgtcccacgattatgtccttcccattttcggcgtgttaaaaaaatgtcttttaggctgggtgcagtgggctctcacctgtaatcccaacattttgggaggctgaagcaagaggactgcttgaaagaaggagttccgcaccagcctgggcaacaaagcgagactcacgcctcttaaaaaaatgtaaaacttagccggcgtaatggtccacacttagagtcccagctactccagagttgaggcaggaggattgcttgascccaggagctctcatggcaccactgtactccagactggatgacatggtgagaccctgtctcttgaaaaacaaaacacatctttaaagatgaaaataagctgggcacggtggctcacacctgtaatctcagtactttgggaggccgaggcgggtggatcacaaggtcaagatattgagaccatcctggctaacatggtgaaaccccatctctactaaaaatacaaaaattagctgggcgtggtggcacgcacctgtagtcccagctactcgggaggctgaggcaggagaatcacttgaaac

SEQ ID NO: 154663 - DNA, 601 bp, Human
gaactgaacctcttcctgagacacggcccagagattatacctgcaggtggcagtacattttttcctgaaaggtaacagatccttactgctgaattatctgtagcagaaatttccaaacccttaactgagactaattctcaatagccaaatgagaaatataagaccacagagataatttctcataaagtttaactccttccattttaaagagctgtcccacgattatgtccttcccattttcggcgtgttaaaaaaatgtcttttaggctgggtgcagtgggctctcacctgtaatcccaayattttgggaggctgaagcaagaggactgcttgaaagaaggagttccgcaccagcctgggcaacaaagcgagactcacgcctcttaaaaaaatgtaaaacttagccggcgtaatggtccacacttagagtcccagctactccagagttgaggcaggaggattgcttgagcccaggagctctcatggcaccactgtactccagactggatgacatggtgagaccctgtctcttgaaaaacaaaacacatctttaaagatgaaaataagctgggcacggtggctcacacctgtaatctcagta

SEQ ID NO: 154664 - DNA, 601 bp, Human
atttcaccttgtatattaggttttgcccttaaagctatgcaaaaccaactatagaattagctgaaagttacagcaatattaaaaacaaataccattgtagactagattatgctcaatcaatagattttaaatcaagatctgcagaactctaaaagtttcacagaaaccactgctaagaaatggggtggggggtgggaggctgctgtccaccccttcttacattgccagtaaaatttgttaaactctccaacaagattttattccaacaaagtaattccagatacacacacacacacacacrcacacacacacacacacacacagtgtatttcccttttcaaatatgactgatctatattatcttaccaaagcctacaattgacactttaacttgatgtattaaaatgctcaaaaaccttacctttaagcaaagggaatgagaacaatttaaaagtgctatacagaactgaacctcttcctgagacacggcccagagattatacctgcaggtggcagtacattttttcctgaaaggtaacagatccttactgctgaattatctgtagcagaaatttccaaacccttaactgagactaattct

SEQ ID NO: 154665 - DNA, 601 bp, Human
aaatttcaccttgtatattaggttttgcccttaaagctatgcaaaaccaactatagaattagctgaaagttacagcaatattaaaaacaaataccattgtagactagattatgctcaatcaatagattttaaatcaagatctgcagaactctaaaagtttcacagaaaccactgctaagaaatggggtggggggtgggaggctgctgtccaccccttcttacattgccagtaaaatttgttaaactctccaacaagattttattccaacaaagtaattccagatacacacacacacacacrcacacacacacacacacacacacagtgtatttcccttttcaaatatgactgatctatattatcttaccaaagcctacaattgacactttaacttgatgtattaaaatgctcaaaaaccttacctttaagcaaagggaatgagaacaatttaaaagtgctatacagaactgaacctcttcctgagacacggcccagagattatacctgcaggtggcagtacattttttcctgaaaggtaacagatccttactgctgaattatctgtagcagaaatttccaaacccttaactgagactaatt

SEQ ID NO: 154666 - DNA, 601 bp, Human
agtcatgaaagtaattatggtaagaaaagaggaatatctaaagtacgaagcaagaaaacttactcaatttaactctttgctagttaatctaccagaactgaatggttgctttttgaaaagcaaaggtggtgttggtgcatattatgatgtaaaattggcataaacaggattctagtgcctaatctatactcaactactaattctaaatttcaccttgtatattaggttttgcccttaaagctatgcaaaaccaactatagaattagctgaaagttacagcaatattaaaaacaaataccaytgtagactagattatgctcaatcaatagattttaaatcaagatctgcagaactctaaaagtttcacagaaaccactgctaagaaatggggtggggggtgggaggctgctgtccaccccttcttacattgccagtaaaatttgttaaactctccaacaagattttattccaacaaagtaattccagatacacacacacacacacacacacacacacacacacacacacagtgtatttcccttttcaaatatgactgatctatattatcttaccaaagcctacaattgacactttaacttga

SEQ ID NO: 154667 - DNA, 601 bp, Human
gagcttaaaaatcttgcccagggtcccacagttagtaagcagcaggcagggctaggagtctagcatccaagtgttggaacaggtcagctactgggcaccatcactatgtttcaaaatatgtcttatttgtctccataaggtcctggactcccttgtctaactttctatcagcaagcactcttgactgcccattgctaaaaatcaagttaaaatgaaacagtatttttaaatggcattaagtatttggactttagtagagcacatcaaatatatagtgatgggtaaattacagaaaaaaaawtttttttgaaggaatggaacaggcacaggaaatggaaaaatatcccttaactacaaaaaagcttctaggtcttctgaagttcattaacagcatcaaaaccaatctgcacaagttaacctgaaaaggttaagtgaagacactactaaataataattacatggttatacaagaacttcaaatacttaactcatattattttattataatttctcccaacaagcacaaagattgacacgctgcaagtgggggaaaacagacagcagataagtgggttgtcccgtcactcatgaatcagctgct

SEQ ID NO: 154668 - DNA, 601 bp, Human
aggatcgcttgagaccaggagtttgacaccagccaaagcaacttagcaaaaaccccatctctacaaaaaattaatagtcccagctagtcgggaggctgagatgggtagattgcttgagcctggagtttgaggttagagcaagctatgattgcaccactgcactccagcctggatgacgcagtgagaccccgtctctactaaaaaaaagagagagaaaaaagaaaaaggaaaaaaaaaaaaaaaggaactttgaaatacaggctgctgccaagataagatgcctgctcctacttgacacccrttggctcaatcatgaaactgtcaggactcatttccttggaaaccctgctatggtttctggttctgcttcattcctcctgttccccttgtactcggcccccgaccacacatgcaccagcccattccctgacaggcctcgagccagctgaaaccacactgagctagcccggtccagcactgacttccacacgtcatagaagcttccacgtgctccagcttcaagtatgctccacgccccattctccccttctaattttctatggcaatgacctaatctaacatttttgcaacttgcatgtgt

SEQ ID NO: 154669 - DNA, 601 bp, Human
ttttcccatttctctgagagagaaggatggttaggttccatgagctccacagaccatcacaacgcggcagcctttgtggtctgagacactaataactaattcaggctctccttcaacaaagccaagttctatttgaacttttaacaatggaagctgacttgtttgccaactcttctcgcaaactgtttttcattaatatggcttttttgtaagtgcgtctaataataaagctcatgatctctttgtcctggcttcattattccggactctggagggctcgagggcttggagtttttctgarcatattacggttatgtttcaaacacccaggcaaagccataatatttcctgctgagattagcacaatatctgataactagacaaagaggactcaatcatagaaggcatgacacttgactttggggtgggggggcttggtgggggtgggggcagttccacataataggcagaaaagcaggtggcacagatattcttggtttcatagtataaagtaaaactttaaaaagaagcatcttatagaaccctttatatgtataagcacatttagatcatgtgcccccagacctatcgcagtttagat

SEQ ID NO: 154670 - DNA, 601 bp, Human
aaaaaattagccgggcgtggtggcaggtgcctgtaatcccaagtacttgggaggctgaggccagaaaatcgctagaacctggaaagcggagattgcagtgagccgagatctcgccattgcactccagcctgggcaacaagagcggaaatgcatctcaaaaaaaaaaaaaaaggagatttcgaatgtttaggagctgcttacataaccctgaagacagattcagaaacagttattattcagaaacaatgcacattttcaaatgaatcagttttaaagtcatttaggtcttttcatggtgtgytagaagaactgagatattaaagacaattattttgtgagttgaactacgcccattaaaagttctgtacaaaaggtcagtacttattactaacaacacaaacaactgtgttaagcaggctgaaactccaatagtcagaaggattttccagatttttagaaaaagggcttaaaatgtctttaagttaatcctgacaccaaaatttatctctgcgaacttaataccctttttattatgcacgagcaagcatgaaacggcaaagctggagattaatgttcatttgaaaactttaaatttttccca

SEQ ID NO: 154671 - DNA, 601 bp, Human
ccaagatggtgaaaccccatctctactaaaaatacaaaaaaaaattagccgggcgtggtggcaggtgcctgtaatcccaagtacttgggaggctgaggccagaaaatcgctagaacctggaaagcggagattgcagtgagccgagatctcgccattgcactccagcctgggcaacaagagcggaaatgcatctcaaaaaaaaaaaaaaaggagatttcgaatgtttaggagctgcttacataaccctgaagacagattcagaaacagttattattcagaaacaatgcacattttcaaatgratcagttttaaagtcatttaggtcttttcatggtgtgctagaagaactgagatattaaagacaattattttgtgagttgaactacgcccattaaaagttctgtacaaaaggtcagtacttattactaacaacacaaacaactgtgttaagcaggctgaaactccaatagtcagaaggattttccagatttttagaaaaagggcttaaaatgtctttaagttaatcctgacaccaaaatttatctctgcgaacttaataccctttttattatgcacgagcaagcatgaaacggcaaagctg

SEQ ID NO: 154672 - DNA, 601 bp, Human
atatgcacaacaaaaatatgcaagcccatatttaaaatgactagttcctactaataaagttaaaaccaatacatgagagaaaaaaggagatccaacatagggagagttatctttaaaattttttttaaaaaaggagatttcaggccgagtgcagtgcctcacacctgtaatcccagcactttgggaggccaaggcaggcggatcacctgaggtcaggagttcgagaccagactggccaagatggtgaaaccccatctctactaaaaatacaaaaaaaaattagccgggcgtggtggcaggygcctgtaatcccaagtacttgggaggctgaggccagaaaatcgctagaacctggaaagcggagattgcagtgagccgagatctcgccattgcactccagcctgggcaacaagagcggaaatgcatctcaaaaaaaaaaaaaaaggagatttcgaatgtttaggagctgcttacataaccctgaagacagattcagaaacagttattattcagaaacaatgcacattttcaaatgaatcagttttaaagtcatttaggtcttttcatggtgtgctagaagaactgagatattaaagacaat

SEQ ID NO: 154673 - DNA, 601 bp, Human
ttttgttgtgcaatatgcacaacaaaaatatgcaagcccatatttaaaatgactagttcctactaataaagttaaaaccaatacatgagagaaaaaaggagatccaacatagggagagttatctttaaaattttttttaaaaaaggagatttcaggccgagtgcagtgcctcacacctgtaatcccagcactttgggaggccaaggcaggcggatcacctgaggtcaggagttcgagaccagactggccaagatggtgaaaccccatctctactaaaaatacaaaaaaaaattagccgggygtggtggcaggtgcctgtaatcccaagtacttgggaggctgaggccagaaaatcgctagaacctggaaagcggagattgcagtgagccgagatctcgccattgcactccagcctgggcaacaagagcggaaatgcatctcaaaaaaaaaaaaaaaggagatttcgaatgtttaggagctgcttacataaccctgaagacagattcagaaacagttattattcagaaacaatgcacattttcaaatgaatcagttttaaagtcatttaggtcttttcatggtgtgctagaagaactgagat

SEQ ID NO: 154674 - DNA, 601 bp, Human
aaaaaatgcaatatgcatttttgttgtgcaatatgcacaacaaaaatatgcaagcccatatttaaaatgactagttcctactaataaagttaaaaccaatacatgagagaaaaaaggagatccaacatagggagagttatctttaaaattttttttaaaaaaggagatttcaggccgagtgcagtgcctcacacctgtaatcccagcactttgggaggccaaggcaggcggatcacctgaggtcaggagttcgagaccagactggccaagatggtgaaaccccatctctactaaaaatacaaaaaaaaattagccgggcgtggtggcaggtgcctgtaatcccaagtacttgggaggctgaggccagaaaatcgctagaacctggaaagcggagattgcagtgagccgagatctcgccattgcactccagcctgggcaacaagagcggaaatgcatctcaaaaaaaaaaaaaaaggagatttcgaatgtttaggagctgcttacataaccctgaagacagattcagaaacagttattattcagaaacaatgcacattttcaaatgaatcagttttaaagtcatttaggtcttttcatggtg

SEQ ID NO: 154675 - DNA, 601 bp, Human
gctgcagaagaaaagtctggagccagcacagattcgttgatgagatttaagaaaagaagccgtctccacaacacaaaagagcaaggggaagcaggacatgttgacaaagaagctgcagcaagttattcagaagatctaaataagatcattgatgaaggtggctacactaaaaaggttttcagtgtggacaaaacagcctcctactagaagctgccatctagaacttccacaattaaagaggagaactcaaggcctggcttcaaaggacacacagactctcttgttaggggttaatgcaaakgaggactttaagttgaagccagtgctcatttaccattctgaaaacgttagagctcttaagaattatgctaaatctactcatctctataaacggaataacagaactgagatgccagtacatctgtttacagcatggttttagtgatatgttaagtccactgttgaaacctactgctcagaaaaaaagatttctttcaaaatattactgctcactgacaatgcacctggtcacccaagagctctgataaagatgtacaaggagattcatgttttcatgcctgctaagacaacacccattctg

SEQ ID NO: 154676 - DNA, 601 bp, Human
ggttgccaggggttaggaggagggttatagggactggctgctaacaggtacaaggttttctttcggggtgatgaaagtgttctaaatttgactgtggtgatgactgcacaactctgtaaatacactaaagaagttgctgaatggtacactttgagtaaagtctatggtttgtgggttacatctcaataaaactgttattcttttttaatacacatgagttaggcacttagcacagaacccagggaatgcaaggtgtctgatatatgctggtgcctttccctcactggcaaactgagcccayctcaaatacaggcacacctcgtttaattcacagacactgcattttcttacaaatcgagggtttgtggcaaccctgtgcaagtctactgctgctgtttttacaacagcaggtgctcacttcacatccgtgtcatattttggtaattctcacaataattcaaacttttccattattataatatttgatctttgatgctcctattgtaattgtttgggggcgccacaaaccacacccatacaagacagtgaacctaatgtgtgttctgactgctccaccgaccagctgttccctgtctctctc

SEQ ID NO: 154677 - DNA, 601 bp, Human
aggagaattgctgaaacccgggaggcacaggttgcggtgagccaagatcacaccattgcacttcagcctaggcaacaagagcaaaattccgtctcaaaagaaaaaaaaacatactgacgaaccttgtaaatatgctaagtgaaagagtccagacacaaaaggctatatattattatgtttccatttacataatatgtccagaataagcaaattcatagagacagaaagtagattagtggttgccaggggttaggaggagggttatagggactggctgctaacaggtacaaggttttctttyggggtgatgaaagtgttctaaatttgactgtggtgatgactgcacaactctgtaaatacactaaagaagttgctgaatggtacactttgagtaaagtctatggtttgtgggttacatctcaataaaactgttattcttttttaatacacatgagttaggcacttagcacagaacccagggaatgcaaggtgtctgatatatgctggtgcctttccctcactggcaaactgagcccacctcaaatacaggcacacctcgtttaattcacagacactgcattttcttacaaatcgagggttt

SEQ ID NO: 154678 - DNA, 601 bp, Human
ttacactctttcagtagataacaaatggtcactattcatatgagagaacagctcctcctccactgttacagacaaaaatagtaaaaatttaacccctattcctactttggttataacccacctccagtggtttgcatcttcatccatcaactccacctcattttctacattccagagtcaaagataatgaagaaggccaacagcaaaaactcaatgactacacatgtgcccaagaagatgggcagatggaaactgatgaaaatatgacggacatgcaccaaggggtatacagcccccaccytgcggatatctgaaaactgggaaaagctgtatctcattcagagcagtcacgtccttcagagactttgagatttggatcaggatttttttaaaacttaaaattgttctctgctcacttgatagttgtatttatgccttttaaatatatatgagttaactcatggctggtgggaatgtaaaatggtgcagacgctttggaaaacagtctggtcattctttgaaaggctaaatacagttaccatatgatccagcaattcactcctagatatatacccaagaaaaataaaaacgtatgtccaca

SEQ ID NO: 154679 - DNA, 601 bp, Human
ttttttttttttttttttttttggtgagatatgtacaaagacagcaagatgtcagcttggctcaaacttatggtacaaaaactaggagaactcacaacatccagaagataacaagccacatcagctcagaatatgacataattatctccccacactcttcctgtccaccaaccccatccccactatcaaggaaatctgtagaaatatcaggaaaacactctctgaattaatggaaagattagggaaaggcagaaggccagaaagaagaaagaccccaaaaaaaagtaggttactaattaargagggcaaaagtctttaaaaaaaaaaaaaagacatttttgataacaaaaacattaatatcatgctctgggagagttttcccagtacatggatcataataaaaataaggtcacttgttccccctactcctctcaaatgtgtcaacaagaaattgctgtgtctttgtaagtgtctatgaaagcaaaggatgtaaaagccctgcacagcttgtaccagaaatctggtctgaatatctaagagccagaggatctgagggttagggaaactgatgggaatcagggtgaaacctcctaagaacaaa

SEQ ID NO: 154680 - DNA, 601 bp, Human
cacaccaaagtcatttttggctgttttttttttttttttttttttggtgagatatgtacaaagacagcaagatgtcagcttggctcaaacttatggtacaaaaactaggagaactcacaacatccagaagataacaagccacatcagctcagaatatgacataattatctccccacactcttcctgtccaccaaccccatccccactatcaaggaaatctgtagaaatatcaggaaaacactctctgaattaatggaaagattagggaaaggcagaaggccagaaagaagaaagaccccamaaaaaagtaggttactaattaaggagggcaaaagtctttaaaaaaaaaaaaaagacatttttgataacaaaaacattaatatcatgctctgggagagttttcccagtacatggatcataataaaaataaggtcacttgttccccctactcctctcaaatgtgtcaacaagaaattgctgtgtctttgtaagtgtctatgaaagcaaaggatgtaaaagccctgcacagcttgtaccagaaatctggtctgaatatctaagagccagaggatctgagggttagggaaactgatgggaatca

SEQ ID NO: 154681 - DNA, 601 bp, Human
tcacaccaaagtcatttttggctgttttttttttttttttttttttggtgagatatgtacaaagacagcaagatgtcagcttggctcaaacttatggtacaaaaactaggagaactcacaacatccagaagataacaagccacatcagctcagaatatgacataattatctccccacactcttcctgtccaccaaccccatccccactatcaaggaaatctgtagaaatatcaggaaaacactctctgaattaatggaaagattagggaaaggcagaaggccagaaagaagaaagaccccmaaaaaaagtaggttactaattaaggagggcaaaagtctttaaaaaaaaaaaaaagacatttttgataacaaaaacattaatatcatgctctgggagagttttcccagtacatggatcataataaaaataaggtcacttgttccccctactcctctcaaatgtgtcaacaagaaattgctgtgtctttgtaagtgtctatgaaagcaaaggatgtaaaagccctgcacagcttgtaccagaaatctggtctgaatatctaagagccagaggatctgagggttagggaaactgatgggaatc

SEQ ID NO: 154682 - DNA, 601 bp, Human
aatcccagctactcgggaagctgaggcacaagaagctgaggttccagtgagccgagatcacaccaaagtcatttttggctgttttttttttttttttttttttggtgagatatgtacaaagacagcaagatgtcagcttggctcaaacttatggtacaaaaactaggagaactcacaacatccagaagataacaagccacatcagctcagaatatgacataattatctccccacactcttcctgtccaccaaccccatccccactatcaaggaaatctgtagaaatatcaggaaaacactstctgaattaatggaaagattagggaaaggcagaaggccagaaagaagaaagaccccaaaaaaaagtaggttactaattaaggagggcaaaagtctttaaaaaaaaaaaaaagacatttttgataacaaaaacattaatatcatgctctgggagagttttcccagtacatggatcataataaaaataaggtcacttgttccccctactcctctcaaatgtgtcaacaagaaattgctgtgtctttgtaagtgtctatgaaagcaaaggatgtaaaagccctgcacagcttgtaccagaaat

SEQ ID NO: 154683 - DNA, 601 bp, Human
ctctctaatcaccactaaagaacttattcatataaccaaacaccaactgttcccccaataacctatggaaataaaaaaatttatatatatcagaactccaataatgtgtggcaagtttataggtttttgggtgtgtgtgtgtttatttatttatttttgagacaggtctcactttgtcacccagcctggagtgcagtggagcaatctcagctcaccgcggcctccacctcttgggttcaagtgatgctccccgccttagcccccaaccaggtagctgggactacaggcgcatgccaccacrccctgctaatttttgtgtagagacagggttttgccacgttgtccaggctggtgtcaaactcctgagctcaaaacaatctgaccacttcagcctcccacagtgctaggattacaggtgttccccactgcacctggctttgtaggtgtttttaatacttttctatgactctttccctgttttctaaagcttgtatacatttctaggcttaaaaaggaaatcagtccaatcaaaatcactatcagtgaatgtatctggataaatataaggggtttaatacatttttataaaatgagcattgta

SEQ ID NO: 154684 - DNA, 601 bp, Human
caaatttgtatttatatgtaaggtcaggaactgtgattttatagactcaggtacagatttcctttaaatcctcaactacagtactttgtttattcacaaaagaaaactttctgtataatttttaagggacatctactgcacaaagaaaagcatccttgttgttttcgttatgctaagatgtgtaattagaacgctttcttgttgcttatacccactatgcaggccaagtctatcaagaaaaaaaaaaagatgttcaaactcttcgagccagtctttccacatttaggaatttagtgtgcasaaaacaatcactgtataaaaatggttttttcattgtggagttatactaaaatgaatttgtaataaaattctactatgcatatatgtagtataatcctaacgttatttttttaataggcacacacacacacacactcacacacacacacacacacacacagggcgactgtactcttgggccttcattctaaaaacttacatttgcaaaaaaacttgcacacaaatatttatagcacatttacaataggcaaaagctgaaaaagccaattcctggttacatgctatgtgattctattcatag

SEQ ID NO: 154685 - DNA, 601 bp, Human
aaataggcaatcctgacagtgcagtaggggctgttatggtagaaatgcccagggcacaatagagatgatccatgtgggacaggtaatggccaggagggacacagatgcaagggtgatgtggcacggggcatctgtggttgagcgtggctgcagcaggggctgacttgggaagggccccctgtgccctgggtgctgcctggcttctgacctgaaggacatgaaaggcacataagtagttagggagggcacagaatcttctctacctgctcatcatcatgggcaacactaacatcaaacacarcaccgagactttctagagacaagagataaagaataaatctcactgcaagatgcaattcaacagaaactccacaggaaagcaatcttctgaatcctcttgaggagcaatcgccacaaacactgctgttcccaaaatggaaggtttcttcctgccgtcatgtacacaaatcgcgcacccccaaaagtatcagggatggtgcacacaacatcataaagctgctggcagaccagtcactgagcggtaaatactaaccatccagctcaaacctttctgacagcgccgcagggctgcaggcaggct

SEQ ID NO: 154686 - DNA, 601 bp, Human
cagtccactgagggttctgaaaaataggcaatcctgacagtgcagtaggggctgttatggtagaaatgcccagggcacaatagagatgatccatgtgggacaggtaatggccaggagggacacagatgcaagggtgatgtggcacggggcatctgtggttgagcgtggctgcagcaggggctgacttgggaagggccccctgtgccctgggtgctgcctggcttctgacctgaaggacatgaaaggcacataagtagttagggagggcacagaatcttctctacctgctcatcatcatggrcaacactaacatcaaacacagcaccgagactttctagagacaagagataaagaataaatctcactgcaagatgcaattcaacagaaactccacaggaaagcaatcttctgaatcctcttgaggagcaatcgccacaaacactgctgttcccaaaatggaaggtttcttcctgccgtcatgtacacaaatcgcgcacccccaaaagtatcagggatggtgcacacaacatcataaagctgctggcagaccagtcactgagcggtaaatactaaccatccagctcaaacctttctgacagcg

SEQ ID NO: 154687 - DNA, 601 bp, Human
agcctaggggttaacattatctttttttgtttttttggagacggagtctcactgtcacccaggctggaatgcagtggcacagtctcgactcactgcaacctcctccgcctcctgggttcaagcaattctcctggctcagcctcccggatagctggaattacaggcaagcaccaccaagcctggctaatttttgtatttttagtagagatgcggtttcaccatgatggccaggctggtctcgaactcccgtactcaagtgatccgcccaccctggcttcccaaagtgttgggattacaggcrtgagccactgcgcccagccaatgttatctttatatacgtaactcttctgctactttgttagataactatgaagtatagataacacaaagattgttagtttctttttcaaagactcaaactagtttgtgaaattaagtcctttaaactgtcatcaggttttcaatgcccagtgtatcctttaggtgccaaaacaaaataagagggccaagcagagggaacgggtttattaagtgccagctgcatgcatcagacattgctaatgttacctcatttgatcctcagatggggaggtaatactga

SEQ ID NO: 154688 - DNA, 601 bp, Human
taagctctctgatgaaaatctatttgtcataacactctcttctcctattttaatccctttgcacgaagttggctggcctcgtttagatttttcctggaattccacgttgtttctggggatgtcgctcttattttcctcctttcgtgtattggctctttaattcatgaatcaaagtagtgatcaataacaaaggttgttaagatatctgcctcctgacatatggctgaaattagcaatcatgtaaacaaaaacgagcttatgttcagcttcactgaccctgtgctttcaatgactggtgtaygcgtgcttaagctccatgattattttgtactgagtaatttatacttttatggcgttcctttgcaaccaagaagagtctaagaagaaaacaatccacctaactgcaaatctgccttttcctattgtttttgctgcttcctcacaagactggagaaattatttgggggcaagaaaacgtcaagtcccctagagaatttcattggaatctaatcaaaaggaaattcacacaggtctactctgctagcgtgcggaggaaaaaatagcaatactgccctgttttcagctcaaacttgtcagagat

SEQ ID NO: 154689 - DNA, 601 bp, Human
acccaatactacccaaaatgacaatagtacggtctagaaatgtcctgagatgccaaacaaccagatgtctacccagacactaagtaaaaatgatgacaataagccaatgcctgtaagtaaaacttttcataaatcataaaaacatctttcagccgggcgcggtggctcacgcttgtaatcccagcactttgggaggtcaaggcaggcgaatcacgaggtcaagagattgagaccaacttggccaacatggtgaaaccctgtctctactaaaaatacaaaaattagctgggcgtggtggcaygcacctgtagtcccagctactcaggaggctgaggcaggagaatcgcttgaacccgggaggcggaggttgcagtgagccaagatcacaccactacacaccagactgggcaacagagcaagactctgtctcaaagaaacaaaacaaaacaaaacaaaaaaactttcaaaaacaatcgaagaaataaaaacactgaacagaggtaaatcaaaatcagcatgacaatattatgtcatattatattcattcgtttttatttgacccaagttaaggaggaggaggaggatttctaggaattggaga

SEQ ID NO: 154690 - DNA, 601 bp, Human
ccgctggtaacatggtgaactggattggcgtgggggcagaacaaaggaaactgatcaatacgactgaaaacataacttggagaaggggcttatacacagatttcttttattacaagtcattaggagcccccagtcttaaaacctaacttttccaactgaagggaaattaaaatgaaaaaataaaaaccctaatcgctagatgacatacagagtattctcaagcacagcatcttcctctcacactagcttggcttttctcctagagtagaggttctcaatctccttcccgcccccgccactrctggggacactcgacaacacctggaaagatttgtggttgttagaatttgggggagaggagaagggtgctacctggcattaaatgggcacagaccaggaatgctgccaaacatcaaagtgatacccaatactacccaaaatgacaatagtacggtctagaaatgtcctgagatgccaaacaaccagatgtctacccagacactaagtaaaaatgatgacaataagccaatgcctgtaagtaaaacttttcataaatcataaaaacatctttcagccgggcgcggtggctcacgcttgtaat

SEQ ID NO: 154691 - DNA, 601 bp, Human
cctgagaacaaactgttctgttctagaagtacaaaccgctggtaacatggtgaactggattggcgtgggggcagaacaaaggaaactgatcaatacgactgaaaacataacttggagaaggggcttatacacagatttcttttattacaagtcattaggagcccccagtcttaaaacctaacttttccaactgaagggaaattaaaatgaaaaaataaaaaccctaatcgctagatgacatacagagtattctcaagcacagcatcttcctctcacactagcttggcttttctcctagagyagaggttctcaatctccttcccgcccccgccactactggggacactcgacaacacctggaaagatttgtggttgttagaatttgggggagaggagaagggtgctacctggcattaaatgggcacagaccaggaatgctgccaaacatcaaagtgatacccaatactacccaaaatgacaatagtacggtctagaaatgtcctgagatgccaaacaaccagatgtctacccagacactaagtaaaaatgatgacaataagccaatgcctgtaagtaaaacttttcataaatcataaaaaca

SEQ ID NO: 154692 - DNA, 601 bp, Human
gatacctgagaacaaactgttctgttctagaagtacaaaccgctggtaacatggtgaactggattggcgtgggggcagaacaaaggaaactgatcaatacgactgaaaacataacttggagaaggggcttatacacagatttcttttattacaagtcattaggagcccccagtcttaaaacctaacttttccaactgaagggaaattaaaatgaaaaaataaaaaccctaatcgctagatgacatacagagtattctcaagcacagcatcttcctctcacactagcttggcttttctcctagagtagaggttctcaatctccttcccgcccccgccactactggggacactcgacaacacctggaaagatttgtggttgttagaatttgggggagaggagaagggtgctacctggcattaaatgggcacagaccaggaatgctgccaaacatcaaagtgatacccaatactacccaaaatgacaatagtacggtctagaaatgtcctgagatgccaaacaaccagatgtctacccagacactaagtaaaaatgatgacaataagccaatgcctgtaagtaaaacttttcataaatcataaa

SEQ ID NO: 154693 - DNA, 601 bp, Human
cgcccagctaattttttgtatttttagcagagatggggtttcactgtgttagccaggatggtcttgatctcctgacctcgtgatccacctgcctcggcctcccaaagtgctgggattacaggcgtgagccaccgcgcccggcccctttcctcctattttcaggagcacattacgcatgcccattccaggggtggaaaaatcaagagaactagaaccattccttctcaggaccacaggaagacagaatcatgacgggagacaatcgctacatgaataaaacagaaggctaggaagagggggaaaaaaaaaagcattatttcaagatacaggattgcagctgctcaaaacaatgtgtatttcaaaaaaaaaaaaagaatagtagagaaaaatgtatttgtggaggaaaagcaaggataaaccatccattcagaggtgggctcaagttggtaaagaccttagaacattgtctggcattcagaaggtgctaaataaggatcagatacatttagaaatttggggagagcatcaggaagaatagctaatggatgctgggcttaagacctaggtgatgggatggcgtgtgcggcaagccaccacggca

SEQ ID NO: 154694 - DNA, 601 bp, Human
gtctcgctctgtcacccaggctggagtgcagtggcgcgatcttggctcactgcaacctccacctcccaggtttatgccattctcctgcatcagcctcccgagtagctgggactacaggcgcccaccaccacgcccagctaattttttgtatttttagcagagatggggtttcactgtgttagccaggatggtcttgatctcctgacctcgtgatccacctgcctcggcctcccaaagtgctgggattacaggcgtgagccaccgcgcccggcccctttcctcctattttcaggagcacatkacgcatgcccattccaggggtggaaaaatcaagagaactagaaccattccttctcaggaccacaggaagacagaatcatgacgggagacaatcgctacatgaataaaacagaaggctaggaagagggggaaaaaaaaaagcattatttcaagatacaggattgcagctgctcaaaacaatgtgtatttcaaaaaaaaaaaaagaatagtagagaaaaatgtatttgtggaggaaaagcaaggataaaccatccattcagaggtgggctcaagttggtaaagaccttagaacattgtctgg

SEQ ID NO: 154695 - DNA, 601 bp, Human
ttttttttttttttttttttttttgagacggagtctcgctctgtcacccaggctggagtgcagtggcgcgatcttggctcactgcaacctccacctcccaggtttatgccattctcctgcatcagcctcccgagtagctgggactacaggcgcccaccaccacgcccagctaattttttgtatttttagcagagatggggtttcactgtgttagccaggatggtcttgatctcctgacctcgtgatccacctgcctcggcctcccaaagtgctgggattacaggcgtgagccaccgcgccyggcccctttcctcctattttcaggagcacattacgcatgcccattccaggggtggaaaaatcaagagaactagaaccattccttctcaggaccacaggaagacagaatcatgacgggagacaatcgctacatgaataaaacagaaggctaggaagagggggaaaaaaaaaagcattatttcaagatacaggattgcagctgctcaaaacaatgtgtatttcaaaaaaaaaaaaagaatagtagagaaaaatgtatttgtggaggaaaagcaaggataaaccatccattcagaggtgggct

SEQ ID NO: 154696 - DNA, 601 bp, Human
aaatcatgtatagcccaagtgaacagttcagagctggaaaccatcactgaaaaatagggctataacctgtaaactagagttccccaccttcatacatttgacttcctttcctcctattttcttttttttttttttttttttttttttttttttttttgagacggagtctcgctctgtcacccaggctggagtgcagtggcgcgatcttggctcactgcaacctccacctcccaggtttatgccattctcctgcatcagcctcccgagtagctgggactacaggcgcccaccaccacgcccrgctaattttttgtatttttagcagagatggggtttcactgtgttagccaggatggtcttgatctcctgacctcgtgatccacctgcctcggcctcccaaagtgctgggattacaggcgtgagccaccgcgcccggcccctttcctcctattttcaggagcacattacgcatgcccattccaggggtggaaaaatcaagagaactagaaccattccttctcaggaccacaggaagacagaatcatgacgggagacaatcgctacatgaataaaacagaaggctaggaagagggggaaaaaa

SEQ ID NO: 154697 - DNA, 601 bp, Human
gggtagaagtgcttcgcacccagaaggcacaaggacattcaagagtgaagaaacatgtagacccttcattttaagtcatcaacaccatggaagaaagttaagaaacagaaacttaggccagagtcaaagcagccttggggcaacctagaaattcccagaagttaaatagctagaatgccctgccttcccctagcacgccacatccccatgatgccaatccaggcacattttcagaagagctacaaccagacaggtacttgcgtcttccaaagaaaagtgccgaccagggtggggcagaaamagaacttgcctgctggtcaactctcggccaaccaagtagtataaagtagggcccatgccacctgccagctcccggcacacacctgaggtctcatctcactctgctgactcaaggctcctgccagcgcaactcgagttcccttcccaaattttcttctaagcaagaagacagggcactgaagccagcacaactatctccctctccagcccctgcaaactcaccaacagcaagtccttctcaacgtgaaaacaaacagcttctactaactgtcactctaggtatactgagaaatccagattt

SEQ ID NO: 154698 - DNA, 601 bp, Human
ttcgtggggtgcatagcagtcaccttctggtgggtaattgtgctctgcttgtaagtgaatacctgagggagggagaggaattcaattatttcattatcagcagtaagtgatttttcacacaagtttcccaaactgacaatacaatctcggtataatttcaggaaaaagattctaaattggacaatcaaaaatatatcgcaaaaatctctttcattttatgtcacctatctctctctctctctctgtgtgtgtatgtatgtgtgtgtgtgtgtgtgcgtgtgtgtgtgtgtgtgtgtgtgtrtatatatatatatacacatatctttgttgttgttgttgttttgaggcatgatttcactctgttactcaggctggagtgcagtggcatgattacagctcaccgcagcctccacctctgagactcaagtgatcctcccacctcagcctcccgagctgggactacaggcatgtgccaccagccagctaatttttgcatttttttttttttagatacagggttttgtcatgttgcccaggctggtctcaaacccctgggctcaagcaatccacctgtcttggccccccagaagtgctgggatta

SEQ ID NO: 154699 - DNA, 601 bp, Human
taagcattcactcaaacgtgaggatctttttaaaggaattacaagtggaacttacatatatttgatttctcttataccgctggaataagttatacatgatggagccgccatggagctctgtcaaggacgccatgtcatccacgccctcctcgttcgtggggtgcatagcagtcaccttctggtgggtaattgtgctctgcttgtaagtgaatacctgagggagggagaggaattcaattatttcattatcagcagtaagtgatttttcacacaagtttcccaaactgacaatacaatctcrgtataatttcaggaaaaagattctaaattggacaatcaaaaatatatcgcaaaaatctctttcattttatgtcacctatctctctctctctctctgtgtgtgtatgtatgtgtgtgtgtgtgtgtgcgtgtgtgtgtgtgtgtgtgtgtgtatatatatatatatacacatatctttgttgttgttgttgttttgaggcatgatttcactctgttactcaggctggagtgcagtggcatgattacagctcaccgcagcctccacctctgagactcaagtgatcctcccacctcagcctcc

SEQ ID NO: 154700 - DNA, 601 bp, Human
tcttattcatagtatgtattggcaatttagctgtcaggtttaacattattatcatgaaaagaggaaaataaataaaaaactttttaaaagggtctgccttttaaacccttgtgtagtttttttttccttctaatttacttactttttcttgactattgaaaatgtacaataacaacttgtgtctaggtgggcatgctggcacgtgcctgtaatcccaggtactcaggaggctaaggcaggaggatcactttagctcaggagtttgagtctagcctgggcaacatagcaagacactattacaaaaaaaaaacaaacttgtgttttttctctaatgacagcaaagtatgagtttcaaaatatagattgagcatcccttgtgtgaaatgcctgggacacaaagtgttgtggatttcaatattttttggattttggaatatttgcatactatgtactggttaagcataatttaagttaaattcaaaatccaaaatattcccaatgagcatttcctttcagcaacacatcagcatgcaaaatgtcttggattttgaagcattgtggatttggagtttttggattaggtatattcaacctatctgca

SEQ ID NO: 154701 - DNA, 601 bp, Human
tggcttcaatgataattttaaaaaatcatggtggctgctttatggataatatacaattttgcaagcctcaaacggaaggtctacaatggcataattaactgaactgaactgcaaattggatgcacaaaaatcctacgggtttccccttagaaaggaagaatatgaccttattccaagaccaagatcttattcatagtatgtattggcaatttagctgtcaggtttaacattattatcatgaaaagaggaaaataaataaaaaactttttaaaagggtctgccttttaaacccttgtgtagtttttttttccttctaatttacttactttttcttgactattgaaaatgtacaataacaacttgtgtctaggtgggcatgctggcacgtgcctgtaatcccaggtactcaggaggctaaggcaggaggatcactttagctcaggagtttgagtctagcctgggcaacatagcaagacactattacaaaaaaaaaacaaacttgtgttttttctctaatgacagcaaagtatgagtttcaaaatatagattgagcatcccttgtgtgaaatgcctgggacacaaagtgttgtggatttcaata

SEQ ID NO: 154702 - DNA, 601 bp, Human
aggagtgagttagaggctgcagggaacagcgatcatgtcactgcattccagcccaggagacaaagtgagaccctggctctaaaaaaaaaaaaaaaccaacaacaacaaaaaaaggaggacacgtatggtgggcagaataatggctcctcccgcaaagacatccatccacactcatcccagagcctgtgactagataatgtcacatggcaaaggggctctgcacaggtgattatggttatgaagcctgagatggggagatcatccagggaggcccaatctaatcatgtgaggccttaaaagmagacagcctttcttggctgcagtcagagagagagaaagaagacagtggaggagaaggaggaaagatttgaagccatgagagggaaacaatacatggttactggcactgaagatgaagaaagggagccacagatcaggagaccagggaatgtgagcggcctctagaagctgggaacagccctcaggtgacagtcagcaagaaaacaaggacctcagtcctccaactgcaagtaactgaattcagccaacgacacaatgagcaggaaacggatcctcctctagagcatctggaaacagacgc

SEQ ID NO: 154703 - DNA, 601 bp, Human
aacatagcaatgttttataaatttaaaaaaattaaaaaaacttaaaaattaaccaagtgcagtggctcacacctatagtcctatatattatatactgtagtactatatatatactcaggcgagaggatcactggagcccaggagtgagttagaggctgcagggaacagcgatcatgtcactgcattccagcccaggagacaaagtgagaccctggctctaaaaaaaaaaaaaaaccaacaacaacaaaaaaaggaggacacgtatggtgggcagaataatggctcctcccgcaaagacatccatccacactcatcccagagcctgtgactagataatgtcacatggcaaaggggctctgcacaggtgattatggttatgaagcctgagatggggagatcatccagggaggcccaatctaatcatgtgaggccttaaaagcagacagcctttcttggctgcagtcagagagagagaaagaagacagtggaggagaaggaggaaagatttgaagccatgagagggaaacaatacatggttactggcactgaagatgaagaaagggagccacagatcaggagaccagggaatgtgagcggcctc

SEQ ID NO: 154704 - DNA, 601 bp, Human
accacaaacacataccctgctcctcctctccttagcgggtatttgcccttgccaggtcttagcaggcggtgacaggagatgaagaagtctaggccctcatcagacccattccaaggaaggggacaatcaggagagagccaaccccctctcctcaaggcagcaaacccatagccaagaggttcagggtggaaacctggggcccctggctgggaactgggagcagagcagggctctagtcttgaagtggccagaggaaggataagattgatgaggggaagtctcaggcaggaagagcctgggattccaggaagagaatctaacaggggcatagaaggccgggcttctgcacaggcagttacagccagcgcagaggggctctaacccaggcactgcagcttaaaccacgcagtccagacctatggacactggcatcaaactcggtacggcctctgtcccctcagcgacaagcctgggacaggaatgcacccacaggaatagctaaagggcccagcggtaaggttcaggggcttcataagcacactcaaacccaagcctgtgtcatcatcacataaccctcaatgacaggacttcagctatccaa

SEQ ID NO: 154705 - DNA, 601 bp, Human
gacagccttctcccgctgcgatgaggccgcatcaagctcactctcagctctccatcttcatgtatggtgttcactggcctttccttctcatcagttcttttctttttctcttttgttgagacagggtcttgctctgttgcccaggctggagtacagtgacacaatctcggctcactgctgcctcaacctccccggctcaggcaatcctcccaccccagcttcctgagtagaagggactacaggggcacgccaccacggctggctaatttttgcaatcttttgtagagatgggacttcgccwaattgcccaggcttgtcttgaactcatgggctcaagcgatcctcccgcctcagcctcccaaagagctgggattacaagcatgagccaccatgccaggctttctactcaaccctgattgatctcatgcctttgtagcgtcaccaccaccaccacctccatagggcttcctgagccacacataggttatgtctctgtaccacaaacacataccctgctcctcctctccttagcgggtatttgcccttgccaggtcttagcaggcggtgacaggagatgaagaagtctaggccctcatcagac

SEQ ID NO: 154706 - DNA, 601 bp, Human
ctattgcataggctggagtgcagtggcacaatctcggctcactgcaaccttctcctcccaggttcaagcgattctcctgcctcagcctcccaagtagctgggactacaggcacccgccaccacgcctggctaatttttgtatttttagtagagatggggtttcaccatgttggccaggctggtctcaaactcctgaccttgtgatcagcctgcctcggcctcccaaagtgctgggattacaggcatgagccaccacgcccagccttgaaaggaatctaaacccaaagagagacaaggaagaaaaaaaaaaatcacaaaaaaacaagtttcaaattgccactctcatgtgctgatgtggaagcggccactccggagcataaatgtttggtaaagttttaaaatacatatagtcagacagatggttacaatcatcttttggctacgagtcttgatttcatgtggaaaaaaaaaaaagccaaaaaaacccagaaagtcctgactgtgttcatctgccccaagtgtgttcaaactgcactgcgttcatctgtcccaagggcaccccaatgccaaggcagtgctaaccaaccaaccacgcggcctt

SEQ ID NO: 154707 - DNA, 601 bp, Human
aatcccagcactttgggaggctgaggcaggtgggtcatttgaggtcaggagtttgagaccagcctggccaacatggcaaaaccccatctctattacaatttaaaaaaaaaaattagctgggcatggtggcgggcacctgtaatcccagctactggggatgctgaggtagaagaatcgggaggtggaggttgcagtgagccagaggttgcagtgaaccgagatcacgccactgcactccagcctgggccacagagtaagactctacctccaaaaaaaggccgggtgcgacggctcacacctrtgatcccagcactttgggaggcagaggcgggcggatcacgaggtcaggagatcgagaccacgttaacacggtgaaaccccatctctactaaaaatataaaaaaattagctgggcgtggtggcgggcgcctactacgtagtcccagctactcaggaggctgaggcaggagaatggcatgaacccaggaggaggagcttgcagtgagccaagatagtgccactgcactccaacctgggcgacagagcaagactccgtctcaaaaaaaaaaaaaatcaagtataactgagaaaacttaaagtg

SEQ ID NO: 154708 - DNA, 601 bp, Human
aatcctggctgggtgcagtagctcacacctgtaatcccagcactttgggaggccaaggccagcagattacttgaagtcaggagttcaagaccagcctggccaacatggtgaaaccccgtctctactaaaaatacaaaattagccaggcgtggtggcggatgcctgtaatcccagctactcgggaggctgaggcaggagaatcgcttgaacccaggaagcagagattgcagtgaaccatcatggcactgcactctagcccgggcaacacagtgagactccatctcaaaaaaaaaaaaaaaaraaaaagaaaagaaaaaaaagaaatcctaaggtctatgagacaacatttgccatgggctcacgtcatttctcactctatgaaaagatattgttaccgctccacaaacggccatgatgatgccatgcagtttaagactgtggacacatgcagctcccaaacacgaggtggggccacgtaccggtttcctcatgttggatttcaaattccacaagaataaataagctggtcggtttaatggcttttcagaaataggaagtacattctattttgaagcacataaaaacattttcttgtcagaaa

SEQ ID NO: 154709 - DNA, 601 bp, Human
ttcctctgagatttccctcggggtctttacccccttaatccaatcaccaaaaggtgatacagcagcccaagccctaatgaagtattttcgtaacaggtcaccaaagggagtgggggaagggcttcagctcacagaaggacttcacttactactgggtttttactgtttgtgtccatgcacatgacaaatggcacttctgaacctgctaaaacagggatgtaaaataacaccggcaaccatagtcatagttcccaatcgtttatttcaagaaagacaaattatggtcgcgcgcagaggctcmggcctgtaatcccagcactttgggaagctgaggcaggaggatcacctgaggtcaggagttcgagaccagccaaggcaggaggatggcttgagcccaggagtttgagaccagcctgggcaatgtggcgaaaccccatctctactaaaaatacgaaaattagctgggtgtggtagtgcatgcctgtagtcccagctactcggcaggctgaggtgggaggatcacctgagcctggggaggtcaaggctgtagtgagccatgaccactgcactccagcctgggtaatacagtgagaccccacct

SEQ ID NO: 154710 - DNA, 601 bp, Human
ggaaagaatatgtaaaatgtgtgtctggctggtacaaagaaagaacctgatttcttaagattatagaaaattttgcctcattgtataaaaattactcagtagacaacagcccaatattacttacttattaataattcaaaggcctcccttagactacctacctccatttagtacctatggccaaaaggattgtttacacattcgcacacccactcatttgctcttccataaccctgtgatgggcagcagaggtcactgctcctgcctcttctgacaggtaatggaaccggcaaggggacartaagatattgtccctacggtcacggagcccgtgagtcagagtgaaggcaggaaccctggatttttgagaatgtgccacactgtggatctacagcgaatgccttctccatcacccatccacccacagggctctgtcagcctcatcacctcatcacctcatcaccatggctgacgtctccttgtcccgtgtgttccacttttcattaactccagggcgacccacccactcccttcatctgtgctgtcctggtctgctcagggcctcaccttgcattgactaacttccacaaaggctccttcc

SEQ ID NO: 154711 - DNA, 601 bp, Human
cctgttatcccaacactttgggaggatcacttgagcccaggagttcaagaccggcctgggcaacacagtgagatcctctctctcaaaaaaaaaaaaaaatttacccatgtgtggtagcacatgcctgtattcccagccactagggaggctgaggtgggaggatggcttgagcccaggaggtcaaggcttcagtgagccgtgattgcatcactgcactccagccttggtaacaaagtggaaaccttgtctctttaaaaaaatttaaaaaaaaaattaaatttaaaaaaaggccaggcctgayggctcatgcccgtaatcccagcagtttgggaggccgaggcgggaggatcacttgagtccaggagttaaccagcctgggcactaatgtcaaaaccctgtctctacaaaaaatacattaaaaagttagccaggtatgatggtgcacacatgtggtctcagctactcaggaggctgaggtgggaggatcacctgagcccaggaggcagaggttgcattgaaccaagattgtgccaccgcactccagcctgacagagtgagaccctatctcaaaagaaaaaaaaaagtttcagcatacacacct

SEQ ID NO: 154712 - DNA, 601 bp, Human
ggtttagaccatatttcgtactctaaacaagagaaaactaagatacatatgttcataacatgtccggcatctgctgttttcaagattttccttaaacccacatcctccaagcactttcttattcttttttgcatattgccactaactcaaggatgttttttcaaactttttataccatgtataaaaaatattcagtaaacaacagccaaaaggtagaagcaacccatgtgtctgccaataaatgaacagatacaaaaaatgtggcacatccatacaacggaattattcagccctgaaaggratggaaattcagacccttgctacaacatggatgaacccttaagacattatgctaagtgaattatgacagtcacaaaaagataaacactgtgcgagtccacttgtatgaggtatccagaatactcaaattgatagagaaagtggaaatgtacaattccacttatatgaggatccagaataatcaaattgacagaaagtggaagggtggttgccaggggctggagatgggggaaatggggagctgttgtttaatgagtatggattcagttctgcaagaggagaagagttctggagattgctg

SEQ ID NO: 154713 - DNA, 601 bp, Human
tcagtatgtttaaaacctttcaccttttaaggtaagtaataaataaaagttacgtgcaccctagaagctgcctgcctcagatgtgtgacgatctttcatgccccatgatctactttatagctttaaactgaaccatgagttgaactccccaaattcctcaaaaaatggtcaggaccctttctgcttgttgggtagagaaagagcacttaaacagctgctcctgatttttaaagatcaatcatgcatttatttatttttgagacagagtctcgctccgttgcccaggctgccgtgcagtggygcaatctcagcttactgcagcctccgcctcccgggttaaagcaattctcctgcctcagcctcccgagtagctgggattacaggcgcccaccaccacacctggctaatttttgtatttttagtagagacgaatggggtttcaccacattagccaggctgctctcaaactcctggcttcatctggcctgcttgcatcagcctcccaaagtgctggcattacaggcatgagccaccatgcctggctaagatcatacatttaatggtacatggctatattccaacatgactctgtaagaatgta

SEQ ID NO: 154714 - DNA, 601 bp, Human
tcctacaataatattgatctttgtatctgactcttacaataaaatgcatgcttcatctgtcagtcagcctagtgagttaccatgaaaaaaatatggtccctcattactacacattgtcaataaatttaaaatcccggccagctacggtgggtcatgactataatcccagcacttttggaggccaaggtgggagaactgcctgagccaaggagttcaagaccagcctgggcaatataggaagaccccatctctacttaaaaatatatttttaaaattctgcataaatattaataacagactkttgctgctttaggcaagaaagccttgattgttcccgttttgatgagaagcttctgaagggtacagcatgtgctcgtgggttctttacccaggttaggaacctgatttcatcttttcttgaggattctgggactcattcaggctctccgcccataaaagcgatgcccacagcaagtgaggaagactctatcttctaatctacaatgaaaccaccccaggctcctaagcttccgctgttctccaatctgcttggcctcactacactggttctttctcagccttgccatgcgccacccccgtg

SEQ ID NO: 154715 - DNA, 601 bp, Human
caaaatggtctcatgcttgactttttacagtaattcacaccacaccttgtccagtgaaatagtttttaaatgtttcagaatgacaatgtagtagctgtggcaactagagacaacatatgcaacccagaaatcaatgtccacaggtcctcttccaccagaatcagcagtgctttagaagagaaatacttttttttttttttgagactgagtctcgctctgtcatccaggctggagaacagtggcacaatctcggctcactgcaaccttcgcctcccgtgttcaagcgattctcctgtctcascttcccaagtagctgggataacaggtgtgtgcccctacgcccacctaatttttgcatttctactagagacgggatttcatatattttggccaggctggcctcaaactcctgacctcaggtgatccacccacctcagcctcccaaagtgctgggattacagatatgaaccactgtgcccggctgagaaaggactcttaacagcggacgctccctggggaggcagcccacagactctgcagaattatgtggcatccttgctgatggtcacgcagctcacaaaaggcatcgggatactctcct

SEQ ID NO: 154716 - DNA, 601 bp, Human
agagcatccttttaagatactgctcgttctgacagtgtggatgacatgggctttgaatgaaggtagaagacaaagtggcattaagcctgttagcaaaggtgaagacgcaacatccaaaatggtctcatgcttgactttttacagtaattcacaccacaccttgtccagtgaaatagtttttaaatgtttcagaatgacaatgtagtagctgtggcaactagagacaacatatgcaacccagaaatcaatgtccacaggtcctcttccaccagaatcagcagtgctttagaagagaaatacttttttttttttttgagactgagtctcgctctgtcatccaggctggagaacagtggcacaatctcggctcactgcaaccttcgcctcccgtgttcaagcgattctcctgtctcaccttcccaagtagctgggataacaggtgtgtgcccctacgcccacctaatttttgcatttctactagagacgggatttcatatattttggccaggctggcctcaaactcctgacctcaggtgatccacccacctcagcctcccaaagtgctgggattacagatatgaaccactgtgcccggctgaga

SEQ ID NO: 154717 - DNA, 601 bp, Human
aaatgatatgcccatatcattttgcatgccccattcatgacacgtttgtatggttgctgtaaaattctaagatgagcctttctttcttaaggcactgatttacttataaaaccattattaaaacttcttacacagctttcttcaaaagaatgatcatgttttttaaaccatattcctcctcctggttggggaacctcactagccatagagcatccttttaagatactgctcgttctgacagtgtggatgacatgggctttgaatgaaggtagaagacaaagtggcattaagcctgttagcaaaggtgaagacgcaacatccaaaatggtctcatgcttgactttttacagtaattcacaccacaccttgtccagtgaaatagtttttaaatgtttcagaatgacaatgtagtagctgtggcaactagagacaacatatgcaacccagaaatcaatgtccacaggtcctcttccaccagaatcagcagtgctttagaagagaaatacttttttttttttttgagactgagtctcgctctgtcatccaggctggagaacagtggcacaatctcggctcactgcaaccttcgcctcccgtgttc

SEQ ID NO: 154718 - DNA, 601 bp, Human
tgcattctctctgtctcacactcaagctttctcatcatgtgatgcctcaggccatgacacagcaagagggtcccaccagatgccagcgccatgctcttggactggccagtctccagaaccataagccaagtaaacttttgctccttataaattacccagtgtgtggtatcctgttttggcagcagaaagcatactgaaacagagttgttggttgtacagcattgtgaatgtactaaatgccactgagttgtacacttcaaaatggttaattttatgttaaatgaatttcaccttaattagaaaaaaaaagatctggtgcttttatgagtaaatgttcaggtccttggaaacatcaactctctagaaaacccattttgtcctgtcggagcactatggggaagatttggccagaaaaaaaaagatggaagttggaaaaaaaaaagtgtcctactccttgggatgcctccatcctccatcagtgcctggaccacagacactccagtgcctccttctatctaacatctgcagaggtgagggagcaggcagacaatacttgaggctgtgagtgcctggccccttccactactttgtttaaaatgcc

SEQ ID NO: 154719 - DNA, 601 bp, Human
acagaaagtccaaacatcctgagagcatctataccatattatagcaatttgtaatattttatattcatagtatcagccaggaacatcaagcaaagtattgttttgttcagtataacttttcaaatgcaaataagtccatacaggttgagtatcactaatccgaaaaccaaaatctgaaatgctgtaaaatctgaagctttttgagcaccaacatgatgctgaaaagaaatgttcatgggggcatttcagatttcagattttctgatgagggatgcccaactggtaagtataatgcagatayttctaaatcagagaaaatatcagaagtccaaaacacttcaggtcccaagcattctggataagggttactcaacctggaatgtgttttggaaataatatgaagcaaaagatttaaaaaaaggttaaaaacataaaagatattaccatatgacccagcgattccactcctagatacatatcaaaaagaagcgaaagaaaatactcaaacacttgtacacacatgttcacagaagcaccattcacaacagccaaaggtggaaacaatgccaagggcccatcatcagatgaatggatgtggcat

SEQ ID NO: 154720 - DNA, 601 bp, Human
tggagataggggctttaaataagtgactaacttaaaatgaggccattagggtgggccctaatccaatctgactggtgtctttgttagaagaggaaatttgaacacacaaaaagacaccagggatgcatacacccaggggggttggcggagggtaacaaaaaacaagaaaactagacagaaagtccaaacatcctgagagcatctataccatattatagcaatttgtaatattttatattcatagtatcagccaggaacatcaagcaaagtattgttttgttcagtataacttttcaaatgyaaataagtccatacaggttgagtatcactaatccgaaaaccaaaatctgaaatgctgtaaaatctgaagctttttgagcaccaacatgatgctgaaaagaaatgttcatgggggcatttcagatttcagattttctgatgagggatgcccaactggtaagtataatgcagatacttctaaatcagagaaaatatcagaagtccaaaacacttcaggtcccaagcattctggataagggttactcaacctggaatgtgttttggaaataatatgaagcaaaagatttaaaaaaaggttaaa

SEQ ID NO: 154721 - DNA, 601 bp, Human
agtacttaagaatgttactatgcttggagataggggctttaaataagtgactaacttaaaatgaggccattagggtgggccctaatccaatctgactggtgtctttgttagaagaggaaatttgaacacacaaaaagacaccagggatgcatacacccaggggggttggcggagggtaacaaaaaacaagaaaactagacagaaagtccaaacatcctgagagcatctataccatattatagcaatttgtaatattttatattcatagtatcagccaggaacatcaagcaaagtattgttwtgttcagtataacttttcaaatgcaaataagtccatacaggttgagtatcactaatccgaaaaccaaaatctgaaatgctgtaaaatctgaagctttttgagcaccaacatgatgctgaaaagaaatgttcatgggggcatttcagatttcagattttctgatgagggatgcccaactggtaagtataatgcagatacttctaaatcagagaaaatatcagaagtccaaaacacttcaggtcccaagcattctggataagggttactcaacctggaatgtgttttggaaataatatgaag

SEQ ID NO: 154722 - DNA, 601 bp, Human
actaaccaccaaccaacttttacaaagctcgtacagtgtgtctagggctttatgggctgttaagggctgattcatgccttctccccaaattcacatgctgaagccctaatcccaagtacttaagaatgttactatgcttggagataggggctttaaataagtgactaacttaaaatgaggccattagggtgggccctaatccaatctgactggtgtctttgttagaagaggaaatttgaacacacaaaaagacaccagggatgcatacacccaggggggttggcggagggtaacaaaaaacaagaaaactagacagaaagtccaaacatcctgagagcatctataccatattatagcaatttgtaatattttatattcatagtatcagccaggaacatcaagcaaagtattgttttgttcagtataacttttcaaatgcaaataagtccatacaggttgagtatcactaatccgaaaaccaaaatctgaaatgctgtaaaatctgaagctttttgagcaccaacatgatgctgaaaagaaatgttcatgggggcatttcagatttcagattttctgatgagggatgcccaactggtaagta

SEQ ID NO: 154723 - DNA, 601 bp, Human
ccaggctagtctcgaactcctggttttgagtgatcctccctccttggcctcccaaagtgctaggtctgtgaatgtacctaatatgactgaattgtacacttcaaaatagtcaaaatggcaaattttatgctatgcagagttagctacagcttttaaaagataacgtgaccatttcgaaaatgctaggtatcagaccgagcgcagtggctcacgactgtaatcccagcattttggggggccgaggtgcgaggatctcaagatcaggagaccaagaccaccctggctaacagagtgaaacccygtctctactaaaaatacaaaaaattagccaggcccggtggcacacacctgtaatcccagctactcgggaggctgaggcaggagaatctcttgaacctgggaggtggaggttgcagtgagccaagattgcgccactgcactccaacctgggcgacagagcgagactctgtcaaaaaaaaaaaaaaaaagaacagagagagagcgagagcgagaaagagaaagagcgagcgtgcgagagagagagagagaaagaaagaaggaaagaaagaaagaagaaaagaaagaaggaaagaaagggaaa

SEQ ID NO: 154724 - DNA, 601 bp, Human
gagacatggtcttgctttgttacccaggctagtctcgaactcctggttttgagtgatcctccctccttggcctcccaaagtgctaggtctgtgaatgtacctaatatgactgaattgtacacttcaaaatagtcaaaatggcaaattttatgctatgcagagttagctacagcttttaaaagataacgtgaccatttcgaaaatgctaggtatcagaccgagcgcagtggctcacgactgtaatcccagcattttggggggccgaggtgcgaggatctcaagatcaggagaccaagaccaycctggctaacagagtgaaaccccgtctctactaaaaatacaaaaaattagccaggcccggtggcacacacctgtaatcccagctactcgggaggctgaggcaggagaatctcttgaacctgggaggtggaggttgcagtgagccaagattgcgccactgcactccaacctgggcgacagagcgagactctgtcaaaaaaaaaaaaaaaaagaacagagagagagcgagagcgagaaagagaaagagcgagcgtgcgagagagagagagagaaagaaagaaggaaagaaagaaagaagaaa

SEQ ID NO: 154725 - DNA, 601 bp, Human
ttatttatttttatttttaattttttttgtagagacatggtcttgctttgttacccaggctagtctcgaactcctggttttgagtgatcctccctccttggcctcccaaagtgctaggtctgtgaatgtacctaatatgactgaattgtacacttcaaaatagtcaaaatggcaaattttatgctatgcagagttagctacagcttttaaaagataacgtgaccatttcgaaaatgctaggtatcagaccgagcgcagtggctcacgactgtaatcccagcattttggggggccgaggtgygaggatctcaagatcaggagaccaagaccaccctggctaacagagtgaaaccccgtctctactaaaaatacaaaaaattagccaggcccggtggcacacacctgtaatcccagctactcgggaggctgaggcaggagaatctcttgaacctgggaggtggaggttgcagtgagccaagattgcgccactgcactccaacctgggcgacagagcgagactctgtcaaaaaaaaaaaaaaaaagaacagagagagagcgagagcgagaaagagaaagagcgagcgtgcgagagagagagaga

SEQ ID NO: 154726 - DNA, 601 bp, Human
tattatttatttttatttttaattttttttgtagagacatggtcttgctttgttacccaggctagtctcgaactcctggttttgagtgatcctccctccttggcctcccaaagtgctaggtctgtgaatgtacctaatatgactgaattgtacacttcaaaatagtcaaaatggcaaattttatgctatgcagagttagctacagcttttaaaagataacgtgaccatttcgaaaatgctaggtatcagaccgagcgcagtggctcacgactgtaatcccagcattttggggggccgaggygcgaggatctcaagatcaggagaccaagaccaccctggctaacagagtgaaaccccgtctctactaaaaatacaaaaaattagccaggcccggtggcacacacctgtaatcccagctactcgggaggctgaggcaggagaatctcttgaacctgggaggtggaggttgcagtgagccaagattgcgccactgcactccaacctgggcgacagagcgagactctgtcaaaaaaaaaaaaaaaaagaacagagagagagcgagagcgagaaagagaaagagcgagcgtgcgagagagagaga

SEQ ID NO: 154727 - DNA, 601 bp, Human
ctcaaaaaaagttatggaagtggttggtacttgtggatgcagaacattgtgaatgtccttattattatttatttttatttttaattttttttgtagagacatggtcttgctttgttacccaggctagtctcgaactcctggttttgagtgatcctccctccttggcctcccaaagtgctaggtctgtgaatgtacctaatatgactgaattgtacacttcaaaatagtcaaaatggcaaattttatgctatgcagagttagctacagcttttaaaagataacgtgaccatttcgaaaatgytaggtatcagaccgagcgcagtggctcacgactgtaatcccagcattttggggggccgaggtgcgaggatctcaagatcaggagaccaagaccaccctggctaacagagtgaaaccccgtctctactaaaaatacaaaaaattagccaggcccggtggcacacacctgtaatcccagctactcgggaggctgaggcaggagaatctcttgaacctgggaggtggaggttgcagtgagccaagattgcgccactgcactccaacctgggcgacagagcgagactctgtcaaaaaaaaaaaa

SEQ ID NO: 154728 - DNA, 601 bp, Human
gggagaaggacatttacaatttaatgggtgcagagtttctatttagggtgatggggaagttctggaagtgggccgggcctggtggctcatgcctgtaatcccagcacttccagaggctgaggcgggcagatcacctgaggtcaggagttcaaggccagcctggccaacatggtgaaaccccatctctactaaaaatacaaaaattagccaggcatggtgatgcctgcctgtaatccctacacaggaggctgggaaaggagaatcacttgaacccaggagccggaggttgcagtgacccaaratagtgctactgcactccagcctgggcgacagagtgagattccatctcaaaaaaagttatggaagtggttggtacttgtggatgcagaacattgtgaatgtccttattattatttatttttatttttaattttttttgtagagacatggtcttgctttgttacccaggctagtctcgaactcctggttttgagtgatcctccctccttggcctcccaaagtgctaggtctgtgaatgtacctaatatgactgaattgtacacttcaaaatagtcaaaatggcaaattttatgctatgcag

SEQ ID NO: 154729 - DNA, 601 bp, Human
gggggagaaggacatttacaatttaatgggtgcagagtttctatttagggtgatggggaagttctggaagtgggccgggcctggtggctcatgcctgtaatcccagcacttccagaggctgaggcgggcagatcacctgaggtcaggagttcaaggccagcctggccaacatggtgaaaccccatctctactaaaaatacaaaaattagccaggcatggtgatgcctgcctgtaatccctacacaggaggctgggaaaggagaatcacttgaacccaggagccggaggttgcagtgacccraaatagtgctactgcactccagcctgggcgacagagtgagattccatctcaaaaaaagttatggaagtggttggtacttgtggatgcagaacattgtgaatgtccttattattatttatttttatttttaattttttttgtagagacatggtcttgctttgttacccaggctagtctcgaactcctggttttgagtgatcctccctccttggcctcccaaagtgctaggtctgtgaatgtacctaatatgactgaattgtacacttcaaaatagtcaaaatggcaaattttatgctatgc

SEQ ID NO: 154730 - DNA, 601 bp, Human
agaggtagccaggggttgggggagaaggacatttacaatttaatgggtgcagagtttctatttagggtgatggggaagttctggaagtgggccgggcctggtggctcatgcctgtaatcccagcacttccagaggctgaggcgggcagatcacctgaggtcaggagttcaaggccagcctggccaacatggtgaaaccccatctctactaaaaatacaaaaattagccaggcatggtgatgcctgcctgtaatccctacacaggaggctgggaaaggagaatcacttgaacccaggagccrgaggttgcagtgacccaaaatagtgctactgcactccagcctgggcgacagagtgagattccatctcaaaaaaagttatggaagtggttggtacttgtggatgcagaacattgtgaatgtccttattattatttatttttatttttaattttttttgtagagacatggtcttgctttgttacccaggctagtctcgaactcctggttttgagtgatcctccctccttggcctcccaaagtgctaggtctgtgaatgtacctaatatgactgaattgtacacttcaaaatagtcaaaatgg

SEQ ID NO: 154731 - DNA, 601 bp, Human
ctccaacaaaacccaccgagtgtgcgccgggggaaagacgtcttctgtctcccgggtgcacactgtccctgcctttctgggtaccaaatcttgatattctggacaaatgaatgaagccatttcaaagagggatggcagtgaaagggaaacaagagaaggaagatggtgaggcggcccaggcccagtccctgctccccaggccctgctccccaggcccagatccctgctccccgctgacctcaccaatcttaatcccttcccatgggcaaaggactggccaggtccagtctcctgtctcatyaaatggctactgtgaaacagcatggttaaaaagtgacgggacagaaaggagaagagaggtagccaggggttgggggagaaggacatttacaatttaatgggtgcagagtttctatttagggtgatggggaagttctggaagtgggccgggcctggtggctcatgcctgtaatcccagcacttccagaggctgaggcgggcagatcacctgaggtcaggagttcaaggccagcctggccaacatggtgaaaccccatctctactaaaaatacaaaaattagccaggcatggtgatgcctgc

SEQ ID NO: 154732 - DNA, 601 bp, Human
agtccgactggctgtgagccccgttacctgatgaggatgcactggttgtcgtggcgcttccacaggcagcggtagcactcgttggcgatggcgaagatgtgcgggggcagctcgcccaggtggcgccggctgtactgctccatggtggcaggctcgtacagcccggcgatgggctggtaggggttcacggaggccaggatggagccgatgtaggtctgcaagcacagagtgagacagggatgcgtcacttctaacccaggccactggatgagctccaacaaaacccaccgagtgtgcgccaggggaaagacgtcttctgtctcccgggtgcacactgtccctgcctttctgggtaccaaatcttgatattctggacaaatgaatgaagccatttcaaagagggatggcagtgaaagggaaacaagagaaggaagatggtgaggcggcccaggcccagtccctgctccccaggccctgctccccaggcccagatccctgctccccgctgacctcaccaatcttaatcccttcccatgggcaaaggactggccaggtccagtctcctgtctcatcaaatggctactgtgaaacagcatggtta

SEQ ID NO: 154733 - DNA, 601 bp, Human
aaaacagaaaactctgtcggagaaactcaggcggttgtaaaagcttcctctggttaatgccctaaggaggctggggttgggggtgcgcggagggactcctgggccatgggaaagtccgactggctgtgagccccgttacctgatgaggatgcactggttgtcgtggcgcttccacaggcagcggtagcactcgttggcgatggcgaagatgtgcgggggcagctcgcccaggtggcgccggctgtactgctccatggtggcaggctcgtacagcccggcgatgggctggtaggggttcacrgaggccaggatggagccgatgtaggtctgcaagcacagagtgagacagggatgcgtcacttctaacccaggccactggatgagctccaacaaaacccaccgagtgtgcgccgggggaaagacgtcttctgtctcccgggtgcacactgtccctgcctttctgggtaccaaatcttgatattctggacaaatgaatgaagccatttcaaagagggatggcagtgaaagggaaacaagagaaggaagatggtgaggcggcccaggcccagtccctgctccccaggccctgctccccaggccc

SEQ ID NO: 154734 - DNA, 601 bp, Human
ttattttaaaaatactcgccgggagcggtggctcacgcctgtaatcccagcactttgggatgctgaggcaggcggatcacctgaggtcgggagtttaagaccagcctgaccaacacagagaaactccgtctctactaaaaatgcaaaattagctggggtggtggcgacgcatgcctgtaatcccagctactcgggaggctgaggcaggagaatcacttgaacccaggaggcggaggttgcagtgagctgagatcgcaccattgcactccagcctgggcaacaagagcgaaactccaactcaaaaaaaaaaaaaagaaattctactacttttttagacagtttctagtaataaaggagctgatattggggctcctaatagtttctttgtaaaagcgagtacgactcagctaaaatagacatgccaagtgccttctcacccactaaaaaaaaatattgaaataaacatgcccttaacatacacacagtaagcccctcttctgtggctaattaactttaagagcaccctattattaaaaattcctaaatttgggagattctatctagagttattttattgcagtagagaaaaaagaaaccttgt

SEQ ID NO: 154735 - DNA, 601 bp, Human
agccattgtgcccagccaataaatatttattttaaaaatactcgccgggagcggtggctcacgcctgtaatcccagcactttgggatgctgaggcaggcggatcacctgaggtcgggagtttaagaccagcctgaccaacacagagaaactccgtctctactaaaaatgcaaaattagctggggtggtggcgacgcatgcctgtaatcccagctactcgggaggctgaggcaggagaatcacttgaacccaggaggcggaggttgcagtgagctgagatcgcaccattgcactccagcctgggcaacaagagcgaaactccaactcaaaaaaaaaaaaaagaaattctactacttttttagacagtttctagtaataaaggagctgatattggggctcctaatagtttctttgtaaaagcgagtacgactcagctaaaatagacatgccaagtgccttctcacccactaaaaaaaaatattgaaataaacatgcccttaacatacacacagtaagcccctcttctgtggctaattaactttaagagcaccctattattaaaaattcctaaatttgggagattctatctagagttattttat

SEQ ID NO: 154736 - DNA, 601 bp, Human
ctagaaagccatctgaagcagatgtcggaatcttcgttcacactggcagctttacaagactgtggctcctcagtaacaactataccccgtgagtgaactcctgcgaggagaaatgaatgaagaaatgcttggcgcctccacggaaacctcactagaagagactgacatgcatcccgtctgctctgagtatcacccaggggtgtgaggatcatcactagagcacaggtccaatagaaataattaacaaactccaacaggatgtcaatagcatacatgtgatgaggtcaatttgaatgttaayaataaaaattaagaaattttatttatttatttattgagaaggagtctcactctgtcacccaggctggagtgcagtggtgtgatctcagctcactgcaacctccacctccgggttaaagtgatcctcccatctcagcctcgcaagtagctggaactataggcatgagccaccgcgcctggctgattttgcatttttagtagaaatggggtttcatcatgttggccaggctggtctccaactcctgaactcaagtgaaccaccctcctcggcctcctaaagtgctgggagtacaagtgtgag

SEQ ID NO: 154737 - DNA, 601 bp, Human
ggctgcagtgctcacaggcccacttggctgggagtcttaggctgacatatggctctccatatgtctcctgtggtcttacttccactgaatcggaaatccggagagaggggtctttttagtgtccccccctcccccgacatcacccgccaaatccaaaccaccctttcctctccctttcccattcctcctgaaataacataataactattctgaggaaataatataattattctgaggacgagagccaagttgccacaagttgggactagaaagccatctgaagcagatgtcggaatcttcrttcacactggcagctttacaagactgtggctcctcagtaacaactataccccgtgagtgaactcctgcgaggagaaatgaatgaagaaatgcttggcgcctccacggaaacctcactagaagagactgacatgcatcccgtctgctctgagtatcacccaggggtgtgaggatcatcactagagcacaggtccaatagaaataattaacaaactccaacaggatgtcaatagcatacatgtgatgaggtcaatttgaatgttaataataaaaattaagaaattttatttatttatttatt

SEQ ID NO: 154738 - DNA, 601 bp, Human
catcatggccaccagttacctggctatacccatgaccaggtgggtctgtctgtgtgattcggggctgcagtgctcacaggcccacttggctgggagtcttaggctgacatatggctctccatatgtctcctgtggtcttacttccactgaatcggaaatccggagagaggggtctttttagtgtccccccctcccccgacatcacccgccaaatccaaaccaccctttcctctccctttcccattcctcctgaaataacataataactattctgaggaaataatataattattctgaggamgagagccaagttgccacaagttgggactagaaagccatctgaagcagatgtcggaatcttcgttcacactggcagctttacaagactgtggctcctcagtaacaactataccccgtgagtgaactcctgcgaggagaaatgaatgaagaaatgcttggcgcctccacggaaacctcactagaagagactgacatgcatcccgtctgctctgagtatcacccaggggtgtgaggatcatcactagagcacaggtccaatagaaataattaacaaactccaacaggatgtcaatagcataca

SEQ ID NO: 154739 - DNA, 601 bp, Human
gaaaggcagcacctgcctgcttttctccaccatctgggaatcagtttcccacagtcatcatggccaccagttacctggctatacccatgaccaggtgggtctgtctgtgtgattcggggctgcagtgctcacaggcccacttggctgggagtcttaggctgacatatggctctccatatgtctcctgtggtcttacttccactgaatcggaaatccggagagaggggtctttttagtgtccccccctcccccgacatcacccgccaaatccaaaccaccctttcctctccctttcccattyctcctgaaataacataataactattctgaggaaataatataattattctgaggacgagagccaagttgccacaagttgggactagaaagccatctgaagcagatgtcggaatcttcgttcacactggcagctttacaagactgtggctcctcagtaacaactataccccgtgagtgaactcctgcgaggagaaatgaatgaagaaatgcttggcgcctccacggaaacctcactagaagagactgacatgcatcccgtctgctctgagtatcacccaggggtgtgaggatcatcactaga

SEQ ID NO: 154740 - DNA, 601 bp, Human
gagctttctgtttgggatccacccccctctcccccttatttttaaataccatgaaaatgccaacctccttccgttttaatacatacatacacacacacacacatacacacacacacacacatatgcacaatgatctcatttgatgtttcgctttcttctttagcggctctgtctagcaaatgatatattagtcatgctctcattttttccactgaatgtaataaatacaagcaattatcaatggcaattatttaaggatctaagtgtggacaccaacttgatctgttaaaatagattgttytcttcccttctgttaatcttcttaaattatattctgtatgctgaaataatgatctttaaattctaactccagaacttttatgaagtcatttagaagagcccacaaatagtggttctagtcacagattaaattgttttattgggtatgtgaatcttaaaagctgtttctatattaagcagccgcttcatttcgattaactgcaagccgttatgatccctatctgtttaactgaatacactgacagtccctctatccaagttgtttctatggcccaacaaattattagtcctgttagacttt

SEQ ID NO: 154741 - DNA, 601 bp, Human
acaaaaaacagaaatacagacttcacaggcagagagactgaagttcaaatcctatgtttgttgccaatagctaaagtttcttcagcaagccaaccaaacagttctgggcctcggcttccctacagaaaatgcctcttgggcccctctgaggaatacacaagaataagtcttctcgatgaatttcagttcctttttctttgtgtttcccactccacctctttcatctgctatattacaagagcacgcccccatgccttattctgcttggtgcctttctaatcgaggatgcaagttttgttcmgcattccaacactatcacctctaaatgtatttctagaaatagaaaaagaccaaacactcaattaccagtccaggacatggttaagtagaaatcactcaagttttgaaaaaccaaaacacacaaagcaagcaaagatcctgaaccaacagtcattctgtatattcatcctttgattggcagctgttgaatgctggtcctctcccagacactgtgctgggtaccaggctgcaaagatgaattagccacaggccttgtctgtattatacaccttaagaagtcatatgtactgcaaagaccaca

SEQ ID NO: 154742 - DNA, 601 bp, Human
ccaaaggtcttagcaagccaaacaaagcccttttgtttggaagctgtaccagaaagtaggattctgttctggaaatacagacttcactcatgcctgtaatcttagcactttgggaggctgaggcaggcagatcacttgaggtcaggagttggagaccagcctgaccaacatggtgaaacctcatatcgtaaaaatacgataaaaaaaagttagccagccatgatggtgcacgcctgtaaccccagctacctgggaggctgaagcaggagaattgcttgaacttgggaggaggagccgagaytgtgccaccgcactccagcatgggcaacagagcaagactctatctcaaaaaacaaacaaaaaacagaaatacagacttcacaggcagagagactgaagttcaaatcctatgtttgttgccaatagctaaagtttcttcagcaagccaaccaaacagttctgggcctcggcttccctacagaaaatgcctcttgggcccctctgaggaatacacaagaataagtcttctcgatgaatttcagttcctttttctttgtgtttcccactccacctctttcatctgctatattacaagagcacg

SEQ ID NO: 154743 - DNA, 601 bp, Human
gatgcagcaatgtcctcgggtgagcagagaggagggatccatgacacacctgaaggaaaaggaatctgatacgagcagggcctttggtgcacaggacacgctagcctcccagcagcacacatcaaggctggcagttttctagatccagcccatgtgtcagcaaacaatggtcctcaactctgacctgctgcctgtttttataaataaagttttattggaacacagtgcaggctgtgcgttgcatactgagtgctttcacactacaagggcagagttgattagttgcaacagaggtgctttygcccacaaagcctaaaatatacactctttggctctttacacaaaactttttgctgccatctataacactacttagaaatcaattcccttgatccacatgattttctcaaaatataaatcggatcattccttcaattgttagatgaacttgggaaacttctctactgcctaaaagattaactccaaaggtcttagcaagccaaacaaagcccttttgtttggaagctgtaccagaaagtaggattctgttctggaaatacagacttcactcatgcctgtaatcttagcactttgggaggct

SEQ ID NO: 154744 - DNA, 601 bp, Human
ggggaagaatcacttccagatctcaggcttgggacagggtaggatggagaggctactggctgagaataggaggcacaagaggagggacaagtttctgggagaagatgatactgactttagaacatgccacccctgagacatctcagtgatgacacctaaggggcactgggacttaagtctgggactcaaatgagaagttgagggtgtataaacttggagagtcctgcagactcagagaagaaaacgcaggtgggtgagaagacagcagatgaaaaatgactgagaagctgaggagtggccrtggagagccaggaagaaatataggatggggcgccatggtggggggcgtgggggcagcttgctgagacgaaggagtagttgaatgaggctgtggaaccaaacgagcatcttttgtatttttttccaagatggaacatactaaaagattttgaataacgtcaacaatccagttgagagagaggtcaaagaatccagggcaaggaggctcagagatgcagcaatgtcctcgggtgagcagagaggagggatccatgacacacctgaaggaaaaggaatctgatacgagcagggcctttggtgc

SEQ ID NO: 154745 - DNA, 601 bp, Human
cagcctcacataattcagataggactctaccaggaggtaagtggtgtctactcatatattgggctgtggaagtgttttacaaacaacagggcaaagaagaaatataattaaataactcacaaactgctaaaacccagaaatatgccagatgtcccgagatactaatgtcaaggtcacagactctgcaggtagtacatttctgtctaacccgtctcctcctcctccagcctgcagttccacttggtcctcattagcccaaggcaattacagttctatgccttgtgccagcaggccagccaayacaaacacaggctttggcaaaaatgtgtgcattcagattaaccaaaaggagcttatattgttttgttttgctttaaaaaaaaaaaaaaaaaaaaaaactttctaactataataatgaaaatgtgaaaacaaacccaaagcactgatggggggccacaggctgtattaaaaattgtgagaattttttgtaagcacaatggaaagtcacaagacagttcctaagcaggagagtgtcatgatcagatttaagcttctaaaggatcgttcttttgtgtgtgtgtgtgtgagtttcgctctgtct

SEQ ID NO: 154746 - DNA, 601 bp, Human
aggcagtaacaaggggaccaagtgtagccagttgaacaactgagccatggggctatcagccacttctatgcctggtagctaaaaacccccttcacagtcctctgggctccaccttccgcttgccacctaagtgtcctcagagatggtacatctcccaagcaaagaagcctacagagtagactcgagtccctcccctacccaccaggggccgtgagaggagcaagaaatagaccatccctgtgttacacccctaagatttgatggctgtctgtcatagcagccagcctaccttggctcaccsaatatggcaaaaatacaattatggagaagatacgatactcttcaaactctacagcagaggcttggtcaaagaaagaaaacccaggattctcgtcgtcataaagatgcttcaagagtgtatgacacattgagaaaaaatacggctggaaatggaccaagtcatggatatcaatctctgtcaatctcttatacaggtggaagatctcctatctgaaatgctggggacgagaagtgtttctgatttcagattctggattttgagaatatctgcattataccaactgagtaaccctaaatctga

SEQ ID NO: 154747 - DNA, 601 bp, Human
cccagccggggcgggggctgaatccacatccctgaaactgccctgcctcatgtagtctgaaatagtaaaaggcagcataaattaggccacctttagttggggtttcccttaccagccaccagaatcttcccagtacagagcttagcatacattgaataactggcatctgctcagcccagtgcctggcacgggggaggcattcaacaacagtgcacagaatgactcacagaaaccaagagagacagtttcaaggaacgatttaaatcatcttccatatttaaaacatatctatattgacgcracagctgttggtggctgagttattaaaacaaaaactagaaggttaagttgtctagtgaaaatggtgaggcagaaataatgttatgtgttcctctacctacctctttatcctcgggcacacagaagccgaaaacatttagactcccttgcagtaaaaacagcaggcagaggccgggcactgtggcttgcgcctgtaatcccagcaccatgggaggctgaggcgggtggattacttgaggtcagaagtttgagaccagcctggctaacatggtgaaaccctgtctctactcaaaatacaaaa

SEQ ID NO: 154748 - DNA, 601 bp, Human
cccttttgcgttctaaagagaagtcctgtggagtaccaagagctgggacgttatcaagaaagaggaattttgctaaaaatgtgaatcaattgcatgtaataaaagagaagaaatgactcagagatgacgccaacatgccgggctgggtgcaggggtcccagggatctccactggtctagacaaccacagtcctttcacctgctctgctagcgacaggcctgggcaggggccagtgtcacgattccacaaagacataatgtcgtaatgtcaagggtactgtgggctcctaggggaggtttgygcacacacacgacactgggcggaaatgtcccttttgcggcagacaacaaagatctgacgatctaaacctgtcttgaaatcataaagcaaaagccaagaaaatcagaggcaagcccagccggggcgggggctgaatccacatccctgaaactgccctgcctcatgtagtctgaaatagtaaaaggcagcataaattaggccacctttagttggggtttcccttaccagccaccagaatcttcccagtacagagcttagcatacattgaataactggcatctgctcagcccagtgcctggca

SEQ ID NO: 154749 - DNA, 601 bp, Human
ctgacaaccgctgaatggtgggatgggcagatgagccccttttgcgttctaaagagaagtcctgtggagtaccaagagctgggacgttatcaagaaagaggaattttgctaaaaatgtgaatcaattgcatgtaataaaagagaagaaatgactcagagatgacgccaacatgccgggctgggtgcaggggtcccagggatctccactggtctagacaaccacagtcctttcacctgctctgctagcgacaggcctgggcaggggccagtgtcacgattccacaaagacataatgtcgtartgtcaagggtactgtgggctcctaggggaggtttgcgcacacacacgacactgggcggaaatgtcccttttgcggcagacaacaaagatctgacgatctaaacctgtcttgaaatcataaagcaaaagccaagaaaatcagaggcaagcccagccggggcgggggctgaatccacatccctgaaactgccctgcctcatgtagtctgaaatagtaaaaggcagcataaattaggccacctttagttggggtttcccttaccagccaccagaatcttcccagtacagagcttagcatacat

SEQ ID NO: 154750 - DNA, 601 bp, Human
acagttaacaaggctggagacggagaggaagatacggacatgagagagacttgaacggagaaaccccatccatctggcatatggcaccatgcttggtgttgtgcagagaacagaagtagcaaagaggctggaaacttacaagaaaggtaaactgaagggataagcaagagcacagccatacaaacgccatcacgaggcagcacgctgacaaccgctgaatggtgggatgggcagatgagccccttttgcgttctaaagagaagtcctgtggagtaccaagagctgggacgttatcaagaawgaggaattttgctaaaaatgtgaatcaattgcatgtaataaaagagaagaaatgactcagagatgacgccaacatgccgggctgggtgcaggggtcccagggatctccactggtctagacaaccacagtcctttcacctgctctgctagcgacaggcctgggcaggggccagtgtcacgattccacaaagacataatgtcgtaatgtcaagggtactgtgggctcctaggggaggtttgcgcacacacacgacactgggcggaaatgtcccttttgcggcagacaacaaagatctgacga

SEQ ID NO: 154751 - DNA, 601 bp, Human
agggaagcatggctgagtgtccgagttggactcttaatgccagctcggcctgatccaaagtcctgccaaggtcacgtgttagtgatagttaaggacaagtgaacaaaaaatccagagggaagggaggcaaaggacagaagtaaataagggatgagttatgccttaaaagaccagcaaacatgagtcaggccaagaaagcacagaaaccacagaagctgggaaagattcttatgggagaatgagatccaggtctggttaggtcagctgggctgagacgaaaggcggcagagaagatgagctraggttcagctggatgcttcagaggcaagtgcaggagctggagggtggtgatgacctcatcaaggccacctgtaggaaacgcagctctggaggaaaagctctagaaggaccgaagggtccctcgggagaccagctgctgccgttgtttaggcccgcggtggccaggtcccaaacacagttaacaaggctggagacggagaggaagatacggacatgagagagacttgaacggagaaaccccatccatctggcatatggcaccatgcttggtgttgtgcagagaacagaagtagcaaagagg

SEQ ID NO: 154752 - DNA, 601 bp, Human
gggagatcaaaatgcctgtttccaaagagctgagttaaaagaaagcaaaagtcctttctcctgctggccacattgtgtctggccttactcgcctcttttggcaaatgaggcaaatagaactaccttttcctaaggaaaggtcataagatgtatggtgcctcacagggaaggtaagctctgggaaagagggatcttcattttgttcactagttcatcccaaacacctccactgtgtaaacgtttggttaaatgcatgagctcactaacatgatctttctgagaaacttaaagcaggtacacrtgaataaaaatgcaatcattcatgaataatactgaggggacaaggcaatgaacctgcgggtacacaacccacactaactcatgttattcccacaataatcccatgagggaagcatggctgagtgtccgagttggactcttaatgccagctcggcctgatccaaagtcctgccaaggtcacgtgttagtgatagttaaggacaagtgaacaaaaaatccagagggaagggaggcaaaggacagaagtaaataagggatgagttatgccttaaaagaccagcaaacatgagtcaggccaaga

SEQ ID NO: 154753 - DNA, 601 bp, Human
ctattagttggaaacaagaaaatcaataaatacctgctttcaagaatagctcgttcaacacaggatgtcttctcctttaaggacaattccaaagactgttgactgatgactgacagaaacttgaggatcaatttagtgctttcggttttacctgccccactttcaccactgaaagacaaaacggaaaagtttgtgcttctaactataatttttaaaaaaaaatcagctttggtcaatggcactataattactcaacagaacaatggtagaaaggtgggaagagggagatcaaaatgcctgyttccaaagagctgagttaaaagaaagcaaaagtcctttctcctgctggccacattgtgtctggccttactcgcctcttttggcaaatgaggcaaatagaactaccttttcctaaggaaaggtcataagatgtatggtgcctcacagggaaggtaagctctgggaaagagggatcttcattttgttcactagttcatcccaaacacctccactgtgtaaacgtttggttaaatgcatgagctcactaacatgatctttctgagaaacttaaagcaggtacacatgaataaaaatgcaatca

SEQ ID NO: 154754 - DNA, 601 bp, Human; identical to SEQ ID NO: 36726

SEQ ID NO: 154755 - DNA, 601 bp, Human; identical to SEQ ID NO: 36727

SEQ ID NO: 154756 - DNA, 601 bp, Human
accttaacatgagacagccaaatgcttaggcagataaaatggggtccctggagaatctccaagcgtcccaagaatgtttacattagatgcttttgggtcgatgagggaacctgcccagggcttgtctgggcatcccacagtgaactggagcctgacgtacgcactgggggaagtgggtggggccacggggaattcttccacggggaagagaagcctgctctcttccgctcctgtagtgacctggaaatcaacatgtgaggtgggggcctgttagcaggaacccctctcgctttgctgaggtttttttttttttttttttgagacggagtctcgctgtctcccaggctggagtgcagttgcgcgatctcggctcactgcaagctccgcctcccgggttcacgccattctcctgcctcagcctcccgagtagctgggactataggcgcccgccaccacgcccggctaattgtttgtatttttagtggagacggggtttcaccgtgttagccaggatggtctcaatctcctgacctcgtgatctgcccgccttggcctcccaaagtgctgggattataggcatgagccaccgcgcctggccatc

SEQ ID NO: 154757 - DNA, 601 bp, Human
atccagctaattttttgtgtgtttttagcagtgacggggtttcactatgttggccaggctggtcttgaactcctgacctcgtgatccgcctgcctcaccctcccaaagtgctgggattacaggcatgagccaccgtgcccggctgcatctaactgttctaataagggctctggtaaagaacttaagatcacagtgatgaaatctcctggccaggcccgattgggtggggctgttcgcaacgctcgatgactgggctatcttaaatgcagataccttgtaacaaagcccttgcaagagaccrtggcatgccacaatgcagagacaggatgactaatgctcacgcaaccagaaatggccatcacaagccacgagggctggatgataccttaacatgagacagccaaatgcttaggcagataaaatggggtccctggagaatctccaagcgtcccaagaatgtttacattagatgcttttgggtcgatgagggaacctgcccagggcttgtctgggcatcccacagtgaactggagcctgacgtacgcactgggggaagtgggtggggccacggggaattcttccacggggaagagaagcctgc

SEQ ID NO: 154758 - DNA, 601 bp, Human
gtatggatatgggctgcaccaggtactgggtaaggttaggctggtcactaacttctctgagtcttagaatggagacaaccatacttcctaccatcagagggttgatgagagtgattggaaagtaaactccatgtgaagttcataacagtaagtgctcactaaatgtcagctgcatttgtgatgattagaatgataatgacgccaccctaggtgcattgcatctaacttttttttttttttttttttttttttttttttgagacggagtcttgcactgtcacaaggctggagtgcaaaggcktgatctcagctcactgcaacctccgcctcccaggttcaagcgattctcctgcctcaggctcctaagtagctgggactgcagtcgcccgccaccatatccagctaattttttgtgtgtttttagcagtgacggggtttcactatgttggccaggctggtcttgaactcctgacctcgtgatccgcctgcctcaccctcccaaagtgctgggattacaggcatgagccaccgtgcccggctgcatctaactgttctaataagggctctggtaaagaacttaagatcacagtgatgaaatctc

SEQ ID NO: 154759 - DNA, 601 bp, Human
cctcccacctcagcctcccaagtagctgggtttacacgtgtgtgccactacacccggctaatttttgtatttttttgtagagatgggtttttgccatgttgcccaggctggtcttgaactcctgtgctcaagtgatctgcccacctcagcctcccaaagtgctgacattacagacatgagccactgtaccccgcctatcccccaattcttgattctcataggtttgggagaagaaaatcttattgtatatagaaaggaatatattttcctccctctttcccaaaagttacacttttttttytctttttctttttgctgcactgcttagaatttccagtacaaggttaaagagtaacgggttaaattttgctattattatagcaaaaatgtcatgtttgtgatattaataaacatcagctaagttttcattgatacacctgctagactaacactaaaaagtaattgcaaattagatatttaaggatctataaatatcttttataagtagaatgtattaactagaataaatttgttaggtatgctcattatgtcaatttcatgtataaatttctcttcctttctaggtgattgacatatcctt

SEQ ID NO: 154760 - DNA, 601 bp, Human
aaaattcgcctagtgtgctggcatacacctgtactcccagctacttgggaggctagggcaggaggatcatctgatcccaggagttcaagggtgcagagagccattatcacaccactgtgctccagcctgggcaacagagtgagaccttgtctcaaaaaaaaaaaaaaaaaagtgaaataagtagtagaaaatttctaactgccaaataaaaaatattgacacatatcccataaataaaaatttttggttaagttctaaaaaaaaatacaaaggttgtataagaagatatgtaagcaaatgaacaaatgtgtttactatattaataaatttgtggacttctttgctttctagtctaactctaagtgattgggcaagtagttagtagtgttgtgataagcggcaactgcattaatcataacatggaataatttaatgtctaaaaccagttctcgccaatgcagacatgtatgctaaaactccagcaagagtctctatttattgtttcttactctcctatttacaatctttgttaataagcaatctccacccctttgacaagagtagccacttcaaggcttattataattagtatttcaacact

SEQ ID NO: 154761 - DNA, 601 bp, Human
tttgctgattttctactgtgactgaggagctgcattcttgtgaccaaaaaaagctattaaaaaagaaaagaaaaccagacacgtacacacaaacttgggggcagacttgttggcaatatcgatgaaaatgacctacaaaaagaacttggactcacacaaggaccataggagagtgggaagaaggaaaccacgcaccgctctgaagcaacataaattgcaaaaggaaacaactggagatttaacactgcgaaaagttcaatttctttcccttttttttgttttctttctgagatggagtttygctgtttcgcccagcctggggtgcagtggcacgatctcggctcaccgcaccccgtgcctcccaggttcaagcgattctcctgctttagcctcctaagtagcagggattacaggcatgcgccaccacgcctggctaattttgtattttcagtagatacgaggtttctccatgttggtcaggctggtctcgaactcccaacctcaagtgatatgcccaccttggcttcccaaagtgccaggattacaggtgtgaaccaccacgccaggccaagattaatttctttataaagaaaaagcaata

SEQ ID NO: 154762 - DNA, 601 bp, Human
caggcgtgagccaccatgccaagccaagaattttaaaaaattagccaggtgtgttggtgcacacctgcagtcccagctcctggcttggctgaggcaggagtatcgcatgaacccaggagttcaaggttacggtgagctatgatcgcatgtgtactccagcctgggagcctgggtgacacagttaagaccctgtctcttaaaaaaagaaaaaaattaaataaatgctgatggaaaatctaaatagatctggacctatcttccttaggcactcatcacatctctatttttaatttctccaaakgattttttatggtcttatcttggcctgaggatactaagtggaagttaacataatgctgtttgaggaaaaataaaaataaacaggcacttacaggaatctgttaccaacagtatctaaacaactgaagccaggtgttttctgaatcatatctaagatttgctgattttctactgtgactgaggagctgcattcttgtgaccaaaaaaagctattaaaaaagaaaagaaaaccagacacgtacacacaaacttgggggcagacttgttggcaatatcgatgaaaatgacctacaaaaagaac

SEQ ID NO: 154763 - DNA, 601 bp, Human
ctggtcttgaactcctgacctcaagtgagccaccaaccttggcctcccaaagttctgggattacaggcgtgagccaccgcgcccgcccaatagcaactcacttttaaaatgatgaggacattacatagtgcacataagaggaggaagataaagaactatagcatgctcagagataatcaatgaaataaacatagtgtcccccttacatacaagcctcctatatatgctacaaaagaattacctcagggagtcacagtcatgacaacaataaagaaacagttttctgtacagctatcagagkgtaatgaaatatttattattttctttagatgtaaaaatgtggagagggagtacttggagagggggtgtatttttgttttgttttgttttgttttgtttgtagagatgggggtctcatgttggccaggctggtctcaaactcctggcctcaagcaatccttccagcttggccttccaaagtgctgggattacaggcgtgagccaccatgccaagccaagaattttaaaaaattagccaggtgtgttggtgcacacctgcagtcccagctcctggcttggctgaggcaggagtatcgcatga

SEQ ID NO: 154764 - DNA, 601 bp, Human; identical to SEQ ID NO: 36728

SEQ ID NO: 154765 - DNA, 601 bp, Human; identical to SEQ ID NO: 36729

SEQ ID NO: 154766 - DNA, 601 bp, Human; identical to SEQ ID NO: 36730

SEQ ID NO: 154767 - DNA, 601 bp, Human; identical to SEQ ID NO: 36731

SEQ ID NO: 154768 - DNA, 601 bp, Human; identical to SEQ ID NO: 36732

SEQ ID NO: 154769 - DNA, 601 bp, Human; identical to SEQ ID NO: 36733

SEQ ID NO: 154770 - DNA, 601 bp, Human
aaatgaggaatccatgcaatattaagccaaaggcaactggttggcattataaaagataagatccagcatcagtcaaattaccagaatataataaaccaagtctcatgggaaacagttcagatcagattttttaccttaaaccttatgaggatggcatctagttctttaacattagctcttaaaattacaattaaattttacaatttaattacattacaattaaattacataaaaattacattacaattaaattacataaaaattacattacaattaaaatttgtaggggttttctcacatmagaagcattcctaagaggctgtttgctgaatcaaaataatttaaatgtattaacaatactttaagacaagctacctaattagctgtggattcagcgactgcatatatctaacactatagtttctttgtttaggtagcttttcctttttaagctcacattccttgtaatcggattatgaaattagaaagctaaaatcaaagagccaagacattaatacttatgacaacctttagagtgctttctaattagttataaacaactatttaaagtacttaaaatctagcattactacttaaagcc

SEQ ID NO: 154771 - DNA, 601 bp, Human
tgcctcagcctcctgagtggctgggattacaggcacgtgacaccatgcctagcaaatttctgtatttttagtagagatagggtttcaccatgttggccaggctggtctcaaattcctgacctcatgtgacccgcccacctcgacctcccaaagtgctgggattacaggcgtgagccaccatgcccggctactgtggttcttataagcatacatctttaaactataaatgaggaatccatgcaatattaagccaaaggcaactggttggcattataaaagataagatccagcatcagtcaarttaccagaatataataaaccaagtctcatgggaaacagttcagatcagattttttaccttaaaccttatgaggatggcatctagttctttaacattagctcttaaaattacaattaaattttacaatttaattacattacaattaaattacataaaaattacattacaattaaattacataaaaattacattacaattaaaatttgtaggggttttctcacataagaagcattcctaagaggctgtttgctgaatcaaaataatttaaatgtattaacaatactttaagacaagctacct

SEQ ID NO: 154772 - DNA, 601 bp, Human
tcgagccatagctatcttgccataatcaaattagcatctccatctaccatcacacctgcattttaggcctcagacaagtcagctcttgtgcctctgccttcacttgctgagtgcctttattttttcatttttttgagacagagtctcactctgtcgcccaggctggagtgcaatgtcgtgatctcagctcatggcaaccaccacctcccaggttcaggtaattctcctgccttagcctcccaagtagctgggattacaggcacgcgccaccaaacctggctaatttttttttttttttttwagtagagacgaggtttcaccatgttggccaggctggtctccaattccgcccatcttggtctcccaaagtgctgggattacaggcgtgagccaccgcccccaccgctcccagccttctgagtgcctttaaaagggcaccaagacattcttggaaaggtttctatagcctatcactggtgcgttattaattagtgtctgccatacttcaggacatgtaaagtgagccaatacaaatgcaaacgtgaggttgagttagttcattttctaaatgcaaaattcaaagcaattaggtactatcaaa

SEQ ID NO: 154773 - DNA, 601 bp, Human
gagatcacctgaggtcaagagtttgagaccagcctgaccaacatggagaaaccccatctctactaaaaatacaaaattagcagggcgtggtggtgcatgcctgtaatcccagctactcaggaggctgaggcaggagaatcgcttgaactcgggagacggaggttgtggtgagctgagattgcaccattgcactccagcctgggtaacaagagcaaaactctgtctcaaacaaacaaacaaacaaacaaaaaacttctatattttctaaaacccatgctccttgcttctgaataatacacamaatacctaaatacacacatatttgaatacgatctcccaagtccttcggtggactgcgactggagaggaaaatgaggtgaggagaaaccgtctcatccctccacgctgaaaatacacattccccatctctggagaggaagaaggcaagatttttcctgcgaaatttctataagaatctatctttggattaaaaaaaatatataaggaagtctaaataaaggtcatttgcacacatttcacagaacataataggtggtgacagtccgatatttccagtggaaccaaatgaatgctaatcgag

SEQ ID NO: 154774 - DNA, 601 bp, Human
gggagagagggagggagggagggagggagaaatagcaggcagcacctggattacataaatataaatccccgggaggaaatgtgctagattcattaaattcattcatcaaattattacacctctggaaacaaaaggctcatgcttccataatgtctgcacagagctctcactgcatgtgtgtggtcatgagttgtctaggatgttgtcaacctgaggggctgagtctgacctaagaaggaagccccgtggaagagaggaatacaggtcatcaggactcatttatgtgaaaggagctgacatccccccaaagtcctttacagaagacccctgtgtgagatggtttacacatcctcatcttcatccttgtgtctcggggtagagacagatggggctccaagatcgacagcccacaaggctcacgtgacctccctaactccactccacgtctccagcttccttctctcacttgatattccattttccagcaaatttggctgcatggaaactctagccctgctggtttccctcccctgaggcctggtcttcagcctcccccagcacaggcatctttcccttcttcccttccgtaaaccttactcca

SEQ ID NO: 154775 - DNA, 601 bp, Human
actgcactccagcctggaccaaaagcgagactccatctcaaaacaaaaataaaaacctttcccatgaacactaagggcttaaaaaacaaaaattcaaaagcagaccaggcacggtgagtcacatctgtaatcccagcactttgggaggccaaagcaggagaatcgcttgaggccaaaagtttgagaccagcctgggcaacacagtaagacctcgtctctatgaaaaattaaaaaattagccaggcccagtggtggtgtatgcctgtactcccagctatttgggaggctggggcaggagatygcttgagcccaggagttcaaggcttctgcgagttatgatagtgccactacgctcccgcctgggcaacagaataagaccttgtctctcaaaaatgaaaaaattaaaattaaaaaattaaaaaagcacctggctacctttaagtgttaggaaagattaaattctctgtttctgagggttccttaggaaaagggaggatgatccctttatgtaacatttaaaagagagaactagatcatatttcctcaattcttaatgcatacatgctcccatgtggacatgctgaaactgggatgtgtctca

SEQ ID NO: 154776 - DNA, 601 bp, Human
aagatcgtgccactgcactccagcctggaccaaaagcgagactccatctcaaaacaaaaataaaaacctttcccatgaacactaagggcttaaaaaacaaaaattcaaaagcagaccaggcacggtgagtcacatctgtaatcccagcactttgggaggccaaagcaggagaatcgcttgaggccaaaagtttgagaccagcctgggcaacacagtaagacctcgtctctatgaaaaattaaaaaattagccaggcccagtggtggtgtatgcctgtactcccagctatttgggaggctgrggcaggagattgcttgagcccaggagttcaaggcttctgcgagttatgatagtgccactacgctcccgcctgggcaacagaataagaccttgtctctcaaaaatgaaaaaattaaaattaaaaaattaaaaaagcacctggctacctttaagtgttaggaaagattaaattctctgtttctgagggttccttaggaaaagggaggatgatccctttatgtaacatttaaaagagagaactagatcatatttcctcaattcttaatgcatacatgctcccatgtggacatgctgaaactgg

SEQ ID NO: 154777 - DNA, 601 bp, Human
ttgcagtgagccaagatcgtgccactgcactccagcctggaccaaaagcgagactccatctcaaaacaaaaataaaaacctttcccatgaacactaagggcttaaaaaacaaaaattcaaaagcagaccaggcacggtgagtcacatctgtaatcccagcactttgggaggccaaagcaggagaatcgcttgaggccaaaagtttgagaccagcctgggcaacacagtaagacctcgtctctatgaaaaattaaaaaattagccaggcccagtggtggtgtatgcctgtactcccagctayttgggaggctggggcaggagattgcttgagcccaggagttcaaggcttctgcgagttatgatagtgccactacgctcccgcctgggcaacagaataagaccttgtctctcaaaaatgaaaaaattaaaattaaaaaattaaaaaagcacctggctacctttaagtgttaggaaagattaaattctctgtttctgagggttccttaggaaaagggaggatgatccctttatgtaacatttaaaagagagaactagatcatatttcctcaattcttaatgcatacatgctcccatgtggaca

SEQ ID NO: 154778 - DNA, 601 bp, Human
cacctgaggtcaggagtttgagactatcctggccaacatggtgaaaccccgtctctactaaaaatacaaaaattagctgggagtggtggcgggtatctgtaatcccagctactctggaggctgaggcaagagaattgcttgaacccgggggaggtggaggttgcagtgagccaagatcgtgccactgcactccagcctggaccaaaagcgagactccatctcaaaacaaaaataaaaacctttcccatgaacactaagggcttaaaaaacaaaaattcaaaagcagaccaggcacggtgastcacatctgtaatcccagcactttgggaggccaaagcaggagaatcgcttgaggccaaaagtttgagaccagcctgggcaacacagtaagacctcgtctctatgaaaaattaaaaaattagccaggcccagtggtggtgtatgcctgtactcccagctatttgggaggctggggcaggagattgcttgagcccaggagttcaaggcttctgcgagttatgatagtgccactacgctcccgcctgggcaacagaataagaccttgtctctcaaaaatgaaaaaattaaaattaaaaaatta

SEQ ID NO: 154779 - DNA, 601 bp, Human
tgtggatcacctgaggtcaggagtttgagactatcctggccaacatggtgaaaccccgtctctactaaaaatacaaaaattagctgggagtggtggcgggtatctgtaatcccagctactctggaggctgaggcaagagaattgcttgaacccgggggaggtggaggttgcagtgagccaagatcgtgccactgcactccagcctggaccaaaagcgagactccatctcaaaacaaaaataaaaacctttcccatgaacactaagggcttaaaaaacaaaaattcaaaagcagaccaggcrcggtgagtcacatctgtaatcccagcactttgggaggccaaagcaggagaatcgcttgaggccaaaagtttgagaccagcctgggcaacacagtaagacctcgtctctatgaaaaattaaaaaattagccaggcccagtggtggtgtatgcctgtactcccagctatttgggaggctggggcaggagattgcttgagcccaggagttcaaggcttctgcgagttatgatagtgccactacgctcccgcctgggcaacagaataagaccttgtctctcaaaaatgaaaaaattaaaattaa

SEQ ID NO: 154780 - DNA, 601 bp, Human
gctcacgccggtaatcccagcactttgggaggcagaggcgtgtggatcacctgaggtcaggagtttgagactatcctggccaacatggtgaaaccccgtctctactaaaaatacaaaaattagctgggagtggtggcgggtatctgtaatcccagctactctggaggctgaggcaagagaattgcttgaacccgggggaggtggaggttgcagtgagccaagatcgtgccactgcactccagcctggaccaaaagcgagactccatctcaaaacaaaaataaaaacctttcccatgaacastaagggcttaaaaaacaaaaattcaaaagcagaccaggcacggtgagtcacatctgtaatcccagcactttgggaggccaaagcaggagaatcgcttgaggccaaaagtttgagaccagcctgggcaacacagtaagacctcgtctctatgaaaaattaaaaaattagccaggcccagtggtggtgtatgcctgtactcccagctatttgggaggctggggcaggagattgcttgagcccaggagttcaaggcttctgcgagttatgatagtgccactacgctcccgcctgggcaacaga

SEQ ID NO: 154781 - DNA, 601 bp, Human
gcggtggtgtttttattattgtcactattctttgtcgcatatttttgagggtcatagaaagaacttgccggagaaaaaaacaaggaaagtacccctaggatgaagaagaacagagtgaagtgctgaagagctaatgaagcagagtggaccatctgcacagatgagagaagacccaggggagtttcagaccctgatcttgagaaccgcagtccacccctaacctctggtctccagtctcaaacctggccctttgctccagagtcttctgagggagtgacagctgggagggaggctgatgggsatttgggaattggtcctttgtagccgctgggggagcaaagtgagctttagaacaaagtcactaccagaaagcacacattgagggggctgcccgtgaaaacgttaattcagggcggctaatgcttagaggggaaaaaaaaatatctcagtctgcatgagctagacggacaggggtgggagttgggggtgcaggtaggggagggaagggatttgctcacagtgggagcaggagtgccattcagattggacatgattcagtaagttcatcaggataagccaaagtaaaaatgcagtggtggaa

SEQ ID NO: 154782 - DNA, 601 bp, Human
tgttgtttaaaaatgctaccatgaggccaggtgcagtggctaacacctgtaattccagtaatttggaaagctgaggcagaaggattgcttgagcccaggagttcgagatcagcctgggcaatatagggagaccccatttccaccaaaaataaacaaaattagctgggtatggtagtgcatacttgtggtcccagctacatgggaggactgtttgagcccaggaggtcaaggctgcagtgagccgagatcccaccgccacactctagcctaggcgacagagcctcgggaaaaaaaaaaaaacaaaacccaaacccagaaaatgctattatgacacattacacactggcagacactctaaaaaatcctccctgtctgtctccgcattcaactccaacaatatcttggcatcatgaactatgatctgaggctggtctgtgacacagtaacagaaacagaaaaaactcagacatgagctgctcatctcttcactctttcctacatttttgcacccaaccctcactagagctaaatctcaactgaagagtctctactcatccacacccgcagatcagggcccctttccaggtactgctgctagttt

SEQ ID NO: 154783 - DNA, 601 bp, Human
gagctgtagggcagagtctaaatgctgtgatttacacgagaaaaccgtgggaccaggccacggtggtgaatgttgtttaaaaatgctaccatgaggccaggtgcagtggctaacacctgtaattccagtaatttggaaagctgaggcagaaggattgcttgagcccaggagttcgagatcagcctgggcaatatagggagaccccatttccaccaaaaataaacaaaattagctgggtatggtagtgcatacttgtggtcccagctacatgggaggactgtttgagcccaggaggtcaagrctgcagtgagccgagatcccaccgccacactctagcctaggcgacagagcctcgggaaaaaaaaaaaaaaaaaacccaaacccagaaaatgctattatgacacattacacactggcagacactctaaaaaatcctccctgtctgtctccgcattcaactccaacaatatcttggcatcatgaactatgatctgaggctggtctgtgacacagtaacagaaacagaaaaaactcagacatgagctgctcatctcttcactctttcctacatttttgcacccaaccctcactagagctaaat

SEQ ID NO: 154784 - DNA, 601 bp, Human
tcacacgactactgtgcactaggacctgtgtctagttctgtgcccttcgtcctcgtgggaaaaccagaagagcgtgactccaagtgtggcctgggacggctgcctgtccatggcaagatggccaccaaaggtgagaataagcatttaggaactcttacagcgatctgatgtggctgcatcgtttttactgtatttttttactgtatttttcttttcttttcttttaagcagcagcaagaaggggacccttttcttttcttttaagcacagcgtggaaggggacccgagtgggttgccgatytttactgtatttttcaaatgcaccagtcctcaatgaattggcaatgaaaaacaaaacactgctcttttgactctttgagatgcattgttctagaaggtactaaggtcaattttgagttaaagctcctaagatatttatttgtattggtgtatataaaaatccactgttattacaatattattctgtaattttgcatgacgtactaaactttctcttcctatagtttaacatcaagtcagactcaatggataagaaagtgtccttatttaaattcttcttcaaaactaccacaagtctaaa

SEQ ID NO: 154785 - DNA, 601 bp, Human
agaagtttactaatctcttgagttagagaataaaagctagacaaacagggtgctcaactggtgcaaattgagttgtgctctagagataattacacaccagatttcaaaaacttagtatgaaaaaataaagtatctcattaatcattttgaaatttattacatgttgaaaggataacattttggatatagtaaaaaaaatatgttgttaaaactgctttcacaaaaaaaacaatttttttttacacttctaaatgtggctactagaaaacctaaattagacatggtgctcacattctattcytattgaacagtgttattctaaaaagttagggcttctggtttataaggacttggagagtaaaacaacaaggcttaaaattctaatttgattacaattttgtttgatacctgcagcatgttttgtataaatacactgtcagactattttgatataaggcttgcatgtttagagactaacacatattccttttcataacattacccatttttcaaagataaaaaacaatgctcatgcaaatactgtgaaataaaggccccatgaagggttctcacgaggctaatgactctgaacaaataaatc

SEQ ID NO: 154786 - DNA, 601 bp, Human
accattgaactgagcactttacatgtgcccacttaatctttacaactactctatgaattaaatcagtccatgatgataaaattaagtgtgtgatatacatttttaaaaaagcaatcgtgtgggaaatgctctcagctaatatttccacaacactctacaatttccaaagtactttacctacaatttgctctatcaccctgtgaggtgggtagggcagccattaattagcattttcattaaatagggtcaaagaatgttgtgtgacctgagtcatatcatacagcaattaccaggccagagragcaacaggtacccccttttttttttttttttgtgaggcggagtctagctctgtcacccatgctggagtgcagtggcgtgatcttggctcactgcagcctccacttcctgggttcaagcgaatctcctgcctcagcctcccaagtagctaggattataggcgcacgctgccacgccaggctaatttttgtattttcagtagagacagatgaccatgttggccaggctggtctcaaacttctgacctcaaggtgatccacccgcctcagcctcccaaagtgctgggattacaggtgtaagc

SEQ ID NO: 154787 - DNA, 601 bp, Human
tgaggagggatgcaaaagaaattgggagattacagccatctctttttccccactaactaatttgttgttgttaaatgaaaaaataatacacgcaaaggatctgggtgtatatatgcatatataatacatacacatacatacatatacaaaaaagcatctgccataaaaaccccacagctctcctgaggaagaccattcgtactagtttcctgtgtctccttcaggcacagtcaatgcatgtataaacacagtatgcatgtgtgtgtatatgcacgctcacgtgtgtgcagataaatacacrcactgcttttttaaaaatgcaaataaaagtgttccacattttgcttctcttacctaacagaatcttagagacagttaacctgtcaggatatacagttctctcaccttcttcttcttttttttttttttttttttttttttgagacagagtcttcctctgtcatccaggctggagtgcagcggcatgatctcagctcactgcaacctcagcctcccgggttcaagcgattctcctgccttagtctcctgagtagctaggattacagacatgcatcaccatgcctagctaattttgctaatt

SEQ ID NO: 154788 - DNA, 601 bp, Human
gccagcataaggtccaagtagccctcacaatgtgtttctagagaacatgcccaaaacgcagctcgatacccagttatttttttttaatgactcacatgacacgactggaatgtgtttctatgggggttccactgcaagacgtcatgaagtaactcttcagtatagtgtttaatgaggagggatgcaaaagaaattgggagattacagccatctctttttccccactaactaatttgttgttgttaaatgaaaaaataatacacgcaaaggatctgggtgtatatatgcatatataatacayacacatacatacatatacaaaaaagcatctgccataaaaaccccacagctctcctgaggaagaccattcgtactagtttcctgtgtctccttcaggcacagtcaatgcatgtataaacacagtatgcatgtgtgtgtatatgcacgctcacgtgtgtgcagataaatacacacactgcttttttaaaaatgcaaataaaagtgttccacattttgcttctcttacctaacagaatcttagagacagttaacctgtcaggatatacagttctctcaccttcttcttctttttttttttttt

SEQ ID NO: 154789 - DNA, 601 bp, Human
tatccatacaatgaaatattattcaaaagctatcaagccacaaaaagatgcggaggaacctcaagtgcatacatagtgctaggtgaaagatgtcagtctgaaatggctatatactatttgactccaattatatgacatccagaaagagacaaaacttcagagacagtagaacaatcagtggttgccaggggtcgggggaaggatgaagaactaaagcacagaggaattttagggaagtgacactattctgtgtgatactgtaatggtggatacatgacatcatgcatttgtcaaaactcgyggaactttagagcactagaataaacctttggggaaaccaagaaataatgtagattgtcacaagagaatctaaatgaatcgacctcactaaacagggtgagggaaaagacgctgacttaaataacgctggaaacatatagagtctataagactaaaagcataaagaactgcatttcagctctgtactatagttgataaagttgttttccccaggggtatggagtcacaactctggatactactgtacatgtacactggaattaaacaaaaaaatgaatggcagatgatgggagccaggttt

SEQ ID NO: 154790 - DNA, 601 bp, Human
agatctgcttaggatgcaaaatggtagagagcccgagatctggcaacacaggagatcctcagagccctgacaaacagccccagaaagccaaacaaaggagctgagcatcacaccgacagtaagtcaattgcctttactgccttaacttgggagcttattaaaagaattttttgaagactttatgtcttataagaccaacctccacattgctagactatttctcaaagtgagtggtactgcattcaaaatttagagttctacttttccactattttatttttattttattttatttattttwttttattttaatttaatttttgagacggagtctcgctctgccgcccaggctggagtgcagtggtgcgatctcaggtcactgcaacctctgcctcccaggttcaagcaattctcctgcctcagcctcccgggtagctgggatgggaatataggcacgtgccaccacacccggctaattttttgtatttttagtaaagacgggatttcaccgtgttagccaggatggtctccacctcctgatcttgtgatccacccgccttggcctcccaaattgctgggattacaggcgtgagccaccgcg

SEQ ID NO: 154791 - DNA, 601 bp, Human
cttaaagatcacaattttaagggccacgaccacatcgataagaaatcagtttgctacattgtgagttcagccaaacatctgcatatggaagcaactagagaataaagaagagcttttagaaaatcaaattgcaaactgagcaaatccaactctggctactcccataaacacggacaatcatcagcggaccatatccttacttcgcatatcaacctctgatcactgacaaacaattcaactgttctttgacccacgggggatttaactccatttgcatctcatactgagaggtgacagcacrctggcagtcctcagagccctcacttgctctcggcacctcccctgcctgggctcccactttggtggcatttgaggagcccttcagccccctcactgcactgtggaagcccctttctggtctggccaaggctggagcccactccctcagcttgcagggaggtgtggagggagaggcacgagcgggaaccggggctgcgtgcagcgcttgcgggccagctggagttccgggtgggcgtgggcttggtgggccccgcactcggagcaaacagccagccctgctggccccgggcaatgggggact

SEQ ID NO: 154792 - DNA, 601 bp, Human
cctagagatcaacttgtcaggtactgacttggtctaatacaggcgacttaaagatcacaattttaagggccacgaccacatcgataagaaatcagtttgctacattgtgagttcagccaaacatctgcatatggaagcaactagagaataaagaagagcttttagaaaatcaaattgcaaactgagcaaatccaactctggctactcccataaacacggacaatcatcagcggaccatatccttacttcgcatatcaacctctgatcactgacaaacaattcaactgttctttgacccacgggggatttaactccatttgcatctcatactgagaggtgacagcacgctggcagtcctcagagccctcacttgctctcggcacctcccctgcctgggctcccactttggtggcatttgaggagcccttcagccccctcactgcactgtggaagcccctttctggtctggccaaggctggagcccactccctcagcttgcagggaggtgtggagggagaggcacgagcgggaaccggggctgcgtgcagcgcttgcgggccagctggagttccgggtgggcgtgggcttggtgggccccgca

SEQ ID NO: 154793 - DNA, 601 bp, Human; identical to SEQ ID NO: 36734

SEQ ID NO: 154794 - DNA, 601 bp, Human; identical to SEQ ID NO: 36735

SEQ ID NO: 154795 - DNA, 601 bp, Human; identical to SEQ ID NO: 36736

SEQ ID NO: 154796 - DNA, 601 bp, Human; identical to SEQ ID NO: 36737

SEQ ID NO: 154797 - DNA, 601 bp, Human; identical to SEQ ID NO: 36738

SEQ ID NO: 154798 - DNA, 601 bp, Human; identical to SEQ ID NO: 36739

SEQ ID NO: 154799 - DNA, 601 bp, Human; identical to SEQ ID NO: 36740

SEQ ID NO: 154800 - DNA, 601 bp, Human; identical to SEQ ID NO: 36741

SEQ ID NO: 154801 - DNA, 601 bp, Human; identical to SEQ ID NO: 36742

SEQ ID NO: 154802 - DNA, 601 bp, Human; identical to SEQ ID NO: 36743

SEQ ID NO: 154803 - DNA, 601 bp, Human; identical to SEQ ID NO: 36744

SEQ ID NO: 154804 - DNA, 601 bp, Human; identical to SEQ ID NO: 36745

SEQ ID NO: 154805 - DNA, 601 bp, Human; identical to SEQ ID NO: 36746

SEQ ID NO: 154806 - DNA, 601 bp, Human; identical to SEQ ID NO: 36747

SEQ ID NO: 154807 - DNA, 601 bp, Human; identical to SEQ ID NO: 36748

SEQ ID NO: 154808 - DNA, 601 bp, Human; identical to SEQ ID NO: 36749

SEQ ID NO: 154809 - DNA, 601 bp, Human; identical to SEQ ID NO: 36750

SEQ ID NO: 154810 - DNA, 601 bp, Human; identical to SEQ ID NO: 36751

SEQ ID NO: 154811 - DNA, 601 bp, Human; identical to SEQ ID NO: 36752

SEQ ID NO: 154812 - DNA, 601 bp, Human; identical to SEQ ID NO: 36753

SEQ ID NO: 154813 - DNA, 601 bp, Human; identical to SEQ ID NO: 36754

SEQ ID NO: 154814 - DNA, 601 bp, Human; identical to SEQ ID NO: 36755

SEQ ID NO: 154815 - DNA, 601 bp, Human; identical to SEQ ID NO: 36756

SEQ ID NO: 154816 - DNA, 601 bp, Human; identical to SEQ ID NO: 36757

SEQ ID NO: 154817 - DNA, 601 bp, Human; identical to SEQ ID NO: 36758

SEQ ID NO: 154818 - DNA, 601 bp, Human; identical to SEQ ID NO: 36759

SEQ ID NO: 154819 - DNA, 601 bp, Human; identical to SEQ ID NO: 36760

SEQ ID NO: 154820 - DNA, 601 bp, Human; identical to SEQ ID NO: 36761

SEQ ID NO: 154821 - DNA, 601 bp, Human; identical to SEQ ID NO: 36762

SEQ ID NO: 154822 - DNA, 601 bp, Human; identical to SEQ ID NO: 36763

SEQ ID NO: 154823 - DNA, 601 bp, Human; identical to SEQ ID NO: 36764

SEQ ID NO: 154824 - DNA, 601 bp, Human; identical to SEQ ID NO: 36765

SEQ ID NO: 154825 - DNA, 601 bp, Human; identical to SEQ ID NO: 36766

SEQ ID NO: 154826 - DNA, 601 bp, Human; identical to SEQ ID NO: 36767

SEQ ID NO: 154827 - DNA, 601 bp, Human; identical to SEQ ID NO: 36768

SEQ ID NO: 154828 - DNA, 601 bp, Human; identical to SEQ ID NO: 36769

SEQ ID NO: 154829 - DNA, 601 bp, Human; identical to SEQ ID NO: 36770

SEQ ID NO: 154830 - DNA, 601 bp, Human; identical to SEQ ID NO: 36771

SEQ ID NO: 154831 - DNA, 601 bp, Human; identical to SEQ ID NO: 36772

SEQ ID NO: 154832 - DNA, 601 bp, Human; identical to SEQ ID NO: 36773

SEQ ID NO: 154833 - DNA, 601 bp, Human; identical to SEQ ID NO: 36774

SEQ ID NO: 154834 - DNA, 601 bp, Human; identical to SEQ ID NO: 36775

SEQ ID NO: 154835 - DNA, 601 bp, Human; identical to SEQ ID NO: 36776

SEQ ID NO: 154836 - DNA, 601 bp, Human; identical to SEQ ID NO: 36777

SEQ ID NO: 154837 - DNA, 601 bp, Human
gacctggctggcagggacctcccggccagcccagaactgccaacatgtctgccagcactgcccctccattcccagtcctggggggaggctctgtctgggcagcttgaggcctgacctactgtggctgcttcctctgctccccagcctgggtcctgagggcctggcttaagggaactgctgccagaaggctgggagtgtaggcagtgttcgggtgcccagctgtgccctgtctgacctcatggccacccacaagctggcaccccccacaggcctcttggggaagcctgtactttccaccgcmggaggcgggtaccgcgtggaagccaggctcaggcggactcattctttttgaactttgggaacaggcctggtacaggctgagttctcacaagagacacacacccgtgtcactgtctcctgagctgtgccggacccgtcctacagactccacctcctctaggtcctggccctggcatctgccagggggattttaaatgagttgatatatgctaagtgctttgaaaggcgcctgcacggagggagagctgtataaatattcactattggtaatatttctcccatgctgttactctccaaagct

SEQ ID NO: 154838 - DNA, 601 bp, Human
agaggtgggtgtgggccatagcccagacctgttgaaccagttgtaggctctggaatcctctgtccccaggtagtgaccaggccctgacaggcgggaatctgtccctcccatcaccctcccagttatgggtgcagatgaccctgaaattgctaaagcctcagggcttgagcccagaaagtgtgagcaggctggtggggcagctggaggaaggccttgcaggttcctggatttgggtgccgggtgggctgagaggacagtccctgtcactgggactgggcacaggtgcagagaggctgagacrggcccagaggacagtgagtgtgtgttgtgtgggcgccgggccaggaagtgccctccatggggcagcaggctctgcagtaccctcggccaaatggccacaggctgccctgggacactctccaggcctgctggggacacacctgtggggctcataggcgtggctgggtctcctctcaggtgccagaatctttctgggagctgagcctggctgggcagagggcgaggagcccaggattcccctttccgtgactttggaggaacgaggttcctgagggctggcacagccactccctgcccctta

SEQ ID NO: 154839 - DNA, 601 bp, Human
catacagtttggcaagtagggggagggctggagcccagcctcacttgccaccctggccaggccgtgattgcccagggtgcatactgtggctggtgctctgccacctgctgtttctgtcctcagggtaggacacaaggagggcaagtagggctagtcagtgagaggcacaggtgatgcgtgttctagggcttgagatcagctgcttccatttcagtaattgtctttggaggtacgttgtttgctcaagcaacctcccttcaagatagtgcctttttctttctctctctctcttttttttggsggggggaggcagagttttactcttgtcgcccaggctggagcacagtggtgtgatctcggctcactgcaacctcggcctcctggattcaagcgattctcatgcctcagcctcccgagtagctgggattacacgtgtgtgccaccacgccctgctaatttttgtatttttagtaaagatagggtttccccatgttggccaggctggtctcgatctcctgacctcaggtgatccgctcgcctggcctcccaaagtgctgggactataggcatgagccaccgtgctggctgatagtgccatttt

SEQ ID NO: 154840 - DNA, 601 bp, Human
catcttgcaaatgcacttcttagttttttactcttttaagtatgagcttgctcacttgctctctgtatctcacttaaactttatgtgagtgtattaatctttcattatttagcttctgaatttatatttcttcaatctccattcctttttttttttttccttgaaatggagactcgctctgtcacccaggctggagtgcagtggcacgatctcggctcactgcaacctctgcatcccgggttcaagcaattctcctgcctcagcctcccgatttgctgggactacagacatgtgccaccaygctcggctaatttttgtattttttagtagagaccattttggtcaggcaggtctcgagctcctgaactcaatcaatctacctgccttggcctcccaaagtgctgggattactggtgtgaaccactgtgcctggccctcgttcttttttttatatgaaaatatttcaaatatgtaaaaattaatataacagacctccatgtgataatcagccagatttatcaagtgtgaaccttatcccatattagatattttttcctttaagaaataaaatattacaagtatagaactaaagatgtgctac

SEQ ID NO: 154841 - DNA, 601 bp, Human
aatatacacaaacttagtgctgttttctgattcatcctttatctatttgcaacactttaaaaagttaatgttatgttttcacattgatcccagttgacctgtatggattaatttcttcagttgacatggctatataatattcagttgcgtgaatgtagcacagcttatgtagccatccctctcctgacgatagttaagttgtttccattttttgctattgtaacactgctaataaacatgcttgaatggggtgtcccgtacaagggagggttactcggggctgtgcccggaaatgcaatcrccagattgtaaggtatgcacgtgttcagcctgactacatattgtgaagtgctcttctaagcctttgtatcaactggtactcccaccagcaatgtgtgagaaactatatttggttttaatctgtattccctggttactagtgagcctgagcatcttttctgtctattaggtgtttgaatttaatctgtgaattgcctttttgtgttcttttttattcctttgattgttttggtggtggttatgataaaatgcacaagcacaaggttctgttgacctgttgaccgtcttaaccctttttatg

SEQ ID NO: 154842 - DNA, 601 bp, Human
cagcttatgtagccatccctctcctgacgatagttaagttgtttccattttttgctattgtaacactgctaataaacatgcttgaatggggtgtcccgtacaagggagggttactcggggctgtgcccggaaatgcaatcgccagattgtaaggtatgcacgtgttcagcctgactacatattgtgaagtgctcttctaagcctttgtatcaactggtactcccaccagcaatgtgtgagaaactatatttggttttaatctgtattccctggttactagtgagcctgagcatcttttctgtctattaggtgtttgaatttaatctgtgaattgcctttttgtgttcttttttattcctttgattgttttggtggtggttatgataaaatgcacaagcacaaggttctgttgacctgttgaccgtcttaaccctttttatgtgtatagttcagtggcattaagtacatttagaatgtgctaccatcccgccatccagctccagaaatcttttcgtctcgtcaaactgaaacatcctcctgctagtcaatggctcatctccttttcccctcagtccttggcagccgccattctgctttctgt

SEQ ID NO: 154843 - DNA, 601 bp, Human
tgcccggaaatgcaatcgccagattgtaaggtatgcacgtgttcagcctgactacatattgtgaagtgctcttctaagcctttgtatcaactggtactcccaccagcaatgtgtgagaaactatatttggttttaatctgtattccctggttactagtgagcctgagcatcttttctgtctattaggtgtttgaatttaatctgtgaattgcctttttgtgttcttttttattcctttgattgttttggtggtggttatgataaaatgcacaagcacaaggttctgttgacctgttgaccrtcttaaccctttttatgtgtatagttcagtggcattaagtacatttagaatgtgctaccatcccgccatccagctccagaaatcttttcgtctcgtcaaactgaaacatcctcctgctagtcaatggctcatctccttttcccctcagtccttggcagccgccattctgctttctgtgtctatgagtttgactgcttttgagtacctcctataagtggaatgatacagtatttgtccttttgtaactggcttatttcactttgcatagtgtcttcaaggttgatccatgttgcagtgtat

SEQ ID NO: 154844 - DNA, 601 bp, Human
cagatccatttattaattcaacacgtttgtattgagagcctgctgggtgccgggcactattgtcaacatgggtaatacagcagcaagcaaaacaagagaaacatctttgcaagcaggggagggggcctgcagtgttgggtgtgtggagttgttgctgggaagtagagaagctgagtaagagctggacaaagaggccaggcacagtggctcacccctgtaatcccagcactttgggaggccgagtttggcagatcacttgaggtcaggagttcgagaccagcctggacaacatggggaaacsccgttcctactaaaaatacaaaaattagctgggtatggtggtgcatgcctgaaatcccagctacttgggaggctgaggcacgagaattgcttgaacccgggaggtggaggttacagtgagccaagatcacacaccattgtaccccagcctgaatgacaaagcaagactttgtctccaaaaaaaaaaaaaaaaaaaaaaaatagagaaaaggaaagctggatgaagagagatagccaagcccatgtctacggaaaagcattcttgactgagtgaacgaaagtacaaagcctcagaggaggg

SEQ ID NO: 154845 - DNA, 601 bp, Human
ggcccctcctcccctcgtcttccctccctcatggcccacctttactctgagggggtgggcttcctgcgggggacaaactggagagggactctcttgccgccttctctgttcctggggacaggctgctgcagggtggagggcttgcttttcctgcccaccctcatctttgccgagtcctcgtctgggggccctgccccactctcccttcccaatgcagggccctctcctctggcgagcctgccttgatactccccggctcaacccctttaaccctgctggctcctaatgggactaatgggayttcaggtgtggacccttggaccctccgctgcacagttccagaaacttgttcatcaagtgccaggctgaccatggtgtccgtctcagtgcccagcagttgttctggtgatgggaggtgggagtacaaggtctgccgagtgaggcagaggaaaggggtttctgagcccagatctccggtgctccaagacactcaaaaccagagctgagagcctgaattcagaggctgtactgtggggcagggctggaatttgtggcacctgtgtagggactccagggctgaacgttgcctttgctgtccctg

SEQ ID NO: 154846 - DNA, 601 bp, Human
ggagggttgcttcagcctggtgggtggctgcagtgagctgagattgggcctttggtcttcagtctgggctacagagcaagactctgtctcaaaaaaaaaaaaaaaattataaaggtaagcagtacaaatgggaatatgagcataagtcactctcattccagacctctgacccccaggacttttctcttgagaggccatagcctttgttttgcatccttctgagtaaacctattcgtgtacagacatatctgggtatgcatgtaactgttttgtgaaagtgcatttggagatatggatatcrttgttttcacccatcctaagttttgatgctatggatactatgttttggagattagacgataccagcacgcataggtttgcagcctctttttcacagctccatagtgtttccttgtctgtgagcagatttcaagttgtttccatcttaacccctagaaaaagtgctgttgaagatcctgacagacaagtctgtagaaacataggaaactttgtagaataaagttctggccatgggccaaattccctctgagaggtagctctagtttttcttcctagtacatctatgagagctcaggtccct

SEQ ID NO: 154847 - DNA, 601 bp, Human
ttggagatatggatatcgttgttttcacccatcctaagttttgatgctatggatactatgttttggagattagacgataccagcacgcataggtttgcagcctctttttcacagctccatagtgtttccttgtctgtgagcagatttcaagttgtttccatcttaacccctagaaaaagtgctgttgaagatcctgacagacaagtctgtagaaacataggaaactttgtagaataaagttctggccatgggccaaattccctctgagaggtagctctagtttttcttcctagtacatctrtgagagctcaggtccctcgtgttttgctgttatgatgaatgaaatatgctgtctccatcacgctggaatttgtagatgtagatgaccatagtttcttatttgccattcatttctttacattaaggtaaatattcatgtcctttggctatttttattttatttcttttttcttttcttttttaagacagagtctcgctctctctcccaggctggagtgaagtggcttaatcctggctcactgcaacctccacctcctgggttcaagcgattcttctgcctcagcctcctaagtagctggga

SEQ ID NO: 154848 - DNA, 601 bp, Human
atattgcaagtagagaaccaaagacatgcccctgtgacctcttttattcttccccatctccccagaatataattatcacttaaagttgggtgtcaacctgtatttcattctttcatcatacacacaagcacacactgtttatacacataaataatgttgtttttggacgcatactttgtttttgcaacacctttaaacataagtttttacttttattattttatttaagataggatcttgctctgtcacccaggctggagtatagtggcgcgatcatagctcgctgcaacctctcatctcstgggctcaagtgatcctcccaccttagttagcctcctgaggaactgggataatcacagtcataagccaccaagcccagctaagttgtttattttatttttttattttttaaataaagatgaaatcttgctatgttatccaggctggtctcaaactcttgggctcaagcaatcctcctgccttggcctcccaaagtgctgggattacaggcatgactttaaaaagttaacattatgggccaggcgcggtggctcacgcctgtaatcccagcacactgggaggccgaggcgggtgaatcacg

SEQ ID NO: 154849 - DNA, 601 bp, Human
tccagtttgtttttttttttttgctattgcagcactgcctaataaatatcctggagtgggttgtacttatatacttcaaaatggaattaccagattgtaaaatatgcacatattcagcctcactagatactgtgaagtgctcttctaagcctttgtgtcagtttgtacttctgccagcaatgtggaaatgagatttggttttaatatgtattccctggtcacgagtgagcctcagcatcttttcatatgtccaccaagtgtttgggtttaatctgtgaattgcctttttgtgttctttgcttttttttttttttatttctttgattgttttggtggttgttatggtaaaatgcacaagcacgaggttgtatttaccatcttaactctttctgtgtgtatagtgcagtggcattaagcactttcagaatgtgctaccgtgctaccatcccaccatccatctcccgaactctcttcatcttgccaaactgaaacatcctacccactagtcaagaactcctcatttccgcctccccccagccccttggcagccaccattctgctttctgtgtctgtgagcttgactactttaagtatctattct

SEQ ID NO: 154850 - DNA, 601 bp, Human
tgtacttatatacttcaaaatggaattaccagattgtaaaatatgcacatattcagcctcactagatactgtgaagtgctcttctaagcctttgtgtcagtttgtacttctgccagcaatgtggaaatgagatttggttttaatatgtattccctggtcacgagtgagcctcagcatcttttcatatgtccaccaagtgtttgggtttaatctgtgaattgcctttttgtgttctttgcttttttttttttttatttctttgattgttttggtggttgttatggtaaaatgcacaagcacraggttgtatttaccatcttaactctttctgtgtgtatagtgcagtggcattaagcactttcagaatgtgctaccgtgctaccatcccaccatccatctcccgaactctcttcatcttgccaaactgaaacatcctacccactagtcaagaactcctcatttccgcctccccccagccccttggcagccaccattctgctttctgtgtctgtgagcttgactactttaagtatctattctaaatggaatgatacaggacttgtctttttgggactggcttatttcacttcgcgtagtacct

SEQ ID NO: 154851 - DNA, 601 bp, Human
tacttctgccagcaatgtggaaatgagatttggttttaatatgtattccctggtcacgagtgagcctcagcatcttttcatatgtccaccaagtgtttgggtttaatctgtgaattgcctttttgtgttctttgcttttttttttttttatttctttgattgttttggtggttgttatggtaaaatgcacaagcacgaggttgtatttaccatcttaactctttctgtgtgtatagtgcagtggcattaagcactttcagaatgtgctaccgtgctaccatcccaccatccatctcccgarctctcttcatcttgccaaactgaaacatcctacccactagtcaagaactcctcatttccgcctccccccagccccttggcagccaccattctgctttctgtgtctgtgagcttgactactttaagtatctattctaaatggaatgatacaggacttgtctttttgggactggcttatttcacttcgcgtagtaccttcaaggttgatccatactggtagcagaatttcctttctttttcaggctgaataatattccattgtatgcgtagaccacattttgtggatccgttcatccactga

SEQ ID NO: 154852 - DNA, 601 bp, Human
aaccttgtgcctgctgagtggtggaacagttctgaaaaggtctgttctggagtgggggtgctgtttcggagagcgatgaatcaggggcttgggtgctgactttaggaggtgcggctcttggaaagacagagtgtgacttccccagtgtggtctccttccttttcctcaccacttctcctacctaaccccaagaatgagtccttgagtctgtctcagtaggtggatctgcattcagtgcagggcagagcctgggtggcagtgcctctccttgcctccctggctgctacaaggtcctgtgtarcatctggtgtggacccagcagccaggaggagagctgagtgtgattggggtcgtggtggggccagtggcagtggatctctctctttgttgggctgggccagcgcttgaattgagaggggctgccatgtgtctggggagggcagaacccagcgtcactgacaccctccagatacagagttcttgctctgtgtttggcccatacctaatgttgtgaagtggaaatactggggtgtgttttgaggctcagaacacctgtgataacttggtcatgtgtgtgtgtgtgtgtgtgtgtgtgtgtgtg

SEQ ID NO: 154853 - DNA, 601 bp, Human
ctcatcgacatgcatttggcagaaagtgcgctggctctgccagctcccagtgtgagcttctagcaagccccttgtgccttagatgcccaggtcttttcagaataagcctggcttgttttaacttgatgcaacttgctgctcacagtcatcttattgtttgctgatgaattcagacctccattcatttaaatatttgtcagttatctaccatgtgtcaggcattaaatttagtgctggagatactatgggacataagaagtccctgcttgctgggagtgtgtggtctaattggtacttgggrcagtgtggtttaactgccacaaagttaataaagcagcatgatgtgacagagctggatgtgggggagtgaggaagcttctctggactgggtggtctgaaccccatgcagggaggaaactgtggctgggaggagaggaggccggaagagaggtctgggcttgggtcccaaccactgattccagatctctcaacatttgtaacacgaccaactcctgttctttttttttttttttttttgagacaggctagagtgcagggggacgatcatagcttactgcggcctcgatctcctggactcagg

SEQ ID NO: 154854 - DNA, 601 bp, Human
tgtggtctaattggtacttggggcagtgtggtttaactgccacaaagttaataaagcagcatgatgtgacagagctggatgtgggggagtgaggaagcttctctggactgggtggtctgaaccccatgcagggaggaaactgtggctgggaggagaggaggccggaagagaggtctgggcttgggtcccaaccactgattccagatctctcaacatttgtaacacgaccaactcctgttctttttttttttttttttttgagacaggctagagtgcagggggacgatcatagcttactgcrgcctcgatctcctggactcagggggtcctcctgtctcagcctcccaagtatctaggactacaggtgtgtgccaccacacccggctaattttatttttatttttatagagacggggcagagtctgcagtcacatgccttgcaagtagcagagacagggtttagtctcggtagccagtgcctagggcacaggtcttggccagaggagagaaggctcaggtgaaccagtttcatctgacctgcttgctaactcaaacatggctgcccaactgcgtgggctggcaaggtatgtgaggtgggtag

SEQ ID NO: 154855 - DNA, 601 bp, Human
gggggagtgaggaagcttctctggactgggtggtctgaaccccatgcagggaggaaactgtggctgggaggagaggaggccggaagagaggtctgggcttgggtcccaaccactgattccagatctctcaacatttgtaacacgaccaactcctgttctttttttttttttttttttgagacaggctagagtgcagggggacgatcatagcttactgcggcctcgatctcctggactcagggggtcctcctgtctcagcctcccaagtatctaggactacaggtgtgtgccaccacacccrgctaattttatttttatttttatagagacggggcagagtctgcagtcacatgccttgcaagtagcagagacagggtttagtctcggtagccagtgcctagggcacaggtcttggccagaggagagaaggctcaggtgaaccagtttcatctgacctgcttgctaactcaaacatggctgcccaactgcgtgggctggcaaggtatgtgaggtgggtagctgggtggcccgccccttgcaggcactggggcaggatatcagggggtccagaagaggttgggtttaggcagagtagaggtga

SEQ ID NO: 154856 - DNA, 601 bp, Human
agccacatgtaattttaaattacttttaaaacatttaaatttagccacggttttaaaaagtaaaaataggtgaaattcgttttaatattttaacccaatatagccaaaatcttggcatttcaacatgggatgagcataaaataatgaaggtgatattttattctttttttggggtactaaatctttgaaatccggtgtgtattttccacttaaagcacatgtcagtgtggactggccccattgcaaatactcagtggcctgggactggggtgaccaagtgggatgtggtggggctggtgcmgtccaccattctcacagcaggcatctggggtcaggggaggcagggcactggctgtgctggaagcaggggattggctgtgctggtgggaagccagattccagccccagacactggtacctttggctttagatccttggggtggggtgggtgcattgcttctcctgggagggaggagcgcccgggagcccctgaccaggacctggggcaggtccacacaggccctggatttctcctgtatcctgggcctggccctgctctcttgactcccacctcgtcacagtggcttcagctttttcaccc

SEQ ID NO: 154857 - DNA, 601 bp, Human
taaaaagtaaaaataggtgaaattcgttttaatattttaacccaatatagccaaaatcttggcatttcaacatgggatgagcataaaataatgaaggtgatattttattctttttttggggtactaaatctttgaaatccggtgtgtattttccacttaaagcacatgtcagtgtggactggccccattgcaaatactcagtggcctgggactggggtgaccaagtgggatgtggtggggctggtgcagtccaccattctcacagcaggcatctggggtcaggggaggcagggcactggcygtgctggaagcaggggattggctgtgctggtgggaagccagattccagccccagacactggtacctttggctttagatccttggggtggggtgggtgcattgcttctcctgggagggaggagcgcccgggagcccctgaccaggacctggggcaggtccacacaggccctggatttctcctgtatcctgggcctggccctgctctcttgactcccacctcgtcacagtggcttcagctttttcaccctgagaagggaattcaaagcctctgcccctctcaggcaggcaccaggatatgat

SEQ ID NO: 154858 - DNA, 601 bp, Human
aatccggtgtgtattttccacttaaagcacatgtcagtgtggactggccccattgcaaatactcagtggcctgggactggggtgaccaagtgggatgtggtggggctggtgcagtccaccattctcacagcaggcatctggggtcaggggaggcagggcactggctgtgctggaagcaggggattggctgtgctggtgggaagccagattccagccccagacactggtacctttggctttagatccttggggtggggtgggtgcattgcttctcctgggagggaggagcgcccgggagccyctgaccaggacctggggcaggtccacacaggccctggatttctcctgtatcctgggcctggccctgctctcttgactcccacctcgtcacagtggcttcagctttttcaccctgagaagggaattcaaagcctctgcccctctcaggcaggcaccaggatatgattttcttttttcttttctttttgtttgagacaggatctgacttggtctggagtgtagtagcctgatctcagctcactgcagcctccacctcccgggctcaagtgatcctcccacctcagcctctgaagtaattggg

SEQ ID NO: 154859 - DNA, 601 bp, Human
aagcaggggagggggcctgcagtgttgggtgtgtggagttgttgctgggaagtagagaagctgagtaaagagctggacggagagagatagccaggcccatgtctacagaaaagcattctagactgagtgagcataaatcgcaaaggcccagaggagggagcatgcctagctagccccctagacctggtgaggctggtgtgggttgggcagtgatacggtttggctgtgtccccacccaaatctcatattgaattgtagctcccataattcccatgtgtcatgggagagacctggtgggagmtaattgaatcatggtggtgttctcccccaagttgttctcctggtagtaagtgtcaggtgagccgatggttttatgaggggtttcccttttcacgtggctgtccttctttcttgcctgctgccatgtaagatatactttttttcttctgccatgattgtcaggcctccccagccacgtggaactgtgagtccattaaacttctttttctttattaatttcccagtctcgtgcatgtctttatcagcagcacgaaaacagactaacgcaggcagcctgtgttgggaggagttggcaaggagg

SEQ ID NO: 154860 - DNA, 601 bp, Human
ctggtagtaagtgtcaggtgagccgatggttttatgaggggtttcccttttcacgtggctgtccttctttcttgcctgctgccatgtaagatatactttttttcttctgccatgattgtcaggcctccccagccacgtggaactgtgagtccattaaacttctttttctttattaatttcccagtctcgtgcatgtctttatcagcagcacgaaaacagactaacgcaggcagcctgtgttgggaggagttggcaaggagggaggaggtgctggccagtagagcacatgtgtctctgtgcrtcagagcaaggacccgggctctccccgtgagtgagaagagtccatggggttttggggctgaggaggagttttacagatgaccggtctgttcttggcacttgcaattagcggaccgtctgtatccgagtgttgatcgggtggattctaaccctgtgggagaactccccagcccgtagcctgcgctcactgtacctggcagttgtattaatgacgtcaaatgcacagtccagcttgagtcccctctagaacgtgggcagcggacactaagccgagaggaatcgctgtgggttggcagacact

SEQ ID NO: 154861 - DNA, 601 bp, Human
ttaactctggtgggctcttggtataaaaatgtctccaatctcagaggtcatgggatagtgggcaagacatgaaaaccttgtataatataaaattttgttacctctaagtgctgaaattaaggtataaacaacgtctcatgggaaccaaaacatcagtcatttggaagtataagtcaagccttcgtaggagaggaaccatttcagcccgatattaccagagtgggatggtcccagcgagcgggatgtggagggttaggatgttatcttagtctgttttgtgctgccattaccaccaagtagrtaatttataaggagcagaagtttatttggctcacagttctggaggctcggatgtccaagatctagaggacacatccggtgagggtcttcttgctgcattgtctcatggtggatggaagaagggcaaggtggagagagagagcaggaaggggcctaattgtccttttataaggaacccactcctgtaataatggcattaaacccattcatgagaacagagcccttgacccattcatgagaacagagccctcatggcctactcttatgagaccccacctcacaacattgttaacatttagga

SEQ ID NO: 154862 - DNA, 601 bp, Human
tggaagtataagtcaagccttcgtaggagaggaaccatttcagcccgatattaccagagtgggatggtcccagcgagcgggatgtggagggttaggatgttatcttagtctgttttgtgctgccattaccaccaagtaggtaatttataaggagcagaagtttatttggctcacagttctggaggctcggatgtccaagatctagaggacacatccggtgagggtcttcttgctgcattgtctcatggtggatggaagaagggcaaggtggagagagagagcaggaaggggcctaattgtscttttataaggaacccactcctgtaataatggcattaaacccattcatgagaacagagcccttgacccattcatgagaacagagccctcatggcctactcttatgagaccccacctcacaacattgttaacatttaggatcaagtttctagcacatgaactttgagggacacattcaaaccatagcattctgccccagtccccaaaatggatgtccttgtcacatgtagaatacatttgcttcttacctataatcccaaattcttatttgtttcagcaccacattaaaagtccaaagtcc

SEQ ID NO: 154863 - DNA, 601 bp, Human
cagatattccattccaaaagggagagataggcaagaagaaaggggcaactggtccagacaactccagaacccagcagggggaacaataccaaatcccaacttgacaataatcttctttgactccatgtcctgccttccagacacactcgggtagggacttgggcccccaaggcctccggcagccctgcttccctggccttgctgggctcattccatgcagcagctctcaccggttggagtctcatgcttgcagctcccccaggttgctgttgcacactggtagctctgcagttctggggtrtcaggatggccttactcccacagctccactaggcttcctggggactctcagcagctcagactccacagttctgctgggcattgccctacaggggctccctggtggtggctctgaccctgcaaccagtctctgcctgggtcccgagtctgtccgcaatatcctttgaaatctagttggagggagccaggcccatagcccctgcattctgtactctggtggcattaggaccatgtgggatgccaccaagactcaccacttgcaccttctagaatggtaggtcaagctgcacctgggcccatt

SEQ ID NO: 154864 - DNA, 601 bp, Human
ctctgaggggctgggcatcatactgtgcccctgggggcatatctagttctgccccacttggttgggcgggtacctgctgagtactcactgtgtgttaggctgtgaatgctggggcagcaggaggcatggtttctgcctccactgggccttatttcttcaccttgtcccccagttctgcccttgggtaagttctgtggcagaactgaccagctcccttcggccagggacatcttggttcctggcagagcaccaagaagagcagattgtcttcctacccgggggcacctttgcccagcaggtygggtgagctggcctcttggtgagaggctggtccccttggacatgagtggattcgatgcctgctttcccacccaggtactctactgtggctttgctcctgccctttatgctcagagctagaccagcaatgtgggggagctgctggggaaaggcgccatgttgtcttgaggtagcagccagccccggaagccctggaatgcctggggccactgagcaatcctcaccctcagccccacaaggggagggcgtggctcgtgaaattcctgattgggtatagcccagcaagccccaagactcgccc

SEQ ID NO: 154865 - DNA, 601 bp, Human
tagcccagcaagccccaagactcgcccagtttgcttagcgcaacactgacgctgttttggaatgaagacaagacaatgtagaactttactggggaagaggtcgaagaagggctaattgtcttgttgttcaagactggttagcgctgctcacctctgacgctgctcacctctgacgccaaaggtttttccctggaaggcagccctggaggatacctgtgtatctgtctttcacaaaaggtgaaatgagctctttgtagtgtttcccgcccaggctgcattttagaatcacagaggaggtacrgcgctgatttgttttactattccctattcatgcctgggccccacccctaaccaattaaataaacatctcggagagtggggcctagactttatatgtttaagctcctcaggtcattgcattgtgcagccaatgctgtgacctatgaatacaaaggaagatgaaacgcaccctggtcatgcaaggaagatggagagagggagcagggagggtgagagaggctgcagttcgtaaggtcctgaaatgttagagctggagggatcctggttcggagcactgcaactcaaaagagtagttctagcc

SEQ ID NO: 154866 - DNA, 601 bp, Human
tagggagctggttagaatgcaaatccccgcctgccctgcaccccatctggcaccctctgagtcacggcgtgcacatcgaggtttgagaagtgtgctttcaggtcacccacagatcatccagaccagtggttctcaaccttggctgcactttagaatcacccagcgggcttcagcgaattccagtgctgggctagatgaattaacccagaatttctaggtgttgggacccaaatactcatttaaaaaattttttttgtttaagtacttcaggtgagtctcttcttcagccataatcaagaayatcaggcttgaccagtgcttctcaaacttggacagatagatgaatcgccagggtatcgtgtttaaatgcagattctgattttataggtctggaaggggccaaagaatccacttgtctgggctctgggatgcccatgggactgatctggccttttttgagcagtgggaataggctgacttctcagtttgacagcaaggaaactgcaggtcagagagggaggtgtgatcgtccacggtaaccaacctgatatgcattcagtactttctgatgtactctactgtgtgccaagcagcatgctac

SEQ ID NO: 154867 - DNA, 601 bp, Human
cctgccctgcaccccatctggcaccctctgagtcacggcgtgcacatcgaggtttgagaagtgtgctttcaggtcacccacagatcatccagaccagtggttctcaaccttggctgcactttagaatcacccagcgggcttcagcgaattccagtgctgggctagatgaattaacccagaatttctaggtgttgggacccaaatactcatttaaaaaattttttttgtttaagtacttcaggtgagtctcttcttcagccataatcaagaatatcaggcttgaccagtgcttctcaaactyggacagatagatgaatcgccagggtatcgtgtttaaatgcagattctgattttataggtctggaaggggccaaagaatccacttgtctgggctctgggatgcccatgggactgatctggccttttttgagcagtgggaataggctgacttctcagtttgacagcaaggaaactgcaggtcagagagggaggtgtgatcgtccacggtaaccaacctgatatgcattcagtactttctgatgtactctactgtgtgccaagcagcatgctacatgtgggactagagctgcgaacaggacag

SEQ ID NO: 154868 - DNA, 601 bp, Human
atgaattaacccagaatttctaggtgttgggacccaaatactcatttaaaaaattttttttgtttaagtacttcaggtgagtctcttcttcagccataatcaagaatatcaggcttgaccagtgcttctcaaacttggacagatagatgaatcgccagggtatcgtgtttaaatgcagattctgattttataggtctggaaggggccaaagaatccacttgtctgggctctgggatgcccatgggactgatctggccttttttgagcagtgggaataggctgacttctcagtttgacagcraggaaactgcaggtcagagagggaggtgtgatcgtccacggtaaccaacctgatatgcattcagtactttctgatgtactctactgtgtgccaagcagcatgctacatgtgggactagagctgcgaacaggacagacccaattccaaccctcacagagcttatatcccaactggggagacagacagaaagaaaacaagtaactaagctgatgacagatgggaaaagctatgaaggcgaggagggccatgtgtagggaacgactcagagattgctgtggggtgaggggtaggtaaggcacg

SEQ ID NO: 154869 - DNA, 601 bp, Human
cctgacctgagcaaacctgtttggctggattgatgatggagaggcaggcagtgaccagaccaagagacgccttggatggtggagaataggtgaccctctgttgggtaaaagaggactcaagccctcacacagtgagttggctaactttttgtctcaacagtgggcgggggtagctgtctgcctcctggagctggcccttcctgggtcaaaatgcagaaggagatggtgagaagaaccacaccagagaggctggagtaggccagcctggcttgggaccgagtcccgagtccctggctggacmctcggttttcccttccgtggcagggctcacctggatccttaatgccgcccttggaggagttaggaggatcctggatgagaaaactcaccctcaggatgattgccccagggagcagcttcctgctttctggtggaagggaggggcagacagtgggtgtgtcctgctccagtgtctaggcaggagagtttgtgaagccgaccggacacctgtggctcttatttcctaggtggcccgaggcagccgggatgacagctctccccaggaatcctgctgcctgctgagaaacatggtcagcaagtc

SEQ ID NO: 154870 - DNA, 601 bp, Human
acgccttggatggtggagaataggtgaccctctgttgggtaaaagaggactcaagccctcacacagtgagttggctaactttttgtctcaacagtgggcgggggtagctgtctgcctcctggagctggcccttcctgggtcaaaatgcagaaggagatggtgagaagaaccacaccagagaggctggagtaggccagcctggcttgggaccgagtcccgagtccctggctggacactcggttttcccttccgtggcagggctcacctggatccttaatgccgcccttggaggagttaggargatcctggatgagaaaactcaccctcaggatgattgccccagggagcagcttcctgctttctggtggaagggaggggcagacagtgggtgtgtcctgctccagtgtctaggcaggagagtttgtgaagccgaccggacacctgtggctcttatttcctaggtggcccgaggcagccgggatgacagctctccccaggaatcctgctgcctgctgagaaacatggtcagcaagtcccgtgagtgtcatccgagggctcccccaccctggaggacaggcctcagaagccgtcttcagcagga

SEQ ID NO: 154871 - DNA, 601 bp, Human
cttcctgggtcaaaatgcagaaggagatggtgagaagaaccacaccagagaggctggagtaggccagcctggcttgggaccgagtcccgagtccctggctggacactcggttttcccttccgtggcagggctcacctggatccttaatgccgcccttggaggagttaggaggatcctggatgagaaaactcaccctcaggatgattgccccagggagcagcttcctgctttctggtggaagggaggggcagacagtgggtgtgtcctgctccagtgtctaggcaggagagtttgtgaagcygaccggacacctgtggctcttatttcctaggtggcccgaggcagccgggatgacagctctccccaggaatcctgctgcctgctgagaaacatggtcagcaagtcccgtgagtgtcatccgagggctcccccaccctggaggacaggcctcagaagccgtcttcagcaggatcctgggacctctgggggctgtggagggacagacagggagccaggggcccttctcttcatcttgaaggacagtgggtacaatcagggtcaagccctcagccagggccaggagagggccagagactgcttc

SEQ ID NO: 154872 - DNA, 601 bp, Human
tgccctcttctgtgctctgcgcagtctcctcctcttacaaagcccagggctgtaaagtcagcatgaccctaagcaggaccacggggtgatgcctgcttcatggggaccaggggctgagggggcctaggaagtggtcctgagatgggcccaggcagatccagggcagcgagcctgggttagagtgtggggtgacatagaccactcctctttctatggcagcctcaggtgccgccgctgtgtggtcgtggggaacgggcaccggctgcggaacagctcactgggagatgccatcaacaagtaygatgtggtcatcaggtgtgtgtgactgtctcttcctactgttgtttgggaactggatgtccgagccagggactgtagacaggcccaggaggcctctagtgatgggaatcctcctcccaacccccagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcct

SEQ ID NO: 154873 - DNA, 601 bp, Human
ctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtaagttgggggacagactgggggctgaggcctggcggtggggacgctgcccgagtcaggacctcacgctccttgatgtccgcctggcagtcctaaagaggctgtgaggggacagcatgaaccgggctccyggaagtcagcgccttaggctgccctccaagggtggtgctctgataagctgccccagcaactgggtataaaagcctgcaggcgtcaggtggcagcagccacaggcacccatgctccaggcgtgtctgtgacaggaaagctttccgagtaggtgtttgcctgtgaggaactcgggagctgagcaaccctccagcagccatctccaggctgagggcaggttagagcaatgaggcctgtgtccaaacagatggtccccagaaagagttcactacatcactttgccatccggtcacaggctgaac

SEQ ID NO: 154874 - DNA, 601 bp, Human
ctcttctaccctgaatctgcccacttcgaccccaaagtagaaaacaacccagacacactcctcgtcctggtagctttcaaggcaatggacttccactggattgagaccatcctgagtgataagaagcgggtaagttgggggacagactgggggctgaggcctggcggtggggacgctgcccgagtcaggacctcacgctccttgatgtccgcctggcagtcctaaagaggctgtgaggggacagcatgaaccgggctcccggaagtcagcgccttaggctgccctccaagggtggtgctcygataagctgccccagcaactgggtataaaagcctgcaggcgtcaggtggcagcagccacaggcacccatgctccaggcgtgtctgtgacaggaaagctttccgagtaggtgtttgcctgtgaggaactcgggagctgagcaaccctccagcagccatctccaggctgagggcaggttagagcaatgaggcctgtgtccaaacagatggtccccagaaagagttcactacatcactttgccatccggtcacaggctgaactgtcccatctggcatttttgtcaagtgtttagacagcctaa

SEQ ID NO: 154875 - DNA, 601 bp, Human
cgcttggaccccctcgcctcgctgaggaccactgggttggatttgagaaacagggcttcacccgcttctgtctctctcttctgaccccatcctcctaggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcaggtgatgatgggaagtcaggcctgagggctaggatcctgggcgggaagtaggagggatgwtcctatgggcttaggaagccctggaaggatcccataacagaggcggcggtttgcattttccctccaggaacacacctgtcattaaagttgctgctgcaaaggggagtgcacactttagagaaccaaggggcatttactaagtggggagggatggggatggcctggatcaggtttaggggctggtgtgagaggatggttttggcaggcgctggtcagaatttgtcaactggggagctgctggaacagtcagtggtctgatctgtggaacaacttgagccatgcagagttactgttagatac

SEQ ID NO: 154876 - DNA, 601 bp, Human
ggtctcactgtgttgcccaggctggtcctgaactcctggcctcaagtgatcctcgtgtctcagcctcccaaaatgccgggattacaggtgtaaggcactgtgtctgaccacaagttatgtgttatgtgtttcttctttttaacctgatgtccttgagccatagcaagttatggttttgagtgcagtgccctggtggtcttcagctggtgggctttaacccactttgtagcttcccaagtacttccacccatatcttggagcccctcggggaggccgtgtgggatggtgagagacaggcacyagcagacacaggtatggcgcttggctgtgctgtgtactgtgtggggcttggcaggtcaactgctcagatccttgtttttcttgcctgtgtggtgggataatatccataatgaccttttaaggctgttgtaggagtttgaaaaataataatgatgtaaaatacctattctggagaccggtacacagggcctgccctttaaatatttgccagattttgaataaatgattttattgtttactgaacatttcctgttattccatgttctgtgttgaatggctgcttttgtgactgctcaatgcc

SEQ ID NO: 154877 - DNA, 601 bp, Human
attacaggtgtaaggcactgtgtctgaccacaagttatgtgttatgtgtttcttctttttaacctgatgtccttgagccatagcaagttatggttttgagtgcagtgccctggtggtcttcagctggtgggctttaacccactttgtagcttcccaagtacttccacccatatcttggagcccctcggggaggccgtgtgggatggtgagagacaggcaccagcagacacaggtatggcgcttggctgtgctgtgtactgtgtggggcttggcaggtcaactgctcagatccttgtttttattgcctgtgtggtgggataatatccataatgaccttttaaggctgttgtaggagtttgaaaaataataatgatgtaaaatacctattctggagaccggtacacagggcctgccctttaaatatttgccagattttgaataaatgattttattgtttactgaacatttcctgttattccatgttctgtgttgaatggctgcttttgtgactgctcaatgccaggccccgagtcttcttgcttggcgaggaagttgtgctccttgctctaagggacctcagtctagcagagtaagaatgcag

SEQ ID NO: 154878 - DNA, 601 bp, Human
atcttggagcccctcggggaggccgtgtgggatggtgagagacaggcaccagcagacacaggtatggcgcttggctgtgctgtgtactgtgtggggcttggcaggtcaactgctcagatccttgtttttcttgcctgtgtggtgggataatatccataatgaccttttaaggctgttgtaggagtttgaaaaataataatgatgtaaaatacctattctggagaccggtacacagggcctgccctttaaatatttgccagattttgaataaatgattttattgtttactgaacatttcctkttattccatgttctgtgttgaatggctgcttttgtgactgctcaatgccaggccccgagtcttcttgcttggcgaggaagttgtgctccttgctctaagggacctcagtctagcagagtaagaatgcaggttgcactgtggggtgataaaattccacaatggagagttgttcccaatgccgtggaatctcagaggaggggcagacatctgctgagagatgtctgggaggctccccagaggaggtggtgctggagccgggcctggaaggatcaggcagagagctggggaaaggcattccat

SEQ ID NO: 154879 - DNA, 601 bp, Human
tcttggagcccctcggggaggccgtgtgggatggtgagagacaggcaccagcagacacaggtatggcgcttggctgtgctgtgtactgtgtggggcttggcaggtcaactgctcagatccttgtttttcttgcctgtgtggtgggataatatccataatgaccttttaaggctgttgtaggagtttgaaaaataataatgatgtaaaatacctattctggagaccggtacacagggcctgccctttaaatatttgccagattttgaataaatgattttattgtttactgaacatttcctgytattccatgttctgtgttgaatggctgcttttgtgactgctcaatgccaggccccgagtcttcttgcttggcgaggaagttgtgctccttgctctaagggacctcagtctagcagagtaagaatgcaggttgcactgtggggtgataaaattccacaatggagagttgttcccaatgccgtggaatctcagaggaggggcagacatctgctgagagatgtctgggaggctccccagaggaggtggtgctggagccgggcctggaaggatcaggcagagagctggggaaaggcattccatt

SEQ ID NO: 154880 - DNA, 601 bp, Human
acatctgctgagagatgtctgggaggctccccagaggaggtggtgctggagccgggcctggaaggatcaggcagagagctggggaaaggcattccatttggccagagcaggcggctcctccagcactgaactgtttccagtacaagtggcgttgaagggcaacaaggagtttcatgccattcataggattacagatggagaggaggctggagagggagatgagagagggcgaggacctgaacccagctcctggcagtgggaagggaaaaggaggagatggactcaacattgtgttggttgtttttttttttgagatggagtcttgctctgtcacccaggctggagtgcagtggggtgatcttggctcactgcaacctctgcctcccaggttcaagtgattctcctgcctcagcctcccaagtagctgggattacaggcatgtaccaccacacctggctaatttttgtatttttacgaaaatacaaaacacaggagtgctggtctcgaactcctgaccttaggtgatctacccgcctcggcctcccaaagtgctgggattacaggtgtgagccactgcgcctggcctgtattagctttctgt

SEQ ID NO: 154881 - DNA, 601 bp, Human
tggctgtcagctggaggctgggggccacgctcagctcttggaggtggcccacatttcttgaccgtacagcctccatcttcaagccagcgacggcacaatagatcctttctgtgcttcaaatctctgacctccgtttctgatcttgacacccggatttaaaggttcaggtaattaggtcaagctcagcaggacagcctctccttttgtgttcaactgtgccatataaagtaacgtcacgtaatcgcatcatattcacgggctccccacacgcgcaagggaggagattacatgagggttagcrtcactggggttctcttacgattctgccttatatattttacaggtggaattgagagatttctgaccaattctgggtttctagcttggacagccggtagggggcggggggtggtaacatatttaactaatagagagagagtgcaaggaagaggaggaatttggtgagtgtaaggagactgtgtccaggcagagctggctagaaggccatggaagtgtggctcagcccagctggatgagataacacactggtggtgaaagcaacaagggtggaaaagaaggtccagccagggagtggaagatg

SEQ ID NO: 154882 - DNA, 601 bp, Human
aggttgctgaagcggaggaaggcggggctggagaagtgagaatatcaggctgcccgtcactgtggatgaattaggcatgagcaactgaggttctcagagcagccagtaaggtgaatgggaaaggtactgctgtcctgctttaaaggagagggcagccaccatggctcacgcctgtaatcccagcgctttgggaggcagaggtgggtggatcgcttgagcccaggagttcgagatcagcctgggcaacgtggtgaaaccccatctctttaaaaaaatagagcgccacccccataaagggtcrcacagttagtgcatgtcagagcacccaggtcttctgaatgaggtcaggttctccaaggaggagggcagaacacttcctttcctttgaatgagttgcttaacgcttttgtaagccttggttttctcatctgtaaaatggggctgatgataatagctacctccaagtgtttttgtgagactagatgagataatgttttatagtaggtaggtaaaatactaaacatagtgtctggcacatagtgtttaaaaagtaactgatatgatgatggctgtcattctgattgttagtcttatctctaca

SEQ ID NO: 154883 - DNA, 601 bp, Human
gttgcagtcaggacgtgacaacaagacaaataatttcttggaccttttatcttggacaccatttattttccctcagccccggggcaggactgacctcatggtagggcccaagcgtggcagctgcaccgtcactgggggctgggccaggccaggccaggctgggcagggctgagccatgctgggcttgtgcacctccgggccagctgcctcccttctcccaggcatcactctttaccgcctccgttcccctcccactctctttccccttcttcctttcgcagcttttccccgttccccgttytgtttttgtccacctctctgtccccctccccaccagctctgtctccctccttcggaccacagcttccctcctccccacctctcccaggccctctgctggctgcctctatggggcctcccatccctcgtggccccctccacagacgcctggctgtgctaggctgacccaggtggtggttttccctcggatctgctgtccagtggctgccagaaggggcagctggctggccgtggcaggaggaggtgcccttctggggagtcccagagctctcattggcccctccaggctgggagagtacag

SEQ ID NO: 154884 - DNA, 601 bp, Human
ccactctctttccccttcttcctttcgcagcttttccccgttccccgttttgtttttgtccacctctctgtccccctccccaccagctctgtctccctccttcggaccacagcttccctcctccccacctctcccaggccctctgctggctgcctctatggggcctcccatccctcgtggccccctccacagacgcctggctgtgctaggctgacccaggtggtggttttccctcggatctgctgtccagtggctgccagaaggggcagctggctggccgtggcaggaggaggtgcccttytggggagtcccagagctctcattggcccctccaggctgggagagtacaggggggtcagactctggtctgaaccatctgtccacgccctgagacaggaggcgggagctcgagagggaggggagcctggaaatggccggcccctcaccccagaagtcacttgccctctcattccctctgcctgaactgggaactcagggaatctttcctgctgtgtgacctcagacaagcactttgccttctctgggccttggtttctcctctgcacaatggttgggctaacgcagtgcttcttctttttct

SEQ ID NO: 154885 - DNA, 601 bp, Human
ttccagctttacagggagtcagcacgccccagtgcagatgcttctctgagcccccaggctgggtacagagccccagagcccctgtgcttgcccttgtcccaacaagggtcctgctgcggtggaaccatctgttgacgtggctggtgcccctgcgagagtgtgagctccttggagggagtgactttgtcttgctctttgccatgtctccatgtccagcacaaggcctggcagagagcagggcccctttaaatgtggctagaaggatgcataaaatatgtacagggcaactcaaagtgtaacygggggctgccgtcagtggctcacacagggaggaaggtcggggcttcagggctattgctgagttggtggtggagctgggagggagtcctctcgtccccatttccctccttctggtagttgccagaggtcctttgggctggttgagtggctgacgtagcagggacccctagtctcagagttgagcccccacggtccattttccacacgcatcccaaaatgtgagcatgttcctgcacagctcagaggtgctcatctcacttagagtaaaactcatgtccttgaatcggcctgcaggcctggc

SEQ ID NO: 154886 - DNA, 601 bp, Human
ctgttgcatccccagtacacagggccaaccacgaagacgctctcagtatatgcttgagcaagtgaatgtatgggtgatgccctgtgtgtgtcagggtatgtggcaggtgtccttccccctggcgcattgaggcaaagaggcttccttctgtttggcacagatctcagtgcacagtaggtacttggcaaatcagtgttccctccctcctttcccaccacccttcctttctatccggccaggcttgcactgtgcagtggggatagggtgatcatcagacccagcttcccccagcaggtctccyagctgggaatggaacttcctatctccacctaaacccctgcccctctgagctcatgtcccacaacttctgtccccagggaggagtgaccacccacacctcaccaaccccttgactgacacggctatgctagagctacagctagggttaaacagagctcccgatgaaccctattggtttttccccccaactttctggtgtgtccatatggagaaaggtctttgagaaaagaccatatacagcagagtgtgtgtgtgtgcctgggtgtgtgtgttacagtgacagggaagcgtctccagaaag

SEQ ID NO: 154887 - DNA, 601 bp, Human
gatctcagtgcacagtaggtacttggcaaatcagtgttccctccctcctttcccaccacccttcctttctatccggccaggcttgcactgtgcagtggggatagggtgatcatcagacccagcttcccccagcaggtctcccagctgggaatggaacttcctatctccacctaaacccctgcccctctgagctcatgtcccacaacttctgtccccagggaggagtgaccacccacacctcaccaaccccttgactgacacggctatgctagagctacagctagggttaaacagagctccygatgaaccctattggtttttccccccaactttctggtgtgtccatatggagaaaggtctttgagaaaagaccatatacagcagagtgtgtgtgtgtgcctgggtgtgtgtgttacagtgacagggaagcgtctccagaaaggataccttctcctccattgccacctctctctccccctctcaagatctggtctgccttcagtggggaaggagggagggctgactcggtgtgacctctcagtgctgtctgtagtgaggatggttcttcactgggggaagacgcctggagagcagccagcag

SEQ ID NO: 154888 - DNA, 601 bp, Human
ccccttgactgacacggctatgctagagctacagctagggttaaacagagctcccgatgaaccctattggtttttccccccaactttctggtgtgtccatatggagaaaggtctttgagaaaagaccatatacagcagagtgtgtgtgtgtgcctgggtgtgtgtgttacagtgacagggaagcgtctccagaaaggataccttctcctccattgccacctctctctccccctctcaagatctggtctgccttcagtggggaaggagggagggctgactcggtgtgacctctcagtgctgyctgtagtgaggatggttcttcactgggggaagacgcctggagagcagccagcagctctgtcagcactgggatctttgcggctggccagctaccgtccagccctcgcagggccccagatcggaggcccagcccctccctggctcccagctcccctgctgctcttgcgggtcttggggactttaccccaggcttggggaaaacaaacccaccctccagctttgttctcttgggttctgcctctttgggtcttgtcccctgcatctgtgggattcaactctgtctctgtgctgtgtctctctc

SEQ ID NO: 154889 - DNA, 601 bp, Human
gtgttacagtgacagggaagcgtctccagaaaggataccttctcctccattgccacctctctctccccctctcaagatctggtctgccttcagtggggaaggagggagggctgactcggtgtgacctctcagtgctgtctgtagtgaggatggttcttcactgggggaagacgcctggagagcagccagcagctctgtcagcactgggatctttgcggctggccagctaccgtccagccctcgcagggccccagatcggaggcccagcccctccctggctcccagctcccctgctgctctygcgggtcttggggactttaccccaggcttggggaaaacaaacccaccctccagctttgttctcttgggttctgcctctttgggtcttgtcccctgcatctgtgggattcaactctgtctctgtgctgtgtctctctccaggcctctggctgcctctctgagtctttccctgctgtttcccacccttcaaacccaaagtcttcacagcgaggccccggatcaccctctgggaaacccggctggggaagcacactgggattagtcaaccaatcaatcagtcagtcaatgccacttccctttt

SEQ ID NO: 154890 - DNA, 601 bp, Human
cggctggccagctaccgtccagccctcgcagggccccagatcggaggcccagcccctccctggctcccagctcccctgctgctcttgcgggtcttggggactttaccccaggcttggggaaaacaaacccaccctccagctttgttctcttgggttctgcctctttgggtcttgtcccctgcatctgtgggattcaactctgtctctgtgctgtgtctctctccaggcctctggctgcctctctgagtctttccctgctgtttcccacccttcaaacccaaagtcttcacagcgaggcccyggatcaccctctgggaaacccggctggggaagcacactgggattagtcaaccaatcaatcagtcagtcaatgccacttcccttttctgtcatcaccagcctgcgtaaggtctgtcctctgtctgcctgcgtaccttggtctgaatctccatctgtctcaaactggctctggccttgctctgcctgtgttcaaatcctggtcctactgtgagactctggtcaagcaatttaactgctctattaacttacactgattcagtttcttcatctgtaaaatggcataatagttcctacctcatag

SEQ ID NO: 154891 - DNA, 601 bp, Human
cccctttgctgctctcctttctggatgccggagaagggagcagatcctttgagccatttttctttctgccactctccttggccccagccctgggtggcctctgggctcctgctctgtgcggagccctggggagacaggctctgtgggccttccttccggggcagctgtggcctggagcttcccattttgtattcctcctcttgtttcatgcagccttttctcctcttcatcagatctgaaaccttctttgcctctctctggctgtggtcgcagcccagccctgggtggtcctgagggtttcccatctcccggtatcaaaggtatctttctcagggtgaccctggggactccctccttcctcaaagtcatttggaagtggagctgagggaaggtggacatccccatccactaacttctgcccaaagaaagtggggtcaaagagaagacctcccctgcctccttcgctgttcactcactcgctccccaggaaagggactggggcctctgagaagtgaggggtggggtagacaggcaaagcccaagacttctgggtcagactgcctgggcttggatctcagctccatcactgtgtgactgtggg

SEQ ID NO: 154892 - DNA, 601 bp, Human
ctgctctcctttctggatgccggagaagggagcagatcctttgagccatttttctttctgccactctccttggccccagccctgggtggcctctgggctcctgctctgtgcggagccctggggagacaggctctgtgggccttccttccggggcagctgtggcctggagcttcccattttgtattcctcctcttgtttcatgcagccttttctcctcttcatcagatctgaaaccttctttgcctctctctggctgtggtcgcagcccagccctgggtggtcctgagggtttcccatctcscggtatcaaaggtatctttctcagggtgaccctggggactccctccttcctcaaagtcatttggaagtggagctgagggaaggtggacatccccatccactaacttctgcccaaagaaagtggggtcaaagagaagacctcccctgcctccttcgctgttcactcactcgctccccaggaaagggactggggcctctgagaagtgaggggtggggtagacaggcaaagcccaagacttctgggtcagactgcctgggcttggatctcagctccatcactgtgtgactgtgggactcggtt

SEQ ID NO: 154893 - DNA, 601 bp, Human
gctctcctttctggatgccggagaagggagcagatcctttgagccatttttctttctgccactctccttggccccagccctgggtggcctctgggctcctgctctgtgcggagccctggggagacaggctctgtgggccttccttccggggcagctgtggcctggagcttcccattttgtattcctcctcttgtttcatgcagccttttctcctcttcatcagatctgaaaccttctttgcctctctctggctgtggtcgcagcccagccctgggtggtcctgagggtttcccatctcccrgtatcaaaggtatctttctcagggtgaccctggggactccctccttcctcaaagtcatttggaagtggagctgagggaaggtggacatccccatccactaacttctgcccaaagaaagtggggtcaaagagaagacctcccctgcctccttcgctgttcactcactcgctccccaggaaagggactggggcctctgagaagtgaggggtggggtagacaggcaaagcccaagacttctgggtcagactgcctgggcttggatctcagctccatcactgtgtgactgtgggactcggtttt

SEQ ID NO: 154894 - DNA, 601 bp, Human
aggaatttggggctatgatttttgttatggagaagcaagtcccttgtcactgaaattaaacttttgtgggtgagggaggggcaggggctaggaagcaaggggtcagggaaaagagtgcacgaattgggagtggggcggtcacaggcaaataaagcagctggtactggggagtcaggcacagcggtttaagaccagagaggagagagagctaagagagggcgcgtggcctacccaaagtcacgcagcagcgtactggggagaaaaatgtgggctggtggagtgagaggaaaagatttggacmcagcatacctaatcaagggacagtcactctttgcctgcttgatgtccttgttcaggcagggctttgggggatcagctctggacccctcatcctgagggaggctctgtggagcatggatggtgtagcatggggtctcccaccctggggggaatcccagtggggatccggtcctgattgggatttctgggctcctgggagttagttacccttcagctttggtggcctccatggacggcagtggaatatcctgcataccctttcctagggagctcgcacctcactccctgtgcccttcctgct

SEQ ID NO: 154895 - DNA, 601 bp, Human
ttcctagggagctcgcacctcactccctgtgcccttcctgctatgaataggcaggttaaaggtgccgggggcactagcaggggctccagatgtttgccctgcaggaaggggccacagacctaacttttggaggaaatagcttgacgtcctgaaaggcaggggaggtgtgcgtgcacatgcctgcatctgtatctatctgtccccttggtccccttagctacttctctgtggttatttgtatggcatctgtcctgatttggggaatggggttatttttgtgattgtctgtcttgctttgggkttgggggatggggttatttgcatggccgcctgtcctgcttgggagaatggcctttttgtatggccgtctgtcctgctttgggaaatgggttttttgcacggttctttgtcctgtttggtggaatagagttgaggggctagggaaggtgggtgacgatgggtagaagggcacactggtgttcagccacagggggcagaactcccttctggctggagccatctggatcccaagtggagccaagagaggctggaggaaagggaacaggtgataggcagcttccatctccctgcctgaggggca

SEQ ID NO: 154896 - DNA, 601 bp, Human
ccacctttcttcataccaagtattaaaatgcaccacatcccacatgacatgtaatttgtatttaactagatcacagtggagttgagttacagctgagtagctgatttaatgtcaggttttatgcaaatctatcaggactcatttctgttgtaagcgatagaacacagtatcacctgttttaaaggaaacgaaccatcattggcccacataaccgtgaggtaatgtgagcttcagacgtggctggatctagagcccaaatgatgtgaccaggacgtagtttctgtccttctctcctccttgrctttgcttcatctgtgctggcttcactgtcagacaggatctcccctcatggtgataaagtggctgcctctgcttcagccttacaaactcctctggtttaaatccacctatgtttggggttgcctagaaaaggtctcaaggaacactgattggatggcttgggtcacttgctcacctgtgagccaatcactgaagccacagggaaaatagtgtctggatgtcttgctctggtagggatgaagtggagccattgggctatctgggtggagagtggggaaggaatagatttctgaatgacaat

SEQ ID NO: 154897 - DNA, 601 bp, Human
tttaagcctttctttttgtctcataatttagggtttgtctgatccaggtaattatcatgaattttgtcgatttttggctcgtttaaagacaaattatcagctgggagaattagttatggtgaaggaatatcctgaagttattagattgattgctaattttaccattactagcctacaggtaggtaaaaatatgtaattatgttaaactgtagccagttttaaaacagcttcttggtaagggttggtgggggtatttgaaaaatatctattaatttgattactttgctggaaatgttcattrcagggttttaggttaaaaaattcattgaaatgtatataataaaaattgagaagctatttaaatatctaataattgaataatggcttgagaaactataataaaatctatgtgaagaaataaaatttttacagattatattatagaaaagtttttaaaataattttaagggagagattataaaaccatgtttttcacaggatgtcaactctgaaaaatattcatggaatgattagagggaagtagagtaatattttaatgttactctgggtggtaaaataatagagatgttggtttctttat

SEQ ID NO: 154898 - DNA, 601 bp, Human
tttgtctcataatttagggtttgtctgatccaggtaattatcatgaattttgtcgatttttggctcgtttaaagacaaattatcagctgggagaattagttatggtgaaggaatatcctgaagttattagattgattgctaattttaccattactagcctacaggtaggtaaaaatatgtaattatgttaaactgtagccagttttaaaacagcttcttggtaagggttggtgggggtatttgaaaaatatctattaatttgattactttgctggaaatgttcattgcagggttttaggtwaaaaaattcattgaaatgtatataataaaaattgagaagctatttaaatatctaataattgaataatggcttgagaaactataataaaatctatgtgaagaaataaaatttttacagattatattatagaaaagtttttaaaataattttaagggagagattataaaaccatgtttttcacaggatgtcaactctgaaaaatattcatggaatgattagagggaagtagagtaatattttaatgttactctgggtggtaaaataatagagatgttggtttctttatacttttttgcattt

SEQ ID NO: 154899 - DNA, 601 bp, Human
aaaatatgtaattatgttaaactgtagccagttttaaaacagcttcttggtaagggttggtgggggtatttgaaaaatatctattaatttgattactttgctggaaatgttcattgcagggttttaggttaaaaaattcattgaaatgtatataataaaaattgagaagctatttaaatatctaataattgaataatggcttgagaaactataataaaatctatgtgaagaaataaaatttttacagattatattatagaaaagtttttaaaataattttaagggagagattataaaaccrtgtttttcacaggatgtcaactctgaaaaatattcatggaatgattagagggaagtagagtaatattttaatgttactctgggtggtaaaataatagagatgttggtttctttatacttttttgcatttataaatttgctatattatgtgttcattagttttatagtaagaataaaagttaatttaaaaatgtatgtttagtaattttattctgtaattcttattgtaggaagatgtaatattttaaataacttctgctttatttctttgtagcactgggaatttgctcctaacagtgtt

SEQ ID NO: 154900 - DNA, 601 bp, Human
gatgttggtgacctacagatggggtttctgtgtagatgtcctttttgttgatgtcgatgctattcctttctgtttgttagttttccttctaacagacccctcagctgcaggtctgttggagtttgccggaggtccactccagaccctgtttgtcttggtatcaacagcagaggctgcataacagcaaatattgctgcctgatccttcctctggaagcttcatcccagagggtcacctgcctgtttgaggtgtctgtcagcccctactgggaggtgtttcccagtcaggctacacaggggtsagggacccgcttgaggaggtggtctgttcgttctcggagtttgaacgctgtgctgagagaaccactgctttcttcagagctgtcagacagggacgtttaagtctgcagaagctgtctgctgccttttgttctgctatgccctgccccaagaggtggaatctacagaggctgagctgcggtgggctctgcccagtctgtgctttgtttacactgtgagctattcaagcctcagcaatggcggaccccccttcccccgtcaagctgcagcatcgcagtttgatctcagactgctgcactagc

SEQ ID NO: 154901 - DNA, 601 bp, Human
atgatctagttgagaataatatacctcctaggtattttacttttcactctgctgattaataagtttagtattatttcatgtttattgattgttgtatcatcatcagtgaaatgtatgtgcatctcttttgttcatttccacctcaccactggattgctttctttcactgatttgtaggagtcttttatgtattttgacattaatcatttaggtttttgaattgtaaatatcactccaagtttgcgacctgtctgctgcatatcattttagtgtgttattcttattttcatatcaaacttgrttttgattaattcacaaaaatttttttgaagaggtaatgtatttcattgtgcaaaaattaaaaaaaattaaaatgtgttctgttccagtgctatactctgtcctccctttcttcactctagcaagtagttattcttagttttgcatgtctttccaaagtttctatatgcatatacaaagagttatgaatatataaattcttacctcccttatttgcatagaatacagcataccatactcactgctctacttcttgcttgttttcatttagtgttttatagctattttcataatatagaga

SEQ ID NO: 154902 - DNA, 601 bp, Human
ctatactctgtcctccctttcttcactctagcaagtagttattcttagttttgcatgtctttccaaagtttctatatgcatatacaaagagttatgaatatataaattcttacctcccttatttgcatagaatacagcataccatactcactgctctacttcttgcttgttttcatttagtgttttatagctattttcataatatagagagaactcttattttttgtagatacatacgtaatattttactttttgaatatatcataatttaaccattccatccactgttgacaatgatttkagtgatttagtcttttcctgttaaaagtattcctgtacagataaaccttgtatgtgtcattttatgtatatatgaatttataaatttctcctagtgaaattgccgttgagtggaaggttaatgtatttgtaattctgcaaatgttgcccagttgttttctgtaaggactataccatttacttgtccactagaaatgtatgagattgtttccatgtatccttcataggacaatatatatatatttttattatactttaaattctgggatacatgtgcagaacgtgcaggtttgttacatag

SEQ ID NO: 154903 - DNA, 601 bp, Human
ttgccgttgagtggaaggttaatgtatttgtaattctgcaaatgttgcccagttgttttctgtaaggactataccatttacttgtccactagaaatgtatgagattgtttccatgtatccttcataggacaatatatatatatttttattatactttaaattctgggatacatgtgcagaacgtgcaggtttgttacataggtatacacatgccatggtggtttgctgcacccatcagcctgtcatctacattaggtatttcttggaattcttggcaatcctgtgtgtgaaaaatggtttytcagtataatttaactttgcatttttcttatcagtgaggttgtgcattgtttaaatttacataagagccatttggcctttttttttgtaaatgaacaattcatttcctttgccatttttctattgggttgttggtcctttttttctccttgatttttaagagctttttacagttaggaaagtgagctccttgggtgtgatcagagttgcaaatatctttttcctttttttctttgcatatgttttagagattcaaatatggtgagcatattttgtttctttttgttgttgcatagtattc

SEQ ID NO: 154904 - DNA, 601 bp, Human
ctggaagcttagtctcagaggggcaccgggccttatgaggtgtcaatcgcccccctactgggaggtgcctcccagttaggctactcgggactcagggacccacttgaggaggcagtcggtccgttctcagatctcacactccatgctgggagaactactgctctcttcaaagctgtcagacagggacgtttaagtctgcagaagtttctgctgccttttgttcagctatgccctgcccctagaggtggagtctacagaggcaggcaggcctccttgagctgccgtgggctccacccagttygagctttctggctgctttgcttacctactcaagccgcagcaatggctcaagccccttccccagcctcgctgccgccttgcagttccatctcaggctcttgtgctagcagtgagcgaggctccgtgggcatgggaccctccgagctaggtgcaggtcataatctcctggtgtgccgtctgctaaggccattggaaaagcgcagtattagggtgagagtgtcccgattttccaggtgccgtctgtcacagcttccctttgctaggaaagggaattcctggacctcttgcgcttccagggtga

SEQ ID NO: 154905 - DNA, 601 bp, Human
agggacccacttgaggaggcagtcggtccgttctcagatctcacactccatgctgggagaactactgctctcttcaaagctgtcagacagggacgtttaagtctgcagaagtttctgctgccttttgttcagctatgccctgcccctagaggtggagtctacagaggcaggcaggcctccttgagctgccgtgggctccacccagttcgagctttctggctgctttgcttacctactcaagccgcagcaatggctcaagccccttccccagcctcgctgccgccttgcagttccatctcargctcttgtgctagcagtgagcgaggctccgtgggcatgggaccctccgagctaggtgcaggtcataatctcctggtgtgccgtctgctaaggccattggaaaagcgcagtattagggtgagagtgtcccgattttccaggtgccgtctgtcacagcttccctttgctaggaaagggaattcctggacctcttgcgcttccagggtgaggcaatgccccgccgtgctaggtgggctgcaccgacttgtttggcaagccctagtgagatgaatccggtacctcagttggaaatgcagaaatc

SEQ ID NO: 154906 - DNA, 601 bp, Human
tcaagccgcagcaatggctcaagccccttccccagcctcgctgccgccttgcagttccatctcaggctcttgtgctagcagtgagcgaggctccgtgggcatgggaccctccgagctaggtgcaggtcataatctcctggtgtgccgtctgctaaggccattggaaaagcgcagtattagggtgagagtgtcccgattttccaggtgccgtctgtcacagcttccctttgctaggaaagggaattcctggacctcttgcgcttccagggtgaggcaatgccccgccgtgctaggtgggctrcaccgacttgtttggcaagccctagtgagatgaatccggtacctcagttggaaatgcagaaatcacctgtcttctgcgtcagtctctctgggagctgcagactggagctgttcctattcggccatcttggcgccaccaagccgctgttttatttttattttcatttaaagataatttctaatttaattattatttctttgttctttgtgatttatggattatttagaagtgtgcttttaagttacaaatatttagagttttcctagttattgttactgatttttaaattttacctacctt

SEQ ID NO: 154907 - DNA, 601 bp, Human
ttaaattggtagataccctggcttccagcagaagggaatgaaaacctcttccaaaggatcaaccataatttagggccttggaaatcctgcagattaagttaaacaagtgttcatagtaaacaaaaacaataaaagccagcacataaacaatgaagtaagctgccatgaatgagcactaacaaaaataagttatctatttgatttagaacccctatctcctaaagactcttaagatgttggaattggataggaatataaagcaattatgtgcgaaatagttaaagaaataaaaaatagaatyacaaatgagcacataacaggagtgtgaaaaacaaccaggaggatatgaaaaggacctgaaaaaactttttttattgaaaactttgtgatctaaaatttcatggatgtgttaaacagtaaattggacccaactgaggaaagagttggctaactggcagttagaactgaagaaattttcaagactgcaggaaaaaaggaaaatgaaaatattaaaagagacgttaaaggatggaatgaggtcaggtatgtcaaaatgagtcccagaaagatagaatagaggaaggaggagaggtgataactg

SEQ ID NO: 154908 - DNA, 601 bp, Human
ccgaaggagtttttatagttggatacactatgcagttttagtaaaataacatttcagagtctgtaatataatgcctagtacttagaaaatttttaatagtattagtcaaaaggtcagtgggaaagaatctgtctgcccttttagagatatctgtggtctgctcaaaatgatcattttatattatgaaaaatgcctaacatggccctagtttgtatacactgtgtgtagtagtattagtttttttgcgtgtgtgaacacttcagttagtgttgaacaaagaaaattatatgctcttgttatrtgtgctttaatttagatgcttaatggcttttaatgttacaaaataagtttattattatattatgatctcatttgtattatattgtctcgctcttctgtatttgtggtgatatggtcatggtttacgaaaacaataatccgtaagaaataggtcattaacagtagttaacgtttacttgtgatctatggtaatgactgatttctttgggattactgcagttataaaccataattacagattattacagcaataattattttgttaaggaaaaaatgttctatgtttgaacagctgctaaaa

SEQ ID NO: 154909 - DNA, 601 bp, Human
ggttggagggtgtttgttttactaacagcattagaaagtgtatatggctagtcgtaactagctttaattgtaataagcctctttggtagagaggaaagaacttaaaaattcttattgtgtgacttcattttcttgagcagcatctgacgtaaggcacagaaagaacatggatgttacatattggtatgtcttatgtttttttgtaggtatgatacagaaccacgttaaaaaggggatgacaatttaataatagttacactagccaacatttactgagcacttatagcacttactcatataytttacatgcaaaataccagttggtgcttgtcacaactctatgggccaggtattattatccttgtaagattaagtagcctagtgtaaataagtactagaggcaggatttgaacctaggctgtgttcttattagctaaattgtactgcttccctttttttaaaacaaatatttatcttccagtagagaaatataaaaaattacatgcacggtgaggtctttgtctgttttcaggtaggcatgttttatcaagggctaataggcaggtatttctatgtttacattattggtaagcccaaaaaa

SEQ ID NO: 154910 - DNA, 601 bp, Human
tatttttcatgctggaacaaagcttatctaacatgtgttttctatataagacacataacaagctttttttctttaggaacactgcatagcatttcagcattatgcttagatcatcttaaacagtgaaatcactaacaaaaaacacaaaaatgtggcagtagatagaccattaaaaacatacttgtttacattatgaagctgaaacaagaaggtagagtttcactttgtttgctctgagcttgaaacatgtgtactggacaactacagattttcactgctttgcacattagcaggtgactgwgagtattgattttgggattataaataaattttatcaagtaggcaaattcacaaataatggaatctgtgaataatgaggatcaactatatcatatcttatattgagtattattggagaagttgctttaatttaagcaatagaaatataattactattaccattcattattaataatgggtctacattttaatacatttattaaattggtaatgttaacctttcctttcctttttcatgccatgttttctatataatgatttcttaattcagtaacccatatctgttgataatgtataatat

SEQ ID NO: 154911 - DNA, 601 bp, Human
atctattaccagaacttaatggcttatcaggtaacaattgcattattatctctcagtgttctgggggttgataagtctcagatggttctcttcaggggtctttcagtcattgtaatcagatgacagctggggctggagttgcctgaatgcttctttactcacctgtctggtgtgtgtgctggaatgcttagagtgtatactctatctagttgggcatttctctctctgttcaatctctccagatggctagttcgggcctcctaatagtataatggtctcagggtatatggtcttcttaaayggtggcaggcttccccagagtgaacattctctgagagactggaggaatttgccagttcttgtaaaggttaggcacagtactaggatggcgtcactttcaccaaattctattggtcaaagcagttacaaatttccaaagattggaagaataaactccacctcttgatggcatatacatacatggaaggaattggtgatgagtatttgaagacagactaccatgctaagtattgaaaattgataggatatcttggtaaggtctgagaaggtgacatcaagtaagactggtcagcatagttgt

SEQ ID NO: 154912 - DNA, 601 bp, Human
aaatacctcctcacaccaactaggatggatataataaaaaagaaaactacaagtgttggcaaagatttggataaatttgatcttcatacattgctggtgggaatgtagaatggtgcagccgcttttgcaaacattatggcagttcctcaaaatgtgaaaagtagaggtgccatgtaactcagcaattccacttctaagtatactcaagagaaatgaaaacatacatccacataaaatcttgtacacaaatgttcatagcagcattatttataatagtcaaaagatggaaacaatccaagcwtccatcaactgaatgggtaaatgaaatgtgatatatccatagtaaccaaaacagcatggtattggtataaaaacagacacatagaccaatggaacagaatagaaaacccataagtcgtatgtttacagccaattggtttttgacaaaggtgtcaagaacatacattggggaaaggataccctctttaataaaatggtgctgggaaaattgtatatccagatgtggaagaataaaactggacttctacctcttaccgtatacaaaaatgaaatctagatggattagacttaagacctgaaa

SEQ ID NO: 154913 - DNA, 601 bp, Human
aagtagaaatgaggaacgtgaagatcacctactccatattcaaggcccaagatacacgagaagtggaagaaaaagcagctaccacttgatagagcctacagagaaagcagggtcatcagagtagagcttctatgatagacttttatattgaccctaaaacactgaaattcataaggtaactttctggatactttcagcttcctacatgaagtttttgatctgttacgtttttcatgaattgtatgtcatgaaacttgagtctgtttttcagtggattacttgatcaaattagtgttcttaytctcctacttaatctatttcacattcctaatgtataaggctgtataattggtcagttctggtttatttttgttttgtgagagaataaaggatgtgaatacttgccaggttagatttctaatttacaggaatcttgtcaccctaataggttgatatgtctcaccaaaaattataaaagagttgttgattaattgtagtataataatgactgctagtatccatgggagaacagaaagaatttgttctttttctaacttttatttgtcctttctgagtcttctaacaagcagatagcctcttt

SEQ ID NO: 154914 - DNA, 601 bp, Human
atctggtcctagacagtttagtgttttgtactcaaatttattttcagtcatgtcttcatggtagacattgttttttccattttacaaatgaaaaccctaagacttaaagagataagtaacttatgcaagatcacatagcaaattagtagagctgggattcaaattagttttatttggctctaaattctatgccattttcagtgttctactgccttgataaacttaaaaccgatctgctttctatccagaactgagttcacaataatttatcactcatttggaagaacagatcattgtgctrattttggaatttcccccaagataagctacgtttctatgaatacttactaaacttttttcttccttattctatattaggacgtcttgcatggctggtatacttagttgggacagttgtaggaggaagattaacatataccagtacagatgagcatgatgctatggatggagaattatcctgtcggtaagtaagagctatgtaatttactgaaattcactaaatagttaaaaaaaattagttattgaactagtattatgagtgaagacattttgtatgtggccttttgaggaaggtattatt

SEQ ID NO: 154915 - DNA, 601 bp, Human
tacaactggttgcttgcttttataggaatttttccctggaggccacacgaaaccacttgtgcctcagaacaactcatgactgggggagtaaggacaagcagtatatccattggcttctttctgtgtctcgtttcttactggttaatgtctactcctgggatatttcacttttccacacttcttagttatgtttcctggcctctttgaggagctgctgggaagacagagctttaattggtcctgttagagttatgaacaggaatggtggtttgtctctcttttctgggaagatacataactscagaaactgtgagagtcttttctggggctacaagacaagtggctgaagccaggggtgaggtgagaggtgatagtgtggttggtgggtgtgcaagcagggccaagcaaattcaaggtggggcatattctaggacttacacaacagtctggaaataaatatgtattttagaatattgagattctaaactaagaatgatgtcttacgtaaaattacaaaaaaaatcactttcatatgaagatgttccaaataattggaactacagtactgtgactttctatatgttatatataatagcattcc

SEQ ID NO: 154916 - DNA, 601 bp, Human
gggaatttagggttttctctaatttgttgagtgatagtaacagaaattgcacacttctgtggataggacccattgtcacttgttgtttttaacctcaactaggccctcagcattgctcagtgattctattttgtttcagtaattcttgtcttctgacttctaaacacctattgggctgttgcactgggatgttgtatcccacatgcacctctaattcagtgactaaaattaaactcatcttttccatcacctaaccctggctctcttcacatgtctcttcatcatacactcagtttcccaagcctgaatcgtgagagttatccttaacttttcccctttttctctctagcattcatatagtcatcaagtcctgtcagttctatcttttagttacctcagttagtccacctatcctatctcctctgccagtttagctactatcatctttcacctggattagtagtaagtttttaaacggacttcttgcttccttttgcagccagagtaatctttctaaagtacagatctgattatgtcaatgcttggcttgaactatgcaatgacgtcattgtttttaagatgaacaacatggcttatcagg

SEQ ID NO: 154917 - DNA, 601 bp, Human
agtaagtttttaaacggacttcttgcttccttttgcagccagagtaatctttctaaagtacagatctgattatgtcaatgcttggcttgaactatgcaatgacgtcattgtttttaagatgaacaacatggcttatcaggctgttcattatctggctcctgcctgtcccattagcctcattttctgccattcactacattatagccatgttgaacattatacagctgagtagctgggatacaggctcctgccaccacacctggctaatttttttatttttagtagagacagggtttcaccrtgttggccaggatgatctcaaactcctgacctcaagggatctgcctgccttgggctcccaaagtgctgggattacaggcgtgagccactgcacccggccccctgcccctttagatggttacacatgctttcctttttgtcgcaacactctatggctttgccttgttccgtcctagaatattaggaaatagcatttgttataggacttgtcattctttattccagctgctgcttttatcttcctcttgatagattatagatttctagaggactggggatatataggtcttgtactttgttg

SEQ ID NO: 154918 - DNA, 601 bp, Human
atgaacaacatggcttatcaggctgttcattatctggctcctgcctgtcccattagcctcattttctgccattcactacattatagccatgttgaacattatacagctgagtagctgggatacaggctcctgccaccacacctggctaatttttttatttttagtagagacagggtttcaccatgttggccaggatgatctcaaactcctgacctcaagggatctgcctgccttgggctcccaaagtgctgggattacaggcgtgagccactgcacccggccccctgcccctttagatggytacacatgctttcctttttgtcgcaacactctatggctttgccttgttccgtcctagaatattaggaaatagcatttgttataggacttgtcattctttattccagctgctgcttttatcttcctcttgatagattatagatttctagaggactggggatatataggtcttgtactttgttgtattttgaatgcctgacacatatctgacgtatagtgggccctcaaatttgttgactgaataaatgcttatttagttggatacctaggaaaattcagcacagttatccaaaattcattt

SEQ ID NO: 154919 - DNA, 601 bp, Human
ttctgtgctttttaccagaaataatttaagataaacgaataatacatgtaggacaataaattgaaactgggaatggatattatatacacattgaacatccctaatccaaaaatctgaaatttgaaatgcttcaaaatctgaaacagtttgagcatcaacatgaatctcaaaggtcatgcttaaaggaaatgctcattgaagcatttcagattatggatttttggattcgagatgctcagatggtaagtataatgcagatattccaaatttcaaaaaaattaaaaatctgaaacacttctgrtctgaagcatttcacaaaaggaatacttaacctgtatatattggtatgtataggcattagtcttatacacttgttagaggtggcagcacatcttcagagggcactgtggtagagactgtcaattgtctttcatctcttcttcctttcccttcccataataaagtgcttgattgttttcttgagcaaatggccactctgaataaagaccagattttctaggttgttttgcagctaggtatggcaaagtgattatgttcttagtgtaaatgaacgtgttatgtgtaatatatgtagatgtaa

SEQ ID NO: 154920 - DNA, 601 bp, Human
agggatccaacttacaagggacgtgaaggacctcttcaaggagaactacaaaccactgctcaatgaaataaaagaggatacaaagaaatggaagaacattccatgctcatataatggaatgttaagcagcttcagaagagaatgaggaacctccttatgtctgatgtgtaaagagctctaagattcattgttcaatggaaaaagctaagcttagaaccatgtggataatatgttctatgtgttcagaagggttgggaggagaatctgtagtcatatttgcctgtacatacataaaacattytctggaagacatataaactattaataatgtgtgtatatatgttcatgtgtgcatatatggaagaaactgggtgggtcaggcctagacagagcttcctttgtgcaaattagaaaaggatactgcttcctcaacaacctctacttctgtctcaaaaaattattatattatattcattttgttagcacaaggtacttggcggtcatccaccagaaaattttaatgaaaatagataatattgaaggattttttttgaggttctgcactaagtttttcattatattgaattaagctttttctata

SEQ ID NO: 154921 - DNA, 601 bp, Human
aggcacctggaaggaactatgtaaaatgagactggttgttttagggctatgggatttcggattttgtttcaaaacttttaatataaggtaattgtgaaaaaaagcgaattacagattagtttttcgtttttgaaaaagcttgcactttaggaaaaagtaaacacatcaccagaatggtattggctcctttattgtaactttaacattgttggtgtgtgtatcttaccctattaaaggaagttagtcctaaggtgacaaaatttctaaggcatttctattgcataaccccagagtgaaactraatcttcctactttttggtttctctgacttacctgccaatctgtcttaatagaaatcattttcagaagtccttaattatgtgtcccgtcactctcctaggtactcttcatgctagctttattccttacagtaggcttgcaaggttggtattaatgtcctcattttactaatgaaagaacagactctaagacatttcgtaagtactatatatacaatttttttagcaaccaactacgtaaggaagagtgagtggaacatatttcttggtgggtgtattgtccgattccaaattgtggcaaa

SEQ ID NO: 154922 - DNA, 601 bp, Human
gcttcttgccccactgtcctaaatttagtattattctcatccatgattttgtactttttctacatttctgtgtatatataaacaaaacacagcactgttaactttatataaaagtattatgcagtttggatctttaggatttttttttttttttttttttttgaggtggagtttcgctcttgctgtccaggctggagtgcaatggcgccatcttgactcactgcaacctccgcttcccaggttcaagtgattttcctgcctcagcctcccaagtagctgggattacaggcatgcaccaccrcgcctggctaatttttttgtatttttagtagagacgaggtttcaccatgttggccaggctggtttcgaactcctgacctcaggtgatccacccaccttagcctccctgagtgttgcaattacaggcgtgagccaccacatctgaccagaattcatctttttttattaccatttttgagatttattcataatgacacatatagttctaattattttaattattgagtggtattagagtgtatcactatgccattatacattgattttattattgatatgttagattgtttccagattttca

SEQ ID NO: 154923 - DNA, 601 bp, Human
tttgtcagggacacaaacattcagaccatagcatttcacatttgccccacaaagtgcatgtccttctcatatgcaaaacacgccattccattctagtttagtccccaaagtcttagtttatcctacaatcagctccaaagtctgaagcctagagtctcatgtaaatatcatctaaatgagatgtggttgagactccacagtgattcattctgagccaaattacccctctagctgtcagcctgttaaatcagataacatcatatgcttccaaaatacaatggtgggacagacacagggtagwccttgccattccacaagggagaaacaggaatgaaggaagaaatgacaggtcttgaacacgtccaaaacttaataaggcagcattaaatcttcaggctccagaataatcttctttgacttaatgtcctactttctgaacacactggggtagggattaggctcccaaggctctaggtggtagagttctcatatactggagttgggtgcttgctgctctcccaggatggaatcacatgccagtggctcttttagtctagagttccagagatgaatgactctgcccccatgactccactaggca

SEQ ID NO: 154924 - DNA, 601 bp, Human
caaatattctatatcattccttacaaattcttttttacaaaacagtaggacacaaacaattcttctaggttctttgccacttttataagggcaccttttataagggcactaatcccccttataattctctcccaaaggccctctctcttaaaaccatcacattggaaattagattttaacatacgaatttcccgcattttttctgcagctctgtttgttttttattctttttctctctgtcctttgaatagtactagggtcttaatatagatgtaaaagctaaaaaacaaaaaaacaaacagaaacaccaaaatggattccagcatcttataagtgctttctcttatgatcgagagtaagacaagcatggctactcccttctcttctattaaatattgtactaggggttctattgagataaataggcaaaaaacaaaacaaaacaaaacaaaaaggcatccagatttaaaaaaaaaaggaatctaggaataaagggattacatctctaattgcagatgacatgatcttatgtataggaaatcctaaggatccactgaaaaactgttagaactaataacatcagtaagtttgcaggattata

SEQ ID NO: 154925 - DNA, 601 bp, Human
ctctgtttgttttttattctttttctctctgtcctttgaatagtactagggtcttaatatagatgtaaaagctaaaaaacaaaaaaacaaacagaaacaccaaaatggattccagcatcttataagtgctttctcttatgatcgagagtaagacaagcatggctactcccttctcttctattaaatattgtactaggggttctattgagataaataggcaaaaaacaaaacaaaacaaaacaaaaaggcatccagatttaaaaaaaaaaggaatctaggaataaagggattacatctctamttgcagatgacatgatcttatgtataggaaatcctaaggatccactgaaaaactgttagaactaataacatcagtaagtttgcaggattataagattaatacaaaaactcgactgaatttctgtgcacttgcaataaacaacccaaaaacaaaaggaacaaaacattccattataatagaatcagaaagaattaaataggaataaatttaacaaaagtgtaaaacttataatctgaaaatcataaaacattgttgaaacaaattaaaggggatgtaataactggaaagatatcttatggt

SEQ ID NO: 154926 - DNA, 601 bp, Human
ttatttagaagaatgaatgaaaatagtaaaagaaatagccgaaagagttgaaaatgggttgacttgagtattggaatcagatatggagaggagtatgtcagaggatggcagttttttattactgttttactttttaaatcatgtatgtgtataattttagtagaaatacaaatttggacaattacaacatagttttatgcatgaaaaaataatggtaagcgtttggtgccctgaaaacacaggggacagtgtatttaacccagattttgggaatcagaaaggcttctgggagagaagattsctgaatgaaatccagaagaattagttgaagctgctgaagaggaaggaaaatgggatgcttgttctaggaggtagaagcagaatgtgcaaagccttaaagctctacattggaagaaatccagataggttagtatagctaaggcttgtggtattcccagtgagcattacagagcctaacattagattttcagcaaatactgaataaataaataaataactgatgtaagggaaggagttttttaagagtaggaagtctgggaaagcagacacatagcagtcacatgcagcctaccttgtgtct

SEQ ID NO: 154927 - DNA, 601 bp, Human
aaatgtctctgtttggatgataaattatatgatctccttgcatataaaccacaagtttctaaagaggataatatagtaattcataaataagtttgtaaaggccaggaagtgaacctttccttttgactctgtggctctcagtacctgagtaaaagccttgtttataagtgtcatgaactagtgatatataagcatgtttagatcttttttgtggaataacttgaaatttgcattaagccgataagtgctccagtagtgtaactatagtgaacaataatttattgtatattttaaaatcackaaacaagtagaattggaatgctcctaacacaaatggcaaatgcttgaggtaatggataccccaattaccctgatgtttattacacactgtatgcctttatcaaaacatcaaatgaaccccataaacatatatatatatatacctgtgatgtacccataataattgcaaatctagaaattttttaaaagataagttctcattgatgtattttcaaattgtccaaaataaaaatggggaattatctaaactttcaagctttatctgtgtatatggatttctaaattgttttgtgtaattact

SEQ ID NO: 154928 - DNA, 601 bp, Human
ttaagccgataagtgctccagtagtgtaactatagtgaacaataatttattgtatattttaaaatcacgaaacaagtagaattggaatgctcctaacacaaatggcaaatgcttgaggtaatggataccccaattaccctgatgtttattacacactgtatgcctttatcaaaacatcaaatgaaccccataaacatatatatatatatacctgtgatgtacccataataattgcaaatctagaaattttttaaaagataagttctcattgatgtattttcaaattgtccaaaataaaaayggggaattatctaaactttcaagctttatctgtgtatatggatttctaaattgttttgtgtaattacttattattcaacctttttcctactgttgagtacacatatgaagcagcagatggcattctttccctgcaattgttatgtcttcctgtatggtatgttactgtaataacagttactgttaaattgagtaggaaaacacttgaataaggaaatagaaaaacatttcatgatagtatcttcaatggactactacaactttaagtgcaatccaatgttaaaataatgtactagctgct

SEQ ID NO: 154929 - DNA, 601 bp, Human
tttttttggtgattctaggaataagaataataaatgaaataccatgtagtatgtgactaaatacccaaataccaagtagatgtactttgaagagttgtcagcactaaagaagactttcaatttgaaagaggttttagttactaaattttacgacttgaaaacccagtccctccatcagtctgtaattttttttaatagtcattggatcttgtggaaatcatcaacaaggcaatcttcgtccacaaatcagaaggctagggccacaaatatgcatattttccctgataaaagattttcatamttaaaattttatgtctacagttcattatatatgtattatacatacatgatctttgcacttatgtgatagttcttgcttctggaataaggatggatgttgttgaacattcagagactctgccagatacctcttactgtttattatttttgtaccaaattaaatatgccattatttgactggaaaaaaattagccaggcatggtggcaatgcacctatagtcctagctactggcaaccagtttgtaagatgaagatgggaagccttccttaccggagtcttgggtagaatttgctatcttaa

SEQ ID NO: 154930 - DNA, 601 bp, Human
tagtcctagctactggcaaccagtttgtaagatgaagatgggaagccttccttaccggagtcttgggtagaatttgctatcttaaaaatattcaagttgcttaaagtaagatcatgtgtgaatacacgtcagtaactttggtatttcagtaataaagtcataggcaaaccctctactaagtttttactagaaatatgttcacctgtaatggtggtgctaaaattattatttgtcaaaaatagttgtcagtgagaatctcatactacatacttggaagtattttctaatgcttataattgayttaagtatcttgcttgaagggaatcaggatgagatataatctatcctacttgtgctgcagaaacgctgaagctattcagtctgtgtaaataatccatcccacatctttgcttcctcttcagtgaatgcttaacatccatatattatgatggcttgagtatcatttggaaacataagtcataatagctacaagtttgtaatcgaaatattgcgaaaagaattttaggtttcaagatagtgatcctttaatgtcaaatgtttcctgcaaaactgaatgaggaatattgtggattatttaatt

SEQ ID NO: 154931 - DNA, 601 bp, Human
ccagttaagaaagggttcatctgttcagaataaagatgcgggaagcagcttggccttttcatcagatagatctccagccagctctgggcttcaactagctctcactacccctgggaaatctcattactttttctgcgtatcagtttcctaacctgtcaacagaagtgataccttttacagaaatttgggatgattaagtaaaatatggcaaataccaagcacagaatttagtacagtacagatgttcaaaaaaacatagctgctgttattggtaagaataagaagaactatttttaaaatkttaccactatttaaatttaatgggaaaattctctttgaaagaattatgtgtaatctttagaacatctaatgtaattctaaatttgtgttggaaaccaaccaatttatcacagattgatttttggagaagaatttggaaacagttggtctttggggcatgtatttatggtgattatacatgttgtttcctaataccaggcagaacttggaattaaaaccagacagtttgattctaaagtcaagactctagaaaaagacaaaagtgtgacttctggcctgatgaaatctgtaatgagttcaa

SEQ ID NO: 154932 - DNA, 601 bp, Human
gtgttagttaaagctgtttttttccctaaaaagcaaggcaatgaatgaaaagataaggataatagtagacaataatgtcaatgaaataaaatgaggaatggaaaattttttaatggaaatttgacttggagtgattgtcataatacctgtaatggagttcagaggaagcaaaaatagtcttcatgagattggttgtcttgatcatttgaaattgggatttgttttatccgtactgtgtaaaatagcttttcagccactatactaggtgaatatgaagaaagttttctgttctggagcattytgatttcatagttatgccaaaaagtttttgcagataaaaagtcatgaagacagcattcagacctaggatggttgtactcaaaagcacttgccgtaggtgtacataatgtttagcattttactttctgggtaagatgtactgcttcagtttggaaataaaaaatgtatcttaggttacattgtcatcattactacttttccttttagaaaagaataatttatctttctcaactatatgaaagggatgaacatttctctgtgttcctactcattttgcattagtttctataaaattgaagtg

SEQ ID NO: 154933 - DNA, 601 bp, Human
gttaaaaaaatttgaggctcactgaaaatgtgtgacttgcccactgtctcatattgctagtattggagagaaaactagaatctaggcctttattttcctgatgtaatgattttagctaattattatttattttcttaaatcattgcattaattcatttttcacaagtagagcctatatcagtgtttgcaataattaaattttaagtatatttctataattgtaaataaaatcctgacatttgttacaggatggggttttctttcatcatatttttataataaaaattaagcagttataaacataaatagcctagtttttcaattggtataagctggctttattttatactgctaataaaggcacattatgttcaagcattgcaattatcgctgaaatgcatgtccattaactgaaacattaggctgagtatataattactgtctagagccaatatctttgtgaagctgtacctataatgctattaaactataaacaatatttgtaaactaatatttaaataattcagaattgatataatctttttgtaaacttaaaaatgaatgctatatacatttagtttgattgtttttacgtgcttag

SEQ ID NO: 154934 - DNA, 601 bp, Human
tcagacaccagtggaatatgggtgaataatcaggcaggcatccctgcaatgattaaacaccaagggaagactgtcttcctgaatctgtgaccggtgccggagttttgggtacacagataaaatgtgtctcctttgtctgtactagagagggaaaagatctggaattggaaggacagggagattgaagggtagcgagagaggctggagaagagagtgaaaagaccgcttactcgaaattggtgagatgttccttgggctggttggtctgaggacccgaggtcataggtggatctcttcacgcagtgagggtgaggacaggggactggtctcccaaaggagtccctctgacccgggtctttggcaccaaatgtcacggacgtccgtgtgaagagatcaccaaacaggctttgtgtgagcaacaagactgtttatttcacctgggtgcaggcaggctgagtctgaaaagagagtcagcaaagcatggtgggattatcattagttcttacaggttttgggataggcagtggagttaggagcaatgttttgcgggtagggggtgaatctcacaaagtacattctcaagggtggggagaattacaaa

SEQ ID NO: 154935 - DNA, 601 bp, Human
gctgcaccttgtagtggaaatcattttggctttgaaatctgaacttgatttcagtgccaatctttatcacttagtaggtttgtgacagttaagcaatttacctaacttttctgcatgtcagtttccctaaataaaacactgctggactgtttgagggttagagataataaatataaagagtgtcaaacaagattggtgttctctaaatcatagctattaacattgctttacttgtaactttgggtaagttgcttataatctaaatcttagatttacttcatgtaaaatgaaaggattgaaytggattggtataaatgggtcttaggacccttgaggtaatatacagatatttttattttgtacacttttgtgaggtttgtagtgttcatcagattcataaagtgatttgtaaatcccctgaataaaagggtaaattctaaactaggtgatctccaagttcttttcttatgataaaattttctacctataggctacatagtcaacttcagtgtgactgaggttagggaaattatttttgaaaaattttttgaatcaggacctccagaatgtaaatgtttgttgctgttaaaagtaattatta

SEQ ID NO: 154936 - DNA, 601 bp, Human
tttttttaatatgtgtttaaaaggaattgaattttaacccatttttcatgataattatggaaaattattttttccaatgacatattttggaaactttcaaacccacagaaaacttaataatttaacaaatgccttcatactgtgcattttgccacatttgttttacctctctctttctacatctatatatacatttatgcatacatatgatatataacctttttttggtaaaccatttgaaaataagttacataacatcatgagagttaacccctagtattttttatatacctcctgagarcaagaatattctcatacacaaacgcaatactatgattacactcaaatgttgtaatgatataggaatattatttaatacatagttcctagttgtttctcgtttgtcccagtaatgtcctatataactttaaaaaaaatatctgaaccggacatgcattggatttaatgtctctttaatctaacatcgttttgctaccttttatgttttttcatgattttaacatttttgaaaagtccaagccactgttttgtagaaagtcgtactatttgagctattctggttattgcctcagtaatatat

SEQ ID NO: 154937 - DNA, 601 bp, Human
aattgaattttaacccatttttcatgataattatggaaaattattttttccaatgacatattttggaaactttcaaacccacagaaaacttaataatttaacaaatgccttcatactgtgcattttgccacatttgttttacctctctctttctacatctatatatacatttatgcatacatatgatatataacctttttttggtaaaccatttgaaaataagttacataacatcatgagagttaacccctagtattttttatatacctcctgagaacaagaatattctcatacacaaacrcaatactatgattacactcaaatgttgtaatgatataggaatattatttaatacatagttcctagttgtttctcgtttgtcccagtaatgtcctatataactttaaaaaaaatatctgaaccggacatgcattggatttaatgtctctttaatctaacatcgttttgctaccttttatgttttttcatgattttaacatttttgaaaagtccaagccactgttttgtagaaagtcgtactatttgagctattctggttattgcctcagtaatatatttgtttaaacaaataatatatttg

SEQ ID NO: 154938 - DNA, 601 bp, Human
gtcaattgaaacattttcagtggtcatacccaaagagaaagtaataacagtattatttcttgtttaagtcattatttgctgttcctttttcagttacctcataattttcatgacagttttaataggtagaaataattactttctaacttggactttttctacgagttgaatattttcttttagttgagaagtttaaagtatacttttaaaaacaaatgtatatggttgcttgcagatacgatcaaatcacagaatagttacattttaattccttctatcatacattttaatttctcctgtygtgttaagatagtctgtatagcttcattgttcatctgtcagcttttcagttaacccaaatgaggaaacagtcactttttgaaagatatttagaagctttgaatgtctagtttgactttagagttaaatctcagaagacatattgcattgagtgtatgtgtacgttcagcttagaactgccttacactgctgcaataatactgatgcacatttagttgatactgcttacagttccttatgaacttgttcagagcagttcccagaactcaaggataatctcaacattcatcacccaccatat

SEQ ID NO: 154939 - DNA, 601 bp, Human
gttactctatattggcacaagttttaaatttttttggaaaatttttcaaaatttctataagtgacaaagctattcttagcttacataccataaagacataagtgagaggcttagttttgcctgtaatctgtagtttgctgacttctctttagaccatttttctttaatatgattatcaatatggctaccaccttgccatttgttttctatttatcccatctggtttttgttcttttttcctttatatatatttttgttgttgttatactttaagttctagggtacatgtgcacaacgtgcmggttttttacatatgtatacgtgtgccatgttggtgtgctgcacccattaactcgtcatttacattaggtattgttttttgttctttttgagtattttttactattccattttatcttcactattgacttattagttgtacttctgttttatttgttatttgtttccctgtgatttataatatgcatttttttatgtcttctttaaaaaaaaaagcgggatacacgtgcagaacgtgcagttttgttacataggtatacatgtgccatggtggtttgctgcacctattgacccgtcctct

SEQ ID NO: 154940 - DNA, 601 bp, Human
ggccatcttggccctgcccccaatatgcatctttatctacttcctcaatggtattacagtacttcacttctaatgtaagacttttataacttttatacttctgtcctttgtactattgttcttatagattttacatctacatcaaacctgtcaaaacattattattttttaattgcctattaagaaattgaacagtgagaggaaaatttttgtcacatgtgtgctatttacacttcttttctttgtatagatctaaattttgatgtgatatcctttttattttctatttgaaaaactcttyaacatatagtacagatttgatgaaaatggattctctcatctactttttttctaggtgaaaaatttattttctccttaattttgaaagacattttcactgggtataaaattccagtttggcattttgtttttctttcagctatttaaaagtgtattccactgtcatctggctttcatagtttctgacaagaagtctgtgacaattccagaactctaccctgaaagaacaagttaccttagactctgaactcttatctctgtcttctcaactcagtgaaatttctgtactttacttaggatc

SEQ ID NO: 154941 - DNA, 601 bp, Human
gcaaatcaaaaaggtaatttaagataatagagaatctgtgaagacagtactgcagggtggtatgatagagtaatgggggaaagagtatactttaaataggaaaaacatgaaattgctgaggtggtaatatttgactttagccttgtaataaaaaacaggaattgacagactgtggtctgagggccagtgtctgttttgtaaataaggttttatgggaatacagccacagtcattcttttacatattgtctatagctgctttgtaacaataatgggaaagttgagtagttggaccataagcytaaaatatttactatctggtcttttcagaaaaaaattgccaatccttaacataaaagaagcacaccacttgctgattgagctgagatcaccactgactacattacttataaacctggtatatactttctatccttattcaacataatcaaccacttactccttctagaaatcgtttcttctttttcttagcttgtctgataccatgttcttttgttttattttctaatctctgtagcaacttcttcctcagcttctttagtctaataattttcctgaatctgatctttagtgttacagta

SEQ ID NO: 154942 - DNA, 601 bp, Human
atcaggcattgctttgaaaaagtgcagtttatttcactctgttattactgcgtggttccagattgttaaagattcagctactttaaagcagtgtcttaaagaattaatttttgtcctttcagcattggcagattcatttttgtcatggaacatcttatctccttatgatgcttttgaagtattaatataggtggaattacctatgatagtttggtggaactaaactctttgtcactttttctatttgtgagatttgcatatagtattgtagcttttttctgaaattttttgttttgcaacrtgccttcataagaaactcatcgatttgtatatttaaaaagaggctgtaaagcatttgaactagccccagtaggatcatattataattaataataataataatattaatgtcaccagggcttgcataacaattcataataattgtctttacacttaagtttaactgctaaactttgtagcctaatatagtgatttttatcacaatgataaacttttttatttacctcttgaactgtatgtaagaacagagaccagtagacctagtttttcctggttattttgtagaacgggaattgggaac

SEQ ID NO: 154943 - DNA, 601 bp, Human
ttcagcatactatacattttgtttacagtgtggataggccagtggtcttcacgctcttcagttgaaataaatgtattaatgcagcaatattctaagcaatgaatacaggtttaaaatatggaactgtctagggcctgattgtaaaagacttttgatgtttcaaagatgaaaatagaaaaaatatactgcgtccatattaaagaagaaaatcctacgacagtagaacttactgtagttataacctgggaccatgctgtcctctttggaagaatatgttgcctatgttgccttttctaacttyagaggttattgttgctttggctaaaaatttatatgtaaagtgttttataatcatgaacatatgctaatttctgggttttgttttatattattatttttatttatttatttagtgttattttttagagacagatctcactgttgcccaggctggagggtagtggcactataattagaacttattaaattgtgcatatgttcattcactctctgttgagtcttgtttatgagttataacattgagagcataatatgaacagtgtaaagcccagggtactgactttggagataagattgcatg

SEQ ID NO: 154944 - DNA, 601 bp, Human
tttttcctgcccagcatcttttgggggaaaaagagagaagatgaataaattaaaggtttttttctttctttgtttttttgagacaaggtctcactctgtttcccaggctggagtgcagtgttgccatcatggctcacggctcctggcagcttcaacctccaggctcaagtgaccctcctgcctcagcctcctgagaactgggaccataggcatgagccaccacaggtttggtttttttttcttaataggttggacatatggctataaataaaaaataagaaaattaaaaaagagtaagtgmtaagaagaaaaataaaatgaaattataagtataagaaatgctagatggggttgttatatatatgattttttgtagaaggcctttctgataagatggcatttaaggaaaaatctaaataaagtgcaggacaagccaagatatttatctatggtaaaaaaatatcccaggaacagtgaatgtaagtgttctgagagagaagcatatttgatatgtatgcagaacagcaagactgctatggctcagcagataaagggggaaacataagaaattaaacatgataccttagtaattttttaaatg

SEQ ID NO: 154945 - DNA, 601 bp, Human
ggatatgaccttgttttttaagtatttaaatatgcttgaacatgttaacccgatcatgtatcttttgtggaggtctagagtttttttttgttttgttttttagggtttttttttttaatgatacaggctttattatcttccccattttgcagatgagaacactgaggcatttacccagtggcttataagctgataggtgctaaagccaggaatcaaattcagaaagtgtagcccagattctgaacttttagccattgtttgcactgtttgtttctttttttgtttttttttttttttttttaagtaatttcaacttttattttagattcaggatatgtgtgcaggtttgttccatgggtatactgtataatgctgaggtttgggatacactacaacccgttaccaaggtagagagcatagtacccagtaggttttcttttctttctttctttctttgagacagagtcttgccctcttgccaaggctgaagtgcagtgttgtgatctcagcttactaaatctccacctcccagtcttaagcagttcttgtgcctcagcctcccaagtagctgggactgtaggtgtgttcttccatgcccagc

SEQ ID NO: 154946 - DNA, 601 bp, Human
atttgtcataaagtttggatattagacttctgttgtatgtataggtttttctctcattctgtagattgtctatttattctgttgatagtttcttttgctgtgcagaagctctatagtttcattaggttccatttgtcagttgttgtttctgttacaattgcttatgaggacataaacataaattctttcccatgactgatgtccagaatgatgtttcctaggttttcttctaggattcttatagtttgaggtcttatattaaaatctgttaatcggtcgagttaatttttgtatatggtayatacagctacatatagctagccaactatcccagaaccacttattcaataggaagtcctttcccgattgcttagttttgttgaccttgttgaagatcagatgtctgtaggtgtgtagctttacttctggctcctctattctgttccattggtctatgcatctgtttttgtaccattaacatgctgttttggttactgtagccttatagtgtagtttgaagttgggtaatgtgatgaatgcctccagatttgttctttttgttcaggattgctttggctattcaggctctttctgttctgta

SEQ ID NO: 154947 - DNA, 601 bp, Human
tatgaattttagaatagtttttttttacttctgtgaaaaaatggcatggtagtttgataggaatagtgttgaatctatagattgctttggacagtgtggccattttaacaatattgattcctccaatccatgagcatgcaatgtttctccatttgtttgtgtcatctgatttctttcaacagtgttttggaattctccttgtagaaatctttacctttttgtttagatgtattcttaggtattgtgtgtgtgtgtgtgtgtgtgtgtgtgtgtgtgtgcacgtgcgcagcaattataaatrtgattttattcttgatttgtctctcagcttcaatattattggtatatagaaatgctagtaactttttgtacattaatttttgtatcctgaaactttactgaagttgtttatcagttctaggagcctttgacagacttaagggtttttttcaggtatacaatcatattgttggccaagagagatagtttgacttcttttcctatttgcatgccttttatttcattctcttgcctgaatgctgtggcgagggcttccagtactatgttgaatagggtggtgaaagtgggcatccttgtcttg

SEQ ID NO: 154948 - DNA, 601 bp, Human
acatgaagccctccatagggctgcttgattgtccccatgatatggcagctaatttccccaaagtgagtgatgcaagagagagggtgggaaagctactgtaaaaattgggggtcatgttattaattatttgttatttatttattattactattaagcagtaattgatagcactcattttcttcatttatattgtgattcctcattgtttttgatcatctcagggcacaaaataacaatctcccaaaacaaagaaaccaagctaccaccaccaacttgtgataaatacaaaatatacataatwtatgtattttgaaggaagtcctgtaatatcctagttgaaattatttcttgaagtacagtcacacatcacttaacaacaagagtatgttctaagaaatgtccttttaggcaattttgttgttgtggaaacgtcaggaactgttcttacacaaacctggatggtatagcctactacacacctaggctgcgtggtatagcctattgctcctaggctacaaacctgtacagcatgttactatactgaatactgtaaacaattgtaacacaatggtaagtacttatgtatctaatcatagaaaag

SEQ ID NO: 154949 - DNA, 601 bp, Human
aagctactgtaaaaattgggggtcatgttattaattatttgttatttatttattattactattaagcagtaattgatagcactcattttcttcatttatattgtgattcctcattgtttttgatcatctcagggcacaaaataacaatctcccaaaacaaagaaaccaagctaccaccaccaacttgtgataaatacaaaatatacataatatatgtattttgaaggaagtcctgtaatatcctagttgaaattatttcttgaagtacagtcacacatcacttaacaacaagagtatgttmtaagaaatgtccttttaggcaattttgttgttgtggaaacgtcaggaactgttcttacacaaacctggatggtatagcctactacacacctaggctgcgtggtatagcctattgctcctaggctacaaacctgtacagcatgttactatactgaatactgtaaacaattgtaacacaatggtaagtacttatgtatctaatcatagaaaaggcacagtaaaaaatacacttttttttaaatttaatattattttaagttctgggatacatgtgcaagatgtacaggtttgttacagaggt

SEQ ID NO: 154950 - DNA, 601 bp, Human
caagtcttacccattttttaagttagctcatttgttttcttgctattgagttttgagaatactttatatatagattttgactacaagttctttgttggatatgtgatttgcacatttttttcctctaagtatgtagcttgtttttttcattctgaagtatccattaaatagcaaaagtttttattttggcagagtctaattattacatttttatggatcacgcttttgatatcatatctgagaaatctttgactaattctggttcacaaatattttctcctaaaagtgatagaattttatrcaagtcttttgggctatcttttttccttttgctttaactgacttgcatctttacatttaatgtgagtttctgatagatttttttgttttttaattgagatagagtctcatcctggagtgcgatgacacaatcatggttcactgcagccttgatctcttgggttcaagtgatcttctcacctcagcttcccacgtagctgggaccacaggtgcactacacacccaactaacttttttattttttgtagagacatcttctttctctgttgccctggctggtctcaaactcctggactcaagt

SEQ ID NO: 154951 - DNA, 601 bp, Human
tctcttgtattcagggtggagaggcgcacatttagaaagcatccatatgctgagggccattcataactcttgagatccgacagaaggtggtatctggaagactaataagtgttcaacttaagaaaacattgagtgagtttatcctgcatatctacacaaagagtacaatatcagtgtattccacaacagtaaagaaaaataagcaaaattatcccaagtaaagagagctttccatgaactgggccactgtcggaaccaaactgatatggggttgctagctgattcctgtttgtccagaatwagaatactgatccagatttttacattactcatccctcttgtttcttgtgagcagcagctagaaatcactggttggtttacaggaatagacagggttagtctgaattgcaggaaaaaaacatcagaaacaactgatgaaactagcatgtactaacaggtgtaccatatttcttgaaacataatttttctctctccagtctcccatttttattaaagacaaatcatggtacgaatgatttgttctcaaaataagatgtattcttatacttggcctgattatttgtataaagttcagcaagaa

SEQ ID NO: 154952 - DNA, 601 bp, Human
atgttcaatttatggaaaaactgagtaccactttaactttagccaatatgttcacacacagaatttcttttacaagattattttttcacaaatcctccacaacttgattgttttctggtttgtggttcctgtgttcctttttatagtgacaaaccattttatatattttaaatgttttcattttgtacaataaagttagcatattttatacatatttatataattatgtttatatatgtgtttattgcattttgcttttttcacttaattatatctcctggaaatcattccatttcaatasatagagttcctcttcattctgtcttatagcttcatagtactccattttgtgtggatatcatagggtattttaccccccagtctccattgctttacaatcacaaatgatactgtacgaataactttgtgattatgtatttattagtctgttctcaactgtgaagaaatacccaagacttgataatttataaaggacagaggcttaattgatttacagttttctgttgctggggaggcctcaggaaacttacagtcatagcagaaaggaaaagagaaggcaccttcttcatagggtagcatg

SEQ ID NO: 154953 - DNA, 601 bp, Human
tttatacatatttatataattatgtttatatatgtgtttattgcattttgcttttttcacttaattatatctcctggaaatcattccatttcaatagatagagttcctcttcattctgtcttatagcttcatagtactccattttgtgtggatatcatagggtattttaccccccagtctccattgctttacaatcacaaatgatactgtacgaataactttgtgattatgtatttattagtctgttctcaactgtgaagaaatacccaagacttgataatttataaaggacagaggcttmattgatttacagttttctgttgctggggaggcctcaggaaacttacagtcatagcagaaaggaaaagagaaggcaccttcttcatagggtagcatgatggagggagtgcaagcaggggtaatgccagatgcttacaaaaccatcagatcttctgagaactcactatcacaagaacagcatgggggaaactgcccccatgatccaattacctacacctggtctcggccttgacacatggagattatggggattacaattggaggtgagatttgggtggggacacagagccaaaccatatca

SEQ ID NO: 154954 - DNA, 601 bp, Human
gatttacagttttctgttgctggggaggcctcaggaaacttacagtcatagcagaaaggaaaagagaaggcaccttcttcatagggtagcatgatggagggagtgcaagcaggggtaatgccagatgcttacaaaaccatcagatcttctgagaactcactatcacaagaacagcatgggggaaactgcccccatgatccaattacctacacctggtctcggccttgacacatggagattatggggattacaattggaggtgagatttgggtggggacacagagccaaaccatatcatatrttttcatattgttggagaaacatattttagataaattcatacagggatttctagcttgagatttggttatatgtagctggttagatattgacaaattctccttcatagggattatgacattttctgtatccatcaaaaatatatggcattacctatttctctcttacctcactaataaaatgtatttttttattttattattattatactttaagttttagggtacatgtgcacaatttgcaggttagttacatatgtatacatatgccatgctggtgtgctgcacccattaactcatca

SEQ ID NO: 154955 - DNA, 601 bp, Human
ctcagacagggacatttaagtctgcagaggttactgctgtctttttgtttgtctgtgccctgcccccagaggtggagcctacagaggcaggcaggcttccttgagctgtggtgggctccacccagttcgagcttcccggctgctttgtttacctagcgagcctgggcaatggcgggcgcccctcccccagcctcgctgctgccttgcagtttgatctcagactgctgtgctagcagtcagcgagactccgtgggcgtaggaccctccaagccaggttcgggatataatctcctggtgcacygtttgttaagcccatcggaaaagcgcagtattagtgtgggagtgacccgattttccaggtgctgtttgtcacccctttctttgactaggaaagggaactccctgaccccttgcacttctggagtgaggcaatgcctcgccctgcttcggctcacacacggtgcgctgcacccactgtcctgcgcccactgtctggcactccttagtgagatgaacccagtacctcagatggaaatgcagaaatcacccgtcttctgcgtcactcacgctgggagctgtagatgggagctgttcctattcg

SEQ ID NO: 154956 - DNA, 601 bp, Human
atatgtttttacataattaacaagcatttttatatctcctttgagttgtttattcaaatctttgcccatttgtttgtttttttgtttgttttcagacagggtttcactctgttgcccaggctgtagtacagtggcatgatcttggctcactgcaaccttctccttccaggctcaagtgatcctcccactttagccttccaaggagctgggactacagacacatgccactgtgcccaggcacatgccaccatgcccagctaatttttgtatttttttttcatagacatggggtttctccatrttgcctaggctggtgtcgaactcttgagctcacatgatctgcctgcttctgcctcccaaagtactgggattacagacatgagtgaccatgcccagcctccctgcccatttttctataggatttctataggttgattttcctcaatttaaaaaaaaaaaatccttgatttattaagaatgtaactatttatctgcgatatatgctgtgaatgtttttcccaattttgtcagttacctttgattttgttaatgagttttctttggctatgcacattttccaacgtatcatcttattttgttt

SEQ ID NO: 154957 - DNA, 601 bp, Human
tttttacataattaacaagcatttttatatctcctttgagttgtttattcaaatctttgcccatttgtttgtttttttgtttgttttcagacagggtttcactctgttgcccaggctgtagtacagtggcatgatcttggctcactgcaaccttctccttccaggctcaagtgatcctcccactttagccttccaaggagctgggactacagacacatgccactgtgcccaggcacatgccaccatgcccagctaatttttgtatttttttttcatagacatggggtttctccatattgcstaggctggtgtcgaactcttgagctcacatgatctgcctgcttctgcctcccaaagtactgggattacagacatgagtgaccatgcccagcctccctgcccatttttctataggatttctataggttgattttcctcaatttaaaaaaaaaaaatccttgatttattaagaatgtaactatttatctgcgatatatgctgtgaatgtttttcccaattttgtcagttacctttgattttgttaatgagttttctttggctatgcacattttccaacgtatcatcttattttgtttttaat

SEQ ID NO: 154958 - DNA, 601 bp, Human
aagtgattgtcctgcctcagccacccaagtagctgggattacaggcatacaccaccacgcccggctaatttttgtttgtatttttagtagagacaggatttcaccatgtcggccaaggtcaaactcttgacctcaagtgatctactcgcctcggcctcccaaactcctgggattataggcagtgagccaccacacccagctggtgctgatacttctcaaaggctgcagttactcgtttatttagtaactttccaaactatttttgcgaaaactatccttgtcatgtttttgcgatattttrcaaaaactatccttgtcatgtgtggtcactgaggtctctatttcatattctctacagccagctggtgacctgacagcagtttacctgaatgcctggaaccaataagtaaaggagaaaaaaaataggtgttctgtttctttaaattatttcaacagaggcctccaggaaatctacttctacttgaggggattgaaacattgctggccagtcattgaaccactaggcagattcaaatatacaactctgatttttgttagacagggtccttattttctgccctagcagcaggaagctgcacca

SEQ ID NO: 154959 - DNA, 601 bp, Human
tcattgaaccactaggcagattcaaatatacaactctgatttttgttagacagggtccttattttctgccctagcagcaggaagctgcaccaggaacttgggcctttctcccctcactgccttctgcaggtctggaagtgatagttgctgtgcaaaatgctgaaatttaccagcttctttattcatcaagcagtcacctggatgccacaagtcttcagctagagtctagagttctgaaatcattgattctgagagttcttgctagctcaatggtttcagtggaggaattgattactagagyttcttaccctgccattgttgtgtcatcatttagccattatttctgaaaatattatttctgcatcataaattaaaaccatacttagtatccacattctgtttttcattttcagtacagtgttcaataaattaatgaggtattcaacactgtgttataaaatagagtttgtgttaggtgcttttgcccaactttagactaatttaagtgttctgatcacatttaaggtaggctaggctaagctatgacgtttagtagtagatattttcaactcatgatgggtttgtcaggatgtaaccccat

SEQ ID NO: 154960 - DNA, 601 bp, Human
gggtccttattttctgccctagcagcaggaagctgcaccaggaacttgggcctttctcccctcactgccttctgcaggtctggaagtgatagttgctgtgcaaaatgctgaaatttaccagcttctttattcatcaagcagtcacctggatgccacaagtcttcagctagagtctagagttctgaaatcattgattctgagagttcttgctagctcaatggtttcagtggaggaattgattactagagcttcttaccctgccattgttgtgtcatcatttagccattatttctgaaaataytatttctgcatcataaattaaaaccatacttagtatccacattctgtttttcattttcagtacagtgttcaataaattaatgaggtattcaacactgtgttataaaatagagtttgtgttaggtgcttttgcccaactttagactaatttaagtgttctgatcacatttaaggtaggctaggctaagctatgacgtttagtagtagatattttcaactcatgatgggtttgtcaggatgtaaccccatcataagtcaaagagcatctgtaaagacaaagtactttagaaaaaaatacagt

SEQ ID NO: 154961 - DNA, 601 bp, Human
ggcaagtgaactagaagagcccccaaaatttgaaatggaaaaagaggaacaaagttgagaattcacactacccaattttaatataaggctacataagtcaagccagtggggtcctggccaaaggataaacatataattcagtgagacagaatagagagctcagaaatagacccacacaaatattatcaactgactgttggcagaagctaaaaagaaattccacaggaaaagggtagttttttcaataaatggtactggaacaatgaacagctttatgcaaaaaaaaaaaaaaaaaaaaaargaccctcaatacgtcaacatgtaccacacaacttgtacaaaaattaactcagaatgcatcatagaactaaaatgtataacataaaactataaaacttctagaagaaaacatttaagaaaatctccataattttgacttaggtgatgagtacttaaaattgacaccaaaaacacaactcattaaaacttttttgagaaattggactttattatcaaaagtttaaacttttaaactttcactctaagaaaggcactgttaacaagaatgaaaagtcaggtgctgaatgggagaaaacatttg

SEQ ID NO: 154962 - DNA, 601 bp, Human
agttgagaattcacactacccaattttaatataaggctacataagtcaagccagtggggtcctggccaaaggataaacatataattcagtgagacagaatagagagctcagaaatagacccacacaaatattatcaactgactgttggcagaagctaaaaagaaattccacaggaaaagggtagttttttcaataaatggtactggaacaatgaacagctttatgcaaaaaaaaaaaaaaaaaaaaaaagaccctcaatacgtcaacatgtaccacacaacttgtacaaaaattaactcagaatgcatcatagaactaaaatgtataacataaaactataaaacttctagaagaaaacatttaagaaaatctccataattttgacttaggtgatgagtacttaaaattgacaccaaaaacacaactcattaaaacttttttgagaaattggactttattatcaaaagtttaaacttttaaactttcactctaagaaaggcactgttaacaagaatgaaaagtcaggtgctgaatgggagaaaacatttggaaattccaagtccagcaagtgacttggattatccaaaatatacaaaggact

SEQ ID NO: 154963 - DNA, 601 bp, Human
ttttaggccagggagacgtctgacaaatttctaacatacagaactgtaagatagtaaatttgtattgttttaagacaccatatttgtgacaatttgttacagcagtaataagaaactaatataggaagaaaacaaaaaagctaattgaaaaaaaaaaagacaaaagatctgaataggtacttctccaaagaagatatatggatggcaaacaaggatatgaaaagatacttaacatcatttatcattacagaatggaaattaaaatcacaattagatgctatgtcatagttgctagaattgktacaaacagacaataaataaataatggcaaggatctggagcagcaggcattctcatttattgccagtgggaatgcagaatggcatagccactttggaagtcagtttgatagtttcttaaatatcacttctgggtatttacctaaatgtattgaaaacttttgttcacacagaaacctatatgcaaatgtttatagcagctttatttataaattgacaaaaactaggaacaaccaagatgtctttcagtaagtggtacagtggaatactactcaaccatgaagtggagtgagttggttatt

SEQ ID NO: 154964 - DNA, 601 bp, Human
tgtggtagcacatctgtggtattagtcccataacccacaatcccagcctgatcatgagaacatattaaaactcagattgaaggaaattttacaaaatatgaaatacctgattactactcttcacaagtgtcaaagccataaaaaacaaggaaaagtctgaaaagctatcagattggagagaccaaggaaacacgacgattaaatgcaaatggaatcctagattggatcttagaatcaaaaaaagatattagtgggaaaactggtgaaatacacataaagtctgtaattcagttaataatawtattgtaccagtattaatcatttaattttgacaaatgtaccttgattatggaagatgctaacgttaggagaagctcaatagaggatatctgggaactctctgtactctctttgcaactttcccgtaactttaaaattgtttcaagacaaaatgtttatttaataaaggtacattctgtcaacaaatatttatgcaaatgaatgagcatctcttcgttgatcatccttttattaattgcctattataatctttgtccattttttaggttaagtgcactattacatgttattgctatctgtg

SEQ ID NO: 154965 - DNA, 601 bp, Human
tagaagatcaaaccagccataacattccctcaagacaaagcctaatccagagcaaaatcctaactctattcacttctatgaagactgagagaggtgaggaagctacagaagaaaagttggaagctagcagaggttggttcatgaggtttaaggaaagaagccatctccgtaacataaaggtgcaaggtggagcagcaagtgctggtggagaagttgcagcaggttgtccaaaagagctagctaagatgattggtgaatgtggcttcactaaacaacagattttcttttcttttctttcttytttttttttttttgagactgagtctcactgtaccgcacaggctagagtgaagtgacacaatctggttcactgcaacctctgcctcctgggttcaagtgattttcgagtctcactcagcctcccaagtgattctcatgcctcagccacctgagtagctgggattacaggcacctgccaccacgcccagctaattttttggtagagacggagtttcaccatgttggcaaggctggtctcaaactcctgacatcaagtaatccacctgccttggcctcccaaagtgctgggattatgggcatg

SEQ ID NO: 154966 - DNA, 601 bp, Human
agacagggacatttaagtttgcagaggttactgctgtctttttgtttgtctgtgccctgcccccagaggtggagcctacagaggcaggcaggcctcccttgagctgtggtgggctccacccagctcgagcttcccggctgctttgtttacctaagcaagcctgggcaatggcgggcgcccctcccccggcctcgctgccgccttgcagtttgatctcagactgctgtgctagcaatcagtgagattccgtgggcgtaggaccctccgagccaggtgtgggatataatctcgtggtgcgccrttttttaagccggtctgaaaagcgcaatattcgggtgggagtgacccgattttccaggtgcgttcgtcacccctttctttgactcggaaagggaactccctgaccccttgcacttcccaggtgaggcaatgcctcgccctgcttaggctcgcgcacggtgcgtgcacccactggcctgcgcccactgtctggcactccctagtgagatgcacccggtacctcagatggaaatgcagaaatcacccgtcttctgcgtcgctcacactgggagctgtagaccggagctgttcctattcggcc

SEQ ID NO: 154967 - DNA, 601 bp, Human
atataatctcgtggtgcgccgttttttaagccggtctgaaaagcgcaatattcgggtgggagtgacccgattttccaggtgcgttcgtcacccctttctttgactcggaaagggaactccctgaccccttgcacttcccaggtgaggcaatgcctcgccctgcttaggctcgcgcacggtgcgtgcacccactggcctgcgcccactgtctggcactccctagtgagatgcacccggtacctcagatggaaatgcagaaatcacccgtcttctgcgtcgctcacactgggagctgtagacyggagctgttcctattcggccatcttcgtggttatgtctttatcagcaatgtgaaaatggaccagtatagtaaatgggtaccagcagagtggggcactgctgaaaagagacccgaaaatatggaagcaactttgcaactgggtaacaggcagagactgaaacagttttgagggctcagaagaagataggaaaatgtggaagagtttggaactccctagagacttgttgaatggctttgaccaaaatgctgataatgatatggacagtgaaatccaggctgaggtggtctcagatggagatg

SEQ ID NO: 154968 - DNA, 601 bp, Human
tggtcactgagtgcttcttatgtatcaaattctagatgttaatatgtaatttaatcttcagaaagggctgttagaccataagctccttggagcacagctttgggtcttcatctatgtaatctctctaattaactgtacgtttaataagtgtatacagttagatacacagtgaatgagtaaacaagtctgtaaattattgtcctcattttagagaaaatgaaatgggtgtctaagaaattaagtctatcaatagtcccatagctactaagcggcaaaaccttaacctgtatgtagtctttttattattattattattattattattattattattattattattatactttaagttctgggatacatgtgcagaacatgtaggtttattacataggtatacatgtgccatggtggtttgctgcacccatcaaccagtcatctacattaggtatttcttctaatgctatccctccccttgccccacactccccaacaggccccagtgtgtgatgttcccctccctgtgtccatgtgttctcatttttcacctcccacttatgagtgagaacatgtggtgtttggttttctgtttctgtgttag

SEQ ID NO: 154969 - DNA, 601 bp, Human
ttcattctgttttctctaatcttgtctttacactttatttgattaagttgatcttcagtctctgatatcctttcttccgcttgattgatttggctattgatacttgtgtatgcttcacaaacttctcgtgctgtttttttcagctccatcaggtcatttatgttcttctctaatctagttattctagttagcaattcctctaaccttttattgaagttcttagcttccttgcattgggttagaacatgcttcttgagctcagaggagtttgttattacgcactttctgaagcctccttctrtcaattcttcaaactaattctctgtccaatttagttcctttgctggcaaggagttgtgatcctttggaagagaagaggcattcaggtttttggcattttcagcctttttgtgctgtttttttcctcatcttcgtggatttgtctacctttggtcttcgatgttggtgaccttcggatggagtttttgcttcgttgtccttttttttttatgttgatgctattgctttctgtttgttagttttccttctaacagtcagacccctctgctgcaggtctgctggagtttgctgggggcccaca

SEQ ID NO: 154970 - DNA, 601 bp, Human
gttttctctaatcttgtctttacactttatttgattaagttgatcttcagtctctgatatcctttcttccgcttgattgatttggctattgatacttgtgtatgcttcacaaacttctcgtgctgtttttttcagctccatcaggtcatttatgttcttctctaatctagttattctagttagcaattcctctaaccttttattgaagttcttagcttccttgcattgggttagaacatgcttcttgagctcagaggagtttgttattacgcactttctgaagcctccttctgtcaattcktcaaactaattctctgtccaatttagttcctttgctggcaaggagttgtgatcctttggaagagaagaggcattcaggtttttggcattttcagcctttttgtgctgtttttttcctcatcttcgtggatttgtctacctttggtcttcgatgttggtgaccttcggatggagtttttgcttcgttgtccttttttttttatgttgatgctattgctttctgtttgttagttttccttctaacagtcagacccctctgctgcaggtctgctggagtttgctgggggcccacaccagaccc

SEQ ID NO: 154971 - DNA, 601 bp, Human
cacctgtaatccccaacactttgggaggctgtggcaggaggatcacttaagcccagagttcaagaccagcccagggaacatagcaaaaacctgtctttacaaaaatatatatacatatatttttaaaagattagctgagtgggtatggtggcacacaccctgtagtactggctacttaagaggctgaaataagagaatcacttgagcccaggagtttgaagttccagtgaactgtgatcacaccactgtactccagcctgggtgacagagtgagaacttgtctcaaaaagaaaaaaaaaaatttattctatcttatatctttgacttgcaaaagcctatatttttagaatcagtttttttagacattagtctgatacagaaaccaaggttctctgcagcagaccattctgaggttgtggggatattgttggaaagaaatatgattaggatttattatacattcttacctttatttgttttttgtcagagaagcagtcacccctgattgttgctttaggccatcaattgatgtgcactgcaaggggtaaattgttctacacattagtaagctgggtaagcaaattgttgtgcaaacctaatt

SEQ ID NO: 154972 - DNA, 601 bp, Human
tgaagccaggagtttgaaaccagccatggcaatttagtgaaaccctgtctctacaaaaaatttaaaaaatggttggacatggtggtgtgcgcctataggcccaactgcttgggaggatgattgcagcccgggagttcaagaatgcagttagctgtgattatgccactgcactccaacctcggtgaccgagcaagaccctgtctctaaaacaaaaaaaaacaaaaactttatgttaggggagataaaaaaagaaaacaaatgaaagagatttttgccaagctactactaaacttcttaaaaatagcatcttttttgttcttgatgaatgatgattatcattgattctacgtgaataaaaggtagcctatttgatatgagtatagtatattagcaaattctactcccattatgaaatggaaattattgagatctaatacaatgataaagtatttcataaaacaatgactattctatttctaatctctctcaagataaaagataatattgtctatgtatatagtggacacagagactgttcactctaagataaagttaattgccatgagtttgtacatgtgatcatcaaaaagaacagtatcct

SEQ ID NO: 154973 - DNA, 601 bp, Human
gtcaggagttcgagaccagcctgaccaacatggagaaaccccgtctctactaaaaatacaaaattagccgggcatggtgacacatgcctgtaatcccagctactcgggaggctgagacgggaattgcttgaacccaggaggtggaggttgcggtgagccgagatcgagccattgcactctggcctgggcaacaagagcgaaacttagtctcaaaaaaaaaaaaaaaaaaaaatgagagagaggtaccaccttgatggtcttggataagatcccaaagaattttctgtttatcagacagagyggctcctgttcttttcccttactttcttccaaacaaatggagtctctctctctacatgctgagccacctggaactgggagtgtggtgattcaaggccctcttggtcaccaccactggaactgctctgggtcagacttgaagccagcacagcattgtgccttgcccaaggcccttcttttcagggcagagagtttccctgcacatgtccagagatgctgtctgggagccaggaattggagtaaaaaaccttagcagtttacctgctattctattctactgtggctaagctggcactcaagt

SEQ ID NO: 154974 - DNA, 601 bp, Human
tacaaaattagccgggcatggtgacacatgcctgtaatcccagctactcgggaggctgagacgggaattgcttgaacccaggaggtggaggttgcggtgagccgagatcgagccattgcactctggcctgggcaacaagagcgaaacttagtctcaaaaaaaaaaaaaaaaaaaaatgagagagaggtaccaccttgatggtcttggataagatcccaaagaattttctgtttatcagacagagtggctcctgttcttttcccttactttcttccaaacaaatggagtctctctctctacrtgctgagccacctggaactgggagtgtggtgattcaaggccctcttggtcaccaccactggaactgctctgggtcagacttgaagccagcacagcattgtgccttgcccaaggcccttcttttcagggcagagagtttccctgcacatgtccagagatgctgtctgggagccaggaattggagtaaaaaaccttagcagtttacctgctattctattctactgtggctaagctggcactcaagtcatgatacaaagtccttccctctctttgcctgtctccaagtttagaaattctttct

SEQ ID NO: 154975 - DNA, 601 bp, Human
ttgttctagagagggagtttgtactgtttctcacacccctccctgcaaacagctgcagcatagtgccattttgggagcccagccactgccagattacattctgccctggagcccagcagcctttgtatccccacatacctggagccctactggcatcctcccatgtccactcagagggcttcagtgctgtgatgctgactggacccagtggtgcagccaggttcccaaaactctagctaatgcagtcctctgcaccatatgaaacaggcagtgcagcacaccaggagtaggagagtggccytgggacaaagggagccaaagcatgcactccccagagcctgagaactgcctccctggtgttgctgccatatacagtaaccctgacccttccactggtagggttgctgacatacctgcatgtgccttcagaggccctggagattgacccaccagagctagcacccatgtgcaccaccaaggtacctgaatacaggcacatgccacctgctggtacccacacatgtcatccagggacccaaggacgtacctgccctgctcaccatcactgcttcctatgtgtaccatccagggattggcctca

SEQ ID NO: 154976 - DNA, 601 bp, Human
gcacccacgtgcattccctgggggctcaaggactggcgaacatggcctgctactgcatggttgcctaaggaccaacccacctggtgtccccatcttaagcaaagcctcaccacagcctccgctaacaactgtggcctaaaccatggaggaacttacaggcaccactgtaaggaacagccaaaggaattggctactgcacccacgcagggagcacattactgcacctccccagaatcaaaagccaaagcactctacttaaccaacactacagaaactatttccctgtggaaggtagtctatrtaattaaaagaagcaacttaccaagatgcagagatatcaacataaggacatgagaaacatgaaaaagcagggaaacatggcaattccaaaggagcacattaattctctaaagtaacagatccccaaaaaaagaaaatctgtaaaatgccttaaaaagagttcaaaataatgataagatacaagaaaacacaggtaaacaataacaagaaatcaggaaaacaattcatgatctcaatgagaaatttatcaaaaagatagatggcacaacatcgtgaaaccaaagaattcagtgaatgaaat

SEQ ID NO: 154977 - DNA, 601 bp, Human
gcaggaggaagtcatcacctgtcagttacaaccttgaatgtaaactgtttaaattcctccaattaaaagatatagattggctgaatggacataaaaagtaggacccaactatatgctgcctacaagtaactcactttgcctgtagacacgtagattgaaagtaaagggatgggctgggggcggtggctcacgcctgtaatcccaacactttgggaggccgaggcgggcagatcacctgaggtcaggagttcaaaaccagcctggtcaacatggcaaaaccccatctctattgaaaaaatamaaaaattagccaggcgtggtggcagatgcctataatcccacctactcgggaggctgaggcatgagaatcacttgaacccagtaggtggaggttgcagtgagctgagatcacaccaatgtgctccagcgtgggtgacagagtgagactatgtatcaaaaaaaaaaaaaaaaaaaaagaaagtgaagggatggaaaaagatattccacacacacagtaaccaaaagctgccagaaggaactgtatatcaaacaaagggtaaaaaaaaaaaaaagagagacaaagaaggtcattataaaatga

SEQ ID NO: 154978 - DNA, 601 bp, Human
tttgaaaaataatacatttacacatattatttgcttatatctgacataatttgctgtaaggagatacacagttttcagaactctgatgtgactattatagttaatagttaattagctttttaaagtttctataaaaaatgccaaataacttgatacattttgtttgcaattagtgacaagacagtatttgccaacttcatgcatttcaagtatcattatgtaaagattgtttcctaattctttatgtgtaaagatttattcctaattctttataatttatttataaaattatagtttcaayaatctttcatatatactaagagaaaataaaagattgtttttaggaaattacatttttgcagaattttcataaatgcttgaaaagatcatagaattgctaaacccatgtgggcataggctacccggaattttcagctcatatttagatggtaggaaaattgacagaaacttagttactgtatttctttgtgcttaaatgtatgaccaggagtctggtgaatgtgatttcccaaacattggagtaggaacactagcagttcttattttgaaaaagaacattgtacttgagctttcaggttgt

SEQ ID NO: 154979 - DNA, 601 bp, Human
aaactaaatggatggtatataggaattctttgtactatatttgcaacttttctgtatatctaaaattatgccaggccaggtgcaatggttcacactagtaatcccaacacttcggaaggctgaggcactcaggaggatcacttgaggccaggaattcaagactatcccggacaacataatgagtcgtcatctctgcaaaaaatggaaaaattggctgagaaatggtggcatgcacctgtagtgccagctacttgagagactgaaacaggagaatcactcgagcccaagagttcacagctaygatgagctgtgatcatgccacttgcacttcagcctgggcaacatactgagaccctgtctctttaaaacaaaaaaagaaaaaagaaaaataataaattttaaatttaaaaaaattgtaaataacaatttacaagtaaaattatttcaaatgcaaagtttaaaaaaataggcagcaactgtagccccacccgcttttcgggtagcattcctttgaagtagagatagttccctcatttggcagattagaattcttttcttattaaaataattttatatagttagaaaatcctgaaagtcttct

SEQ ID NO: 154980 - DNA, 601 bp, Human
gtgaggtaagaggatcgcttgagcccaggaggtggaggttacagtgaaccaaaatcatgccgctgcccttacagcctgggtgacagagcaagaccctatctcaaaaaaaaagaaagaaagaaaaagaaataaggtaagaaatagggtgccattgaatatttttaactaggtaagagatgtgattgatcatttatttatttcaaaaaaagaattattctggtggcagtggcctagtcctagagggaaaaaaatacaaactgcaggttgcccttcagccatcttgcctctttcacttattgayggctgcgaatggtgcccccattgccttccccaatggcaataagtgttcattatgtcttgttttgttaaaggtgttttgtcctttatggtctctgcctgccacaacagcatagatcagatttggaggaccttttaaaactgagtgtttgactatctgtgaaatccctttttgtgttttcttcacttgaaatgacattatgacttactgtgagacaggataatttgtagtttcttttgtcatgatcttctttggatgtcatagaccatggagcgctctgcattggttcagaggaactgagaa

SEQ ID NO: 154981 - DNA, 601 bp, Human
tttcaaagtcatacagttggtaattgttgggacagaaattaaactcaggttctgcaggtaatatcctctaagaccaaaaaaaaacggtatgtaatgtgttgtatatttttctgggagagggtaaatatctttgatcatattcacaaagaagttcttaaccccccaaaatagaacaacttctatattatgccatcttaagataagcagtacagagcagggaacttggagctatgtgagctcagtctttatatcccccttaacttctacccaggtaatagtagcaagttaaaccagaaaatayatacatatatccttcataatcctttagggctaagaagtctactttttattttgttggagaagaggtatagtgtgctaggtgaatgtacagttgctagagttgaattgcttaaatttaaattctaactctaccacttattctcttacatcaaattgtactatcacagtttcctcatttataaaagtagaatagtaatagtactatcttatggtatatgtgagcgttaaattagtaaatatgtgtaaattacttagtgcagacagcagtttccaaaggacatttgatgatatttaaagatat

SEQ ID NO: 154982 - DNA, 601 bp, Human
cttatggtatatgtgagcgttaaattagtaaatatgtgtaaattacttagtgcagacagcagtttccaaaggacatttgatgatatttaaagatatttttggttgtcacaatttgggagaggggtgccactgtcatctagtgatagaatccaggtgcattttgcagtgcacaagacagccccacaacaaagaattatctgaccttcagtgtcagtagtattgaagttgagaagcccctggttagcacaatgagtggcatatacatttttataaacatttgctattattttgtgctgaagtytaaaaaaaaacatggaagaaaaagtagaattattatgtaatcatcttttcttggttgttttgtgtgtgtgtgtgtgtgtgtgtgtgtgtgtgtgtggttgtttgtttttttgtgtgtttttttttttttttggttttgttttttgttttgagacagagtcttgctctgtcacccaggctggagtgcagtggcggtatctctgctcactgcaacctccacctcccaggttcaagcaattctcctgcctcagccttccgagtagctgggattacaggcacccgccaccaagcccagctaatt

SEQ ID NO: 154983 - DNA, 601 bp, Human
ttttggttgtcacaatttgggagaggggtgccactgtcatctagtgatagaatccaggtgcattttgcagtgcacaagacagccccacaacaaagaattatctgaccttcagtgtcagtagtattgaagttgagaagcccctggttagcacaatgagtggcatatacatttttataaacatttgctattattttgtgctgaagtctaaaaaaaaacatggaagaaaaagtagaattattatgtaatcatcttttcttggttgttttgtgtgtgtgtgtgtgtgtgtgtgtgtgtgtgtgttgttgtttgtttttttgtgtgtttttttttttttttggttttgttttttgttttgagacagagtcttgctctgtcacccaggctggagtgcagtggcggtatctctgctcactgcaacctccacctcccaggttcaagcaattctcctgcctcagccttccgagtagctgggattacaggcacccgccaccaagcccagctaatttttgtatttttggtagagatggggtttcaccattttggccaggctagtcttgaactcctgacttcatgatccacccacttcagcctcccaaagtac

SEQ ID NO: 154984 - DNA, 601 bp, Human
ttggttgtcacaatttgggagaggggtgccactgtcatctagtgatagaatccaggtgcattttgcagtgcacaagacagccccacaacaaagaattatctgaccttcagtgtcagtagtattgaagttgagaagcccctggttagcacaatgagtggcatatacatttttataaacatttgctattattttgtgctgaagtctaaaaaaaaacatggaagaaaaagtagaattattatgtaatcatcttttcttggttgttttgtgtgtgtgtgtgtgtgtgtgtgtgtgtgtgtgtgggtgtttgtttttttgtgtgtttttttttttttttggttttgttttttgttttgagacagagtcttgctctgtcacccaggctggagtgcagtggcggtatctctgctcactgcaacctccacctcccaggttcaagcaattctcctgcctcagccttccgagtagctgggattacaggcacccgccaccaagcccagctaatttttgtatttttggtagagatggggtttcaccattttggccaggctagtcttgaactcctgacttcatgatccacccacttcagcctcccaaagtactg

SEQ ID NO: 154985 - DNA, 601 bp, Human
gttgtcacaatttgggagaggggtgccactgtcatctagtgatagaatccaggtgcattttgcagtgcacaagacagccccacaacaaagaattatctgaccttcagtgtcagtagtattgaagttgagaagcccctggttagcacaatgagtggcatatacatttttataaacatttgctattattttgtgctgaagtctaaaaaaaaacatggaagaaaaagtagaattattatgtaatcatcttttcttggttgttttgtgtgtgtgtgtgtgtgtgtgtgtgtgtgtgtgtggttggttgtttttttgtgtgtttttttttttttttggttttgttttttgttttgagacagagtcttgctctgtcacccaggctggagtgcagtggcggtatctctgctcactgcaacctccacctcccaggttcaagcaattctcctgcctcagccttccgagtagctgggattacaggcacccgccaccaagcccagctaatttttgtatttttggtagagatggggtttcaccattttggccaggctagtcttgaactcctgacttcatgatccacccacttcagcctcccaaagtactgaga

SEQ ID NO: 154986 - DNA, 601 bp, Human
ttgtcacaatttgggagaggggtgccactgtcatctagtgatagaatccaggtgcattttgcagtgcacaagacagccccacaacaaagaattatctgaccttcagtgtcagtagtattgaagttgagaagcccctggttagcacaatgagtggcatatacatttttataaacatttgctattattttgtgctgaagtctaaaaaaaaacatggaagaaaaagtagaattattatgtaatcatcttttcttggttgttttgtgtgtgtgtgtgtgtgtgtgtgtgtgtgtgtgtggttgtgtgtttttttgtgtgtttttttttttttttggttttgttttttgttttgagacagagtcttgctctgtcacccaggctggagtgcagtggcggtatctctgctcactgcaacctccacctcccaggttcaagcaattctcctgcctcagccttccgagtagctgggattacaggcacccgccaccaagcccagctaatttttgtatttttggtagagatggggtttcaccattttggccaggctagtcttgaactcctgacttcatgatccacccacttcagcctcccaaagtactgagat

SEQ ID NO: 154987 - DNA, 601 bp, Human
gtcacaatttgggagaggggtgccactgtcatctagtgatagaatccaggtgcattttgcagtgcacaagacagccccacaacaaagaattatctgaccttcagtgtcagtagtattgaagttgagaagcccctggttagcacaatgagtggcatatacatttttataaacatttgctattattttgtgctgaagtctaaaaaaaaacatggaagaaaaagtagaattattatgtaatcatcttttcttggttgttttgtgtgtgtgtgtgtgtgtgtgtgtgtgtgtgtgtggttgtttttttttttgtgtgtttttttttttttttggttttgttttttgttttgagacagagtcttgctctgtcacccaggctggagtgcagtggcggtatctctgctcactgcaacctccacctcccaggttcaagcaattctcctgcctcagccttccgagtagctgggattacaggcacccgccaccaagcccagctaatttttgtatttttggtagagatggggtttcaccattttggccaggctagtcttgaactcctgacttcatgatccacccacttcagcctcccaaagtactgagatta

SEQ ID NO: 154988 - DNA, 601 bp, Human
tcacaatttgggagaggggtgccactgtcatctagtgatagaatccaggtgcattttgcagtgcacaagacagccccacaacaaagaattatctgaccttcagtgtcagtagtattgaagttgagaagcccctggttagcacaatgagtggcatatacatttttataaacatttgctattattttgtgctgaagtctaaaaaaaaacatggaagaaaaagtagaattattatgtaatcatcttttcttggttgttttgtgtgtgtgtgtgtgtgtgtgtgtgtgtgtgtgtggttgtttggttttttgtgtgtttttttttttttttggttttgttttttgttttgagacagagtcttgctctgtcacccaggctggagtgcagtggcggtatctctgctcactgcaacctccacctcccaggttcaagcaattctcctgcctcagccttccgagtagctgggattacaggcacccgccaccaagcccagctaatttttgtatttttggtagagatggggtttcaccattttggccaggctagtcttgaactcctgacttcatgatccacccacttcagcctcccaaagtactgagattac

SEQ ID NO: 154989 - DNA, 601 bp, Human
cacaatttgggagaggggtgccactgtcatctagtgatagaatccaggtgcattttgcagtgcacaagacagccccacaacaaagaattatctgaccttcagtgtcagtagtattgaagttgagaagcccctggttagcacaatgagtggcatatacatttttataaacatttgctattattttgtgctgaagtctaaaaaaaaacatggaagaaaaagtagaattattatgtaatcatcttttcttggttgttttgtgtgtgtgtgtgtgtgtgtgtgtgtgtgtgtgtggttgtttgtgtttttgtgtgtttttttttttttttggttttgttttttgttttgagacagagtcttgctctgtcacccaggctggagtgcagtggcggtatctctgctcactgcaacctccacctcccaggttcaagcaattctcctgcctcagccttccgagtagctgggattacaggcacccgccaccaagcccagctaatttttgtatttttggtagagatggggtttcaccattttggccaggctagtcttgaactcctgacttcatgatccacccacttcagcctcccaaagtactgagattaca

SEQ ID NO: 154990 - DNA, 601 bp, Human
caatttgggagaggggtgccactgtcatctagtgatagaatccaggtgcattttgcagtgcacaagacagccccacaacaaagaattatctgaccttcagtgtcagtagtattgaagttgagaagcccctggttagcacaatgagtggcatatacatttttataaacatttgctattattttgtgctgaagtctaaaaaaaaacatggaagaaaaagtagaattattatgtaatcatcttttcttggttgttttgtgtgtgtgtgtgtgtgtgtgtgtgtgtgtgtgtggttgtttgtttgtttgtgtgtttttttttttttttggttttgttttttgttttgagacagagtcttgctctgtcacccaggctggagtgcagtggcggtatctctgctcactgcaacctccacctcccaggttcaagcaattctcctgcctcagccttccgagtagctgggattacaggcacccgccaccaagcccagctaatttttgtatttttggtagagatggggtttcaccattttggccaggctagtcttgaactcctgacttcatgatccacccacttcagcctcccaaagtactgagattacagg

SEQ ID NO: 154991 - DNA, 601 bp, Human
agaggggtgccactgtcatctagtgatagaatccaggtgcattttgcagtgcacaagacagccccacaacaaagaattatctgaccttcagtgtcagtagtattgaagttgagaagcccctggttagcacaatgagtggcatatacatttttataaacatttgctattattttgtgctgaagtctaaaaaaaaacatggaagaaaaagtagaattattatgtaatcatcttttcttggttgttttgtgtgtgtgtgtgtgtgtgtgtgtgtgtgtgtgtggttgtttgtttttttgtgtggttttttttttttttggttttgttttttgttttgagacagagtcttgctctgtcacccaggctggagtgcagtggcggtatctctgctcactgcaacctccacctcccaggttcaagcaattctcctgcctcagccttccgagtagctgggattacaggcacccgccaccaagcccagctaatttttgtatttttggtagagatggggtttcaccattttggccaggctagtcttgaactcctgacttcatgatccacccacttcagcctcccaaagtactgagattacaggcatgagcca

SEQ ID NO: 154992 - DNA, 601 bp, Human
accttccctccactattgtcccatgaccctgccaaatccccctctgtgagaaacacccaagaattatcaataaaaaaataaatttaaaaaaaaaatttttaatctcagatattaaatgactttaattaatagaacctcaatattatatggaaaaccccatttaaagtacgaatttttgatagtataaatgaatatgaaaccacatttgatgctatcagatacttgtaaatagtgtatagtttaatcctgtctagtattgaggtacttgtctatatatctgtattgatatatatatatatakagagagagagagagaacatttcatgatcatatatataaagtaattggttaagagtatgggctttgacattattctgacttgggtttaagtcccagccctgtcacgtacagatatgtgactcaatagacacataacttctctgggtctcaatttcttttgtggtaaattgtgatgttaatgtgattggtgtgatattaatgtgatttcttcagtggtaaaattgtgatattaatgtctacctgcttcatagacttaccatgttgattaaatgagataaagtatataaagtgcttagcatag

SEQ ID NO: 154993 - DNA, 601 bp, Human
tcttatgacgaaggtgtcattaacctcatttctatagtagagtaactcaactaagagtacataggtaggaagtggcattcacaagatttgaccttaggtccttctaactctaaatccattaaatgatgaagtgtaattcctgatcttgctcctaaagcattttatgctctgtgtccttattttcttagcaaggtttgagattcttgaggaaaggggcagtgtctatacatatcttgtatctgtcatacaactaggacagtgctagattatcacctattttctcattgattgattggatatygattagagtgagatggtcagactttatggtgacagaaggagagaaattttattctgatcctagtcatatttctgaagtaggtgttgttaattagagcagcatcttattaagaaacagtgggttggaaccagccagtgtttagttttcaagaattgtacattagaaaaagatttatacagagtctgtaagaatgttatttttggctagattagtggcactcttttttttgtttcatttattatacaaatacttatcattacaaatctgtttattatatgctaaacagtgggacacactatt

SEQ ID NO: 154994 - DNA, 601 bp, Human
ccatttcctagtttttgatattacatcatttatatagggattgccaaataaggtactgtatgtaaagctaaacccacactgatgatctggactcttcagtgatgaacattgaaacttgtctttacttcttaaaaagggctttaaaatatgagcatttctactaaaacaatgtggcaacatatttgctgatgaaagattgtatttaccatattgaattgccttagaaaataattgcctctacaaaaggaaacatctgtatgatagcgcatggttaaagctgccatcaatttttaacatttgrgggttgagctatgaccttttatgatgactgtgaacagtaactgcatccattagccataagttttgtttctttattttagtagatggtctagactgtaaatattagagaatctaaaataaatcaacatattatcctaaggatacaaaatgtaagagctatttgtggttgggaacctttgacagatagtttggatgaagcagatgattgcctgcctagcgtatctggtctccattgctatgcctgcaggcagtttagtgctatggttgtatattgatgtcagggttagtactgagtggctag

SEQ ID NO: 154995 - DNA, 601 bp, Human
tcttcaaccttaatctaacctgcaatgggtttctgctttgcatttaaccactttgctgaattattcattacattttctcatttagtcttctcaacaatgttctgtttaatatacatgaatatcattttgcagaaatatgaaacaatttcagaattaaaagcttgtttagtggcaggcccttggtttcaaccagatcatcttactctgaacccagtttgcttttcgctgtatcacattggctatgtatgtatttaggcatgagtccaggaatgatcagtttcagagtgtgttgactgataawgccaatatcataagtttcatctccatactagctgttttacttcccaaggaaaagactcatttctttaactgaagattggatgtctagtcctggctcgccatcagtcacaaaagaactaagctagatccttgatattttatgtcctacaataggagaagcaacctagaaccaatagtctagtgtcagagatcagtaatattatatttatttctgaaaggtagcccctttctgttcccactgtgagagaatgccccttgggagcccatcacctaaaaactcttaataattttaaactaatga

SEQ ID NO: 154996 - DNA, 601 bp, Human
tcaacaatgttctgtttaatatacatgaatatcattttgcagaaatatgaaacaatttcagaattaaaagcttgtttagtggcaggcccttggtttcaaccagatcatcttactctgaacccagtttgcttttcgctgtatcacattggctatgtatgtatttaggcatgagtccaggaatgatcagtttcagagtgtgttgactgataatgccaatatcataagtttcatctccatactagctgttttacttcccaaggaaaagactcatttctttaactgaagattggatgtctagtcytggctcgccatcagtcacaaaagaactaagctagatccttgatattttatgtcctacaataggagaagcaacctagaaccaatagtctagtgtcagagatcagtaatattatatttatttctgaaaggtagcccctttctgttcccactgtgagagaatgccccttgggagcccatcacctaaaaactcttaataattttaaactaatgatagtgttctggacccccgtgtctgtgtacattaatttagtaaagaaaatttgggccgggcacagtggctcacgcctataatcccagcact

SEQ ID NO: 154997 - DNA, 601 bp, Human
tccttagctccctctttcccccaaacatcttacaagcaacaatggtcactttaatcttgttagagatgaaggcctactctcatgggcaaagtcacagatatataatcactgaaatgcttttctgtagggctcagaagttagtaggtaaggcagcaggaatttgaatctcagtcttcctttctctctctctgtttctctctctctctctctctttcttccccagcttctgctctccaccgttcagcccttcctgccttctgtcaccctctacacctaacccttcctcctctccctctttttctctccctctgattcactccatcagcctgaggagaaggcttccagacacaggactcaggttgaaagcctggaacacaacctgctggttcaaatggtatttaaaatccagaaaagaaatttctacaatggcagctttcctcccctctatgaccctatacctctgggtgatttgtgttgcccctgtgataccttcatgacctatggtggtgtatcaagctcgtgttcagatataaaaaacaaaagacagagggaatagaagctatgttgctgtacataagaaataggcagattaggagaaagt

SEQ ID NO: 154998 - DNA, 601 bp, Human
ttaaatgctgaaaacggagaagagtatcacattttatccaaaattctgtttgttcggtaatcattatttcaagtttttattcttttgaaagataattgatcagtatttctactgcaatttattctttactcaaatttgtagcagttaacatgctccacttgggtttcagaaaggaaatttcattctctatcaggccctctgttggtggttggcctttattacataatcatcaaacatgagaaaactaaaaatatctagagtgtgtgtgtgtgtgtgtgtgtgtgtgtgtgtgtgtgtgtggattttgaggtcctttttttaaatatactttaagttctgggatacatgtgcagaacgtggaggtttgttacataggtacacgcgtgccatggtggtttgctgcacccatcaacccatcatctacatcaggtatttctcctaatgctatccctcccctagcccttcacccccctacaggccctggtgtgtgatattcccctccctgtgtccatgtgttgtcattgttcacctcccacttatgagtgagaacatgtggtgtttggttttctgtcccgtgttagtttgctgagaatgatggttt

SEQ ID NO: 154999 - DNA, 601 bp, Human
atggtaactatagaggtaatgcatttgtcaattagttagatttagttactctacatcatacatatgtacctcaaatatattgcaggtttagttccagaccatcatgataaagtgatacagtaaagcaagtcacaccgtttttgttttctagtgtatataaaagttaaacttactgtactgtagtctattaagtgtgtaatgtcatgatgtagatacaatgtacatatcttaatttaaaatactttattgcggccaggtgcggtggctcacacctgtaatcccagcactttgggaggctgargcgggtggatcacctgaggtcaggagttcgagaccagcctgaccaacatggtgaaaccctgtctctacgaaaaatacaaaattagccaggcatggtggcaaataccttgtaatcccagctacttgggaggctaaggcaggagaattgcttgaacccaggaggtagaggttgcagtgagtcgacatcgtgccactgcactccagcctgggcaacaagaacagaactccatctcaaaaaacaataaaaataaataaaatattttattgctaaaaaattctagcaaacatctgagctttcagt

SEQ ID NO: 155000 - DNA, 601 bp, Human
tactttattgcggccaggtgcggtggctcacacctgtaatcccagcactttgggaggctgaggcgggtggatcacctgaggtcaggagttcgagaccagcctgaccaacatggtgaaaccctgtctctacgaaaaatacaaaattagccaggcatggtggcaaataccttgtaatcccagctacttgggaggctaaggcaggagaattgcttgaacccaggaggtagaggttgcagtgagtcgacatcgtgccactgcactccagcctgggcaacaagaacagaactccatctcaaaaaayaataaaaataaataaaatattttattgctaaaaaattctagcaaacatctgagctttcagtgtgttgtaatctttttcctggtggaaggtctggcctcgatattgatggctgctgactgatcaaagtagttgccaaaggttgaggtggctgtggcaatttcttaaaagaagacgacaatgaaatttgctgcatcaattgacttcctttcacaaaagatttttctgtagcatacaatgctgtttgttagcatttgacccacaggagaacttctttaaaaactggagtcaatcctctcaaac

SEQ ID NO: 155001 - DNA, 601 bp, Human
cctgacctgcctgaagccacaggtcatttcaaaactagctagcactcctaagcaatttagagggaaactgaaatgaaaaacaaattgtggcccaagtttcaggggccagttaagcacatttctcaaagttttactgtaatataacttagaagtggtatcttaatgaagcattgggaaatagcagatgatctgggcctagacctgcagaagtcatcagctcttctgagattgcccattgttacttggttttgaatggtttattttcttcgcccagtgcctatgtctccttgtttatctctcytcttaattttccttagtttggaccagagcttcattacacctactttcttgcaaaagtgttggatgtgattcttggatggaaatataaaacattctaattgcatcctacagaaataaattgaatatgtcttgtatataagccatgcacattgcagtgattagaaagggggaaagaaattgggtgtcacattaattggtatttactttgaaatgcattttggtttctactcagtgatttgcactttgtatgaatttaattagatgccatgtgccccaggttgtatttcagatgaaaatgggg

SEQ ID NO: 155002 - DNA, 601 bp, Human
ctgacctgcctgaagccacaggtcatttcaaaactagctagcactcctaagcaatttagagggaaactgaaatgaaaaacaaattgtggcccaagtttcaggggccagttaagcacatttctcaaagttttactgtaatataacttagaagtggtatcttaatgaagcattgggaaatagcagatgatctgggcctagacctgcagaagtcatcagctcttctgagattgcccattgttacttggttttgaatggtttattttcttcgcccagtgcctatgtctccttgtttatctctcckcttaattttccttagtttggaccagagcttcattacacctactttcttgcaaaagtgttggatgtgattcttggatggaaatataaaacattctaattgcatcctacagaaataaattgaatatgtcttgtatataagccatgcacattgcagtgattagaaagggggaaagaaattgggtgtcacattaattggtatttactttgaaatgcattttggtttctactcagtgatttgcactttgtatgaatttaattagatgccatgtgccccaggttgtatttcagatgaaaatggggg

SEQ ID NO: 155003 - DNA, 601 bp, Human
ctgctatccttgtttgccttaaaatttgaatggagaaagagacggaatcaggaagtttttttatctgtcgctcagaatattaagttaggagttgaaatgttaaaagtctgaatttgtctttgttctgaacaagcatccttaccttggaaaactttgttcccaaaggaagggcactgggctggcaatcttgcagttatactttttttgatcaccgtaatcacctctctaagtccatgttagactcaagacaacaatagtgctaatggctgtcatttattaagtaccagacactgagcagggrgatggggcgagggggtggttacagatgttttgtcatttacttaattctcatggctaactttatgaagtaaatattatgtctcttaattacaggtgagcacactaaggctttgatgactaaagtgactttatccaaaaccagacagctaacagtggcagagccaggattcaagcatagataaacttttttttcttttttttaagagacgagatctcactatgttgcccaggttggtctcaaactcctgggcccaggggatcctcctaccccagcttccaagtaggtaggattataagcatt

SEQ ID NO: 155004 - DNA, 601 bp, Human
ccatcatccagttggcatgaaagaaggggcaagaaatctgtgataaagaatgtcaggatattgttttgacagataaaaaatgaactctttgaattagcaaataaatgaaaataattcttcttaattgtcctactatctttagagtgaagaaattagcatacgtattttatcaacagttgtttataaaatggagtggaactttaagagacaattgtactgctgctacttcttataaatgaaaatcctaggcattttaaatctgtgtttggtttctttatcttcacatataggcaatttttttctatatttcttagatcccagcgtttgaattttgatgtatcatctcctaatggaattcttctcttcagagaagctagtaaaatggtttgcacttatggtgagtgtccttttccatatgtgcctctgcaatatagttttatctctttagaggaaagaaagatgttagttattttgttcttttgaactttcatatctttatgaatttgtgaagtcggtaatacaagtgcaaaaagccagttagctatcatattggcatcaggagaagtaagcagcatgcctttgactaaatcatgcctgacca

SEQ ID NO: 155005 - DNA, 601 bp, Human
ttccttctctttgcctctgggtcctggtatctttagtgacatctgttggttgaagagtgcacagaagggagaaataatgattgttttcataagactggccaaaatagaactgccttcattctttccttaggtacctgatttaagaacgcaatatataaagattctaaactttaaaaatggatagtacaagctatgattattcactgtcataagaatttacatcaggatccttttaagcagtgtatgctctgggtgtatgtaaggtataacttaatatgcataaattgaatttgtaaagtgktatacaagccactgttattcgtcaccacctagataataggccattggttttcacccttggttttgcagagctgtagaggcctgtgaaagtgccacagcagccctccagaaaaagggggaaagaggaccactttgccaccttgaccagaaccacccagctatgtagttacactagacttgttcgtaaaagctatcacctgttaggactttttttaaaaaagaggctgaaaatcacttgcatgtactattagaagtgttgtaagaatggaagattaagattgtatacaggcatacttctttt

SEQ ID NO: 155006 - DNA, 601 bp, Human
caggcgtgagccactgcgcctggctgagcatttgctgttaatacgtttctgatgctgtgagagataggaagataaataagatgcaaaaggaaaaaaaaaaaaaaaaaagaatccacctgggcgcagtggctcacacctgtaatcccagcactttgggaggccagggcgagtgggtcacctgaggttgggagttcaagaccagcctgaccaacatggagaaaccccatctctactaaaaatacaaaattagccgggcgtggtggtgcatgcctataaccccagctactcaggaggctgaggsaggagaatcgcttgaacccggaaggcaaaggttgcagtgagccgagatcgtgccattgcactccagcctgggcaacaacagcgaaactccgtctcaaaaaaaagaaaaaaaagaatcttatagattcttcccttaaggaacttaagtccagcaggggagtcggacaaatcaagaaagaattatgatgtgttgtgctatgtgttatccttgagaagtatttagagtgccataggagcccagaagagatttctagctgaaactgggggtttagagaaggcaatatttcttgaagggaaaaga

SEQ ID NO: 155007 - DNA, 601 bp, Human
gggcaggatcaacaatttcagtaagtattgctgaataatacatattgaataaagctgcattccagtaaataaatggataacatggccaagccttcttttccatggtcttttattatcgccatggaatgctgaggcacttgagcaaaatgaggtagtttcctatttcagaagtattcatcattctgttgcaaggtcaaaatagtatattaattactgtcttaacccatttatgcctagtcttccattattaagacgctaagcttgtgggagttatttgtatcctactgctcaaggtcatcascaaggtctgatttttcacacaaaaaaatttgcaaccttcggcataaatgggttaatacagatgtatctgacatagtccaaaaggcaggacatatatgccaaattgcaatattaacatagagataacagttatgattctaaatatttcttgatgatagattatgcagtcctttacagattttttttcccaatcaggcagttcttggcctgcctatttcatctgttgctacagaatataggacctttcctttccctctaaggatatcaacataaaaaggccccaaaagttttctcactttta

SEQ ID NO: 155008 - DNA, 601 bp, Human
aaaatgaggtagtttcctatttcagaagtattcatcattctgttgcaaggtcaaaatagtatattaattactgtcttaacccatttatgcctagtcttccattattaagacgctaagcttgtgggagttatttgtatcctactgctcaaggtcatcaccaaggtctgatttttcacacaaaaaaatttgcaaccttcggcataaatgggttaatacagatgtatctgacatagtccaaaaggcaggacatatatgccaaattgcaatattaacatagagataacagttatgattctaaatatttcttgatgatagattatgcagtcctttacagattttttttcccaatcaggcagttcttggcctgcctatttcatctgttgctacagaatataggacctttcctttccctctaaggatatcaacataaaaaggccccaaaagttttctcacttttaccctggccttcccaacaaacacaaaaccagtgaaaattaccaaaattaccctagctcttttcatcacatgggtatacagtgctgttctttcttgggaaggggaaggagggaaaatgtctaaccttggtttaaattgaatttga

SEQ ID NO: 155009 - DNA, 601 bp, Human
tcaggcagaagaaagaatctcagaacttgaagacaggactttttcaaataatccagtcagacaaaaaaaatttgaaagaaaaagaatgaaccaagccttcatgacatatgaaacaacataaagtgattgaatattcaaattgccagcatccatgagaacagagacaaaggattagaaagcccatttacagaaataatagatgaaaatttcccatttattacaagaaatgtagacattcacatacaggaaactcagtgatccctaggaagatacaatgcagaagggtcttttccatggtacrttatagtcagaatatctatagtaaaacttaaagagcaaatccttaaaactgcaaaagaaaagcatctagttacctataaaaggaaccccatcaggctaacagtggatttctcaggagaagctttacaggccagaagacaatggaatgatacattcaaagtacagaaagaaaaactggccaagaatactacatccagtaaaattaacctttgtaaatgaaggagatataaagtctttccaagagaagcaaatgctaagggaatttgtttgttaccactagactgcagccacaagaaatgct

SEQ ID NO: 155010 - DNA, 601 bp, Human
ctggctaggcgcggtggctcacgcctataatcccaacactttaggaggccgaggcgggtggatcacgaggtcaggagatcgagaccatcctggctaacacggtgaaacccagtctctactaaaaatacaaaaaattagccgggtgtggtggcatgcgcctgtagtcccagctacttgggaggctgaggcaggagaatcactggaacctggggggcggaggttgcagtgagacgagatcatgtcactgaactccagcctgggcaacagagcgagactctgtctcaaaaaaaaaaaaaaaaaattcctgtagttgttggaataattaaaaattctagtgcagtggtggtataccaatctttagaattcttaagtattctaatgttccaagttgaggtcatgcttgggaaaatcatgtcatagcatttatgttattttcagatgtcatttttttaccctggaaagaagtaataatgttcatcataaccctagcagcctggatagtgagctaaacaaaccctttgaagattacattttaatcaagtagactaggaatacaaaaaataagtctttactccccttccacccacctttacaaatctta

SEQ ID NO: 155011 - DNA, 601 bp, Human
gaattcatcttactcttgtctatttatctattttgctcaaatcaactgtactgaaatccaaaagaaattctaattgtgattttctttctctcccttttctcccttttctccctcctttttatgttatttcttttttttttttttttttttttttttttttgctaacatggcatttaactacaaattgtgaagagctgtcaggagctataaaaatcatacttcagtagggacttaagctgaaagaacattcacccttttcctcaatcagtcagtcagtcaatgaaaattgcttttgtatagkgctcttcatgacatgcatcccaaagtgaattacagcaaaagggaaatcatctgctcttttttcatttctgtgtttagactgaaatgatattgctcaacattttgacatactaaccaagacatctttcatacttaagattccattccataatactgagtaggagaaaatgcagtcgcatatttaactgatgttgagattttggcctacaggaaccttagcaagactattacagtcaaaaacacttaagcagatgaaatacagtcatatctcttgtcctcttaaaaagaatagtcagatttt

SEQ ID NO: 155012 - DNA, 601 bp, Human
cattcaaaccatagtacctcataattcttcccattcatataatgtcttcatacctaatgtctctgattctcacaataaccctaacagggagataaggccaacacggattttttttttctaactgaggagtctaggtacatcaacaaatttaatcctgcagtgactgtatgagagacctatgcagagattcagagatgtgtgaaagaacttgcccaagtcacacagctaggaaatagtagcatctagattataattaaggcttcttatcactagatctcacacagtttttataataccacastaagttttcgcagggccttaacctactatttctctgtggcatttcttcttaccttttcatccctgtctaagagagacagcagagtaaatgagaaggtttcccctgccttcatttctctgcatggaattgtgagtggtgtgagaagctctttgaatttcttcaaagaatggcacagtataaagtaagagtgggcttaataaatcacatgacttatttattttacagttattactggtttttcacatacttgcaggttagattatgtgattcccaaagtgtagtgtgctgtagtgtgctgga

SEQ ID NO: 155013 - DNA, 601 bp, Human
cctggccttaactcatggaaagtttaaccagcagtagccactgatggagctgtgagtttatatagtgtgttgaggaagactccttgtttgtctgtaatcttatcactatttgaagaacaaggtaaaaagaggttccctcatcctctggcctttcatgaattaatgctgcctcttatgctttgcaacctagaagagttcttgcttattctctgtcccttggcacgcttagaagaatatagactgagtgctttcaaatgactgaaatttcatcctcctttctaagtttttaaattgcaaattytccatatttgttgggactttctattttacagcaatcagggcagacaggttttacagtcggtatacctggttttgaataccagttatactatttgctaactgtatgtccttggaatagttactccacctcttggaggataacaccacctcacccaagggaattctatagcttacctgaactggcctccaggatcagataactgaaccactccctcctgtggtgtcattcccagactttagttaagactcactgtcttagattctctcccagtccatcactccctcagcctagtctgtagtc

SEQ ID NO: 155014 - DNA, 601 bp, Human
gcgcatcacttcaagatgctttttcagttactggaggaatttgatgcctctaactttaatcttttccattaaaatatccgttctgccttcagattgtgaagcccataatattttagactgtctagatggatctgttagttttgcttgtcagtttaatttgtggctctatgactttgggtggcttgttagattgtacatggaaactcgtgatctgcaaatgatgttcaacatcccaagcttaagtcctctccccagagagactggacataccataaatatgcaattggcagatttcatttgyaaccagcctaattgatatgatgatgtatagaatggcagacgtttagaacggcaaagaagctcattgctgttactatatcccttaaatgtttatagcactttttactctttgcaatgcattttatgtacactatctcatttgattctcagagcttccttgtgctggattattatttccctccttatagttaatgaaactgagacacagagagaagttcagtaacttgcctgagatcacaggataaattggatttcaaaaaataccagaggacaaaaccaactgtgttccaaacaagccagg

SEQ ID NO: 155015 - DNA, 601 bp, Human
taattgccgtttcccctgccctcttttggggaaaggagttctggagctgtgggaacagaagagcttagaggtaggaggtaaagagtccaagaagcagaaactatcatcagctccacatgaatgacagaaacctgtttcacagccacttgcctggactatcgcagcagcctcatccctggtctttctcctttagtttcacctgcacagtacacattctacatgtccccaaagagatctttcttaaatgcaaatcagagcatgtctcatctgtgctgcaaacatatcactagctccccactaycatcaggatgaagtccagattcctcagcagggtcttccagtctggcactggcgtctcacctctggcccacctctcttctctcctgtcatgctaagtttcttaccatggcagaaccctttgtgtgcatccccaccctccttttttgatgccttctttgcttagaacacatttataatgaactctttaaatgttaccttctccgtgcagtcttccctgacttctcctcaaggacccagagtcatccctgcctcctcgcatgcccactgcactttgcccagccctatttcctgttatttctct

SEQ ID NO: 155016 - DNA, 601 bp, Human; identical to SEQ ID NO: 21236

SEQ ID NO: 155017 - DNA, 601 bp, Human; identical to SEQ ID NO: 21237

SEQ ID NO: 155018 - DNA, 601 bp, Human; identical to SEQ ID NO: 21238

SEQ ID NO: 155019 - DNA, 601 bp, Human; identical to SEQ ID NO: 21239

SEQ ID NO: 155020 - DNA, 601 bp, Human; identical to SEQ ID NO: 21240

SEQ ID NO: 155021 - DNA, 601 bp, Human; identical to SEQ ID NO: 21241

SEQ ID NO: 155022 - DNA, 601 bp, Human; identical to SEQ ID NO: 21242

SEQ ID NO: 155023 - DNA, 601 bp, Human; identical to SEQ ID NO: 21243

SEQ ID NO: 155024 - DNA, 601 bp, Human; identical to SEQ ID NO: 36696

SEQ ID NO: 155025 - DNA, 601 bp, Human; identical to SEQ ID NO: 36695

SEQ ID NO: 155026 - DNA, 601 bp, Human; identical to SEQ ID NO: 36694

SEQ ID NO: 155027 - DNA, 601 bp, Human; identical to SEQ ID NO: 36693

SEQ ID NO: 155028 - DNA, 601 bp, Human; identical to SEQ ID NO: 36692

SEQ ID NO: 155029 - DNA, 601 bp, Human; identical to SEQ ID NO: 36691

SEQ ID NO: 155030 - DNA, 601 bp, Human; identical to SEQ ID NO: 36690

SEQ ID NO: 155031 - DNA, 601 bp, Human; identical to SEQ ID NO: 36689

SEQ ID NO: 155032 - DNA, 601 bp, Human; identical to SEQ ID NO: 36688

SEQ ID NO: 155033 - DNA, 601 bp, Human; identical to SEQ ID NO: 36687

SEQ ID NO: 155034 - DNA, 601 bp, Human; identical to SEQ ID NO: 36686

SEQ ID NO: 155035 - DNA, 601 bp, Human; identical to SEQ ID NO: 36685

SEQ ID NO: 155036 - DNA, 601 bp, Human; identical to SEQ ID NO: 36684

SEQ ID NO: 155037 - DNA, 601 bp, Human; identical to SEQ ID NO: 36683

SEQ ID NO: 155038 - DNA, 601 bp, Human; identical to SEQ ID NO: 36682

SEQ ID NO: 155039 - DNA, 601 bp, Human; identical to SEQ ID NO: 36681

SEQ ID NO: 155040 - DNA, 601 bp, Human; identical to SEQ ID NO: 36680

SEQ ID NO: 155041 - DNA, 601 bp, Human; identical to SEQ ID NO: 36679

SEQ ID NO: 155042 - DNA, 601 bp, Human; identical to SEQ ID NO: 36678

SEQ ID NO: 155043 - DNA, 601 bp, Human; identical to SEQ ID NO: 36677

SEQ ID NO: 155044 - DNA, 601 bp, Human; identical to SEQ ID NO: 36676

SEQ ID NO: 155045 - DNA, 601 bp, Human; identical to SEQ ID NO: 36675

SEQ ID NO: 155046 - DNA, 601 bp, Human
aggctttggggttaccaagatgaataggaaactacctggccttcagagagttatgtggtggaggtgggaaatgcatagacctaacatggcagcctcaaggttggccatagcacctaggatggtgatggaaagggtagaaggtgagactgtattatcatagagacccttgagggcctgagggtggagggtgtgctttaatccactagcccatgcaaattgttcaacaatgtacaagactataagaacaaggcccaagggtatcctggaggggatgatgtttctctcctctctttttttttttcttttattattatactttaagttttagggtacatgtgcacattgtgcaggttagttacatatgtatacatgtgccacactggtgcgctgcacccactaacttgtcatctagcattaggtatatctcccaatgctatccctcccccctccccccaccccacaacagtccccagaatgtgatgttccccttcccgtgtccatgtgatctcattgttcaattcccacctatgagtgagaatatgcggtgtttggttttttgttcttgcgatagtttactgagaatgatgatttccaatttcat

SEQ ID NO: 155047 - DNA, 601 bp, Human
ggccatagcacctaggatggtgatggaaagggtagaaggtgagactgtattatcatagagacccttgagggcctgagggtggagggtgtgctttaatccactagcccatgcaaattgttcaacaatgtacaagactataagaacaaggcccaagggtatcctggaggggatgatgtttctctcctctctttttttttttcttttattattatactttaagttttagggtacatgtgcacattgtgcaggttagttacatatgtatacatgtgccacactggtgcgctgcacccactaactygtcatctagcattaggtatatctcccaatgctatccctcccccctccccccaccccacaacagtccccagaatgtgatgttccccttcccgtgtccatgtgatctcattgttcaattcccacctatgagtgagaatatgcggtgtttggttttttgttcttgcgatagtttactgagaatgatgatttccaatttcatccatgtccctacaaaggactggaagcttcggagcacctgagaacgggcgcacaatgagaagtgaaacaacttttgggactgctggatcacttgcacggttta

SEQ ID NO: 155048 - DNA, 601 bp, Human
ctttaatccactagcccatgcaaattgttcaacaatgtacaagactataagaacaaggcccaagggtatcctggaggggatgatgtttctctcctctctttttttttttcttttattattatactttaagttttagggtacatgtgcacattgtgcaggttagttacatatgtatacatgtgccacactggtgcgctgcacccactaacttgtcatctagcattaggtatatctcccaatgctatccctcccccctccccccaccccacaacagtccccagaatgtgatgttccccttccygtgtccatgtgatctcattgttcaattcccacctatgagtgagaatatgcggtgtttggttttttgttcttgcgatagtttactgagaatgatgatttccaatttcatccatgtccctacaaaggactggaagcttcggagcacctgagaacgggcgcacaatgagaagtgaaacaacttttgggactgctggatcacttgcacggtttagaaatggtcaccttacttgcactacggaagaaatctttacgtttttctgctccagaaaggttgcccacccactcttctgtgaataatggg

SEQ ID NO: 155049 - DNA, 601 bp, Human
caccatcaccaccatcactattgctaccagcaccaccacctccaccaccactaccctcaccttcactaccaccaccctttaaatcaacaccattaccaccatcaccatggctaccaccatcccaccatcccaattgccaccaccacatccaccaccattaccaccaccaccatcatcactaccacccttacctccgtcattaccacctccatcacctctaccattaccatgattactatcgccatcccctctaccaccaccaccctaccacttctctctctatctctctctcatgtacacrtacatggttatatgacacttcatgatgcaatcatagacactgtccacatacagtgaaataagtacatgtttttaaattgtcattattttcaatatagaacctactcttgttgctatgtgctttggggtggggaacatcaacgtgtgtttatggccaaaattgaattaggattcataagaaagggctatatctccaaatgcgcacttttaaaaaagttaagtttggatgagggatctttcatttcataaaaggatatactgaggatttcctttcagtgacaaatttttgctgcattttatt

SEQ ID NO: 155050 - DNA, 601 bp, Human
gctccttattgccccagcttagctctaccagatgtcctgtccctgaaatgtaccagtagcccctctaaaaacccacttggctcatcagggcccagtccagggccctccccacctatcccattcctaatcccatcagcattagcgagaagcctgccactgcctcagggacctcgcatctggagactcagccaagatggtggcacctgtgagaggatccacaggtagccaagtccaggtagccagaggccaggtggcaatggggaagagcataagtgacccctgtccaatatgccctcatcarccaaatctggggcctcagtttgggctttgtggtgtgaaggtaccacccgccaaatgggcctggagccaccagcatagctgccctccttctccctgggtggccctggaggtgccacacttgcagcattcctgggtggtccttctgtgcatgggctgtaggtggaggtgtggaaagctgaagacagggtcaggcacagcccagggcagcctagagatatttacatcatgatgatgggattagacagcccactcgcttgtgcggtatctggacgccactggcttgcagagcatttgggggtta

SEQ ID NO: 155051 - DNA, 601 bp, Human
ggatccacaggtagccaagtccaggtagccagaggccaggtggcaatggggaagagcataagtgacccctgtccaatatgccctcatcagccaaatctggggcctcagtttgggctttgtggtgtgaaggtaccacccgccaaatgggcctggagccaccagcatagctgccctccttctccctgggtggccctggaggtgccacacttgcagcattcctgggtggtccttctgtgcatgggctgtaggtggaggtgtggaaagctgaagacagggtcaggcacagcccagggcagcctasagatatttacatcatgatgatgggattagacagcccactcgcttgtgcggtatctggacgccactggcttgcagagcatttgggggttactgcttgagagtgttttccactggtcttgtcactccctaggtgaaggaaagtctggcttttgtaggaactgcctgggtctctggtggagtatttccttcctcacctctggattattctgcctctttagagcattctagaaaaggggtgttttctcggttcattggccacacggcatggctgcatcctggtgacattttcccagcatcagat

SEQ ID NO: 155052 - DNA, 601 bp, Human
tgccacacttgcagcattcctgggtggtccttctgtgcatgggctgtaggtggaggtgtggaaagctgaagacagggtcaggcacagcccagggcagcctagagatatttacatcatgatgatgggattagacagcccactcgcttgtgcggtatctggacgccactggcttgcagagcatttgggggttactgcttgagagtgttttccactggtcttgtcactccctaggtgaaggaaagtctggcttttgtaggaactgcctgggtctctggtggagtatttccttcctcacctctgrattattctgcctctttagagcattctagaaaaggggtgttttctcggttcattggccacacggcatggctgcatcctggtgacattttcccagcatcagatggttggagactgcaatgaggaggctccacacaattcatagccttcagccaggccccttgctaaagtgctgcatgggacggagaagaccaaaccaattggagagggactcgatggaagccacacatggagttttgtgttgttgtccagtacttactgtggttgccctgctcccattgacctggacgatccatgttaccat

SEQ ID NO: 155053 - DNA, 601 bp, Human
gagagggttggtttgggttccatatgactgacataaagcagagcaaatattggcttgggacccaaaccaaccctctcttaggcttgttaaggccccattcaggatagttccctggaggtggttggagagctggcagcctttctggtgactggtgacctggtagtactctctaatagaatatgtcaataagcacagctcatttgaccagaattgtaggccgcctttctcgatccaacaggtgcagacctgctactctcaggattcactttgctagtctcccgcactccacaccggatcccamagtctatgttcaagtaatcccctatttaaatgtcatagatatatttggggaggctcataatttgattcaagtaacagtctgatctgtgcctctcactgagctggtgcaggtaatactttctttaagagtgtgtgcaagtggctctcctcagcctactctcacccccagggaaagaagccctcgtggatggaggaagaagatttatcttttctctacaagagcagcccaggaagaaagcatcaggtaagcataagcttaccaaagctgggacccattcactttacagtggggaaactgagg

SEQ ID NO: 155054 - DNA, 601 bp, Human
agccccactcagatctgcagagctgggagtgtggtttcatggggaggagggatgtggatggaggccagttggaataagaacaaaaaaaagcctggaatctgatccttgaggcaggctgtgcagcacagagggaagagggcagctgtggagaaatagaccaaggaggcacatgatgttgttttgacaaatatggagagggtagagaagggggaatcaaacctgccttggagaaggctggattaagcccctactgggtctgatatgctttctatcttaaggataagctttagcttaggcagtygtgagcaccaggcaattgcagaggcagtgaactcaccatcttccctttctgaggggttgggcctatgaagaggatctgggcagctccctctaaagtggggccttggggaagcccccactattcccacctgtggcctctctcacccctggtagactgaaccctccgaagtgcagtacttccagcacccagggcctgaagatagatggcacagggcgggggacacaggggccttaccctggggccttggcaggggacaggccctggggctgggctcaaggccaagttcaagaaagctcagac

SEQ ID NO: 155055 - DNA, 601 bp, Human
aaaataaaaaaaaagaaagaaagaaagagagaaagaaagaaagaaaaagaaagagagaaagaaagaaagaaagagagacagagacagagacagagaaagtaagaaagaaagaaaaaagaaagaaagaaagaaaaaagaaagaaagaaagaaagaaagaaagaaagaaagaaagaaagaaagaaagaaagaaagaaagaattgaaagcaggggctcaaccagttatctgttcatagcagttttgttcacaatagtcaaaagagagagacaacccaaatgtccatcagctggtaaataaattwaaaaaatgcagcatgcccatacaatagaatattattcagccttaaaaaggaaggaaattctgacatgtgctataacatggatgatcactgaaggcattaagctaagtgaaacaagccagccaccaaaggacaaatattgtatcattccactcatgtgaggtccctagagtagtccaattcatggagaaaggcagatagaactgtgagtgacaggggctaggggagggaggaaattaggagtgcatgtttaatggggacagagtttcagtacaggaaaatgaaaaagttctggagatggat

SEQ ID NO: 155056 - DNA, 601 bp, Human
tattacttttccctgattaagattcattcataccactttggggtggtgctgatattcctaacataagccaatcgattttggtcagttctgagagcagtgagtggtcttcacttacacacagtgtgtttgtaactctgctatttctttatgactagcacagtataaagtgaacgtttttggaaggctgttaagcatatgttctcctggtaggcttaaatgtgacttataaaaatacttgatagtatatgaacaagctcccactactggtttaaaccaaaaaaaagaggtttattttactagytcataagcacagattctacattctttgtgagaattatctttttaggtttttgtttttatttgttcttatcattttgatagccattttaatcatttcttttattcttttgtttgctttgttgacttttaatttggaaatgtctgctttggcagaataattacatcacaaggaggccctttccccacccacctacccagaaaggtctcctgactcccttatgctctatgaattgccctagttcaagattgatacagatcaaagcagcagaatggggttgaaagagcagcctctggcaatggc

SEQ ID NO: 155057 - DNA, 601 bp, Human
agatagtgccagcaactccagaggctacaaatttcctcctgccccattcagagagcaggagaatggcttctagaatctctgtcagaagagccaggaagcttctttcccagaagcccccccagatttcatgctttttagtctgaatggatccaacgcctactagcctactgtgctgcttcatgtcagctgtgtcccccgctagaaccttgtgtggagccaggttcctcctaagcacagaggtggtatgggccaaacgaagctgcctaaatgaaaatggggaaaggtgtcaagagaaggaagmcttagtgctggcaaccaacagtatttgttgcaatcaatctcttggccatcctcattcatacacaccttccttcccacgcatacacctcccaaaatgcccacacttagggaaaacctatttacccctttcccaaagggatccaactccaatccggaaaccctaggtgatgtgtcatcctctgaatttggtcagtatatagctcttcatgtttcagggaccactggtcaccatgctcaccttggcatagaaagtaagagtgcaataaaaagaaaaaaaaatttcaattgggaaagaggaagt

SEQ ID NO: 155058 - DNA, 601 bp, Human
ctggtcaccatgctcaccttggcatagaaagtaagagtgcaataaaaagaaaaaaaaatttcaattgggaaagaggaagttggaaagcagcacacggtggtcactgatccatcatccatatcacatcctgctggacagcagtagcaaggcttgaccaggggtcagactcagtttcctattctgtataatgagaggattggattaaattagtggttctcacattggaatgtggcctggagagcttgttaaaatgcagattactgggttccatccccagagtttctgactccacagatacagrtggggccctggaatttgcatttgtaatagatttccaggggctgctgctgctgctgctgctgctagtacaaggacacccctgcccttccactttgagaacctctgatttagattatccttatgggcccttctgattctgacatttaggactcagggatttttcttagctatctcttctgctctatactgacttatgatggattgttttataaatgggacacacccaactctactgtgtgaacaacttaaaaacatatcatggaattcctgctttggtttgtaatctaattttcaacaattg

SEQ ID NO: 155059 - DNA, 601 bp, Human
caccagcaccttctctacagaaacgagcagcatgtttgctaagggctgctggactttggcaggtagagaccatcagaggactcaactgaatccccttttatcaggaaccctaggagagtagagttgtcaggagtttccccatgacttacattgtcttttttaaaacaaccaattcatgactgaggtgaagaaggaaaataacagaaaaatatatctagcccaagaaatctacagaataacaataaaactcaggcagaaatgaacccactgatctgtgagccaagtgcttaagggaggggtyggggcacttctcatgtggctcactgtcttagtcagttcaggctgctatgacaaaataccataggctgggtggcttagagacaatggaaatgcattatgcatagttctggaggctgggaacttcaagatcaagacactggcagattcagtgtctggtgagagctctcttcctgattagtagatggtgccttcttgctgcattctcatgtgatggaagagtcaaggtagcttccttgggcttcttcttataagggcactaatctcattcaggagagctccaccccatcatctaatcacctcc

SEQ ID NO: 155060 - DNA, 601 bp, Human
gtctatgaaaagcaatcaatgtaacacactatattaacagaataaaggacaaaaaatgcatgatcatcccaatagatgtaaaaaggaaagggactttctcaagttcacacggctaatggcaaagctgagattaaaactcaggtcatctgacttgtaggccagagttctttatactggtgagggtaggggtggagggctgaaccggaccttgcaagactgtccactgcactgaatcctgtactgagggatttctgtttgttttttcatcctgtcctcacaacacccccaagcagtgggctcygttgttattccccctccttttgcatgaggaaactgaggcttagagaggtaacactggttgtctgaggtcatacagctgccaagtatatgaggagctaagcctagatttcaggtctcctgccttgtctctgatattttccagtgcccgccactgctctcctcactcaacagtgccacaggattaacctggttccattggttctcagatcacctactgccaagcacagtggatgggctttttgttgtaagtggatgggagtgccctccaaattctctggaagaatagcctcctctcctgtgc

SEQ ID NO: 155061 - DNA, 601 bp, Human
ggctgggaggtggggcaggggcaggggacagtggggataagatagaaacaaggctgttctttgctccttgagaagctgggtaacaagctggcttggcttctggtggagtctggcccagtgatagctcttgcctcctgatgggacaaaaaaggggagacaggcatctcagagaatgaggtggagagagacacaactgggccaggacccagaaaagagagttacctttttcgtctcagacctgggcatcccagatggaaccgtgctgagcttctggttagtctagcttcctccaggtgtgcawcacaggggtcctgctagggagccttcccagttgagattaaggaggttgctttcaaaatggccagctgcccaagattgcacctctgtcactgttgaggacagtgggggtaaacatgcctgatgttctgccctggaagggctccagagcctttggattgaagccacaaaggaggcctggcatttggctaccattccttcatctggttcactatcaaggatccctcatctcacccattctgctcccccgttctaatgtgggcttccataagcctctgtcccatcttccaaaatgcagtctgga

SEQ ID NO: 155062 - DNA, 601 bp, Human
aatttgcttctcgtatagatctgttttcaccaggaaatgaatcaaagccgcatactctgccttccatccttctcttctcttctctcttcaggtctttcagaccagggaaagtggctgcctttgggatagtcacaacaaggtgccctggactgaaaattgagagtgatgagtgacactctgccctggcttggggcaaggccctttcctgccatgagtttcagtgtccccacctaccaagtggggagttggtgtcagacaatgtttcttagtgggtggcattccaggagtccacacacaaagrctaagtccctgcaaaacagtgcagatagatgctttctgtaggtcttgctgactctcatactctctgtctttaactcgcttggcaattcttgagcaaaccattgggcctcttcatctacagagaatgatgacctgactaggtgatctctcatttctcctcaagttacaaaagcgttagggtggtaaggagaggaggtggccccaggaaaaccagatgggtcagaagaagacagaaggtggagccttcagtgacaggagagcagagaatgatgtccccctcccataaatgtagggaaggaag

SEQ ID NO: 155063 - DNA, 601 bp, Human
gtgagatcatgcacgtcaccaatctctttaggtagtattctgtgcggatttccacagatggctcatctgttttgtgttgatccttattagtttcaattttgtctttttaaatatattttatgactttctgattataagagtaatatgtgctctttgtagtaaacttggaaaatgcagaaaagtggagagaaaacacaaacctcatggcataatacaatatataaacatttaatatataaataatccagaaacaactactgtgtgaacacattggagtgcagtatttcagtcatttttttttctatgtagaaatatatgtttcacattactggtatcaagttgtgtatataccttttccctttattgtggaatataacattgatgcagaaaagtgtgcaaggcctatatgtacagtttaataaggaagtaaaaaatgggccgggcacggtggctcaagcctgtaatcccagcactttgggaggccaaggagggcggatcacgagatcagaagttcgagaccagcctggccaagatggtgaaacccagtctctactaaaaatacaaaaattagctggtcgtggtggtgcctgcctgtaatccc

SEQ ID NO: 155064 - DNA, 601 bp, Human
ggctcacacctgtaatcccagcactttgggagaccaaggtaggcagatcacctgaggtcaggagttcaagaccagcctggccaacatggcgaaatcctgtctctactaaaaatacaaaaattagccaggcatggtggcatgtgcctgtaatcctagctactcaggaggctgaggcaggagaatcccttcaacctaggaggtgaaggttgtggtgagctgagattgtgccactacactccagcctgggcgacagagtgagattccgtctcaaaacaaacaaacaaacaaacaaacaaacaaacaacagcaacagcaaaaaaccttagtggaagacacaatctaagcatttaagggaagagtcccaggccattagtagatgaaggctttcagaagaagagaggttgacctgtcctggtcattatctgccttcagcttcccgggaatgtgtagagcccaccaccatcaggacactagcagagttgtggacatggtattggatatgcagaagaaatatggccaaagagattggactgccctctgtgttttgctttcaagctcaccacagcctgcctccagtacctccagttcccaggtgtagggc

SEQ ID NO: 155065 - DNA, 601 bp, Human
tcaagaccagcctggccaacatggcgaaatcctgtctctactaaaaatacaaaaattagccaggcatggtggcatgtgcctgtaatcctagctactcaggaggctgaggcaggagaatcccttcaacctaggaggtgaaggttgtggtgagctgagattgtgccactacactccagcctgggcgacagagtgagattccgtctcaaaacaaacaaacaaacaaacaaacaaacaaacaacagcaacagcaaaaaaccttagtggaagacacaatctaagcatttaagggaagagtcccagrccattagtagatgaaggctttcagaagaagagaggttgacctgtcctggtcattatctgccttcagcttcccgggaatgtgtagagcccaccaccatcaggacactagcagagttgtggacatggtattggatatgcagaagaaatatggccaaagagattggactgccctctgtgttttgctttcaagctcaccacagcctgcctccagtacctccagttcccaggtgtagggcaacacagaacatccctgtggggtgaagtgagtggcctccactgatctggccagcaggaccaggaa

SEQ ID NO: 155066 - DNA, 601 bp, Human
gcatcaactcaggaagttctgttggatggtgatgcttacagagattctgtttcttacaaaatctcagacttcagttgtacagctttcttgcattgttattaatagatgcatacttatgatatattgaaatcccatttgcacttggccaagtagggtaatggcaagaaaaaagccaagaagcgtgacttacattacgttttcctgtttccccggtgcattatttcaaattcacaaagttgtctcctatcacctctctttgatatggggcaggaggcattcatcaacttgcccaaaaatccargttcttccacatgtctgccttcacctctttgggctatctggataatatttagtgctctagcatagtaacctcacaagtgacttgaacaacggaggttggcttctgaagtcagtgagccacagaggaccttggactctgagcatctttgacacactcatcaagtctccagttcgctttcttgggttttctctgctcatttctgttacatggttagtaaaggccagggaaagaaaaggtgttgaggatccattaccttaattccagaatgattaagtcaagaaacctacaagctctcagaag

SEQ ID NO: 155067 - DNA, 601 bp, Human
ggttggcttctgaagtcagtgagccacagaggaccttggactctgagcatctttgacacactcatcaagtctccagttcgctttcttgggttttctctgctcatttctgttacatggttagtaaaggccagggaaagaaaaggtgttgaggatccattaccttaattccagaatgattaagtcaagaaacctacaagctctcagaagccagtggaattagagtgcactactataaccttgcaaatgtgcatatgcctccttccgaatcaccagagtggagattgggccaatatccaatctmgtcaataatttataaagccagagcattcatccacttcttgcaaagcagctgaatatctatgggggttagtcataatctgagctccttgcaccagagccatttgagctacagaatagcacagagtgtcacagaatagccaaaagtgcagagttatttcagtatgaaagaaggaggagcacctgactgctcctcgccatgtgcagaggaggagcccatgcatttccaaacccaggggttgcttggtttctagcttggtttctgtctgtaccccatcttgctattgtgtgacttgagtaagcc

SEQ ID NO: 155068 - DNA, 601 bp, Human
ttccagaatgattaagtcaagaaacctacaagctctcagaagccagtggaattagagtgcactactataaccttgcaaatgtgcatatgcctccttccgaatcaccagagtggagattgggccaatatccaatctagtcaataatttataaagccagagcattcatccacttcttgcaaagcagctgaatatctatgggggttagtcataatctgagctccttgcaccagagccatttgagctacagaatagcacagagtgtcacagaatagccaaaagtgcagagttatttcagtatgaragaaggaggagcacctgactgctcctcgccatgtgcagaggaggagcccatgcatttccaaacccaggggttgcttggtttctagcttggtttctgtctgtaccccatcttgctattgtgtgacttgagtaagcccatctccacttcctcatcttattagctaggaacaatctatctcaaattcacatgtgcacagagttcagtgcccagcacactaaagcatgttcagtaaatatgttagctgatgttattttcaccatatgattatgatcactctctgttctactgatgggttttata

SEQ ID NO: 155069 - DNA, 601 bp, Human
gcaaactctctgacaatcatgagaagcccagggtccagggggatgagtaagtgtgacctccaggaaacggggcaccactatcagactctatctgtcccatggcttacttctgtgagattcgaaatagtgtagaccttgtcagtccatgagctagtaattatgcccaccaattactgatttatttgcctttctgagatgtgcagtgatcccaaggacaaagatggatttaccttatgtttagaaacttctagaagttgaaatgttcctaacaacctttcctgtggaggttgtacctcacacktagagtgtgtgataagcatttcttttcctaattaaataaaatggagaaaagacacaagcatcagctataaagctcccagtcagtcacagtcaagagactgaatctcatctcttttatttattttttgtgttaactggggattgcattggtctgcacagtgcttgctcccatcctgctccacttgattgagtggctccaggccccctcttgattgctgctgaaatagaactgcccacactgtcggggtatcttccgccgctggtcatttccatgtgccatctgcagttttttctgcctgat

SEQ ID NO: 155070 - DNA, 601 bp, Human
atgagaagcccagggtccagggggatgagtaagtgtgacctccaggaaacggggcaccactatcagactctatctgtcccatggcttacttctgtgagattcgaaatagtgtagaccttgtcagtccatgagctagtaattatgcccaccaattactgatttatttgcctttctgagatgtgcagtgatcccaaggacaaagatggatttaccttatgtttagaaacttctagaagttgaaatgttcctaacaacctttcctgtggaggttgtacctcacacgtagagtgtgtgataagcgtttcttttcctaattaaataaaatggagaaaagacacaagcatcagctataaagctcccagtcagtcacagtcaagagactgaatctcatctcttttatttattttttgtgttaactggggattgcattggtctgcacagtgcttgctcccatcctgctccacttgattgagtggctccaggccccctcttgattgctgctgaaatagaactgcccacactgtcggggtatcttccgccgctggtcatttccatgtgccatctgcagttttttctgcctgatggactactgaggcactgc

SEQ ID NO: 155071 - DNA, 601 bp, Human
tggactactgaggcactgcgtatgttatgctgatggggggtcctgtttcttgacccatcactaatatcttgcaagtcacaggaagctaccagggattcctgagcaaaagcttaaaatgcttcagttctctacaaataagccccattcattgcttttagagtgtgttatcatggagcagacaagtaatcagaacctgagtaatatttgcatattgaggtcttcaaaactccagtgtggctataaaatggtatttaaagttatcaaggagctaggtatgcaggcagaaagaactgtccattgyagaaagcaatgcctctgctcatgtcccagataaccttgctccaaggacaaactggagcttgataacatgaagctgcagatggccggtgagctcagctctgtactcactaaccaccccatgggaggggcactgagccctctatggttggcataaatcccattagaatggtaaagaaatccttttcacaagtacatagaaatcgcttgctaagatttcatgggttttcttgactttgttgtttttgtttgggttttagagggtgggcatgagtcatctctaaaactgttcaggtagttaggt

SEQ ID NO: 155072 - DNA, 601 bp, Human
ttgcatattgaggtcttcaaaactccagtgtggctataaaatggtatttaaagttatcaaggagctaggtatgcaggcagaaagaactgtccattgcagaaagcaatgcctctgctcatgtcccagataaccttgctccaaggacaaactggagcttgataacatgaagctgcagatggccggtgagctcagctctgtactcactaaccaccccatgggaggggcactgagccctctatggttggcataaatcccattagaatggtaaagaaatccttttcacaagtacatagaaatcgcktgctaagatttcatgggttttcttgactttgttgtttttgtttgggttttagagggtgggcatgagtcatctctaaaactgttcaggtagttaggttgtcttcttattcccatttttaagtatttataattagttcttaaaaatttgtccggaggtccacacctccccttggaaaaccttgcctgtacttttcttaatggcacattttaagtttctatgtttcaaaacttgcttatcatataacatgctaatgactaaacacatgcacacctccacaccaatgcaaacgacatgtgggct

SEQ ID NO: 155073 - DNA, 601 bp, Human
ttgctccaaggacaaactggagcttgataacatgaagctgcagatggccggtgagctcagctctgtactcactaaccaccccatgggaggggcactgagccctctatggttggcataaatcccattagaatggtaaagaaatccttttcacaagtacatagaaatcgcttgctaagatttcatgggttttcttgactttgttgtttttgtttgggttttagagggtgggcatgagtcatctctaaaactgttcaggtagttaggttgtcttcttattcccatttttaagtatttataattwgttcttaaaaatttgtccggaggtccacacctccccttggaaaaccttgcctgtacttttcttaatggcacattttaagtttctatgtttcaaaacttgcttatcatataacatgctaatgactaaacacatgcacacctccacaccaatgcaaacgacatgtgggcttgggaacgaggcaagcctgggtttgcatcctgctctgccactagtgggctgtatgattttgggcaacttagttaacctctctgggcctcattggcctcatttgtaaaataagggcaataatagtccctttct

SEQ ID NO: 155074 - DNA, 601 bp, Human
ggaagatggtgagaatggatgatggggtccacttgtaggctgtaccacttgtctggcttgttggagacacctgaccagtaaacaggaagcatcttgttagtattagttaagtgtaaggtgtctttaggaccatacatgttggggccgggcacagtcgcttacgcttgtaatgctggcagttttggagaccaaggtgggaggatcccttgaggccaggagttccacaccagcctaagcaacaaagcaagaccccttctctatattaaaaacaaacaaacaaacaaaaaacccgtatgttgasagtgcactaaaggggtaagcctggaaaagtggagaggattttacagaaaggggaatcttttttattattttaatatattttttaaagccagtcaaatggagcagtagggggttgtatactgacaccgagaaggggagtcttgggttgggtcttgaaatcaatgttagttctccttcaagacagggttacactaacataattttagattcttatcccaagtctgccttacttgattctaggtgactggagttgcagcttagtaggtgggctctagaaatgtgatcatttggccaaggttgg

SEQ ID NO: 155075 - DNA, 601 bp, Human; identical to SEQ ID NO: 33832

SEQ ID NO: 155076 - DNA, 601 bp, Human; identical to SEQ ID NO: 33833

SEQ ID NO: 155077 - DNA, 601 bp, Human; identical to SEQ ID NO: 33834

SEQ ID NO: 155078 - DNA, 601 bp, Human; identical to SEQ ID NO: 33835

SEQ ID NO: 155079 - DNA, 601 bp, Human; identical to SEQ ID NO: 33836

SEQ ID NO: 155080 - DNA, 601 bp, Human; identical to SEQ ID NO: 33837

SEQ ID NO: 155081 - DNA, 601 bp, Human; identical to SEQ ID NO: 33838

SEQ ID NO: 155082 - DNA, 601 bp, Human; identical to SEQ ID NO: 33839

SEQ ID NO: 155083 - DNA, 601 bp, Human; identical to SEQ ID NO: 33840

SEQ ID NO: 155084 - DNA, 601 bp, Human; identical to SEQ ID NO: 33841

SEQ ID NO: 155085 - DNA, 601 bp, Human; identical to SEQ ID NO: 33842

SEQ ID NO: 155086 - DNA, 601 bp, Human; identical to SEQ ID NO: 33843

SEQ ID NO: 155087 - DNA, 601 bp, Human; identical to SEQ ID NO: 33844

SEQ ID NO: 155088 - DNA, 601 bp, Human; identical to SEQ ID NO: 33845

SEQ ID NO: 155089 - DNA, 601 bp, Human; identical to SEQ ID NO: 33846

SEQ ID NO: 155090 - DNA, 601 bp, Human; identical to SEQ ID NO: 33847

SEQ ID NO: 155091 - DNA, 601 bp, Human; identical to SEQ ID NO: 33848

SEQ ID NO: 155092 - DNA, 601 bp, Human; identical to SEQ ID NO: 33849

SEQ ID NO: 155093 - DNA, 601 bp, Human
atctcagggtgggagacaagaggggggactcattgtccggagggaggctctggagggagacagccctgggtcaacccgactgtgtccccacacccaggactgccccatggcccctccagacctgctccagaggcccttctccggctaccccgtgctctccccgctaaccgtgttgccccatgacccgctcagaactgatgagatcaagggaatgttcaagcgaaaagccgagcaggacggaccttccaagatgtgcctaaaggaccagaagagggactcagggcagactggaggcagcagrcactggccccgctccaagcccggccccaagccccgcccccatcgctagacccgccccacccatccataagcccctcccctccatcgatagacccgcccccattgatagccccgccccatacagctatcagcccgcccccgatccagggcatccttctcactggattctccctccttccccaaggcccctcacctctgcgcccagtcccttcccctgcagcctctctctctagacttcggagcctctgcttccccgccccccttccccagctttcttctccctcccggggccgccccctcc

SEQ ID NO: 155094 - DNA, 601 bp, Human
tctccacatgggaggaatgttctggagggggtaacagcctattaaactcatctagctttttttttttttttcaaactccacagcttgcctccctaccctactagactagattgcacagaggcagggcaggcacgggaaacgactctggttggaaattacaaacatatacacacagaatgcaagcaccataaccctttgaatacacagtggtttgtgccttgccccagacctacctaaggatttaaacagcacagaagtcggagttcggctgactgcatgacactctcctatcaatcgggtraaacaaagacccagtactctaagcttaaagcattccaggcaaaattttagttaacaggcaataggaaggtgtgataggccagtgctaacaagaaagccacagatgggtttctttgagctgttaagacactggaaagggctggtatggaagcccagtggagccattaggacaatggaaaaggaggtacccctccaccaggcactttgcagagaaaactatactctggaagctgcctgcactgttgatagggctagacgtatgataaacagctaaccggaggggcacccgaggagacaaact

SEQ ID NO: 155095 - DNA, 601 bp, Human
agctaccaggatggtacctaaaattatcttttgaggttcagtgaggcctcataattcccttaaacagtcaagtcatagaatactttgaaatcccagaagtcaagttaatagtattactcggctagctatataataaaaaccaaactggtatcctggctaggaggccctggaaaagtcacaacttctcagggacacaagttttttttgtttgtaaactgatggtgctggactaagaatccttctagttcttaaagtttaagataattaacttaagatttcatgtcaaaaagaaaagagccaraggctgggtgcggtggctcacgcctgtaatccctgcactttgggaggctgaagcgggtggatcacgaggtcaggagttcaagaccagcgtggccaagatggtgaaaccccgtctcgactaaaaaaaaaaaaaaaaaaaaaaaaaaaatacaaaaattagccaggcgtggtggcaggtgcctgtaatcccagctacttgggaggctgaggcagagaactgcttgagcccgggaggcagaggttgcagtgagctgagatcgtgccactgcactccagcatgggtgacagagtgagactgtct

SEQ ID NO: 155096 - DNA, 601 bp, Human
gctctcagctcagctgacctgcttcaaggtgaactgaagttgcagatcaccagttccggctctaatctgacgcccgcccccagatcacgctgtggcgaccaagtaaccctacacacactgacctttcagggctcagggaagtgacttttttttattatatggcacagtttggcacagttatgtctttagtctttggggtacttttatactgtccaagagtagtatatttttttcctcttttccttttttttttttttttaaaaaaaaaaaaaacagatggccaaaccaggacatatactawaaaaaaaaaaaggaaggttacttacctgagccctaacatcccagctaccatggaatcctgttggagctggtctacagaagcaaggtgtattctggggagtcacatgtcacatcaaagcaggaactggtgagtctgtatttttatggagcctaaaacaaagaaaattgtaagttgaaagcccccattgagctgcacgacctttttcccagggctatttgggacattttgaagataaacacatagacaaagtactaggctatttcccagcttacctagctagaaacaaaggataagctgcaa

SEQ ID NO: 155097 - DNA, 601 bp, Human
aaaggggagaagtgggagttagtgtttaataggtatgaaatttcagttttgcaagacgaaaggttgtagagatggatggtagtaatggctgtacaacaatgtgaatgtactcagtgccactgaactgtacagttaagatgattaaaactgtaaattgttatatatatcgatatatattttttgagacggagtctcggtctgtcgcccaggctggagtgcagtgacgcgatctcggctcactgcaagctccgcctcctgggttcacgccattctcctgcctcaggctctcagagtagctggractacaggcgcccgccaccatgcccggctaattttttgtatttttagtaaagacgaggtttcaccgtgctcgccaggatggtctcgatctcctgacctcgtgatcagcctgcctcggcctcccaaagtgctgggattacaggcgtgagccaccacgcccagcctgttatatatattttataataaaaatttaacacacgggtacacacacgcttttttttttgagatggagtctcattctgttgccaggctggagtgcagcggcgtgatctcagttcactgcaacctctgcctcccaggt

SEQ ID NO: 155098 - DNA, 601 bp, Human
ctactaaaaatacaaaaaattagccgggcgcggtggcgggcgcctgtagtcccagctactcgggaggctgaggcaggagaatggcgtgaacccgggaagcggagcttgcagtgagccgagatcgcgccactgcagtccgcagtccggcctgggcgacagagcgagactccgtctcaaaaaaaaaaaaaaaaagaaagagcagaatcaaggatgactcctagaattttggactgagtaactgggtggatgttgatattgtttactgaaatagagacaacatgaggaataggtttgaaggggraaaaaaatcaagactgggacttgttaaatttgagacacttatgagcaactcaagtaaatgctgacgaggccatcaaatctggagctcaagagagaggtttgaaatgcagaaacagggttgtagccatcagcaggcagacatatcatcattcagagtcatgaacatgcagaaataatggaaatgcctcttaattaaatgaaggcatagacatacaacgaaatgttatgtgattactaaaaatgatggtagaaaaacattatccagaagttatctttatctgtagatgacagatttatggac

SEQ ID NO: 155099 - DNA, 601 bp, Human
aattagccaggcccagctactcaggaggttggggcagaagaattgcttgaacccgggaggcggaggttgcagtgagccaagattgcaccactgcactccagcctggatgacgagaatgagactccgtatcaaaaaaaaaaaagaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagatcgcgccactgcagtccgcagtccggcctgggcgacagagcgagactccgtctcaaaaaaaaaaaaaaaaagaaagagcagaatcaaggatgactcctagaattttggactgagtaactgggtggatgttgatattgtttactgaaatagagacaacatgaggaataggtttgaagggggaaaaaaatcaagactgggacttgttaaatttgagacacttatg

SEQ ID NO: 155100 - DNA, 601 bp, Human
taaaaatacaaaaaattagccaggcccagctactcaggaggttggggcagaagaattgcttgaacccgggaggcggaggttgcagtgagccaagattgcaccactgcactccagcctggatgacgagaatgagactccgtatcaaaaaaaaaaaagaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagatcgcgccactgcagtccgcagtccggcctgggcgacagagcgagactccgtctcaaaaaaaaaaaaaaaaagaaagagcagaatcaaggatgactcctagaattttggactgagtaactgggtggatgttgatattgtttactgaaatagagacaacatgaggaataggtttgaagggggaaaaaaatcaagactgggacttgttaaatt

SEQ ID NO: 155101 - DNA, 601 bp, Human
acaaacaagttaaattatatcacaagaaaagagagacatctaaaatgtgggccagctagtcgtggtggcacaagcctgtagtcccagctacctgggaggctgaggcaggaggattacttgaggccaggagttcaaggccagcctaggcaacatagtgacacgccatctctaaaaatatgtatcttaaaatgtgggcccttctagatgacaattgggctgactgcttcaaaaagtcagtatcacaagtgaaggagaggtgggtaggctgttcttgttaaaagagacaaaggggctgggcatrgtggctcacgcctataatcctagaactttgggaggccgaggcgggcagatcacttgaggtcaggagttcaaaaccagcctggccaacatggtttagtagaaaccctgtctctactaaaaatacaaaaaagttagctgggcgtggtggtgcgtacctgtaatcccagctatttgggaggctgaggcaggagaatcgcttgaacctggaaggcggaggttgcagtgagctgagatcacaccactgcactccagcctgggagacagcgagactctgtctcaaaataaaataaataaataaata

SEQ ID NO: 155102 - DNA, 601 bp, Human
aggtcctccccccatccctggcggctcaagaaccagccccatggaagagagaccaagtctgtccttagaggaaacaaataatattctcagagaaatcttagaatacagaatagtcataaaatcagaacagaaacacccataaacaagaaataaacagatgataaaagaaaagtatcaggcagggcatggtggctcatctctggtgacaccacaccaggcgtggtggcccagcactttggggggcagaggtgggaggatcacttgagcccaggagttcaagaccagcctagacaacacagasacacaccagcccatgtctacaaaaaatttaaaaattagccaggcatagtggcacgtgcttgtagtcctagctacgcaggaggctgaggcaggaagaccacttgagcccaggagttcgagtctgcagtgagctatgtatgatggcaccactgcactccagcctaggtgacacagtgagactctgtctcaaaaaaaaaaaaaaaagtatccattaaaatattttcaccctttaaaaatcaggttgtctttttattaccgagttataggaattcttctgaatacaaatcctttgtcagatatg

SEQ ID NO: 155103 - DNA, 601 bp, Human
tgagggtccatggggcaagagctgacccctgcctcgcctccacagaacttctccaaaccacccttcagagacagaccccgcaggcaacgggccactccaccacagcagagaaggggcagcgcagcagctacccaggtcctccccccatccctggcggctcaagaaccagccccatggaagagagaccaagtctgtccttagaggaaacaaataatattctcagagaaatcttagaatacagaatagtcataaaatcagaacagaaacacccataaacaagaaataaacagatgataaaagwaaagtatcaggcagggcatggtggctcatctctggtgacaccacaccaggcgtggtggcccagcactttggggggcagaggtgggaggatcacttgagcccaggagttcaagaccagcctagacaacacagacacacaccagcccatgtctacaaaaaatttaaaaattagccaggcatagtggcacgtgcttgtagtcctagctacgcaggaggctgaggcaggaagaccacttgagcccaggagttcgagtctgcagtgagctatgtatgatggcaccactgcactccagcctaggtg

SEQ ID NO: 155104 - DNA, 601 bp, Human
tgaggctgatgctgttggggctggtgagcagagcaaacttggagtggcaaggtgccacttcttccctcaggcaagaaatcaatgggtcttttctaaatcaacagctagaaccttcccttccccggcccccaccccacccaccccaaaggctcttgatgtggctggcagcagcccaggtgatgcctaccttttcccagtctctgagggtccatggggcaagagctgacccctgcctcgcctccacagaacttctccaaaccacccttcagagacagaccccgcaggcaacgggccactccaycacagcagagaaggggcagcgcagcagctacccaggtcctccccccatccctggcggctcaagaaccagccccatggaagagagaccaagtctgtccttagaggaaacaaataatattctcagagaaatcttagaatacagaatagtcataaaatcagaacagaaacacccataaacaagaaataaacagatgataaaagaaaagtatcaggcagggcatggtggctcatctctggtgacaccacaccaggcgtggtggcccagcactttggggggcagaggtgggaggatcacttgagc

SEQ ID NO: 155105 - DNA, 601 bp, Human
ataagacagaggtaatgaatatatgtagaatcctgcacccatgcttggtggtgacatattctgtccactggttgtggataatgtgtcatggagcacttctcaaccaactgcaagaactggtgtcacacagaccaagttctttgatcacagtgccatttagttagaagttgattttttctttttttcttttttttttttgagacggagtattgctcttgttgcccaggctggagtacactggcacaatcttggctcactgtgaccactgcctcccggttcaagtgattctcctgcctcagcmtcccgagtagctggaactacaggtgtgtgccaccatgcccggctaattttgtatttttagtagagacgaggttttggcatgttggccaggctggtctcgaactcctgacctcaggtgatctgcccgcctcggcctcccaaagtgctgggattacaggcatgagccacctcatgcagtcaatttttttttctagagcaactaggaaaaaaaaaaaacaaacccaaagccatgtgcttggaaattgaaaaacacattttaaaataatatgtgagtcaaaggaagaaacaaagaaaatttaaa

SEQ ID NO: 155106 - DNA, 601 bp, Human
tgccccgtcccccagaaaccaccctagggagcgggcaacgccctgggaatttgcagtcagtaagctggagagaagcaaccaagtgggagtccttcactttttccttttagacccagaaactccagctgggaggtgcaggagaaatggcaaagtgcccagtgagccagcccagctctgtgggaagcaactgctcttaggtatacacagattatggaaccacccagagactgaggtgccccctatccccatggaaatggcacacacatccctcgtgcagctagagtgagccttagtaagacawccaacacagttcttagaacaaagagaagaatccagatagggctgaagactacatggctgcagctccctccagcgtgcaaattctctccggatacaagataacaagcctgcacgcgatagctcagaggggaaaacagcaagagaagatgccaagaaactgggaagagagagccaagaattcctccactgtctcaaagcaaacagaacgactatgcagagccatccaagcctgagccaagacgaaaagaagtgacatggtaactaggcaaacatattatggccagaagaaaaaaaagaggcc

SEQ ID NO: 155107 - DNA, 601 bp, Human
tgtctccacaaatctgcctactgttgacacttcatataagtggaataataccctcccctggaaagcctgtcttttaaaaaatgattttcatttaaaaaagtttttttgcttaacacagtggctcatacctgtaatcttaggaaggcagaggcaggaggattgcttgggcccaggagttcgagatctgcctgggcaacatagtgagatcccgttattcacaaaaagggggaaaaaagaccaggaaaaaaaaaaatcccaaaactaaacaacgaaaaagttttttttagggagatagggtctygctgtgctgcccaggctgggctcaagcgatcctcctgcctcaggctctcaagtagctgggactacagatgagctaccacgcccaacttagaaacatgtatttttttcagattagctcatcattccctggtaacttctccaatgatttccccttgcatctctgccactatattctagcagggttctcacactgatcctacacacaagtggttagagactcaccaggccaagctcacctccaattccaaatacctagtcctcaaggtccaagtggcctgtttccatagacactgacactgtg

SEQ ID NO: 155108 - DNA, 601 bp, Human
ggttcacatcagtgctagtcaccgccttgcggctggtctaccccaagagacttcccctcttgtctacactgcacagactgtgcaatgagggcaccatggcactcactggcaagcatccttaggaaaccagaactcaaatgatgtagggaagttaccaaaggctgcttagtgctgggactcagaagctgcaaggacgtatctctccagaaccatcaggtcaggtgtagggaggcaagagatgttccaatctagtgacaaggtcttagagtgagggaatgtcttgtccccaccatgactcacscctgagttcctccctatcctgtatcttcctccagaagtttagggcccagagtgtggctgccagagtcacctagagccactgcatacacaaaggcatcctacaacccacagagcagtctttcttgctgtaaagaggggtccctaatctgtcccagcacagagctcgccttgttttgttttttgttttttttttgagatggagtctcgctctgttgccgatggcataatatcggctcatcgcaacctccgcctgccgggttcaagttattctcctgcctcagcctccggagtagctgggatc

SEQ ID NO: 155109 - DNA, 601 bp, Human
cccggcctgaccccaggccagcctgcctgcaccttgtcctactgcctccatggcctctagcgccacccgttggaggacgtcccttgagaatggaccatgccacctcaccctgggccatcctctcctgtggttcaggccagtctacacccagtagttcaagggactcccccctcctagccatgccagagctggagcagacaggtgccactttcctgtcctgtgaagcgtccttgccagttttggattggggctggtgtggggccagacttgagccaccacgggtgggatcgcacaggccattgccactggtcatatccatcttctctaaagaatccaactgtctctcctgcctcacacctccctgtcccaacgtggttgggagtgggggaggtggggggagctgggggagctgtagacggggcactgatggcaccgaaaacgggagtgtcctctcaactgctctgtcgctctgtctctaacgaccacatgggggaaaggtttgggcgggaggggaggtgcctggtcaacagcttgtctggtcagtagtatctgcagcaagccttgttgaaggagcctagtttagaaaagtgcaaagctactt

SEQ ID NO: 155110 - DNA, 601 bp, Human
ctcccttctgcacagggtggcctgtgttactggcaatgctgtccatagctctcggcctctgggctggcacaggggagcatgacttcaactcaggagggggcagacaccctgcctagctcttccagatgctgcacccggcatgcaatggtcactacagtcagcactctccgcctctcagaggagggaggggctgtcaggtgttttgggagcccaaaaccatgcctaatgagggtaatggcttttctaaggagatgttttcgccatggaatgggaaggggttttctcacatctaagttttgckggcgatcgggtgacagccaagagagtgcaagccccctccatggtcattttattgccctgggaaggggagggtggggaatagagatgtcacagtgttgagccctggaggatggggtgggatgtgacggaagtgtcttaaacagtaatgcccacggggcacaccttggagagagaatgcccaccacctggcctgtccaggaagagctgcatctgccaacattagcctgacctgtgcccacagcagagcgtcccagcctcctgcttgggtgggcccagccccattctccccagctcttcagct

SEQ ID NO: 155111 - DNA, 601 bp, Human
ctgcccctacagtcactttcctgtgggggctgccctgctcacccaggaggggagaatcttcaaaggtaaaggtgggcaccccagggtcccccagcccagcagcctgggtggtgggtcagaggaagatgtacaggaagaggcgcagaggcacaggcagtggcaagagcgcggctctgtcccttcttcccccagtctccgctggaatgttcctaccctgccgactgccccagaccgcgctcaaatgtggcttaaatccagggtctttcaatgcttagaggactgggatgaggaaggaagttgratgggaggcaggaaggggaggccataaatcaaaaacatcaacagtcctggggtgcaggcagggagagcgttcgtgctttcccagcctcggatatgtctggcaccttactgaggcttccacaacactaagtccacacctcctgcccactgacctaagtgttaatgctcgtctttagatgaaactacggaggtctcgagaggtgacatgacttgcccaaggtcacacggggcgctggtggtgaaaccctgggctggaggttccccaaagccctgctctcttccttccacccactgtgctcag

SEQ ID NO: 155112 - DNA, 601 bp, Human
aaggtgggcaccccagggtcccccagcccagcagcctgggtggtgggtcagaggaagatgtacaggaagaggcgcagaggcacaggcagtggcaagagcgcggctctgtcccttcttcccccagtctccgctggaatgttcctaccctgccgactgccccagaccgcgctcaaatgtggcttaaatccagggtctttcaatgcttagaggactgggatgaggaaggaagttggatgggaggcaggaaggggaggccataaatcaaaaacatcaacagtcctggggtgcaggcagggagagsgttcgtgctttcccagcctcggatatgtctggcaccttactgaggcttccacaacactaagtccacacctcctgcccactgacctaagtgttaatgctcgtctttagatgaaactacggaggtctcgagaggtgacatgacttgcccaaggtcacacggggcgctggtggtgaaaccctgggctggaggttccccaaagccctgctctcttccttccacccactgtgctcagtgctggccagggtggtgacgtgtttgtcgggggtggtcggtggagaatcttggaggagaaaagccagc

SEQ ID NO: 155113 - DNA, 601 bp, Human
ccagaccgcgctcaaatgtggcttaaatccagggtctttcaatgcttagaggactgggatgaggaaggaagttggatgggaggcaggaaggggaggccataaatcaaaaacatcaacagtcctggggtgcaggcagggagagcgttcgtgctttcccagcctcggatatgtctggcaccttactgaggcttccacaacactaagtccacacctcctgcccactgacctaagtgttaatgctcgtctttagatgaaactacggaggtctcgagaggtgacatgacttgcccaaggtcacacrgggcgctggtggtgaaaccctgggctggaggttccccaaagccctgctctcttccttccacccactgtgctcagtgctggccagggtggtgacgtgtttgtcgggggtggtcggtggagaatcttggaggagaaaagccagctgggctttcggagtccagcagtgagcagcgccctgcggggcgggggcgggtaatggaacctgagcccatctgagtctgctctaatctgttcctaaactcttttctttgatttattgcttttgtagaaaagttcatgtgagcaaaaattcaagcttgtt

SEQ ID NO: 155114 - DNA, 601 bp, Human
cacacctcctgcccactgacctaagtgttaatgctcgtctttagatgaaactacggaggtctcgagaggtgacatgacttgcccaaggtcacacggggcgctggtggtgaaaccctgggctggaggttccccaaagccctgctctcttccttccacccactgtgctcagtgctggccagggtggtgacgtgtttgtcgggggtggtcggtggagaatcttggaggagaaaagccagctgggctttcggagtccagcagtgagcagcgccctgcggggcgggggcgggtaatggaacctgarcccatctgagtctgctctaatctgttcctaaactcttttctttgatttattgcttttgtagaaaagttcatgtgagcaaaaattcaagcttgtttttgctaagcttagaggcattctccttcagggcagtaggggacatggtgtggaggtaccccttggtattattccctgtctgttgaggttctgtcgggtgtgacttgcctgggtcttaaacatctttgagtgggagaagcaggtttgattgagtgctaacagcctgtgaaaggaaggtgattaatgctatccatttaacccctgcaa

SEQ ID NO: 155115 - DNA, 601 bp, Human
gctggtggtgaaaccctgggctggaggttccccaaagccctgctctcttccttccacccactgtgctcagtgctggccagggtggtgacgtgtttgtcgggggtggtcggtggagaatcttggaggagaaaagccagctgggctttcggagtccagcagtgagcagcgccctgcggggcgggggcgggtaatggaacctgagcccatctgagtctgctctaatctgttcctaaactcttttctttgatttattgcttttgtagaaaagttcatgtgagcaaaaattcaagcttgtttttgmtaagcttagaggcattctccttcagggcagtaggggacatggtgtggaggtaccccttggtattattccctgtctgttgaggttctgtcgggtgtgacttgcctgggtcttaaacatctttgagtgggagaagcaggtttgattgagtgctaacagcctgtgaaaggaaggtgattaatgctatccatttaacccctgcaaccctgaaaggcagagaaggaaacaggtttggaaagtttcagagctcgaaatcacagagctgggattggaacccagacttcccctgactccaaaagctgt

SEQ ID NO: 155116 - DNA, 601 bp, Human
ttgtgccattgactttctcgtgctgtgacgtagcacctgcctggctcagaacaggcactcaataactgttgagtgactgattggatgaatgaatgagatgagtacgtttggagaagcagaaggaagagggatggtggggcaggtggtggtgatgggggctcagcatgttcggccacagcatttcctggcctgtggggccagcatggctgccttccatccatgctttccagcactggaactggtgttctgcttggaacagcaggaggtcagacagcctcatcgtgcctccagagccaggggkcccccatgccagaatgctcgggtcctttcttgttttaaaacccacaatagtcgggcatggtggctcacgcctgtaaccccagcactttgggaggccgaggcaggcggatcacgatgtcaggagatcgagaccatcctggctaacacggtgaaactccatctctactaaaaatacaaaaaaaaatagccgggcgtggtggtgggtgcctgtagtcccagctactcgggaggctgaggcaggagaatggtgtgaacctgggaggcggagcttgcagagagccgagatcgtgccactgcactc

SEQ ID NO: 155117 - DNA, 601 bp, Human
ctgtggggccagcatggctgccttccatccatgctttccagcactggaactggtgttctgcttggaacagcaggaggtcagacagcctcatcgtgcctccagagccaggggacccccatgccagaatgctcgggtcctttcttgttttaaaacccacaatagtcgggcatggtggctcacgcctgtaaccccagcactttgggaggccgaggcaggcggatcacgatgtcaggagatcgagaccatcctggctaacacggtgaaactccatctctactaaaaatacaaaaaaaaatagccrggcgtggtggtgggtgcctgtagtcccagctactcgggaggctgaggcaggagaatggtgtgaacctgggaggcggagcttgcagagagccgagatcgtgccactgcactccagcctgggcgacagagcgagactctgtctcaaaaacaaacaaacaaaaaaaaacaaacccacaataaaggaggcacactttcactcataagtgacacctgggagctccttccagtgaagtccacacctctgtcaccctcatactgatcattcaacagatatttgctgaacatcaactctgttccaggt

SEQ ID NO: 155118 - DNA, 601 bp, Human
agcatggctgccttccatccatgctttccagcactggaactggtgttctgcttggaacagcaggaggtcagacagcctcatcgtgcctccagagccaggggacccccatgccagaatgctcgggtcctttcttgttttaaaacccacaatagtcgggcatggtggctcacgcctgtaaccccagcactttgggaggccgaggcaggcggatcacgatgtcaggagatcgagaccatcctggctaacacggtgaaactccatctctactaaaaatacaaaaaaaaatagccgggcgtggtgrtgggtgcctgtagtcccagctactcgggaggctgaggcaggagaatggtgtgaacctgggaggcggagcttgcagagagccgagatcgtgccactgcactccagcctgggcgacagagcgagactctgtctcaaaaacaaacaaacaaaaaaaaacaaacccacaataaaggaggcacactttcactcataagtgacacctgggagctccttccagtgaagtccacacctctgtcaccctcatactgatcattcaacagatatttgctgaacatcaactctgttccaggtaaggtgccag

SEQ ID NO: 155119 - DNA, 601 bp, Human
aggtcagacagcctcatcgtgcctccagagccaggggacccccatgccagaatgctcgggtcctttcttgttttaaaacccacaatagtcgggcatggtggctcacgcctgtaaccccagcactttgggaggccgaggcaggcggatcacgatgtcaggagatcgagaccatcctggctaacacggtgaaactccatctctactaaaaatacaaaaaaaaatagccgggcgtggtggtgggtgcctgtagtcccagctactcgggaggctgaggcaggagaatggtgtgaacctgggaggyggagcttgcagagagccgagatcgtgccactgcactccagcctgggcgacagagcgagactctgtctcaaaaacaaacaaacaaaaaaaaacaaacccacaataaaggaggcacactttcactcataagtgacacctgggagctccttccagtgaagtccacacctctgtcaccctcatactgatcattcaacagatatttgctgaacatcaactctgttccaggtaaggtgccaggtgctggggatatcacagtgaacagggatgacacaatccctgcccccatggcagtcccctcata

SEQ ID NO: 155120 - DNA, 601 bp, Human
agccaccgcacccagccagctcacacattttaagccagggatcataaaacccacctttcaggatgactgtgaacagaaccagattcagctggtatgctggtatgcctggcacgacacggcatggcaggcagcattcactctgatcggttggtgcctgcgctgagtatgtagaatttcacccctggttgtgaggctttaaatgagtaaatgcttataaagcattcagcgcattttctgcctcgtaataagaaggtcacaaatgatagctgcttctgctaccactattaatgctatcattatycttattatctggaggcagattgtggaggacttttggaggccaaacagagacactaagatttgaagaggtaggaagtagggagccaaggaatgttattaagaagaagagtaacataaaagtggtgtgtgatgacatttagtgtgacaggtgctcagcaagggcggggacagaggaacagtgtcagggtacagtatctgctccactcactgacctgtctgcagtgtcagcacacttcctggcctatcactgggcctctgtaaggtttgttgaacacatgaatgaaaggcttctactaggact

SEQ ID NO: 155121 - DNA, 601 bp, Human
taaggtttgttgaacacatgaatgaaaggcttctactaggactgggacaggtagaatgaagagaaaggaatgatccgagagatattgtgtgggacacatggaccgggcctggcatgggcagtgttacaaataaaggctgggtgcggtggctcatgccagtaatcccagtgctttgggaggatgaggctggaggatcccttgagtccaggagttcgagaccagcctggacaacatggcaagacgtcgtgtctacaaaaagtacaaaaatgagctggatgtggtggcgtgcatctgtggtccyagacacttgggaagctgagatggagggatcacttgagccccaggagttcgaggctgcagtgagctgtaatcacaccactgtacatcagctgggcgacagaatgagaccctgtctcaaaaaataaaaaacaaaataagaaataaagtaaaggcacatggctttaggatcgccagccaggtggcccaggtgaatgatgatgaggcactgactgaggtgaggcattgaaggcatggctggactgtgtgctggggacgtgctgggcagggaccagcagcagtattcgaagctacaatggagtga

SEQ ID NO: 155122 - DNA, 601 bp, Human
acatggtaaaaccccatctctactaaaaatacaaaaaattagccaggtatggtggtaggtgcctgtaatcccagctattcaggaggctgaagcaggagaatcgcttgaacctgggaggtggaggttgcagtgagccgagatcacaccactgcactccagcctgggcgacagagcgagacgccatctcaaaaaaaaaaaaaagaaagaaagataaaagaaaagaaagaaagcaaagaaaatggtccacggaaacggagtcagctccgggccttgcacatggctgaggctcagccggtgttcrtgcagcgccgggtgggtgatgggcagggaagagaaggaccacctgtaaccctaggggcactgcacgaggtgtccctgggctcgtggggagtatgcatctggcgatgagaccacgacagtgccagaaagggtcccaggatggtgcccagacacaagacttcttggctgtagtttctgccaactctgctggcacaacccaagggatgggagggtttatcttcttcagctcatgaccttaggacagtggtctctctccctctttcctcctcctttcctctccgtctgccatttagggaaaaag

SEQ ID NO: 155123 - DNA, 601 bp, Human
atctcacaggccaggatgcatgttttggcctcctgccaccagccttcacttttaccttctgtaaaatggtgttctaacagtatttaccttacccaacagttaaaaggattaactgaccttatgcaggtaaagcactccacagagtgcctggcctatgagtgcccagtaaaagaaagcaattagtaatactggcactatgatcgtagtattatttggtcctatcttattattatggatttctaacttagcaccatcccaatctctctcatgtatgttttgaagtaagcaaaggcaatagcaraaacagaattggtttgcctggtcagaagacagcctgctttctgggctgagagaagcaaaacaaaattgcacagcatttcaggatgcagtacgtgggcaaaggcttccttcctttttttttatttgccttttttttttttttgagctagaaaattcaaggaaattgcttgaatttgttacaggctccaaatacagttattcctctgcgtcttaagcatctagcactgaagtggaaaattccactctttcaataatggttagccatcttagctcaggccatgctgtggtttgaaggtttgcc

SEQ ID NO: 155124 - DNA, 601 bp, Human
gtaaaagaaagcaattagtaatactggcactatgatcgtagtattatttggtcctatcttattattatggatttctaacttagcaccatcccaatctctctcatgtatgttttgaagtaagcaaaggcaatagcagaaacagaattggtttgcctggtcagaagacagcctgctttctgggctgagagaagcaaaacaaaattgcacagcatttcaggatgcagtacgtgggcaaaggcttccttcctttttttttatttgccttttttttttttttgagctagaaaattcaaggaaattrcttgaatttgttacaggctccaaatacagttattcctctgcgtcttaagcatctagcactgaagtggaaaattccactctttcaataatggttagccatcttagctcaggccatgctgtggtttgaaggtttgccccctccaaaatgcataagcgtactttggagggcttctcttttcaaatttattatttatatacacttttagagacagggtctcgctatgtttaattgccaatgcaacagtgttgggaggtgggacctaataagaggtgtttaggtcatgagggctctgcccggtga

SEQ ID NO: 155125 - DNA, 601 bp, Human
cttattattatggatttctaacttagcaccatcccaatctctctcatgtatgttttgaagtaagcaaaggcaatagcagaaacagaattggtttgcctggtcagaagacagcctgctttctgggctgagagaagcaaaacaaaattgcacagcatttcaggatgcagtacgtgggcaaaggcttccttcctttttttttatttgccttttttttttttttgagctagaaaattcaaggaaattgcttgaatttgttacaggctccaaatacagttattcctctgcgtcttaagcatctagmactgaagtggaaaattccactctttcaataatggttagccatcttagctcaggccatgctgtggtttgaaggtttgccccctccaaaatgcataagcgtactttggagggcttctcttttcaaatttattatttatatacacttttagagacagggtctcgctatgtttaattgccaatgcaacagtgttgggaggtgggacctaataagaggtgtttaggtcatgagggctctgcccggtgagtggatgaataccgctataaaaagggcttacagtatggattctctctctttcactct

SEQ ID NO: 155126 - DNA, 601 bp, Human
ataaaataaaataaaataaaataaaataaaataaaataaaacaaaataaaataaaataaaaataaaggatttcaaagtgcctgaaggacagggacaggaccactgtcataccttgttgagaaggtgcagagggtcacatagccctactgccaccaaagccttgatttttatgcaattgataacagcagcagctaacagctgccgaccatttcctctgtgccaggctttgtgttaagtgctttacacgagtgatctcaatttattctcacaacaggactatgagggagattctatcattagygatttacaaatgaagccagtgagcctcaaagaggttcagtccctttccccaattctcagagccagttgggcaaagagtcccagggcagaatgaaacctaatggaacctctttctacagggtgctgtttgagtagtggggcatgtgagtgtgccccctgccacaaccatctttctttctcattaactggcctattacatgttttacacaaagtaaaggaagatttctgtctctgaggcctttctgaacttccagagcagacacatgtgaccatcctgagagactgggtcttctgcaagtgt

SEQ ID NO: 155127 - DNA, 601 bp, Human
aaaataaaataaaataaaataaaataaaataaaataaaacaaaataaaataaaataaaaataaaggatttcaaagtgcctgaaggacagggacaggaccactgtcataccttgttgagaaggtgcagagggtcacatagccctactgccaccaaagccttgatttttatgcaattgataacagcagcagctaacagctgccgaccatttcctctgtgccaggctttgtgttaagtgctttacacgagtgatctcaatttattctcacaacaggactatgagggagattctatcattagcgwtttacaaatgaagccagtgagcctcaaagaggttcagtccctttccccaattctcagagccagttgggcaaagagtcccagggcagaatgaaacctaatggaacctctttctacagggtgctgtttgagtagtggggcatgtgagtgtgccccctgccacaaccatctttctttctcattaactggcctattacatgttttacacaaagtaaaggaagatttctgtctctgaggcctttctgaacttccagagcagacacatgtgaccatcctgagagactgggtcttctgcaagtgtgg

SEQ ID NO: 155128 - DNA, 601 bp, Human
tgtgttaagtgctttacacgagtgatctcaatttattctcacaacaggactatgagggagattctatcattagcgatttacaaatgaagccagtgagcctcaaagaggttcagtccctttccccaattctcagagccagttgggcaaagagtcccagggcagaatgaaacctaatggaacctctttctacagggtgctgtttgagtagtggggcatgtgagtgtgccccctgccacaaccatctttctttctcattaactggcctattacatgttttacacaaagtaaaggaagatttctstctctgaggcctttctgaacttccagagcagacacatgtgaccatcctgagagactgggtcttctgcaagtgtggaaatgtgctttaacggcatgtcagcaaaacccaagatctgcatgcatcacttttgatgggaaaagtgtcagactttagtcagggatcgggcagggaagctggaagggcggggctgggagagtcactaggctgggagtgaggctggcagggactgtaatctgggagagaggcagaaaccaagtgtagggatgtcagtgaaggtgggagtggtgagcagatatggca

SEQ ID NO: 155129 - DNA, 601 bp, Human
taaagaaagtcattttcaggggctgggcatcttagctcacacctgtaatcccaagattttgggaggccgagctgggcggatcacttgaggtcaggagttcaagaccagcctgaacaacatggtgaaaccccatcttcactaaaaattaaaaaattagccaggcatggtgatgcacacctgtaatcccagctattagggaggctgagatgagaatcacttgaacccaggaggtggagattgcagtgagctgagattgtgccactacactccaacctgcatgacagagtgagactctgtctcaaaaaaaaaaaaaaagaaaagagaagaaaaagaaagtcatttcaggtgaggatcaggaacctggctggggagacaaggtggggagcaagaggcattattcatttatacattcaactttcattgactcagcagagagactgagcaataaggggccagttatctcagctataataactaacatttaaataaacaaaagctctcagggttgcaacttcctgattgtaccctgccccatattccaactgtattaactgatctctgtatggtttcaaatgataaaaatacacatgaactattttag

SEQ ID NO: 155130 - DNA, 601 bp, Human
gcagctcccatttgaactacatgctggggaataaagtaagagtcattcctcaggggaaaaaatgtaagaggtgttaagttgtcaaaacagtagatgctcactatagtctaccctttggtgctcagtatacaagcctgttttcttccccaaagtagaattccaaaccagcccccatctaacaccatacagccatcccatgcaccactgtgaccacattcaccctcaccctgacaagggacctgcagctgtggcacccagtagtgtctaatgacatccgtcaactctggacatgaatgcctgygatcctgagaacgagttaaatgactaatcactcctaacatgccaatgtaaataatgaagggaccagaaaatatgtgaggaaaaatatacaagaagataatgaccaaataattcccaaatgtgatcaacacggaacaaaatactgcataatcacaatgaagacttggacttataaaaggaggtgtaggctgggcaccgtggctcacacctataatcccagcaccttgagaggccaaggtaggtggatcacttgagcccaagagtttgagactggcctgggcaaccccatctctacaaaaaa

SEQ ID NO: 155131 - DNA, 601 bp, Human
ttatgctactataacaaacagattccaagatgcagtgatataaacatggtggaattctctttttctctcacacaacaattcagagtaggccccaggcaaacgggcaactctgccccatgagttgaccaggtttccaaattccttctctctccttgctgctcctccattcccttggccacgcagtcaaaagtgtcccaccccatcacctccaccttccagtctgtggaaggagaaaagaatggaagtaacaggcaagcaacctccttaccaaaagtatgatccagaaatttcccacatcacyttgggccacatcccattggccagaactgcatcatgtggccacactgtgctgcaagggagtctgggaattacagtccctagctgagcggccatgctggaatgggaggcacttgtattacttaaaggaagaaataggaaatgaatactggggaacaactcctatctccgcctcagggaaaaaggcaatttacaaacagtgatacagatggaataccacatcttgctggtcaggggaaaacccagctcccatagtgatttgttcgtagactcacttccctgaatatggggactttcttagcca

SEQ ID NO: 155132 - DNA, 601 bp, Human
ttgttggctctggccctagactcagtggtttcaggatccaagcacgtaaattagcccttttactggactccattattgaatgacttaatggtgaattgctcctgtgtgcacctttgcattgtgtatgacagttttcttaacaagttaatgatgcaagaaaaatgacatgggaaatgttgatcccacccagaaggaggctgcatgcctgttggtctttagggacatctgggtgcataggtcacattctgtgaggtaattatctcttcactcatagtggagttaattcctgtggtagagctayagcacctttctggctaaaatacagaaagagagctacaccttttagcacctttctggctaaaatgcagaaatgcaggggtttagtgcaaggccagtggggactgcacagaagcaagcccacgtgccttttataagatcctacactttgcctcagtctggccccaaggagacccagcttaatttgtttctgagtaagtaaagcccgaggtgcactcaaggagaagggctccagtatccgatagccttccctgtcaccgaggtgtgtcctggcttccttaaggcttccggaggaataaaggac

SEQ ID NO: 155133 - DNA, 601 bp, Human
ctacagcacctttctggctaaaatacagaaagagagctacaccttttagcacctttctggctaaaatgcagaaatgcaggggtttagtgcaaggccagtggggactgcacagaagcaagcccacgtgccttttataagatcctacactttgcctcagtctggccccaaggagacccagcttaatttgtttctgagtaagtaaagcccgaggtgcactcaaggagaagggctccagtatccgatagccttccctgtcaccgaggtgtgtcctggcttccttaaggcttccggaggaataaakgacgctgtgctgagaacattttgtgcagataggccaagatcaggatgtgaattgcactttatgaaaaaaaagagaaaaggagggaaataactcaatttcaaagctgatccaagaaaataatgatattctagggaaaaagaggccaaagtcaaccaaaggataatgatgccttgctctatttagaattttccaaatgagaggctttttctcttggtcattatcgacttttaaacaaaactaagtatcactagcaatgattagcaaatgtccttatttacacaaaacctgccatttttccag

SEQ ID NO: 155134 - DNA, 601 bp, Human
tttgtgcagataggccaagatcaggatgtgaattgcactttatgaaaaaaaagagaaaaggagggaaataactcaatttcaaagctgatccaagaaaataatgatattctagggaaaaagaggccaaagtcaaccaaaggataatgatgccttgctctatttagaattttccaaatgagaggctttttctcttggtcattatcgacttttaaacaaaactaagtatcactagcaatgattagcaaatgtccttatttacacaaaacctgccatttttccagcacccaactgctgtactctrggtattcagctcagtttccctgagcccaagatgcactcattatcgcactcatgatttgttaaattgagagcgtttgtggatttagaggatgaatgagaagtaccagctcccttgttaacatcagatgggtctgagcaacctcagagagaacccctctcaggtctttaaggatggagaccgcactcaggaaaggtccgtgtgtcttactgctcacagacagatgagactgccccactgggtcccagctgtagtgatcagagtcagtaggtttccagcccgtcaagtctgataagtacggcc

SEQ ID NO: 155135 - DNA, 601 bp, Human
actcaatttcaaagctgatccaagaaaataatgatattctagggaaaaagaggccaaagtcaaccaaaggataatgatgccttgctctatttagaattttccaaatgagaggctttttctcttggtcattatcgacttttaaacaaaactaagtatcactagcaatgattagcaaatgtccttatttacacaaaacctgccatttttccagcacccaactgctgtactctaggtattcagctcagtttccctgagcccaagatgcactcattatcgcactcatgatttgttaaattgagarcgtttgtggatttagaggatgaatgagaagtaccagctcccttgttaacatcagatgggtctgagcaacctcagagagaacccctctcaggtctttaaggatggagaccgcactcaggaaaggtccgtgtgtcttactgctcacagacagatgagactgccccactgggtcccagctgtagtgatcagagtcagtaggtttccagcccgtcaagtctgataagtacggcctcagtgtgtgaccaaggtgagcacaaaccacagaaaactgtaaatagccagcaaaaggcaggacagagtg

SEQ ID NO: 155136 - DNA, 601 bp, Human
ggcagggtagagggagaaagggggaagctgtgaagaaacatcctgaggcagccagcaggtgctcagtcttgagtgctctctcttggcaggaacgttgagtaagttagaagcccaggcttcagggtcagtgaaaccagtttccaaatccagccgcattatggaccttgggcatgctgcttagaccctgagcctggcttctcatctgtgaagtggaggagactggtctgttacagggtcttaagaaacgatttctgtaaagttcctgacacagggtatgtaatacattcaaactattatatatttttgttttgttttgttttgttttgttttgtttgagaacaagtctctctgtgccgcccaggctggagtgtagtggcaagatttcggctcactgcaacctccgcctcccaggttcaagcgattctcatgcttcagcctcctgagtaattgagactacaggtgccggccagcacgcctggctaatttttgaatttttagtagagacagggtttcaccacgttgaccaagctggtctcgaacttctggcctcaagtgatctgcccacctcggcctcccaaagtgctgggattataggcatgag

SEQ ID NO: 155137 - DNA, 601 bp, Human
ctgcttagaccctgagcctggcttctcatctgtgaagtggaggagactggtctgttacagggtcttaagaaacgatttctgtaaagttcctgacacagggtatgtaatacattcaaactattatatagttttgttttgttttgttttgttttgttttgtttgagaacaagtctctctgtgccgcccaggctggagtgtagtggcaagatttcggctcactgcaacctccgcctcccaggttcaagcgattctcatgcttcagcctcctgagtaattgagactacaggtgccggccagcacrcctggctaatttttgaatttttagtagagacagggtttcaccacgttgaccaagctggtctcgaacttctggcctcaagtgatctgcccacctcggcctcccaaagtgctgggattataggcatgagcaaccgcattcagcctcaaactattacattgttttaaagttatcattatttcttctgcaagctgcaaaactaccaaaggcagagtgtgtagatttggggttcaaatcctgattctgccacttcactaactctgtggccttgggcaagtcgtttcacctttcatgatctacagc

SEQ ID NO: 155138 - DNA, 601 bp, Human
ttctcatctgtgaagtggaggagactggtctgttacagggtcttaagaaacgatttctgtaaagttcctgacacagggtatgtaatacattcaaactattatatagttttgttttgttttgttttgttttgttttgtttgagaacaagtctctctgtgccgcccaggctggagtgtagtggcaagatttcggctcactgcaacctccgcctcccaggttcaagcgattctcatgcttcagcctcctgagtaattgagactacaggtgccggccagcacgcctggctaatttttgaattttyagtagagacagggtttcaccacgttgaccaagctggtctcgaacttctggcctcaagtgatctgcccacctcggcctcccaaagtgctgggattataggcatgagcaaccgcattcagcctcaaactattacattgttttaaagttatcattatttcttctgcaagctgcaaaactaccaaaggcagagtgtgtagatttggggttcaaatcctgattctgccacttcactaactctgtggccttgggcaagtcgtttcacctttcatgatctacagcatgcaggtgataagagcgcctg

SEQ ID NO: 155139 - DNA, 601 bp, Human
acgcctggctaatttttgaatttttagtagagacagggtttcaccacgttgaccaagctggtctcgaacttctggcctcaagtgatctgcccacctcggcctcccaaagtgctgggattataggcatgagcaaccgcattcagcctcaaactattacattgttttaaagttatcattatttcttctgcaagctgcaaaactaccaaaggcagagtgtgtagatttggggttcaaatcctgattctgccacttcactaactctgtggccttgggcaagtcgtttcacctttcatgatctacmgcatgcaggtgataagagcgcctgcataccccggccccttacagggttgttgggggattaaatgaactaatccacttaaggtccttagcacagaggctggcacacagaaccactatgtatgtgtaagccattactgttaatgcgctgtctctacatcctcagtgctaggctgcctggaaacactatcctgtgacttttggttgttgaagcctacaccaaatctaccttcccagtggaatgcatgcttgcccaccttgaaatccctgatgcagatcaccttgtccagggagctagccattg

SEQ ID NO: 155140 - DNA, 601 bp, Human
ttttagtagagacagggtttcaccacgttgaccaagctggtctcgaacttctggcctcaagtgatctgcccacctcggcctcccaaagtgctgggattataggcatgagcaaccgcattcagcctcaaactattacattgttttaaagttatcattatttcttctgcaagctgcaaaactaccaaaggcagagtgtgtagatttggggttcaaatcctgattctgccacttcactaactctgtggccttgggcaagtcgtttcacctttcatgatctacagcatgcaggtgataagagcgmctgcataccccggccccttacagggttgttgggggattaaatgaactaatccacttaaggtccttagcacagaggctggcacacagaaccactatgtatgtgtaagccattactgttaatgcgctgtctctacatcctcagtgctaggctgcctggaaacactatcctgtgacttttggttgttgaagcctacaccaaatctaccttcccagtggaatgcatgcttgcccaccttgaaatccctgatgcagatcaccttgtccagggagctagccattgggtagtgggccacagatgcca

SEQ ID NO: 155141 - DNA, 601 bp, Human
ggctgaggcaggagaatggcgcgaacctgggaggcagagcttgcagtgagccgagatcgcgccactgcactccagcctgggcgacagagcgagactccgtctcaaaaaaaaaaagattcagaaaggaagcggtgagctcagcaggggtcagatcacacagggccttacaggccatgaaaggaaggctgaatttcattcagagcaactctcccatggccctaaccatgcctttgttacggcatttgtgtgaaattttatctccccctccagagggtaagctccaggaattgtccgattggtytttgttgctcctttcccatgcctgcctgacatagagaaggattttggtcgacatgtgtggaatgaagtgaaaaataacccccaaaaagcttaagaggccctggctgcaacagctgtcacccagtaattccaagagttcactcggcatcctgggcaggagtccccaccctcttatgtgcccgtgggtttttcttctgaagctggaagcgtcctcagagaggtccccatcatcccatggaacagaacctttcattgactggacccccacatgtaaaaggtagtaatggtgaggattagagaa

SEQ ID NO: 155142 - DNA, 601 bp, Human
ttcattgactggacccccacatgtaaaaggtagtaatggtgaggattagagaaaatagcacctcagctgctttattctaatcataatatcatccctatctccacttgacgcatggttggttggttgggtggttgatcagttgcctagctcccctcactagtctataaactcctgagcatagtgaattttgtctgttttgttcactgctgcactcctagcaccaatgacagtgcccagcactgctcagtaaatatttgttggttgaaatgagacaatgcatataaaatgctttgcagaatgyctggcacattctaggcacacattatcttttttttttttattttattttatttttatttttatttatttatttttatttttttttgagatggagtcttgctctgtcacccagactggagtgcagtggcatgatctcggctcactgcaacctctacctcccaggttcaagcaattctctgcctcagcctcccaagtagcagggattacaggcatctgccaccacgcccggctaatttttgtattcttagtagagacagggtttcaccatgttggccaggctggtcttgaactcctgactttg

SEQ ID NO: 155143 - DNA, 601 bp, Human
atggtgaggattagagaaaatagcacctcagctgctttattctaatcataatatcatccctatctccacttgacgcatggttggttggttgggtggttgatcagttgcctagctcccctcactagtctataaactcctgagcatagtgaattttgtctgttttgttcactgctgcactcctagcaccaatgacagtgcccagcactgctcagtaaatatttgttggttgaaatgagacaatgcatataaaatgctttgcagaatgcctggcacattctaggcacacattatcttttttttatttattttattttatttttatttttatttatttatttttatttttttttgagatggagtcttgctctgtcacccagactggagtgcagtggcatgatctcggctcactgcaacctctacctcccaggttcaagcaattctctgcctcagcctcccaagtagcagggattacaggcatctgccaccacgcccggctaatttttgtattcttagtagagacagggtttcaccatgttggccaggctggtcttgaactcctgactttgtgatccacccacctcggcctcccaaagtgctggga

SEQ ID NO: 155144 - DNA, 601 bp, Human
cactgctgcactcctagcaccaatgacagtgcccagcactgctcagtaaatatttgttggttgaaatgagacaatgcatataaaatgctttgcagaatgcctggcacattctaggcacacattatcttttttttttttattttattttatttttatttttatttatttatttttatttttttttgagatggagtcttgctctgtcacccagactggagtgcagtggcatgatctcggctcactgcaacctctacctcccaggttcaagcaattctctgcctcagcctcccaagtagcaggkattacaggcatctgccaccacgcccggctaatttttgtattcttagtagagacagggtttcaccatgttggccaggctggtcttgaactcctgactttgtgatccacccacctcggcctcccaaagtgctgggattacaggcataggcacacattatcttaataacaattgttgttaagatataataagatgaattatgaaatagtacataaatcacatagcatataataaaactgtgtatgataaagtactaaaattatgacagagcttacatacgtaaggaaataaatgtccagcact

SEQ ID NO: 155145 - DNA, 601 bp, Human
ttttttgtttgtttgttttttgagacagggtctcactctgtcacccaggctggagtgcggtggcacaatcacagttcactgcaacctccgcctcccaggctcgagtgatcctcccacctcactctcctgagttgctgggactacaggcctgcaccaccacacctggctaattttttgtattttagtagagatgcagtttcgccatgttggccaggatggtctcgaactcctgacctcaggtgatccatccgcctcagcctcccaaagtgctgggattacaggcatgagccaccacgcccarcctgcacatactatttatttccttcgcctacgacacagagaaacccagggcttccgaatagcatctctgcctcttcatcacactgaacctatctcctcacccttaaagtggccattctgacatcttgatgtcaggcctctgagcccaagctaagcggtcttaacccctgtgacctgcacatatacatccagatggcctggagcaactgaagaaccacaagagatgacattccaccattgtgatttgttccttccccaccccaactaaccaatcgatcttgtgacattccacccccccacc

SEQ ID NO: 155146 - DNA, 601 bp, Human
tgggactacaggcctgcaccaccacacctggctaattttttgtattttagtagagatgcagtttcgccatgttggccaggatggtctcgaactcctgacctcaggtgatccatccgcctcagcctcccaaagtgctgggattacaggcatgagccaccacgcccagcctgcacatactatttatttccttcgcctacgacacagagaaacccagggcttccgaatagcatctctgcctcttcatcacactgaacctatctcctcacccttaaagtggccattctgacatcttgatgtcagscctctgagcccaagctaagcggtcttaacccctgtgacctgcacatatacatccagatggcctggagcaactgaagaaccacaagagatgacattccaccattgtgatttgttccttccccaccccaactaaccaatcgatcttgtgacattccacccccccaccaccgacaatgagtctcacgatctccccaccctgcaccgtgtgacccccgcccctgcccacaagaaaacaaccccctttaactgtaattttccattacctacccaaatcctataaaactgccccaccctgatctcc

SEQ ID NO: 155147 - DNA, 601 bp, Human
actctctttacacagacgtgcgtgacaccaggctgctctgagaattccatgaattaatgaatgttgagtgcctggtacagagcctggcatacagtagacattcactaaatggtgacttatgaactctacacttcctccaaggaccaggacacatgcctcctcctccataaaatcttccttctcagtccacaggcagggatgagctccctcatactgtgtgttccttctgcaattttttttttttttgagaaggattttcattcttgttgcccaggctggggtgctatggcacggtcttggstcactgcaacctttgcctcccggattcaagcgattcttctgcctcagcctcctgagtagctgggagctacaggcgcccaccaccaagcctgggtaatttttgtatttttagtaaagacggtgttttaccacgttggccaggctggtctcgaactcctgccctcaggtgatccacccacctcggcctcccaaagtgctgggattacaggcgtgagctaccaagcccagctgcattttgtttaacatgataactcagctggttttttacataacagagacaaattctctttgacctttgtat

SEQ ID NO: 155148 - DNA, 601 bp, Human
tctctttacacagacgtgcgtgacaccaggctgctctgagaattccatgaattaatgaatgttgagtgcctggtacagagcctggcatacagtagacattcactaaatggtgacttatgaactctacacttcctccaaggaccaggacacatgcctcctcctccataaaatcttccttctcagtccacaggcagggatgagctccctcatactgtgtgttccttctgcaattttttttttttttgagaaggattttcattcttgttgcccaggctggggtgctatggcacggtcttggctyactgcaacctttgcctcccggattcaagcgattcttctgcctcagcctcctgagtagctgggagctacaggcgcccaccaccaagcctgggtaatttttgtatttttagtaaagacggtgttttaccacgttggccaggctggtctcgaactcctgccctcaggtgatccacccacctcggcctcccaaagtgctgggattacaggcgtgagctaccaagcccagctgcattttgtttaacatgataactcagctggttttttacataacagagacaaattctctttgacctttgtattc

SEQ ID NO: 155149 - DNA, 601 bp, Human
agccaccacgtggccttctcagccttcaggacacagtggatctgtgaatcaggaactgcctgatggggtatgacccaaatcaggaacagaccgagactcagggcctgaatcttagcaattgtcctcagtccttgggagagactaatttgagtttgattctttgcttccccagtgacatgcaagatgattttatctctccatgtggggcctgcaggcaagtcatgagagaggtaagcagcttctcttgctgtctggaatgcaaatatcttccctgtcgcaggctatgggagccacgccaagytgcaggcatggcaggcatggcaggcgtggagacacagctactgtcctgtttgcttggttggctgacttctaaggcctccctacgcttgcatgagtcactggaaattattccttcatttaacaaatacttaccgagtgagtgtctgctttgtgccaggccctgaggtagctctggggaggcacagggaaaagatgggccaggccctgccctcacagagctcataggctaatgcaggagacagatgataaacaaggagcaaaataaataaacaaacagtggcgtttctgagtcaagagggct

SEQ ID NO: 155150 - DNA, 601 bp, Human
aggcgtggagacacagctactgtcctgtttgcttggttggctgacttctaaggcctccctacgcttgcatgagtcactggaaattattccttcatttaacaaatacttaccgagtgagtgtctgctttgtgccaggccctgaggtagctctggggaggcacagggaaaagatgggccaggccctgccctcacagagctcataggctaatgcaggagacagatgataaacaaggagcaaaataaataaacaaacagtggcgtttctgagtcaagagggctatagaggaaaacaaaatgcagaaaaaaaaaaggagtccagtgacaaacgggcaaacaggggacactgcagattggggtcagcaaacaacagcccttgggccaaatccagcctgctgcttgtatttgtaaataaagttttatgggtatacagccatggccattcattcacctattgtccatagccactttgccctgacacagcagaggtgagccattacgacaaaggccacatggcctctaaacctaagatatttactgtctggtccttgacagaaaaaggtttgccaacccctgctttagatatccaggaaggccctctttt

SEQ ID NO: 155151 - DNA, 601 bp, Human
aaataatgaggaaaaaaatgagacagacaaaggtcaaaaaaggagattcagaaccagcaagttcagacccttggtgaatttgagaagaggcaagaaggccacgagggctagagagctagggcctggtaggtggaaggaaagcaatgggattgaagtcagaggggtgggcagaggccagatcacatggggcctggccatggaacgaagggtacattttattccaagaataaaggaaactgaagtgtacacttttttttttttgagacggagtctcactctgtcacccaggctggagtgcagkggcagagtctcagctcactgcaacctccgcctcctgggttcaagcaattctcctgcctcagcctcccgagtagctgggactacaggcgccagctaccatgcccggctaatttttgtatttttagtagagactgggtttcaccatgttggccaggatggtcttgaactcctgaccttgttatctgcccacctcggcctcccaaagtgctgggattacaggcgtgagccaccgcgcccagcctggagtgtacacttaaacatggttaaaatggcaaatcttacattatatatattttatcac

SEQ ID NO: 155152 - DNA, 601 bp, Human
accttgttatctgcccacctcggcctcccaaagtgctgggattacaggcgtgagccaccgcgcccagcctggagtgtacacttaaacatggttaaaatggcaaatcttacattatatatattttatcacattatatacattgggaaaaaagggaataaaggtaagccattggatattttcaagaagaaacttgaaggactttttataaaagtcctcttgatggaaggctgcaatttcttcaactctaaaaacaaaacggtaagccaggtatggtggctcagcctgtaatcccagcaattarggaggcagaggcaggaggatcgcttgggtccaggagttcgagacctgcctgggcaacatagcgagaccctgttctccacaaaaaaaaaaaaaaaggaataaaacaaaacaaaaaaatgaaaacgaagggatagtttagatcatgggttcttaatccaggctcaggggaaggttttcatgtttatatgtacgtttggggaaaggggaatgtcagtaactattgtggattctcaaagagatctgtgtcctctagagtcccaaaagattagagaatcccacaggccctgagctccagcataat

SEQ ID NO: 155153 - DNA, 601 bp, Human
aatggcaaatcttacattatatatattttatcacattatatacattgggaaaaaagggaataaaggtaagccattggatattttcaagaagaaacttgaaggactttttataaaagtcctcttgatggaaggctgcaatttcttcaactctaaaaacaaaacggtaagccaggtatggtggctcagcctgtaatcccagcaattagggaggcagaggcaggaggatcgcttgggtccaggagttcgagacctgcctgggcaacatagcgagaccctgttctccacaaaaaaaaaaaaaaaagaataaaacaaaacaaaaaaatgaaaacgaagggatagtttagatcatgggttcttaatccaggctcaggggaaggttttcatgtttatatgtacgtttggggaaaggggaatgtcagtaactattgtggattctcaaagagatctgtgtcctctagagtcccaaaagattagagaatcccacaggccctgagctccagcataatatcaagagcccctcgaaatacggcatcttgtgggcatgatggcttacacctgtaagccctgcactttgggagactgaggcaggaggatcacctta

SEQ ID NO: 155154 - DNA, 601 bp, Human
ccaaggtcacacagcaaacaaacagtgctcctcatagtataggagaaagatcaagagacaaatttttctttgctgactttactctgctaagcctcagtttcctcatcagtaaaatgggcatcatgatagcacctacctcacagggtagattatgaaaccacgcatgtgcagtatctatgtggtgtggtttggctgtgtccccactcaaatctcatcttgaattgtagctcccataattcccacatgtcatgggagggacctggtgggaggcaattgaatcatgggggcgggtctttcccaygctgttctcgtgatagtgaataagtctcatgagatctgatggttttataaatgggggttccctcacacaagtcctctcttgcctgttgccaggtaagacatccctttgctcttccttcctcttccgccatggttgtgaggcttccccagccatgtggaactgtgagtccattaaacctccttttttattttattttatttttttttttttttgagaccgagtctcgctctatggccaaggctggactgcagtggtgtgatcttggctcactgcaacctctgcctcccgggttccagagat

SEQ ID NO: 155155 - DNA, 601 bp, Human
cactcaaatctcatcttgaattgtagctcccataattcccacatgtcatgggagggacctggtgggaggcaattgaatcatgggggcgggtctttcccacgctgttctcgtgatagtgaataagtctcatgagatctgatggttttataaatgggggttccctcacacaagtcctctcttgcctgttgccaggtaagacatccctttgctcttccttcctcttccgccatggttgtgaggcttccccagccatgtggaactgtgagtccattaaacctccttttttattttattttatttttttttttttttgagaccgagtctcgctctatggccaaggctggactgcagtggtgtgatcttggctcactgcaacctctgcctcccgggttccagagattctcctgcctcaagccttctgagtagctgggattacatgtgcttgccaccacgcctggctaatttttgtatttttaggagagatgaagtttcaccatgttggccaggctcatctcgaactcctgacctcaggagatccgcctgcctcggcctcccaaaagtgctgggagtacaggcgtgcgccacaacacccggcctaaac

SEQ ID NO: 155156 - DNA, 601 bp, Human
actcaaatctcatcttgaattgtagctcccataattcccacatgtcatgggagggacctggtgggaggcaattgaatcatgggggcgggtctttcccacgctgttctcgtgatagtgaataagtctcatgagatctgatggttttataaatgggggttccctcacacaagtcctctcttgcctgttgccaggtaagacatccctttgctcttccttcctcttccgccatggttgtgaggcttccccagccatgtggaactgtgagtccattaaacctccttttttattttattttattttwttttttttttgagaccgagtctcgctctatggccaaggctggactgcagtggtgtgatcttggctcactgcaacctctgcctcccgggttccagagattctcctgcctcaagccttctgagtagctgggattacatgtgcttgccaccacgcctggctaatttttgtatttttaggagagatgaagtttcaccatgttggccaggctcatctcgaactcctgacctcaggagatccgcctgcctcggcctcccaaaagtgctgggagtacaggcgtgcgccacaacacccggcctaaacc

SEQ ID NO: 155157 - DNA, 601 bp, Human
tcccacatgtcatgggagggacctggtgggaggcaattgaatcatgggggcgggtctttcccacgctgttctcgtgatagtgaataagtctcatgagatctgatggttttataaatgggggttccctcacacaagtcctctcttgcctgttgccaggtaagacatccctttgctcttccttcctcttccgccatggttgtgaggcttccccagccatgtggaactgtgagtccattaaacctccttttttattttattttatttttttttttttttgagaccgagtctcgctctatggccmaggctggactgcagtggtgtgatcttggctcactgcaacctctgcctcccgggttccagagattctcctgcctcaagccttctgagtagctgggattacatgtgcttgccaccacgcctggctaatttttgtatttttaggagagatgaagtttcaccatgttggccaggctcatctcgaactcctgacctcaggagatccgcctgcctcggcctcccaaaagtgctgggagtacaggcgtgcgccacaacacccggcctaaacctcttttctttataaattacccggtctcaagtatgt

SEQ ID NO: 155158 - DNA, 601 bp, Human
atagtgaataagtctcatgagatctgatggttttataaatgggggttccctcacacaagtcctctcttgcctgttgccaggtaagacatccctttgctcttccttcctcttccgccatggttgtgaggcttccccagccatgtggaactgtgagtccattaaacctccttttttattttattttatttttttttttttttgagaccgagtctcgctctatggccaaggctggactgcagtggtgtgatcttggctcactgcaacctctgcctcccgggttccagagattctcctgcctcaagccttctgagtagctgggattacatgtgcttgccaccacgcctggctaatttttgtatttttaggagagatgaagtttcaccatgttggccaggctcatctcgaactcctgacctcaggagatccgcctgcctcggcctcccaaaagtgctgggagtacaggcgtgcgccacaacacccggcctaaacctcttttctttataaattacccggtctcaagtatgtctttattagcagcttgagaacagactaatacactgagtatatgtagcaggcttgcagcttctcctggtgtgaggtg

SEQ ID NO: 155159 - DNA, 601 bp, Human
cctccttttttattttattttatttttttttttttttgagaccgagtctcgctctatggccaaggctggactgcagtggtgtgatcttggctcactgcaacctctgcctcccgggttccagagattctcctgcctcaagccttctgagtagctgggattacatgtgcttgccaccacgcctggctaatttttgtatttttaggagagatgaagtttcaccatgttggccaggctcatctcgaactcctgacctcaggagatccgcctgcctcggcctcccaaaagtgctgggagtacaggygtgcgccacaacacccggcctaaacctcttttctttataaattacccggtctcaagtatgtctttattagcagcttgagaacagactaatacactgagtatatgtagcaggcttgcagcttctcctggtgtgaggtgtaaaggggatactgaagggaagcgggtgttagttgtcatttgtcatagcagaaggaggttccaggggttagctgttgctcttataaagccctgggtgagtcttgaatggtgcctgttcacgatgtaccatgcactgttcagtttcacagcattctttcgtttc

SEQ ID NO: 155160 - DNA, 601 bp, Human
tgatgatatgagccctcgtcaaggaccacctccacctcctccaggacaaggtggtgagggtggtagcagagctcggaatcttcctcttcctcctccaccaccacctagagggggagacctcatggcctatgacagaagagggagacctggagactgttaccatggcatggttggtttcagtgctgatgaaacttgggactctgcaatagatacatggagcccatcagaatggcagatggcttatgaaccacagggtggctccagatatgattattcctatgcagggggtcgtggctcatawggtaatcttggtggacttattattactacacaagtaacgattcccaaagatttggctggatctattattggcaaaggtggtctgcagattaaacaaatccgtcatgagtcgggagcttcgatcaaaattgatgagcctttagaaggattggaagattggatcattaccattagagaaacacaggaccagatacagaatgcacagtatttgctgcagaacagtgtgaagcagtgtgcagatgttgaaggagtataatgcaagatatttttttcttttttatagtgtgacgcagtattctgg

SEQ ID NO: 155161 - DNA, 601 bp, Human; identical to SEQ ID NO: 155160

SEQ ID NO: 155162 - DNA, 601 bp, Human; identical to SEQ ID NO: 29279

SEQ ID NO: 155163 - DNA, 601 bp, Human; identical to SEQ ID NO: 29280

SEQ ID NO: 155164 - DNA, 601 bp, Human; identical to SEQ ID NO: 29281

SEQ ID NO: 155165 - DNA, 601 bp, Human; identical to SEQ ID NO: 29282

SEQ ID NO: 155166 - DNA, 601 bp, Human; identical to SEQ ID NO: 29283

SEQ ID NO: 155167 - DNA, 601 bp, Human
ccagcattaatctgtccacagaacatatccaaccctggggataagaacactactaatgcccagaccatgtcttttggagagagtagagaatataggagatggctgtttctgttattgcaaagttttcatgcttccaaatttacttagggttttcaaatcactttggttctttgagggtaaagttaggataaatggtctattaaacctctatgttcctaggtcctccagaccgtgctgagtgcatgttacatacgtttacatttatatgtatgcatttgtatgtgtacgtgtgcatataaarcttaatctactttcacaaaaagaagttcagtataaaaatgaaaatagcttttcgtgttttccttcattaaaaatgaaacaacgaagagcttggcacagacttactgctctcaaaacctgtagaattaaagcttactgactcatgagaacgagaactgtctcatagttaatgttagagaagcagcctggagtggttgttgttagtaatactgtctgtggagcacagtagcgtcgcagtagaagttagaccaatcccacctaagtagtcagagaatcttaaaaagtaaagcccagtaatgtt

SEQ ID NO: 155168 - DNA, 601 bp, Human
tattgcaaagttttcatgcttccaaatttacttagggttttcaaatcactttggttctttgagggtaaagttaggataaatggtctattaaacctctatgttcctaggtcctccagaccgtgctgagtgcatgttacatacgtttacatttatatgtatgcatttgtatgtgtacgtgtgcatataaagcttaatctactttcacaaaaagaagttcagtataaaaatgaaaatagcttttcgtgttttccttcattaaaaatgaaacaacgaagagcttggcacagacttactgctctcwaaacctgtagaattaaagcttactgactcatgagaacgagaactgtctcatagttaatgttagagaagcagcctggagtggttgttgttagtaatactgtctgtggagcacagtagcgtcgcagtagaagttagaccaatcccacctaagtagtcagagaatcttaaaaagtaaagcccagtaatgtttacttaagggtctgtttctggggaattaaaaaattaaacatggaactgtgccaagttttaaagtttccaaaaacgacaaggtatttaccactgaaatttaggaaaaccacat

SEQ ID NO: 155169 - DNA, 601 bp, Human
ttgagggtaaagttaggataaatggtctattaaacctctatgttcctaggtcctccagaccgtgctgagtgcatgttacatacgtttacatttatatgtatgcatttgtatgtgtacgtgtgcatataaagcttaatctactttcacaaaaagaagttcagtataaaaatgaaaatagcttttcgtgttttccttcattaaaaatgaaacaacgaagagcttggcacagacttactgctctcaaaacctgtagaattaaagcttactgactcatgagaacgagaactgtctcatagttaaygttagagaagcagcctggagtggttgttgttagtaatactgtctgtggagcacagtagcgtcgcagtagaagttagaccaatcccacctaagtagtcagagaatcttaaaaagtaaagcccagtaatgtttacttaagggtctgtttctggggaattaaaaaattaaacatggaactgtgccaagttttaaagtttccaaaaacgacaaggtatttaccactgaaatttaggaaaaccacatactaatagtattccattctttacttttctagaacatttttagtagacattaatgcagg

SEQ ID NO: 155170 - DNA, 601 bp, Human
attccattctttacttttctagaacatttttagtagacattaatgcaggtgtgctaaagtagaaatcactgtcccagagtactgtgttggaccatttggaaggagccatgtatctcccattacctatacaatttggtatcattcgattagataggataataagaatatttatttatatgtacttaatttttcaagaaatgtttttttggtgtccataaatctggtcccttggagtgattgaattccgtacttcagagtttagacaataagaggcagatacgtttagagtaacttaaactgwtattagatctactttcccccatataataaaaattgagaaaaagtagacttcaggcaaagtattatcaactctttattgtgccttgagtgaactagatagcattttattctttcattctgactttcttaaagtgtttagacatttcttccttgtgcacaactaaaataatttatggagtgcaggtccaaagtagtttttagagggatatttctttttctaaagaacgaaccaaaaagcctcaacaaaacagtgtaaaaggcagagtattgcttatatagaagctcaaaaacagagatattt

SEQ ID NO: 155171 - DNA, 601 bp, Human
tgactttcttaaagtgtttagacatttcttccttgtgcacaactaaaataatttatggagtgcaggtccaaagtagtttttagagggatatttctttttctaaagaacgaaccaaaaagcctcaacaaaacagtgtaaaaggcagagtattgcttatatagaagctcaaaaacagagatatttgtttggcatattttaaatttcggagtaatgcatattcagaggaaaagttaccttatttaagtaaacgaaactattcggactcctcgtggtagggataatatggaaaatgttagaaatrtagaactttaaagctgaaagagccttagtcattttgtctaaatgccttccccatttaccaatgaggaattagatcaatagagatagaataacttctaaacaccaatttgtggcagaacagataaaactttaatcattcatgaaaccaaatattagttcacaggattgagacaaaatgcagtgtatttgacttgaccagagaagcaagactcaggttctggttccagctttttctcttttactatagacaaaacatttaacactggacttcttgttactctctttggaaataatatctctt

SEQ ID NO: 155172 - DNA, 601 bp, Human
attgagacaaaatgcagtgtatttgacttgaccagagaagcaagactcaggttctggttccagctttttctcttttactatagacaaaacatttaacactggacttcttgttactctctttggaaataatatctcttctaacaagctgctgggtttttttgttttcttttttttcctcttgctctttcaccccgtctgaagtgcagtggctcaatctctgctcactgcaacctctgcctccagggttcaagcgattctcctgcctcagcctcccaagtagctgagattataggcgcccacyaccatgcccgactagtttttctatttttggtagagacagcgtttcaccatgttggccaggctggttttgaacccctgacctcaagtggttggtccaccttggcctcccaaagtgctgggattacaggcgtgagccctggcacccggcctcaaactgctattaaaaaaacaaaaacagctatgattgtatacttatataacatgttagttttcttttttttggtttttttgtttgtttgtttttttgagatgaagtctagctcgtgtcccccaggctggagtgcagttgtgcgatctcggc

SEQ ID NO: 155173 - DNA, 601 bp, Human
agattttttttaaattcatttaacagatgttaaaatgaaactgtacttcacagagtcagtgaagtacacagatcttaattcattgtttagtaacttttgtggattgtataatgctttggcttctatttcaagttttcttttttaagggggaaagatactgttgtcattttgagaaaggtagatggcactttttgttttccttgtgtaagagaaacggattgttatgaaagctttgaactttcctggagttcgagagtacactggtcctctaagtgcggtctccaaatcacgatgatcagcrtcacttgttggaacttgttgggaatgcaaattatcaagccccaccccagacctttgtgatctaaaagccctccaggtgattctgatccacactgaagcacgagaaccactgaccttaggaactgttacctgttcctttgcttccgtagagtgaagtaaaaagtgaggaactcagaagaaaccaaattatctctcttttagagtattttttcaggaatctttaccgtatttatcctgtgtaaattgttttctctgactgtatctgtactagacttggcatgttttctcctctttacagttc

SEQ ID NO: 155174 - DNA, 601 bp, Human
aaattcatttaacagatgttaaaatgaaactgtacttcacagagtcagtgaagtacacagatcttaattcattgtttagtaacttttgtggattgtataatgctttggcttctatttcaagttttcttttttaagggggaaagatactgttgtcattttgagaaaggtagatggcactttttgttttccttgtgtaagagaaacggattgttatgaaagctttgaactttcctggagttcgagagtacactggtcctctaagtgcggtctccaaatcacgatgatcagcgtcacttgttgraacttgttgggaatgcaaattatcaagccccaccccagacctttgtgatctaaaagccctccaggtgattctgatccacactgaagcacgagaaccactgaccttaggaactgttacctgttcctttgcttccgtagagtgaagtaaaaagtgaggaactcagaagaaaccaaattatctctcttttagagtattttttcaggaatctttaccgtatttatcctgtgtaaattgttttctctgactgtatctgtactagacttggcatgttttctcctctttacagttcaatctttgtag

SEQ ID NO: 155175 - DNA, 601 bp, Human
ttattagttttagcttttttttttttttttttgagatgtagtcttgctcttgttacccaggctggagtgcagtggtgccatcttggctcattgcaacctccgcctcctgggttcaagcaattctcccgcctcgcctcccgagtagctgggattacaggcacctgcaaccacgcctggctaatttttttgtatttttagaagagatggggtttcaccatgttggccaggctggtcttgaactcctgacctcaggtgatctgcccagctcggcctcccaaagtgctgcgattacaggcatgarccactgcacctggccaattttaactcttctatgtaggtaaattttgggttaactaaggaacatttaccaatttggttaaacttagaaagcatttaagtgttgtaaggaccaagttttttttcctcctcgtatattcctttgaaatgttgattaattctctaccttgggtccatcaaaatatgataaattattgagacttgaaagaacatttgggattaaaatctgaagaccagaaatgtcagcttgtaaatatattggcagatttgacgcaaatactaatcaggccttaaaataggtaaa

SEQ ID NO: 155176 - DNA, 601 bp, Human
gggttcaagcaattctcccgcctcgcctcccgagtagctgggattacaggcacctgcaaccacgcctggctaatttttttgtatttttagaagagatggggtttcaccatgttggccaggctggtcttgaactcctgacctcaggtgatctgcccagctcggcctcccaaagtgctgcgattacaggcatgaaccactgcacctggccaattttaactcttctatgtaggtaaattttgggttaactaaggaacatttaccaatttggttaaacttagaaagcatttaagtgttgtaaggmccaagttttttttcctcctcgtatattcctttgaaatgttgattaattctctaccttgggtccatcaaaatatgataaattattgagacttgaaagaacatttgggattaaaatctgaagaccagaaatgtcagcttgtaaatatattggcagatttgacgcaaatactaatcaggccttaaaataggtaaacttaaaacacgtttctctctagagactcaaagagcaccttcagtcgtatctatagaagcaagacaaattgtaaagtcttataaactgaagaatgtaatgttgttattt

SEQ ID NO: 155177 - DNA, 601 bp, Human
tgcagttgagctcactgcagcctccgcctcccagggttcaagcaattctcctgcctaagcttcctgagtacctgagactacaggcatgcgcaaccacacctggctaattgttgtatttctagtagagatggggtttcaccatgttggccaggctggtcttgaactcctgacctcacgtgatccacccacctcagccttccaaagtgctgggattacagatttgagccaccgcgcccagcctagaaacatggttgttttattttcagacagggtctcactctgtagcccagggtgaagtacrgtagatcgatcacagcccactgtagccttgaattccttggctcaagtgatccttctgcctcggcctccacaacagttagaactacaggctcatgccaccacgactggctgatttttaaatttttttgtagagattgagtaccaaccactatgttgcctagtcttatcttgaactcctggcctcaagcattgtctcacctcagcctcccaaagtgttgggattacatgcatgaaccgtcacaccagagtagaaatacagttgttgacagtttttttcctggtttgtgtctgcatattatga

SEQ ID NO: 155178 - DNA, 601 bp, Human
atatgtatgttactgtgttatatgtgtatgtattttgtttttatgtattctgttatatgtatgttgtatgtattaacattctattatggtgtttcttttttcctgtatgtgagtttgtgtataacacacatctccatatataaaaagtatacactccttagaaaaaatgtaaaattactaagaacaaaagttctcataaatgctgcctcagggagataaacaccaaatatggttaagtgtggaagcatttttatatattttcaaaaaatgtatgcatgttgtttcacaacctgttttttttccctcaacatctttgcattttagtacacatggaacctactctgggatatcttactcctatcagtggctgcgtagtacttaatttaatggtcccctgcactaaaactactgccttagactgtactatggccttgagaagcagccctagtatagaataccttactaatggacatttagttttttaaaaagttttcttgtattataaattattctgttgaaatcatccttgaatacatttgtcttagtttatttcgtgctgctataacagaataccaacaactcagtaatttataaagaacag

SEQ ID NO: 155179 - DNA, 601 bp, Human
ctcccagcactgttgcttcgtggattaagtttcaacatgaatttttggagaggacaaaaacattcaaaccatagcagtatctaagttctcttgtcatgtaatttaaaagaaaatgtttgatttgcagttaaagtgttaactattgtataccatcagcagggaccattataaaatctaaatattaatgagtggttgtaaaactaatgtgaacactcatatacccttcacatagattcacaaattgttgatgttttgtcacatttgttttatatgtttgcttttgccagacccattgataatyagttgaatttcatctccaaatactttacctttcttttatcttctaacaagaagaatgttcttcacataattacagtgcagttatcatacatttggaaacttaacattaatatggtactgtaatcaaatacaaatctatttaggaattttctcatttatgccaaaaatgtcctttattgcttttattttttaatctagcatccagtcaaagactattcattgcattcagttgtcatgataagttttatttttaatgatcatattaatgtaggatttatatatataaaaaaaactagtccaa

SEQ ID NO: 155180 - DNA, 601 bp, Human
tagtttagaatattaataggatgaccacagttttttaatatatgagaattatattttgtaatatataacatgacaatatttaagaaagtttagctcaacttgaaaaatggttctattaagtttttgttgtagcttgggataattaaaaatactcattaaattgtactgttttcataaaaatttgtaatgcttttttatattcccactaattaagtaaaattggagcctttttttgattttaaaaattcttaaggtttaaattctagaaattgctcttttaagtgttttgctaagagtattrgtaggaatttgattttagatatcttgtggagacctttccagaaaaagagggttgccttttagttcctggaccttattttaagtaagctttttggtcaaacctattctactcagctcaaaaagttgaaactattgaatttattgtgtcatcgttcttaggatccatcaattaagggaacctttcactggtctggcaatgaacagatgactaagtatgaaatggcatgtgcaattgcagatgccttcaacctccccagcagtcacttaagacctgtaagtacatggctgtaaaaacctttag

SEQ ID NO: 155181 - DNA, 601 bp, Human
aattgctagcttgttaagccatgctaatagcagccactggcctctggcttctggcagactctctgcaggctcactctggaatgcacactgacaagggtcacagcacctctagggatcagccacatggtcaggggctctgaactgacgtcttgagataatgctatttgtcgtctgcatgggtgagaaaaggtcctcccttctccttcctttgcactttctgtgaccagaatgatggtttaacagcacaagcttggggtcagactgcctgggattggacactggctctgcaactgacctgctrtgaaaagttgctcagtggctccaagcctcagttttctcatctgcaaaatgaatcagtactaatattgccctcctagggttgtggtgaggttactgcagatgtgaatgcagaggtcctggcacagtccctgctatgtggttaagtgctcaattgactcccactcccggtcttggaaatgattacttcttcctgtggcccttctctggtctcttctccttgacctcagatagccgcatttcctgcctgtgtccaagccctgctgtttcagcctgaccaccagccgaggcttactgaactcca

SEQ ID NO: 155182 - DNA, 601 bp, Human
cttgagataatgctatttgtcgtctgcatgggtgagaaaaggtcctcccttctccttcctttgcactttctgtgaccagaatgatggtttaacagcacaagcttggggtcagactgcctgggattggacactggctctgcaactgacctgctatgaaaagttgctcagtggctccaagcctcagttttctcatctgcaaaatgaatcagtactaatattgccctcctagggttgtggtgaggttactgcagatgtgaatgcagaggtcctggcacagtccctgctatgtggttaagtgctsaattgactcccactcccggtcttggaaatgattacttcttcctgtggcccttctctggtctcttctccttgacctcagatagccgcatttcctgcctgtgtccaagccctgctgtttcagcctgaccaccagccgaggcttactgaactccactcaggtctcggccccacccttcacatggtaaattgacagattaatacagtatcccgtggaaacaccactgagatttcaaaatgagagacagaaagagtgcttcctttatgaaagagctatgctttatcttacagaggcgagactggc

SEQ ID NO: 155183 - DNA, 601 bp, Human
gcacaagcttggggtcagactgcctgggattggacactggctctgcaactgacctgctatgaaaagttgctcagtggctccaagcctcagttttctcatctgcaaaatgaatcagtactaatattgccctcctagggttgtggtgaggttactgcagatgtgaatgcagaggtcctggcacagtccctgctatgtggttaagtgctcaattgactcccactcccggtcttggaaatgattacttcttcctgtggcccttctctggtctcttctccttgacctcagatagccgcatttcctrcctgtgtccaagccctgctgtttcagcctgaccaccagccgaggcttactgaactccactcaggtctcggccccacccttcacatggtaaattgacagattaatacagtatcccgtggaaacaccactgagatttcaaaatgagagacagaaagagtgcttcctttatgaaagagctatgctttatcttacagaggcgagactggctttaacagccagaaattttcagaatgttccttggagtcaccaaggaatgacagtgtgtactcaggatggggtacagcagcctcagggatggagg

SEQ ID NO: 155184 - DNA, 601 bp, Human
cagattaatacagtatcccgtggaaacaccactgagatttcaaaatgagagacagaaagagtgcttcctttatgaaagagctatgctttatcttacagaggcgagactggctttaacagccagaaattttcagaatgttccttggagtcaccaaggaatgacagtgtgtactcaggatggggtacagcagcctcagggatggaggctgggcccagcccctcccctgcttcccagcccagcccagcatctgtctatccaccgatgaggtctctatgtgagactgatttgaacaaaggactcmggcacataccacgcaaaaatttttaagtttcaaatcactattttggagccaggagaaatagtgtttggacaagtcacacctctttgtcttgaaattccagtccttttagaaagctttatgagacaaatgattgagaattggggtacacgaacgttaatcgctctttatcttcagtgatatcaagaagcctgcactggaaacctgcgtgtgggtatggcccctcgctgagtgcccccaagaggaaggcatagccaagtctctgtcccctgagacttccctgccccaaggtcttttcaccaa

SEQ ID NO: 155185 - DNA, 601 bp, Human
caccgatgaggtctctatgtgagactgatttgaacaaaggactcaggcacataccacgcaaaaatttttaagtttcaaatcactattttggagccaggagaaatagtgtttggacaagtcacacctctttgtcttgaaattccagtccttttagaaagctttatgagacaaatgattgagaattggggtacacgaacgttaatcgctctttatcttcagtgatatcaagaagcctgcactggaaacctgcgtgtgggtatggcccctcgctgagtgcccccaagaggaaggcatagccaartctctgtcccctgagacttccctgccccaaggtcttttcaccaaattggagggccagtttttaagttattggaattatttttatagtggaaagtcatagggaagaatgaaaacatttcatttgaatgaaaacattttacaccctgaaaataccaaaaataagtctgagttttcatttctacttagatctttttagttggctcaattatttaagaactgtctggcatatctgtgaggataaggcaatagaaacaggctattctctgctgcagagaattgcagctaggactgagggcaactt

SEQ ID NO: 155186 - DNA, 601 bp, Human
aaatcaattctgcttgctgcatatctgatttcctagagcccactcgtcaagtgaggagacatcgtcagtgctgcagccggggatcgccatggagaccagaggactggctgactccgggcagggctccttcaccggccaggggatcgccaggtaactgaccagcctcagtccctaccttggcctgggggacactgttgcagaaagaaggtagtgacctctcaggaaaaagtgctagatgggggtggagttgaagatttggaaaagaaagggtcaggagcagagcagcctgaaaactatcagygagtaatttcctcttgggtcagatgttctgagctcagaaaagtctaaggaaaactgcctttatctgaaattgcttaataaaagctgacattgaggtacttgctcaggtttggaagaattcagaaaaaaagccaaccggagaaggtggtaagagcagccagccgtgggagacctttgattgggtggacacagtggtgtgctgaggatggtggtgatgagtctgaaatggctctggcagggtctcccgggtgctcgtctggaccccagggcaggtaggtgtccttgcaaaagcatttgtttg

SEQ ID NO: 155187 - DNA, 601 bp, Human
agtgctagatgggggtggagttgaagatttggaaaagaaagggtcaggagcagagcagcctgaaaactatcagcgagtaatttcctcttgggtcagatgttctgagctcagaaaagtctaaggaaaactgcctttatctgaaattgcttaataaaagctgacattgaggtacttgctcaggtttggaagaattcagaaaaaaagccaaccggagaaggtggtaagagcagccagccgtgggagacctttgattgggtggacacagtggtgtgctgaggatggtggtgatgagtctgaaatrgctctggcagggtctcccgggtgctcgtctggaccccagggcaggtaggtgtccttgcaaaagcatttgtttgcaagattagtgagactccaagctctgcttccccctgatgacatccgtactccagcttcaacagctgctccatcctgaggaagtcatttcaccttttcaaatctcatctagaaatgcatctaacagtgcctaccccacaggtggcttgaaagctgcttcagagccaagcaccgactcacggcaggtgctcaacaaacaccaggctcattatttccttccaccacgtgg

SEQ ID NO: 155188 - DNA, 601 bp, Human
gaccccagggcaggtaggtgtccttgcaaaagcatttgtttgcaagattagtgagactccaagctctgcttccccctgatgacatccgtactccagcttcaacagctgctccatcctgaggaagtcatttcaccttttcaaatctcatctagaaatgcatctaacagtgcctaccccacaggtggcttgaaagctgcttcagagccaagcaccgactcacggcaggtgctcaacaaacaccaggctcattatttccttccaccacgtggttttttccaatgccagagtcttacatagtcayatgttctaaactttttacttaagattatcacaaaagaaattcacatatctatttattcttcatgcttttcattatgaaggatgctactccaccattgtttatttaactagtccattgtagctgggcatgtaagtgatgttcagtgtttgcattttactaataaagagctgtcttaaggttctttgatgataaaggaagaaagagaacacctttaaatcagctctgtagggctgatacagggtgtgttgtaagcttgcaacacaagctatctcagggaaacagagccagtggggctcgcag

SEQ ID NO: 155189 - DNA, 601 bp, Human
tctgcagaactggggcctctctgcatcttgcttcgcccccaccctaactgggagataaacctgcaatcagactggtagccccttacacacagacacagggctgctgcctcccctcctgacttgttcatgagaagtctccccagcaggtggtctgcagagagacccctgggccagcacaggttgaatcaattgtcactgagcagtagagggtctctttaggacacttaggtctgtctggaagggaggagaggtaagacgttgaggggaagctgacctcccctcggcctcccaaacaggtggmttctcacccagaacctattttctggggggtgggaaaaggggatcaaataagcatgatggctgcagaacagacagtccctatataatttgctagagaaaaagctatctgtatgtcaatgaggagaagatgggttcaggtttggagcttctcaaatggtcatatgagggtttctggtgtgtgaaggtgatgaagtctcaggggaaacccagtggctctttcgggaacgtccattttcattccatatttgtatggggagtggcagtgggtatttgtatgtaatagatgatgcaggggatggcg

SEQ ID NO: 155190 - DNA, 601 bp, Human
gccccttacacacagacacagggctgctgcctcccctcctgacttgttcatgagaagtctccccagcaggtggtctgcagagagacccctgggccagcacaggttgaatcaattgtcactgagcagtagagggtctctttaggacacttaggtctgtctggaagggaggagaggtaagacgttgaggggaagctgacctcccctcggcctcccaaacaggtggattctcacccagaacctattttctggggggtgggaaaaggggatcaaataagcatgatggctgcagaacagacagtcyctatataatttgctagagaaaaagctatctgtatgtcaatgaggagaagatgggttcaggtttggagcttctcaaatggtcatatgagggtttctggtgtgtgaaggtgatgaagtctcaggggaaacccagtggctctttcgggaacgtccattttcattccatatttgtatggggagtggcagtgggtatttgtatgtaatagatgatgcaggggatggcgaacggcacgggcatttttaagatggaatatgagagttcaaggccatgtcttgccagtgactgctttaggagacccgg

SEQ ID NO: 155191 - DNA, 601 bp, Human
cctcggcctcccaaacaggtggattctcacccagaacctattttctggggggtgggaaaaggggatcaaataagcatgatggctgcagaacagacagtccctatataatttgctagagaaaaagctatctgtatgtcaatgaggagaagatgggttcaggtttggagcttctcaaatggtcatatgagggtttctggtgtgtgaaggtgatgaagtctcaggggaaacccagtggctctttcgggaacgtccattttcattccatatttgtatggggagtggcagtgggtatttgtatgtmatagatgatgcaggggatggcgaacggcacgggcatttttaagatggaatatgagagttcaaggccatgtcttgccagtgactgctttaggagacccggggaaaggtgtgagaatccctgactgagatgggaaggccagagttttcacacgagcttggactgcaaacgcttgggtttcctgggctgggggaaggaggctggggaaggcctgggcgctggcccagacaagtgcagggaggtcccaggttcccaggactgggcatccagtatcctcgagggacaccatgagacagaaagata

SEQ ID NO: 155192 - DNA, 601 bp, Human
aggacaaagtggagaaagaggaagagggaggggggaaaaagaagtttctcagcaagccagccagactggtctaattccttttgggcaagcaaagacttccttatttaaattgatcaaattaccttcctacatccttagagatgaatgttagactctctgtccatttcccgatgggaccagacaaatggagggttgagctaggaccatatccagggcaggccccgaccacctcacagacatctgatggatcactcgcgggcagggtcagcatgggaagatggatgcgatggtgcggatagtsttggtcaatcagcaagtcttcctgggggtgaggattttgaatttttctggaggcaaagtctccactgcaaagccaagtatatacacagacaggtcctagttctcctgtgtgggcttggctttgtggggttacgggcacagaggcatggtgaacacagccactgcatcccccacggagctgaaccttccctccttcacaatcccacggcggttccagttcctgggagattttcagatgagcagaaccaatctagaaacaagcggttatggccatatcttagacggagagagggagatttgg

SEQ ID NO: 155193 - DNA, 601 bp, Human
tttgacttaaagccaaacctgacactaaacacccttgcagctgcagtatcaagtctttcaggcagggaacggctccagatactgaaaccatggacagaggtcctgggggtttctaggcatctttgtcctggggctggggtgtgggcaaggatgtgggtggatagcgtgggctgcacccggctcttcaatctttcaataaatgggctcacttcactggtccactttgaagccaaggaccaagggacaaaactgggaactatcccaaaatgaggacacacacaaaataattatttatgaacaycttccccgactcttcactccatttctgtcattttcatatggtctcatttgtcctgaataatttttccctcccccatcaaactgttcccagccaaaaccagcagcattttgcagttctgtgtagggttcttttggggcagtgctgggtggatttggggatgcagccgatggtgctgggtctttcctaggctctcagcagtttggtacccagacaggccaaggcccgtaatccagggccacaaatcttgcacaaggcaagctgagtccggcgtaaactgcagggcaaagctcacccaaaaag

SEQ ID NO: 155194 - DNA, 601 bp, Human
agaaagaaatgcctgagactcggtaatttatcagaaaagtggtttaattggcttgaggtactgcaagctatacaggaagcatagcagcttctgcttctggggaggcctcaggaagctttcaatcatggtggaaggcaaagggggagcaaggagtctcaaacggcaggagcaggaggaaggtggggtaggtgccgtaaacaaccagatctcaagaaaactcactcactgtctcaagcaaagcaccaaggaattggtgccaaaccatgagaaatccaccaccatgacagggacacagattcaraccacataagctggttacctaacttctctgtgtatctgtttcctggcttataaaataaggattgtaatagggtcttattacatggtgggagtgaagactgaatgtgttactctgtgaaaagtgctcagaacagtgcctggtacatagtaagtgctcaataaatattgacttgtgtggtaggcagaacaatctcccccaaaagatgtctaccatcctaatccttagaacctgtaaacaggttacctcatatggcaaagggaacttcgtaaatgtgattacattcaaggtccttgagatagg

SEQ ID NO: 155195 - DNA, 601 bp, Human
gagtgtttaattagcagaatttatctctcaaccatgccttccttcagcgtgtggaagagagaaatcagaggggcctgaaggggactcgaggggttgtcccttccgcaacctttgtttcttcaactattcaatggggcattactgcctgccttgaagaaatttacatgtattcattagataactttataagagttcctagctcttaaaagacacccaataaagaagaggcagcagtgtgaagtcttatgttgaagaaaaacctgcagtcacaggaccatcctgcggacgctgcctgaaccgyctcgcagcccagcaaagtccgaaggcgtgtctgaactcggccacatttgcgaacctgcgaccacacttatttgccactacatgcgtcacagacccgcctcttcgaatgttgcttcccttctgctcactggctttctcattaaggcccaggttttcacttgatccagagagaggtttcaagaacagcggacaggccacacccttccattcagaacggagagcctggcgtgggatttccaaaactccgagtaactttcccaacttcaatgtgtggatttgggtctatgtcgtactacctcaa

SEQ ID NO: 155196 - DNA, 601 bp, Human
gaggggcctgaaggggactcgaggggttgtcccttccgcaacctttgtttcttcaactattcaatggggcattactgcctgccttgaagaaatttacatgtattcattagataactttataagagttcctagctcttaaaagacacccaataaagaagaggcagcagtgtgaagtcttatgttgaagaaaaacctgcagtcacaggaccatcctgcggacgctgcctgaaccgtctcgcagcccagcaaagtccgaaggcgtgtctgaactcggccacatttgcgaacctgcgaccacacktatttgccactacatgcgtcacagacccgcctcttcgaatgttgcttcccttctgctcactggctttctcattaaggcccaggttttcacttgatccagagagaggtttcaagaacagcggacaggccacacccttccattcagaacggagagcctggcgtgggatttccaaaactccgagtaactttcccaacttcaatgtgtggatttgggtctatgtcgtactacctcaaaacgtctccagtctctggctgtttgtgacttcccaggagctcatgaaaatagatcagaaattgtaga

SEQ ID NO: 155197 - DNA, 601 bp, Human
ctctcttcaggacgtctccacgacgccacacgccacgccctctctccgggacgcagcagcctgccccttccatttggtaatgtccttgatatatgaagtctgctaaatgtgccccggcatcatccagcagcaaggcagaaaagaacgaagagaaaaaagaagagagaaaagctacctaaaacacgaggaggaagtactgaaggaagctgcctctaaagacggggtgccatggtcccagcaggcctgacccctccctgcagggctccagggctgggtatcttggagcaacgctatcaggggrccttagcttcggccctggaggggagagggtgcttggagctgaggaaaagtcggtcccagcaggctgcagaccatgcctcctgagaccatgtgaagcccccatcttgcagaaagaatcctctccaagctccgggaactcaaggggggcttataagtaaagagagttgcttgtctgcagcctccggtgggcagccgggggctgcccctgtgagcctgctcatgtgccccccacccgaagcatttcgtttgccctcacaagtgggccggccacacgtaggctgagggcttctctggggcactg

SEQ ID NO: 155198 - DNA, 601 bp, Human
tggtcccagcaggcctgacccctccctgcagggctccagggctgggtatcttggagcaacgctatcagggggccttagcttcggccctggaggggagagggtgcttggagctgaggaaaagtcggtcccagcaggctgcagaccatgcctcctgagaccatgtgaagcccccatcttgcagaaagaatcctctccaagctccgggaactcaaggggggcttataagtaaagagagttgcttgtctgcagcctccggtgggcagccgggggctgcccctgtgagcctgctcatgtgcccccsacccgaagcatttcgtttgccctcacaagtgggccggccacacgtaggctgagggcttctctggggcactggaagatacaatgttcacaaactttcacccaaattcagtggtgatgagagctgtagggaacgtcccaaagcccggtcagtgagtgaccttgcacttgcagcatccaggtgaaggcaggaagtcactggggtctccgatggagcacaggagcactctgcaggcctgggccagcgtgggtcgcatgggatggcagaggggacacatggacccaacaaaaaggcagtctccag

SEQ ID NO: 155199 - DNA, 601 bp, Human
ggcagggctgggcactgttctccttcaggtgggcaggaggctttggggcgctgagcaagcagcaggtgggcggcaggggcaggctgctgtgcccgtgaggataggaggagagctgggggtgctgcctgtgtgggaaacagcagaaagatggagaaggtagaaaatatttactgtctgttccattgttaatctctcggaaattctcctatttttgttgaactttgaccccagaaagggcaggtctttagcccctttacctgactctgccagtgtggcctggaaaacggtacctcctgggatattgtagctctctgctgagaggcaatggggccgctctttggggtcaatcccagctcttctcaggagttctgtgactgtgggacagaaaagcttctcagagacatctcatcagaagcgggggtgattacactgaggtagtgacaccgcaggcagggccattcccatattacatgatccagcgtcttccacacagagcccgtgcccacaggtgggtggtccacgctccagaaacacacgcacagccatccatctcccacatggcttctttagggcctgtttcgatgagctgcagtccgagtac

SEQ ID NO: 155200 - DNA, 601 bp, Human
ttgtggtgtttttgagacagagtttctctcttgttgcccaagctgcagtacaatggcacagtctcagctcactgcaacctctgcctcccgggttcaagtgattcttctgcctcagcctcccgagtagctgggattacaggcacgtgccaccacgcccggctaattttttgtatttttagtagagatggggtttcaccatattagccaggctggtctcaaactcctgacctcaggtgatctgcccgcctcagtctctctaagttctgggattacaggcataagccaccgcaaccggttgccraatgattttctttaaaatatatatttttttatttgttaagggaatttttaagaatggtgaaattgaattgctgtgggtataaaactaaggaatccccagaagaatgattttatttcataggaaagcaacctggagattagctaggaaaaattcaatatagttctccagaaaaatgtattttacgtttccacagacaattccactattattaattatacattttctaatacagtgttctccagctagtttttcacagaagcatctgtcatcttccattcctcactgtggctctcaatccag

SEQ ID NO: 155201 - DNA, 601 bp, Human
gacatgtcagaagaccttgccctcttagaatggtgccctgagactgctatgtaaggaagccagtctaatccagtgaaggataagtgaggtatcctaactgatagccaccacctactactaacatgtgagtgaagcccttttaagtttccagcccagtcaaccttccagctggatgcaactacataagtaagcccaggtgaaatcagtagaggaactgttcagccaacctccaaagttgtgaaaagtaataaattatagtttcaagtcactcaattgtgggttgggttgtacacaagaagakataactactaacagttactaatttttgtgtctactaggaaactaaagggagcactggctggcactctattatggacacacatcgacaaagtgtttttctcttccctgatttcactgtagcaagtgaaactcatattccaattataggaaactcacaaagcaacaagaactctgaaggtggctagaatggaactcacagtaggtaatgagtctcagagctatcctgctagaaacctgttccattagcagcattaactctaggctcatctttttactcacgcttctcgatcttctctgtccc

SEQ ID NO: 155202 - DNA, 601 bp, Human
tattacatcatttcctatttttgagagttggggccaaaagagagaacagttgatgctacttctgtcatccaattgctgatgcttttctctgagtttatattgttcagaaggaaaaagcaaatgagaaagctgaccactggcaagtggaaattacattccagaatattcttgaagagaaaaataattcaaagtttctgagttattcctactgcccaattttctgactctcttttcacttcttaccatgaagaaggcaccccggtgataatacttctgtaagaacttgtatttgcccttaacmgctttgttggtaatgactttgccgtttgcccgaagttcagctctcctctcttcctcagtcaggtttcgcatgcgttcaatttctgctttctccttctcaagcctgtccagggagcaaaacaatttattggtactgttacagcttcagaaagaccaaattatctgaaaataacagtcccatgtcatttcaagtattagtcaccttctttaattctagtcattgcctattaggaatcaagataaggagctcaataaacaaatgggtgagttagtcttcattatgtttgctagactaggtatt

SEQ ID NO: 155203 - DNA, 601 bp, Human
cgatcttggctcactgcaacctccgtctcccaggttcaagcagttctcctgcctcagcctcccgagtagctgaggctacaggtgcatgccaccacactcggctaattttttgtatttttaatagagacggagtttcaccgtgttagcccagatggtctcgatatcccgaccttgcgatctgcccaccttggcctcccaaagtgctgggattacaggtgtgaaccactgcgcccggccgagatgatattctttttcctttgttgtatttctcctttttttttttttttttccctgagacagsgtctcattctgatgtcctgatgtccaggctggagtgcagtggggtcactactgctcactgaagccttgacctcccaggatcaaacgatgctctcacctcagcctcctgagtggctgggactacaggtgcatgcaactatgcctaattttctccttgagtgtagacgtgtcttgaaggttggcttattctctgcactcaatgtgtttgtttactcatgtgacttcaactctgcataggcctctcaaatctgcaatcctggattttttactggctttcatatatcataagttggatatttta

SEQ ID NO: 155204 - DNA, 601 bp, Human
ataagacacagattgttgggtctcaccccaggtactgtgattcagtaggctggagtggggcctaagaatgcatattttaacaagtttcaaatggtgatgatgatgatactatcagtctggggatcacactttgaaaaccactgttttaacttatacccttactcaaccattgtggaagtctcgggatactttgtctaatctttcccaatgaatatcctgtgtgccacttagtatttctacttaaaaacaatatcacttcttaaagtatcacttcagaaatcatcaccatctctaagttgcrttccactttttagagcattgcaatcttacagatatttaacacatgaaaatatgtgtatatatgtataatatacttactactctaatgtatagattcaacagtaaaagattatgatgggtaaggtatttgaagactcactggtaactaggacttttgatttcatgctataaacaacaaaatgtgtatacaagtgggcaacctccctcctcaggacttaccagtgactggcgcatcaatatccagcaaatttttttcctgtcgaagaattgatgcaccctctgttattattctcaatgcaac

SEQ ID NO: 155205 - DNA, 601 bp, Human
tatctccatataaactaaggccacattgcttcatagtgacaaatgacactatgaggagaataaacactgatcttttaggtcccagaagacaccagattcctatccctgcttaactctcctcagagtgcaggcaaggggaattctcctaattgacgtcagctgctgtaagggaaggactgccatgaccttaaacttggccaccagtccactctcacatccaggaacaaagccagagggttctcctggcaactgcctgacatgctaaatggcaggccccggcactgagggaatcctctgctgmcccagggacaaatcccccactgcaggaaacaggcaaaccagagagattagcagtttgcccagctgatgctggcctatcccctctgcccagagagcagaacatgagttctaaatcattctattcaaaaaacctaagctcccggtctgcttttgcattacaaatgagtggaatgttctctgctaagtgaaaggaaaacaggaaaatatgagaacttcagggagaaatgtaaattggatccctgcacaaatcatcttactgttttcaagaagactttaagagatattaacgttttaaatacaa

SEQ ID NO: 155206 - DNA, 601 bp, Human
ggaatggatattttatatcaataatacaggcaatttaatgtctagctttcacctacctttgatatatatttaataaatattaccagcttatctcatgaagaaggcaaagcagtggttgagattaagctaaggtccacctttgaaggagttggcctttaatgtttaaaacataagaaagagaatttcaaatgaataatgtgtttcatgcttgattatctgagaatctcttattcgccaaatggtatccaaatatccactcaaactttaccttttaaaattaaatgaaaaatatgtaactagrattttaaagaggataatgaatttctacaaatgtctgtgagcaaagctgagttctgaaacttgcagcctgattataatgctttgtaagaaagaatcagattatgcttattaacaaagaccaaagcaaacatgcatattacttcgagaaaacggaaagggaaacacaaacgatcctttgtttgaaatgaaaacaaatgtctgcatgtcatttcaaaaatattcttcataagcaatataggatgtatgattctgagagcaattaaaagaactaggtgtatcaaatgcataccaccagatggca

SEQ ID NO: 155207 - DNA, 601 bp, Human
ctgtaagatggctcattgccaccacgtccttaataaactaagctaaccagccacaaattattttctaaggagctaaaatcttctcatgtatttttaacatttcctcaattcagagtctcaagtggaatggatattttatatcaataatacaggcaatttaatgtctagctttcacctacctttgatatatatttaataaatattaccagcttatctcatgaagaaggcaaagcagtggttgagattaagctaaggtccacctttgaaggagttggcctttaatgtttaaaacataagaaakagaatttcaaatgaataatgtgtttcatgcttgattatctgagaatctcttattcgccaaatggtatccaaatatccactcaaactttaccttttaaaattaaatgaaaaatatgtaactagaattttaaagaggataatgaatttctacaaatgtctgtgagcaaagctgagttctgaaacttgcagcctgattataatgctttgtaagaaagaatcagattatgcttattaacaaagaccaaagcaaacatgcatattacttcgagaaaacggaaagggaaacacaaacgatcctttg

SEQ ID NO: 155208 - DNA, 601 bp, Human
aagtctgtaagatggctcattgccaccacgtccttaataaactaagctaaccagccacaaattattttctaaggagctaaaatcttctcatgtatttttaacatttcctcaattcagagtctcaagtggaatggatattttatatcaataatacaggcaatttaatgtctagctttcacctacctttgatatatatttaataaatattaccagcttatctcatgaagaaggcaaagcagtggttgagattaagctaaggtccacctttgaaggagttggcctttaatgtttaaaacataaraaagagaatttcaaatgaataatgtgtttcatgcttgattatctgagaatctcttattcgccaaatggtatccaaatatccactcaaactttaccttttaaaattaaatgaaaaatatgtaactagaattttaaagaggataatgaatttctacaaatgtctgtgagcaaagctgagttctgaaacttgcagcctgattataatgctttgtaagaaagaatcagattatgcttattaacaaagaccaaagcaaacatgcatattacttcgagaaaacggaaagggaaacacaaacgatcc

SEQ ID NO: 155209 - DNA, 601 bp, Human
tcttatttctgtcattttttttttaagataaactgactgaaccagaagtttgaaaataaactgagaattctaaacaggctacagaggaggaaaaaagtctgtaagatggctcattgccaccacgtccttaataaactaagctaaccagccacaaattattttctaaggagctaaaatcttctcatgtatttttaacatttcctcaattcagagtctcaagtggaatggatattttatatcaataatacaggcaatttaatgtctagctttcacctacctttgatatatatttaataaataytaccagcttatctcatgaagaaggcaaagcagtggttgagattaagctaaggtccacctttgaaggagttggcctttaatgtttaaaacataagaaagagaatttcaaatgaataatgtgtttcatgcttgattatctgagaatctcttattcgccaaatggtatccaaatatccactcaaactttaccttttaaaattaaatgaaaaatatgtaactagaattttaaagaggataatgaatttctacaaatgtctgtgagcaaagctgagttctgaaacttgcagcctgattataatgc

SEQ ID NO: 155210 - DNA, 601 bp, Human
aaaaagtcaattacccaaacatgaaatgaaaatgtatttacatccaaatgattctcaatcatcaaatataaagaaattattactttgacatgggactctttagcaaagcccacccttgcatatatttggctatttacttctagttttctaatatataatagctcatatttcccattttttatttttcattttcttctttctaattgatatactgatagcgcaaaatatgttcatgaaaacaaaatttattttctttcgaattaaaactcatttggaatttagaaaaggtaagtaggggacrgctgtggttaggaggaactatctgcacactctgtcacagcacagccctctcagtctttacttacatccacaaaaggggaactgcaagctatattatccaaattaatggagtttttataaggtgtctatacttctaatcaccaaaaaccatacactagaatcaacagttgatgtaacagatacataacaacaataccggtcacaatagtaacagttacagcaataacaacaaaaatttactactcattgggcatatctgtgctgtggttgcagcgtttcactctttctgagtgacaggcat

SEQ ID NO: 155211 - DNA, 601 bp, Human
aaacagcacaattagggatgttataaattataaccatgagcactaggaagcctatcaaaatcaaaataagagttgacaataatttgattgtaaagtgatttgtatggaataaaaaggtaagattttgaacaatttcatatgtgattatttactcttaagttgtcatactgggctatactgtgcttttctctatttctaggacaataaaaccaggaaaaattggaaagcagccttaatttttctttaaaaaaataattgcataaaagtatctctaagacctatcaacttttaaggtgatagactgagattcaattaacattttattggtattaaacaaaatcaaattgaatgaaacaatcattaagtacctaatacagacaggcattgggacagatgttaagattgctttcaagaagttttagatacagttatttccctcaaggaattttcaggatagctgggagagagaagatactacctaataaacattaaataaaacaggcttaagtattaaaatgcactgggaactaggggaagagaaagaccttgctatctgaggagtcaagaaaatctttccagaagacgtaggacctgagcctgc

SEQ ID NO: 155212 - DNA, 601 bp, Human
accatcacaagtttatgatcaccatattaaaattaaaaaaataacatactaagtatctcgactttcacagacttttactgggtatattatgggcatttataaatatgttgatggctactaagtagaaggaatttaacatcagaaaagatatcaaatactcaatactctaaaaacctgaggatcctttttaaaacaaggtctacaaaggtaacataacaaagctcaaataaaataatatatttcaaagaaatgaaatttacataacttagaatataaagggaaaacaaaagtgttttaaaayttattttagtaaaaataaagtggaggttcctctgttatgcgaatagttttgtcaatttttaactttcctcaaataagtataatctggaatctaaaagcaggatttgataaaaatacacagaaaagcccactatactttgcagccagaccactcaaaaatcacatttgacataaaaaagaaacacattacaatgaaaggattatacaaaataaagtatcttacaattctatgattatatgaatgtttagcaatatgaatttgccatgagaggcacacaaatgagttgtcacatctttagat

SEQ ID NO: 155213 - DNA, 601 bp, Human
gtagttcagtaatgtcaagaagatcctaaacaaaacaactatacttttacttggaaccaaaacaaatgtcaaacaactcatatgagtcaaatgaaaagtggaattcaggtgctaagaaagtacatcaaacaaagtaagaaaaggtttatataaattctatgaattgaatttttgaattttctattataaattattttaattgtttctgatttacatcagaagggcaaatatgaagtaagtactgaatacatcagcaaatctttgatatatcttaccaggaatgactgttgaattaagcacaaaaaaaaaacacaattcctataacaatgactatcattatccagagtacactactatataccaagaaatattattttttctgtttactaaatataaacatatatatccatccatttacagaaggtttcagtgaatatatgtacatagatcaattttagtggtaataagtgatattttttggtcactgagttcctactacatatcagttattacgtgaggagcttttcaacattatctcaagtctcacagcactgtaaagtagaaattatttcaatcacttgcacagaagtttaaatgagga

SEQ ID NO: 155214 - DNA, 601 bp, Human
actcacaaaaataaaactagtggttttaaaatgttcaggaattcatcatatggtgggaagttaaatcacacaataacaaaagttgaggttatctcttactttgacacagaggtgtttttaaagggtagcaggaggaaaccctgattagactaatcaagatattccctttgaagtcatgtaacatatagttggagtaagaaatgcattcatagaatgaaaaccaacaagggctttgagatcacctagaataacctcttcatgaattacaggaagacattgtcagaactggcacaatctctcrggattcctgattcatagtagtcctgtactctcatcacttttagacaatagttttcactaatactattattttcaccctccttttcctgttaagcttgggaaaaaaagggattattgtagttcagtaatgtcaagaagatcctaaacaaaacaactatacttttacttggaaccaaaacaaatgtcaaacaactcatatgagtcaaatgaaaagtggaattcaggtgctaagaaagtacatcaaacaaagtaagaaaaggtttatataaattctatgaattgaatttttgaattttctatt

SEQ ID NO: 155215 - DNA, 601 bp, Human
tatatggtctccacaaaaccttactccctcaagtctgaagacatttaaaaataattacgggagaagatgagggaaactttcccagcagttaaacaggggtagtcatggaaggcacaaacatcacgcctctcaggttattacctctgtcccgctgccaaacatgatgtaagaaagcagaagtgagctctgggtcaaggacaaaatgagcagtacattaagggattgctttatttaaaggtcagtaggaaaaggtcagttattatgtgatctacagggtttttgtgagtagaaaaactcatgyctattgctgaagaataactgttaaatgtattagtgtatacaaacattaaattttaatacagccaacagaaattaaattgcaaaagcaacaataacgtgctgcagaagtaaagtcatcaccttctccattgttattcggaaggaaatagatgacaaacaaagaagggtcgggggacctggtgcagagaatccacaagagcatctagaagaccagagttctgggcctagttcagcactttccagctgtgagtggcagtgcctgactgctccaagcctcctaatctgtaaggccagtagctgg

SEQ ID NO: 155216 - DNA, 601 bp, Human
tatgtacccatcttgcttctaattcactgatatattccaaaaacttacaagaatacctagaatatagttggtgctacattaattaccaaattgtgaggttatttaggaccttaattatgaaaacatgtaaaaaagtattcagcactgtgactaacagagttagtcacagttcccttgtgactaaatgtccccaaaatgttttcctcactttcctttcttttaaaatcttaaaacgagtctttgtcccccttcctcatttcagactcctttctaagcacatgtggtcccttctctaatgagycttaggaggtttagccctatttccatgaaatcacctagttttctaatgcagagggaagctgaatctagtttttaaatcaggacaaattctaacttacaatgggaattcatttgctttcttattcccacaagacatattaaacataactctctaagttctcattctttctaaaacccacgtcctcacttaaatatattttttaatgatcctgtaaaaaaaggcttcaaaacttgcaatgctactttattttcacaattcagactaataaaatcaattaactacaaggcacacattagattt

SEQ ID NO: 155217 - DNA, 601 bp, Human
gatagtctgtagactacagctgtgtatttcttattaaacgagtcatacttgtaaatgacttaatccagagcattagtgctctatcaaagtactgatggagagcagtgggagaaaggaagaaacaaaatgccatcatatccagagtaccgcttgactctctcaataagcccatgacaggcagtggaggtattattatcctattgtaagggaaaaaatcctcaacatgagtatgtctagaaattcatgctatattcccacaacctgagcatagaaccagagagattggtccaaatcccatttytgacacttctatctgcggccttagacaagctcttaacattactggcttcagctatttcatctacagagagaattatgtacccatcttgcttctaattcactgatatattccaaaaacttacaagaatacctagaatatagttggtgctacattaattaccaaattgtgaggttatttaggaccttaattatgaaaacatgtaaaaaagtattcagcactgtgactaacagagttagtcacagttcccttgtgactaaatgtccccaaaatgttttcctcactttcctttcttttaaaatc

SEQ ID NO: 155218 - DNA, 601 bp, Human
acaaataaataaatggaatttaactaactggaaaggagttaagggctgggaaagaatatcatggaagtagggtgagaggtgaaaaaaaaaaataacaacaggagactgccttcatatttgccaaaaaatgttcaccatgcttgggtcaacctcacacctagcatctcttctctacatgtctgcacttttcttagatatacctatacttggattttactaagaaaagtaacagaataatcacgtttcatctaccttcactcaaaaattcttgcccagcctataattaatcattcttatctgytccccaaatatcttaagctttcaaaattcattcaatttatttaaactcttatttattgagcactcttatttactgatacatttaccaatatatctgtgaaactgacacaaatccctgccttcaaggagctcgcattctagtctagtcaaacttatttgggcaaataatcattttggtattttttaaagtactaaaattcaatcccatttaaaaaggaattaactagcatctacaggaatacttaaatatttactgttttacttactatcacatttttccaagtagctatcaatactcacc

SEQ ID NO: 155219 - DNA, 601 bp, Human
tcaggcaaggcccaagttttttggctctgctaacaattatggaaatttcccctatttctatagttttccatataaaatacagtatttatttgctagcatttgctgatcttaaacgtggtccaattaacagctgtaacacaagatacaaaagtgacttaaattactcccagataataatttaagattcttggcttaccaattgaaataacaaaagtggccttagaacaagtaacacaaaagtctgtaatttagagcatcaagacattttttcccacaattatataaaactacatagaaaagaaaaaaaaactcctcctgactcttgttgaaaatctcccatagagatccaatggcagaatatactgcaaagtacctgagatgttaggctttaatctcctggaccctcaaggctataatttttcctggtaattctaaagccacagttaactacataacagagagcatcagtcagaatttaaaaagcaaaagcaataaacattttgcatgttactacaaataaataaatggaatttaactaactggaaaggagttaagggctgggaaagaatatcatggaagtagggtgagaggtgaaaaaaaa

SEQ ID NO: 155220 - DNA, 601 bp, Human
gtgtggctttggaaatgtttaaatttgaggtgtgtctcacacaggcaaatggagaaaagtagataactagaaatatgagactggacagaggaaaggaccgggctaaagatgagaatatttaggaatcatctcacaaaagacaatttttagaacaagacaatagggaaaatatccaaaggcagtgaatgtagatagaggagggaagtctaaggactaaattgtgggacactctaagagggagaagaacctccaaggagactaagtaaaaaggaccacaaactaaggaaaaagcaggtgagcrtggtatcctgataaccaagggaagaaagtattgaaagaaagagggagtgtcaacttctcaggaggtccaatgaaagaaagactaaaaattggctgatggcaaaaaggttcaggtactgaactgaataatatctattaagaccatatatacgtctccttaaaaattagtttttaggagctatgccatactatccacatgtctagcaagtaagacctcttattatatcagaaatttacaccagtcttttgtatctgcttacacatatgatgatacatgtgctaaatccaccatcttagcctt

SEQ ID NO: 155221 - DNA, 601 bp, Human
actatagaggctcttggttaaggcaccttaagaacaaattgcttctggatgcatactgagatgcatggtgacttttgtgtttgttttttgagtaaatcccagccacatggttaccagacagttttcttcacctagacagctttagtaaaaaagcatcaaagaggagcttagtcaacatttaaatcgttaccgaatatgtgtacaagtatttaccaagagcttaatatatgtgatgtattgttttagacactggaaatagggcaatgaaaaaaagagttaaacatctctcccctccttcagygtacactctaaagaggcagaaagataactaataaataaaaaaaactgagctacaaagtgtatcaatgaatgataagtgcaatggagattataatctaggggtgataacaagcacctgggaagtggtgagggttgggggacacagctatcacacagggtggtcagagacggtctcccttaggaggtgacttctaaacacagacacagaaggtcagggctggtataattatgtgggtgacaggctggctggctggaaaggacacaaactacagaacatgtgtgagaaagagaagggaagcca

SEQ ID NO: 155222 - DNA, 601 bp, Human
ggggagataatctttagacagcaatagggatgatgattcctgacatcactatagaggctcttggttaaggcaccttaagaacaaattgcttctggatgcatactgagatgcatggtgacttttgtgtttgttttttgagtaaatcccagccacatggttaccagacagttttcttcacctagacagctttagtaaaaaagcatcaaagaggagcttagtcaacatttaaatcgttaccgaatatgtgtacaagtatttaccaagagcttaatatatgtgatgtattgttttagacactggraatagggcaatgaaaaaaagagttaaacatctctcccctccttcagtgtacactctaaagaggcagaaagataactaataaataaaaaaaactgagctacaaagtgtatcaatgaatgataagtgcaatggagattataatctaggggtgataacaagcacctgggaagtggtgagggttgggggacacagctatcacacagggtggtcagagacggtctcccttaggaggtgacttctaaacacagacacagaaggtcagggctggtataattatgtgggtgacaggctggctggctgg

SEQ ID NO: 155223 - DNA, 601 bp, Human
ttgttgctttacccaagaataaaagaaaaacccttgaacatctgaaactgctttgatgtctaagtagttgttcaaatattataatacttacatgtgtacatcaataaaatgtactaacctttcaagagaattggccatatacaagcacaaagcagccttttatgaaacaataggtaatttacatgaaaataaaaggaatttatcagataacattactgagatatactcaaactgccattggctttgttggtagtgacatccaggccatagatactacataaaattttctatataacaacaraagtggtttgcatgttaaataagattagtcttacctggttagttaaaaggaaagtagatggatgatacagcaatggaatgatcaaaggtagaagatggtagacttgctaaatcagttaagtaaaaatttaagtcataagggatcaattagaatacatacaaccagataaaatatggaacatatattcatttagcagatttcaagaagataaacttgaatttgcatgcacattccaacttaaaagtattttaggatgaaacatatacaacaaccatttagataatgaagtactcctaggca

SEQ ID NO: 155224 - DNA, 601 bp, Human
cctaaccttttaaccaatcagacctcattctcaacttatacaatttttatattaaacccttttcccttgttgctttacccaagaataaaagaaaaacccttgaacatctgaaactgctttgatgtctaagtagttgttcaaatattataatacttacatgtgtacatcaataaaatgtactaacctttcaagagaattggccatatacaagcacaaagcagccttttatgaaacaataggtaatttacatgaaaataaaaggaatttatcagataacattactgagatatactcaaactgscattggctttgttggtagtgacatccaggccatagatactacataaaattttctatataacaacagaagtggtttgcatgttaaataagattagtcttacctggttagttaaaaggaaagtagatggatgatacagcaatggaatgatcaaaggtagaagatggtagacttgctaaatcagttaagtaaaaatttaagtcataagggatcaattagaatacatacaaccagataaaatatggaacatatattcatttagcagatttcaagaagataaacttgaatttgcatgcacattcc

SEQ ID NO: 155225 - DNA, 601 bp, Human
atagactaattattctttgtacaaacagtaaaacatttgctatgtctatttttttacctgtacaatctttaagacagattcagacagacacaaacttaaactgaacattaacctttaatgtgcttcatacagtcccctaaccttttaaccaatcagacctcattctcaacttatacaatttttatattaaacccttttcccttgttgctttacccaagaataaaagaaaaacccttgaacatctgaaactgctttgatgtctaagtagttgttcaaatattataatacttacatgtgtacrtcaataaaatgtactaacctttcaagagaattggccatatacaagcacaaagcagccttttatgaaacaataggtaatttacatgaaaataaaaggaatttatcagataacattactgagatatactcaaactgccattggctttgttggtagtgacatccaggccatagatactacataaaattttctatataacaacagaagtggtttgcatgttaaataagattagtcttacctggttagttaaaaggaaagtagatggatgatacagcaatggaatgatcaaaggtagaagatggt

SEQ ID NO: 155226 - DNA, 601 bp, Human
ctgcagcaataacaacaacagcaacaaactcagcaaaagcagtttatttcatgttggatgactcttataatagaaaacatttctttgtatctctttttgatgtaagggatactgcacatggtttaaaaataagaataatcaaacgaagacagacattccacatttctccttccataaaggcagtctttttcccaaacattgaaaaatgaaataatgccatttttaaatatagactaattattctttgtacaaacagtaaaacatttgctatgtctatttttttacctgtacaatctttaaaacagattcagacagacacaaacttaaactgaacattaacctttaatgtgcttcatacagtcccctaaccttttaaccaatcagacctcattctcaacttatacaatttttatattaaacccttttcccttgttgctttacccaagaataaaagaaaaacccttgaacatctgaaactgctttgatgtctaagtagttgttcaaatattataatacttacatgtgtacatcaataaaatgtactaacctttcaagagaattggccatatacaagcacaaagcagccttttatgaaacaata

SEQ ID NO: 155227 - DNA, 601 bp, Human
gattaaacaaaacggcagcagctgctgcagcaataacaacaacagcaacaaactcagcaaaagcagtttatttcatgttggatgactcttataatagaaaacatttctttgtatctctttttgatgtaagggatactgcacatggtttaaaaataagaataatcaaacgaagacagacattccacatttctccttccataaaggcagtctttttcccaaacattgaaaaatgaaataatgccatttttaaatatagactaattattctttgtacaaacagtaaaacatttgctatgtctatttttttacctgtacaatctttaagacagattcagacagacacaaacttaaactgaacattaacctttaatgtgcttcatacagtcccctaaccttttaaccaatcagacctcattctcaacttatacaatttttatattaaacccttttcccttgttgctttacccaagaataaaagaaaaacccttgaacatctgaaactgctttgatgtctaagtagttgttcaaatattataatacttacatgtgtacatcaataaaatgtactaacctttcaagagaattggccatatacaagcac

SEQ ID NO: 155228 - DNA, 601 bp, Human
atcttttataatttacttatttatactttattggatttattatgttttgtcttctactgttaagacagtaaggaactttgtagaaactttactgtcatatcccaagtgcctaaaacagtacttggcatataataatacctcaaatacttgttgaatatgtgtcaataagaagttcctaaatgaatcaattgttttgatttctcctctccctcttgtcccctataaggtcctatcagttctgtataacttgctatttctaaaaataatgggatttaagttttttttttttttttttagggtyctggctctatacaattaaaagccgttgcaaaatctgttaattgggtagatttacatagaatgattatgaaataaccattgagatcacttacttcagtggttcccagacttggatttcatggaccagtaaaatatcccccacagcagagagagggcagtgaggatcagatgaaaatataatgtcagtatgttcttttgctctgcaaaggcattaaattaaaccaatagcatctatcataattaaaataggattaggttcatatacctaatccaccaaaaaacttagaagaaaaaatggttc

SEQ ID NO: 155229 - DNA, 601 bp, Human
catcaactgatcctcgcacctcagcctcctgaccagctgggattacagacattcaccacagagcctggctaatttttttgtagagacagggtcttactttgttgcccaggctggtctcaaactcctagcttcaagcgatctgcctgccctagcctctcaaagtgctgggattacaagtgtgagctactgtgcctggccacatgacagagttctagtatctgtaatttcacatccaggccttcattctctccacctataaacgtccactggaacacaattggaagaaaatattggtaaaaaygttgttcctttcatgagcagcataagcagtatgttatataatttaatctaattcagcgttaataaatactcaagtttaaattttaccaaaacaaacccattaattacaaatgaagtaacccaaggtttataggatgacagactcttagcaatactatgaaagaaaccacaataaggtatactgccttcagcctgctcactctgagtcacacttgcctccttgatgttgtaatatttctttctgggagccaagctccagctgttcacactgtgaagagcccttcctctgggtgtctcctta

SEQ ID NO: 155230 - DNA, 601 bp, Human
tttggcaggcatttcctgcatttgtgcatggcagtttcctggactccagttcacagtttgcagtagagggaacaacagcaacaagaaacctgaactgatatattcctctgctttttctaaaaattttgaagatacttaattcattgttttaaaactcttttcagtgtgaaatatctggggcttttgttgttgttcgccctgaggtcccttctctcaagaaaaactaatgatctgaatctatcaattcaggatatgcattggcccacaagtcaaagtagtggtatttttaaagagatcacaraagcatgtagcatagacagtgtggtctctgtaattgcttgatgtaggctttaatgaggacaagagaatattctctcatcctttcttattcccaccctttcttccaggcttaaataaccatctggacaaggtgtgttcatccttatttttattctgcttccctctcttctctttctactcttcacacttgcgtaagccctgggctgggttatggaagcacagcagtaggtgttaggatacatattttgctctggcatatatgataggtacaccatggtttaaagtttctggttgatttagg

SEQ ID NO: 155231 - DNA, 601 bp, Human
taggggctatggagtagttacagctttggcaggcatttcctgcatttgtgcatggcagtttcctggactccagttcacagtttgcagtagagggaacaacagcaacaagaaacctgaactgatatattcctctgctttttctaaaaattttgaagatacttaattcattgttttaaaactcttttcagtgtgaaatatctggggcttttgttgttgttcgccctgaggtcccttctctcaagaaaaactaatgatctgaatctatcaattcaggatatgcattggcccacaagtcaaagtwgtggtatttttaaagagatcacaaaagcatgtagcatagacagtgtggtctctgtaattgcttgatgtaggctttaatgaggacaagagaatattctctcatcctttcttattcccaccctttcttccaggcttaaataaccatctggacaaggtgtgttcatccttatttttattctgcttccctctcttctctttctactcttcacacttgcgtaagccctgggctgggttatggaagcacagcagtaggtgttaggatacatattttgctctggcatatatgataggtacaccatgg

SEQ ID NO: 155232 - DNA, 601 bp, Human
attaccacactcttctatactctctctgagctataggagctggaagctgaagcactatgtttcccagactcccttgccattagggttctggataaggcttaggttcagccaaggagatgtactcacatcatgtgattagctgaaagcaaaggaaggtaaaagtcatccatccccagcacttgacatggctactgactacaggttttggtaaaaactttttaataactggcaattccatattccaattctagtcaccagtttaggggctatggagtagttacagctttggcaggcatttccygcatttgtgcatggcagtttcctggactccagttcacagtttgcagtagagggaacaacagcaacaagaaacctgaactgatatattcctctgctttttctaaaaattttgaagatacttaattcattgttttaaaactcttttcagtgtgaaatatctggggcttttgttgttgttcgccctgaggtcccttctctcaagaaaaactaatgatctgaatctatcaattcaggatatgcattggcccacaagtcaaagtagtggtatttttaaagagatcacaaaagcatgtagcataga

SEQ ID NO: 155233 - DNA, 601 bp, Human
agaattgcttgaacctgggaagcagatgttgcagtgagccgtgatcacgccactgcacttcagcctgggcgacagagcaagactccatcaaaataaataaataaataaataaataaataaataaataaataaataaagggaaatgtatcaggtatagaactgatttctgcatctttgacactttgtggaatataaacgtgaccccctgtgcaacatttgacaatgaatttcttagttgatccactcaaagaaatggagtccccaaacacatatgcatgcacgctaattacatacagtttamagtatcttgccctgggtttaaaagttttcaccagcaaatttgactcatcctttccctatgagaattttgatttaatttcacttcttcatttagaaaatggccatgcctttgagaaaccttaattgtcagtcagcatttattaccacactcttctatactctctctgagctataggagctggaagctgaagcactatgtttcccagactcccttgccattagggttctggataaggcttaggttcagccaaggagatgtactcacatcatgtgattagctgaaagcaaaggaaggtaaaag

SEQ ID NO: 155234 - DNA, 601 bp, Human
aggctgaggcgggtggatcacgaggtcaggagctcaagaccagcctggccaagatggtgaaaccccatctctactaaaaatacaaaaattagctgggtgtggtggcgggtgctggtaatcccagctattcaggaggctgaggcagagaattgcttgaacctgggaagcagatgttgcagtgagccgtgatcacgccactgcacttcagcctgggcgacagagcaagactccatcaaaataaataaataaataaataaataaataaataaataaataaataaagggaaatgtatcaggtatwgaactgatttctgcatctttgacactttgtggaatataaacgtgaccccctgtgcaacatttgacaatgaatttcttagttgatccactcaaagaaatggagtccccaaacacatatgcatgcacgctaattacatacagtttaaagtatcttgccctgggtttaaaagttttcaccagcaaatttgactcatcctttccctatgagaattttgatttaatttcacttcttcatttagaaaatggccatgcctttgagaaaccttaattgtcagtcagcatttattaccacactcttcta

SEQ ID NO: 155235 - DNA, 601 bp, Human
taatcccagcactttgggaggctgaggcgggtggatcacgaggtcaggagctcaagaccagcctggccaagatggtgaaaccccatctctactaaaaatacaaaaattagctgggtgtggtggcgggtgctggtaatcccagctattcaggaggctgaggcagagaattgcttgaacctgggaagcagatgttgcagtgagccgtgatcacgccactgcacttcagcctgggcgacagagcaagactccatcaaaataaataaataaataaataaataaataaataaataaataaataaakggaaatgtatcaggtatagaactgatttctgcatctttgacactttgtggaatataaacgtgaccccctgtgcaacatttgacaatgaatttcttagttgatccactcaaagaaatggagtccccaaacacatatgcatgcacgctaattacatacagtttaaagtatcttgccctgggtttaaaagttttcaccagcaaatttgactcatcctttccctatgagaattttgatttaatttcacttcttcatttagaaaatggccatgcctttgagaaaccttaattgtcagtcagcatt

SEQ ID NO: 155236 - DNA, 601 bp, Human
aagaacagatggagttgatgtgtaagagaaaagtcatttgtttccaaaagaacagggaaggccagtgtctacactagcataccataataggagttgcctaaaagcaggcaaagtgatcattttgtcacaggcagacatttgacttggctatatatacattctatagaaaaattttaccttgatagtccacatcgaggttaaaaaaagtgaaataggccgggcgcggtgactcacacctgtaatcccagaactctgtgaggccgaggctggcggatcacctgaggtcaggagttcgaaaccrgcctggccaacatggcgaaatcccatctctactaaaaatacaaaaattagccgggcatggtggcatgtgcctgtaatcccagatactggggaggctgagggaggagaaccacttgaacctaggagggggaggttgtggtgagccaagatggcgccactgcactccagcctgggagacagagcaagactctggccaaaacaaaaaaaggccaggaatggtggctcacacctgtaatcccagcactttgggaggctgaggcgggtggatcacgaggtcaggagctcaagaccagcctggcca

SEQ ID NO: 155237 - DNA, 601 bp, Human
taaggggctaggttttaggaatgtagagaaaatggacttgggatattagatctgctaatatcaagacaaaatctgaatccttgttgaagttcaaaataatgactcagatttcaagggtttctttttcttccttctacaaagaaatacagtcacgtactgcataacaaggttttggccaaggacatgctgcctacatgatggtaggcccataagattataacatcatatttttactgtgtcttttctatgtttagatatgttatatacacaaatacttacctttgtgttacaattacctacaatattcagtacagtaacgtggtacaggtttgtagccgagaagcaataggctacatcacattctctaggtttatataaatagaccctgtatcagctatatcatctaggtttgtgtaaatacaccctatgatgttcccacaacaaaatcggcaaatgacgcatttctcaggatgtttccctgttgttaagcaaagtgtgactataacatttttattgagtatttgaacaagcctctccctatcacaatgaattcaatcactcatgaattatttcataaggtgctgtaatatggtataataca

SEQ ID NO: 155238 - DNA, 601 bp, Human
caaattggtaataaggggctaggttttaggaatgtagagaaaatggacttgggatattagatctgctaatatcaagacaaaatctgaatccttgttgaagttcaaaataatgactcagatttcaagggtttctttttcttccttctacaaagaaatacagtcacgtactgcataacaaggttttggccaaggacatgctgcctacatgatggtaggcccataagattataacatcatatttttactgtgtcttttctatgtttagatatgttatatacacaaatacttacctttgtgttayaattacctacaatattcagtacagtaacgtggtacaggtttgtagccgagaagcaataggctacatcacattctctaggtttatataaatagaccctgtatcagctatatcatctaggtttgtgtaaatacaccctatgatgttcccacaacaaaatcggcaaatgacgcatttctcaggatgtttccctgttgttaagcaaagtgtgactataacatttttattgagtatttgaacaagcctctccctatcacaatgaattcaatcactcatgaattatttcataaggtgctgtaatat

SEQ ID NO: 155239 - DNA, 601 bp, Human
atgaatcaatagctatttcttctttttatatatcaagagtataactattctttaaaaatatttttttaatcagacaaatgaagatgttctttagaatatgtatgtgagtgaaggtatccaaattggtaataaggggctaggttttaggaatgtagagaaaatggacttgggatattagatctgctaatatcaagacaaaatctgaatccttgttgaagttcaaaataatgactcagatttcaagggtttctttttcttccttctacaaagaaatacagtcacgtactgcataacaaggttktggccaaggacatgctgcctacatgatggtaggcccataagattataacatcatatttttactgtgtcttttctatgtttagatatgttatatacacaaatacttacctttgtgttacaattacctacaatattcagtacagtaacgtggtacaggtttgtagccgagaagcaataggctacatcacattctctaggtttatataaatagaccctgtatcagctatatcatctaggtttgtgtaaatacaccctatgatgttcccacaacaaaatcggcaaatgacgcatttctcaggat

SEQ ID NO: 155240 - DNA, 601 bp, Human
cctttctttcatttctatgaagtcaaggtgttactggagttgcttagaataagcatatccaccctctcaagtagcaaacacccttacactactctaaaagatagtgattttcatgaatcaatagctatttcttctttttatatatcaagagtataactattctttaaaaatatttttttaatcagacaaatgaagatgttctttagaatatgtatgtgagtgaaggtatccaaattggtaataaggggctaggttttaggaatgtagagaaaatggacttgggatattagatctgctaatrtcaagacaaaatctgaatccttgttgaagttcaaaataatgactcagatttcaagggtttctttttcttccttctacaaagaaatacagtcacgtactgcataacaaggttttggccaaggacatgctgcctacatgatggtaggcccataagattataacatcatatttttactgtgtcttttctatgtttagatatgttatatacacaaatacttacctttgtgttacaattacctacaatattcagtacagtaacgtggtacaggtttgtagccgagaagcaataggctacatcaca

SEQ ID NO: 155241 - DNA, 601 bp, Human
ggccattgctggaagcagtattcagtattattcttaaagttacaaaaacgtgaactatctataaaatattctgtctgattcttactgaaaatagcccaatagaaaaaatattcatgtatgcatcattataataatcaagctaggataaggtgacaactaccttgggaaagtagagaagaaaaatgtgaaatagaaagtaaaatataaaagtatggttggtgcacgcctgctacattccacacttctatcttgaactgcatgtgccatacaatttagaagtgtgctaagtacaaacctttayagtgactgcaatgatgaagtcgctaacaaaattctcaagtacgtacatttacttccccatggaaaatccattgacaacgaccactgatataagtcattctagtccttaccaacacagtttggctcactttagggaaataacttatcctttttgcccccattttttcatctgaagaagcaggaaaatgaccaacgtgatttctttagtttcctcaaactttaatattcatcaacttggtcaaaaacaataatttcaaatttatgcattaataaaatgtgtgggagtccgatcatggtaaat

SEQ ID NO: 155242 - DNA, 601 bp, Human
attcctgcaggccacgctgctctaactaggtactcaccagttttttccctctatctcttatctccttaccccatacctgcccactgacccacctccccagcccctcattccctaccccaggataagaacagtgccagcctctgatttaatctgggtttacattatctaaggggaagagaccagggattttacagtaacccaacacttccacccaaaagaaacaggtttagactgtgacagattttttaccagaagttttgtcacttgagtgaactagactggccttctttctggtgtcaamagaaagacagctttattaatggttaataatgatctaaatgaacagctgtatttttattaagtaaaactgattcagaaatcctcataatgcccctagtcttaaaattattcccatcctatgtgctatattgtcactactttaaaaattcacagaatatagtcttataacaggattgcaaaataccagaaataaatctttcaaaaatatacatttatggatgtagggctgattctaaaataggtatcaaccagcgctgcctttttctgcttgcttcagatacctgaaatacatacatcaaaa

SEQ ID NO: 155243 - DNA, 601 bp, Human
ggaagcagcagcagctccagggaagatcagcagcgaagaaagaatgtgttatgcaaaaatagttatttcagacagatcacaaatggaagcctggtgggcagagaaaagttgaagcagtgtgcaacaagaacattttaaaaggcagtacttaagaagggagcaactgtttttcctttttaattttttgttgttgaggttcaaatgaagatgagttaagggggctctcctttcagtttccacgtttaggactttgggcctcggtatcatattataattaaatgtcagatgagaaatcatgagmgtagttaaaactaggtgccacacggcaggtctaggtttttggggcctcagtgacctcaactgtggcctctactgtgattgcctatcactggtgcccataaataatatctgaatgagtcagtcaattgttgtttggtatctggttattcaatacccaaattagtgaatcctatgaataagttgcagtttaccaaacatagtaaaagctttgttattcaaatatttgatgcaatggcaaataatagttaaagcattttaatcagctaaaagttaattcatatctcagtaacatttattaagt

SEQ ID NO: 155244 - DNA, 601 bp, Human
catctcagagtcccctggcctgctcctggtgcatcaccagcctcatctgtattccccacgggaagcagcagcagctccagggaagatcagcagcgaagaaagaatgtgttatgcaaaaatagttatttcagacagatcacaaatggaagcctggtgggcagagaaaagttgaagcagtgtgcaacaagaacattttaaaaggcagtacttaagaagggagcaactgtttttcctttttaattttttgttgttgaggttcaaatgaagatgagttaagggggctctcctttcagtttccacrtttaggactttgggcctcggtatcatattataattaaatgtcagatgagaaatcatgagcgtagttaaaactaggtgccacacggcaggtctaggtttttggggcctcagtgacctcaactgtggcctctactgtgattgcctatcactggtgcccataaataatatctgaatgagtcagtcaattgttgtttggtatctggttattcaatacccaaattagtgaatcctatgaataagttgcagtttaccaaacatagtaaaagctttgttattcaaatatttgatgcaatggcaaata

SEQ ID NO: 155245 - DNA, 601 bp, Human
gactcagagggtagctagcctttaaactgaatctttgttaagccaggagagacagttcctttctcctaggaacagatccatttggccccaggcttctgagaaaagggataattatatgactaacataaggaattgttaagcttaaaagattcctttttgttttaagttcccactttgggaagcacataactacttcagtgcactaactacatgcctcattactacttaagggtatattagattaatttttattttaacttgaaataattttattctcaaagcaggaaatatcttttaactygaaatgtgttgaagtaaatggtgaacgagtatcaaattcatcagaaaatatctacaataatatgaatacgaataacaaaggcagcagctaatattcattgagctcttatcatgtgctgtgtattgtttttatcctcacaaccaccctacaaggtagacagggacccttacatgcatttagagatacggaaactatgcctatggtcaagagctagtaaaagtcagagtggggtttcacacccagacagtctgattcctagtacctgctctatgattcaattatgcttttcatatgaaaaca

SEQ ID NO: 155246 - DNA, 601 bp, Human
aatctagagtctggagattaaggggaaaggaccaagagaaggctggagaagaaagcagaaagcagaaagcagtcctctgagcattcggggtgaagtggtaggacggtaaagtgtttggattctatccaaagggcaaagagatgctattaaagggttttgtgtagggacagtggactgacttgtatgtgcagaaactctgtgtgtgggtctgaatgaggcaggcattattttaaagaaaagaattcaggcttttctcaacatggaacctaaagaaagcatgacattataccaaataaacatcccttaacaatagaacttgctaagttcaactatcagcaaaaaataaattactatgtttatttcatctttcttaataacattcatttcaacagtacacatatagttcaagatttctgaagatactatatactactggcaaagtagaattgtataaacacttggtacatggaatataaaattattgtcatcacctcacatttgtttgtttagctgctaaaagatctttgaacaaagaatcacgtcaacaaagagggtgtcaaaatatcaacaaaaagagatcttgtcagagcttaattagggc

SEQ ID NO: 155247 - DNA, 601 bp, Human
aaccaatcaaccagtcaatctgcaaatatttaagataacctaccatggggcaagcacagtatgacacaatgaagaaagaggcagagaaacagtccttgcaagaaataaacatatattctagaaagatcacagataacataggccactgaatgtgtgattaaaagtaaatctaagtgtactagtctcactaaaaaaaagaaaaggaaaaaaaacgcgaaagcattagatggtatacttctgtcgataaagatttcccataggagtgacatttaatttgagacccaaagggtgagtaaggttyatctgggtcaaaggggagcttaacaaattccattaaatgttaggtatctagtaaatctagagtctggagattaaggggaaaggaccaagagaaggctggagaagaaagcagaaagcagaaagcagtcctctgagcattcggggtgaagtggtaggacggtaaagtgtttggattctatccaaagggcaaagagatgctattaaagggttttgtgtagggacagtggactgacttgtatgtgcagaaactctgtgtgtgggtctgaatgaggcaggcattattttaaagaaaagaattcag

SEQ ID NO: 155248 - DNA, 601 bp, Human
ctataatgcttttggatatttgaaaaagatttttctttttatgagttacctctaaaagctgtcagtacaccctgtccaaatgatcacattctaatgtagtaggtgctgaataaagacattttactttgtaagatcatgtaatgtcataggctactaacaaagtaagaaaattggcagttgtaagaccagattttggacagaaaataatataaaatgcaataacataacttgagtaaattttactagaaacagatttctctatcatgccattaagtccttgtacaactctttctccttatcraccaatcaaccagtcaatctgcaaatatttaagataacctaccatggggcaagcacagtatgacacaatgaagaaagaggcagagaaacagtccttgcaagaaataaacatatattctagaaagatcacagataacataggccactgaatgtgtgattaaaagtaaatctaagtgtactagtctcactaaaaaaaagaaaaggaaaaaaaacgcgaaagcattagatggtatacttctgtcgataaagatttcccataggagtgacatttaatttgagacccaaagggtgagtaaggttt

SEQ ID NO: 155249 - DNA, 601 bp, Human
agatttgagttgctacaaatttgaaacttaagaattttttccgaatatttgaagaaagcagaggtagtattctaaatttctttctaaatatccacaatttagtattaaagatgtttttaatttattcttccagttaaaaagcactgactggatagattaatgattagatagacataaaaatgcacttttaatatttggaaaatcatatagtactttgatctaggttgagatgtattaacataaatccttatgaaacttgataagaaataggtaagagtaattgagaataactagcagaagygtttgtaagtaaaataatacatctataatgcttttggatatttgaaaaagatttttctttttatgagttacctctaaaagctgtcagtacaccctgtccaaatgatcacattctaatgtagtaggtgctgaataaagacattttactttgtaagatcatgtaatgtcataggctactaacaaagtaagaaaattggcagttgtaagaccagattttggacagaaaataatataaaatgcaataacataacttgagtaaattttactagaaacagatttctctatcatgccattaagtcct

SEQ ID NO: 155250 - DNA, 601 bp, Human
aatgtcaaaatactatacttagtagtttattcttcctaggtctttaggtctgattgtctgatgattcttccaaattctgttcttgtaccgctaacagttcttaagctttctttgtgctttgaaattttgagaattctaggcagtattgtgcagtgtgaagagagctctgtgtggcaatagaagacataggtaaaacagatcttgctctttactaacaacacttctaagtttcacgtttctcattcattaaatgaagctaacatcctatttgcctcactttgctagtgagagaacatgtatyaaactgctttgagaataagccactttatgtaatgattggtatcactattagaatataatgatatagactggtatgacagttgtaatctttttttattttcattaacctactgggaccaaagtattttttaactgaaatgaaaacattgctaaataaagcattatgtatgatacacagtatagaatagttaataaagctgtatagaagcaaaataaagtctaaatgctctacagagcatcctctgattctacaaattaatattaatcgcttcctccttggcactcacataatactttattt

SEQ ID NO: 155251 - DNA, 601 bp, Human
tagatgccatgaaaagaaacattaccataatttattttttatacttacaaatagtgaatttcttagagatattaatctcttgatatacttttcttaaggcagaataattaatttacttttgtgagctgaattcccgatcgaattagcatatatattttaaagtaacaagaaagaagctggattgccacctctttggattccgatagtgctttaagatcccaagagacctggtgcctgagcatgtcttttatctcagatggtaaatgtaccatcagacccaggaaaggacaaggagtgtaargctttagtgaaagataagagtcaaaggttctctcaaacatgttaccatgacaccttttgtatgtttgttaaaaagagtaaagctggcaaatctctcagaatatcctattatcagattccaaatgaggaaaaaaattgttaaagcataatatattctgatttctaaagcagtctatcacagaaattgttcttacattctttactagcatgccatattaatgaataaagataattttttaaaatttgtgtcttgttgaagtttcctatattttaaaaagtaacaaaaagtttattttcagga

SEQ ID NO: 155252 - DNA, 601 bp, Human
catttaatttgtataacattcctctgagataggtactgtttttatcctcatttttcaaattagaagagaaaagcagataaaggttaaaatttgctacagatcacatagctaataagtagcagagctggggcttgaacccagatttgtcccgaagtctaggctattcccattagactctgttgttaaaggcaatacagtgaattgtcaaaaattgataaaatgatggatttagagttcaaagtttttcttttatggccaataatttcccacttgttctttagagcatgccattaaattctgkcttaatttcctttatactttttactgtaaaaggttgccatgttgttcaattatttaaaataaattagaagactcagtatttttcaaaaatgtcatgaatgagagtttgctggcttgctgtcatgtatgatcaaagaattgaaaaggatgccttttatctgagaatatcaaagggtactaactaaaaaaagacacagagttcctattacagtgaagagaaaaagctgagcccattgaaatattatacaagaatgttggcatacaggtaattcacagatattattacctttgctacttgaaa

SEQ ID NO: 155253 - DNA, 601 bp, Human
gggattccatcattttacagtatttttgctaatatttaatgatcagggaggcaacaatactcaagtgaggagtggcattttctggaactggactgtgcaaggcctctttggctatataccttaatccctgtgctgatctcactctactttttgccatgtctctggtcagttctctttcccagccaccctttcaggaggtttctataccatctccaggtttctccttagccttcactttcagcacatagtttaatttctaccacacaagtaagagagaaagtgggctgggatccacattctytgttttctggttctctacttcctatgtcacgtcaccctttctatcttcatactttttctttccttatggtctcagaaggtctttattcctacctaaagctaatcagtctgctagtattctcatgactattttctcaaggatcacactccatcatcaattatttactccctttcttctatttctaacttcttttcaaatggtttctttccctttgcctataaacacttgaatgtcttccatggtcataaagttttcccttgtctctctcattctctgttgctactgtcatatagctcctca

SEQ ID NO: 155254 - DNA, 601 bp, Human
ctccctactagaacacagcttcccaagaacggagactgttcactcctgcatcctgacttattaatcagtgactgcctcaaaaagtttcttaattgagtgaacgaatgaatgtataggatgggtgatacaaaggctgaacttacacttataacacaaagtggtaaatataatctcagattccacttagttgcggtacaataaaacttaacattagcatgtcaatggaggatgataggaaaaggcactccaatcgtcaagcatttcacaccatttagaggaggaaacaaggtaaaaaaaaaawaaaaagaagaagttattgtggtctaccacaaattatctgtttggataaaaataatacataatacaattaaagacaccaaccaaaaattagcatggaagcaaagtatactagaaacggtagactttgccttcctgaatagcattttaattatctgtacagaagtaagcattttataaatactaaattggacttcctgtaaatctcatccccaggagcttgaggaaataggataactatttgtctatacctgactttgacatacaaggaagagctgcttagtgaatcagaaaagataagaaa

SEQ ID NO: 155255 - DNA, 601 bp, Human
tggctcactcctgtaatcccagcactttgggaagctgaggcaggtggatcacaacgtcaggagatcaagaccatcctgctaacacagtgaaaccccgtctctactaaaaatacaaaaacaaaattagccaggtgtggtggcaggcacctgtagtcccagctactagggaggctgaggcaggagaatggtgtgaacccaggaggcggagcttgcagggagctgagatcccaccactgcactccaagcctgggtgacagagtgagactccgtctcaaaaaaaaaaaaaaaaaaaaggacaacycattaaaggtattttggctgaccagtgatagggtcaagcccaggattcttttaactcctactaatgttcatacaaatttatgcagacattcagaagacaaagacagcctttctgtgtcctctaagtacccagattatgccttgcatctgtacattgtgggagctcacaaatactttattcgacccctaaaagaatatgacagatgtggaaacagtgctttgggtatatgccaggaaagagtgaacatgaacagagtcctgataaatttacaaagtggaatggatcttctacccaaagtga

SEQ ID NO: 155256 - DNA, 601 bp, Human
aaagttatccatccctaatccaaaaatctaaaatcttaaatattccaatgagcatttccttggagtgtcatgttggtactcaaaaagtttcagaatttggagccttttggaattctcaaattttcagattagggatgctcccctgtataacaaaagcattccactctgcactcttatttgtctgaaatctaattaggcttgctctactattcattgtatactgatataatacatgagtattttacatatggttacatacaaggtcacagatgtaaacttatgactatgatactacatatgyataaggttacatttgtaacttttcattgttaataattttataatatgacaaatatatgaaattgaagtgatataaataatgtcaaaatattatgaaaacctaacatgtgaaaaacactttttaagaaaacattcacatatactattttccttaatcctcaaataaaacagtaaacaatccaagtattttaatttatgtaaacagtttaaggaaactaggccgggcatggtggctcactcctgtaatcccagcactttgggaagctgaggcaggtggatcacaacgtcaggagatcaagac

SEQ ID NO: 155257 - DNA, 601 bp, Human
taaaacaggtcactaacaagcgagcagttgtatttccatatctgtaaaatcaagatctcactaatctttaagtattgcttttatcatatcactcatctgggcagaaataagcaatggttgccttttgcctaaatgacagaaatctaaattcctcatcatggcactaccataacatattctgtcctctcaatacaaactggttctctctcacgtctgcagccttgtctcatcaatccctttggagaaatggttggaatggttatgggcttgagctttgatatttacataactgatttgaatmttggcttttctttccttaagtgcataatttttgggtaagtaactaagctccaatgaacatcagagttctcatctctaaaacagaaataagacatctattcattggtttattgtgtgatatatttaatcaccgagcacattagctgaaacatagtaggtttatataaatggtagctattattacaggtcaattatctcttatctgaaatgcttgggaacagaagtgttttgtattttggattttttgggttttagaatatttatctactgaaaagttatccatccctaatccaaaaatcta

SEQ ID NO: 155258 - DNA, 601 bp, Human
agggcttcccagagcaagggtaggctgatgtcctttggaagagctgagcacccactctctctggtctaggtgtctgcctgtgggatatttttacttttcactgtggctgattttattcttttcacaggatcatcatcctacattagttttaactagccaatgcaatgcttccctcctctcaacgttttctcctaatctaaatgtgtcataagaaagagagcaatttactactctccatgggctgagagtaggtacacataaatttgggaagctcattataactcacagctgtcagtccacaaaaaaaaaaaaaaaaccttccacacacatgcacaaaaaaataaaaaattcaaaccagcaaggactttgtctttattattctgcattatataaaacaggtcactaacaagcgagcagttgtatttccatatctgtaaaatcaagatctcactaatctttaagtattgcttttatcatatcactcatctgggcagaaataagcaatggttgccttttgcctaaatgacagaaatctaaattcctcatcatggcactaccataacatattctgtcctctcaatacaaactggttctctctcac

SEQ ID NO: 155259 - DNA, 601 bp, Human
aagacattaaatagcaattaaactcaacatacgtggttccaacaatgcttataactcaaagagacaatataaacagctataactgagttcgtgcatgagcgggcaatgacaactataaatatatcatgactagtgtttgaccaacagccacttgagaaccaggcaaatttcatagtagctaaaatattaaaaaagtgcaccttagaattgtaaagtatattgttgtttgattagtataattttccttgactgtaagagaggtgtctatttaaatatgtacctctgtagttacataaaagargggctcaacaagtatttgcttaatggagtacaggttaccaggcatattacagtggggattttctgatattatctacagtagaagattgctaaattactttccaaacctaggattatttcatcccaaagcaattaaaaaggcaagatggggggagtagtagggaatctgactgagtcatgccctgaaatacaactaaaagaccactttaaataaggaattacagagacaacaaagctggctgtctctgtggctgaggaatggtttgcagttcccaggtgtcatgctcggtgtgagaacgca

SEQ ID NO: 155260 - DNA, 601 bp, Human
cacaatgtcatctcacgccagttagaatggccatatcattaaaacatgaggaaacaacagatgctggagaggatgtagagaaataggaaagattttgcactgttggtgggaatgtaaattagttcaaccattgtggaagacagtgtggcaattcctcaaggatctagaactggaaataccatttgacctagcaatcttattactgggtatatacccaaagaataataaatcattctactataaagacacatgcacacgtatgtttatttcagcactattcacaatagcaaagacttggggmcaatccaaatgtccatcaatgttagactggataaagaaaatgtggcacatatatactgtgcagccataaaaaaggatgaatttatgtcctttgctgggacatggatgaagctggaaaccatcattctcagcaaaataacacaggaacagaaaaccaaacaccgcatgttctcactcataagtgggaactgaacaatgagaaaatatgggcacaaggaggggaacatcacacaccagggcctgtggaagggtgggggcctaggggagggatagcatgaggagaaatacctaatgtacatga

SEQ ID NO: 155261 - DNA, 601 bp, Human
accacaatgtcatctcacgccagttagaatggccatatcattaaaacatgaggaaacaacagatgctggagaggatgtagagaaataggaaagattttgcactgttggtgggaatgtaaattagttcaaccattgtggaagacagtgtggcaattcctcaaggatctagaactggaaataccatttgacctagcaatcttattactgggtatatacccaaagaataataaatcattctactataaagacacatgcacacgtatgtttatttcagcactattcacaatagcaaagacttggrgacaatccaaatgtccatcaatgttagactggataaagaaaatgtggcacatatatactgtgcagccataaaaaaggatgaatttatgtcctttgctgggacatggatgaagctggaaaccatcattctcagcaaaataacacaggaacagaaaaccaaacaccgcatgttctcactcataagtgggaactgaacaatgagaaaatatgggcacaaggaggggaacatcacacaccagggcctgtggaagggtgggggcctaggggagggatagcatgaggagaaatacctaatgtacat

SEQ ID NO: 155262 - DNA, 601 bp, Human
agagagcagcagatctcccagcacagtgcttgagttctgctaagggacagactgcctcctcaagtgggtccctgatccccgtgcctcatcactgggagacacctcccagcaggggtcaacagacatctcatataggaaagctctggctggcatctggtgggtgcccctctgggacaaagcttctagaggaaggaacaagcagcaatctgttgttctgcagcctctgctagtgataaccaggcaaacagggtctggagtggacctccagcaaactccagcagacctgcagcagaggggcctsactgttagaaggaaaactaacaaacagaaaggaatagcatcaacatcaacaaaaacaatgtccacacagaaactccatctgaaggtcaacagcatcaaagaccaaaggtagataaattcacgaagatgaggacaaaccagtgcaaaaaggctgaaaattccaaaaaccagaatgcctcttctcctccaaaggatcacaactcctcaccagcaagggaacaaagctggatggagaatgagtttgaccaattgacagaagtaggcttcagagggatgcataataacaaactcctcctgagct

SEQ ID NO: 155263 - DNA, 601 bp, Human
gctctgaagagagcagcagatctcccagcacagtgcttgagttctgctaagggacagactgcctcctcaagtgggtccctgatccccgtgcctcatcactgggagacacctcccagcaggggtcaacagacatctcatataggaaagctctggctggcatctggtgggtgcccctctgggacaaagcttctagaggaaggaacaagcagcaatctgttgttctgcagcctctgctagtgataaccaggcaaacagggtctggagtggacctccagcaaactccagcagacctgcagcagakgggcctgactgttagaaggaaaactaacaaacagaaaggaatagcatcaacatcaacaaaaacaatgtccacacagaaactccatctgaaggtcaacagcatcaaagaccaaaggtagataaattcacgaagatgaggacaaaccagtgcaaaaaggctgaaaattccaaaaaccagaatgcctcttctcctccaaaggatcacaactcctcaccagcaagggaacaaagctggatggagaatgagtttgaccaattgacagaagtaggcttcagagggatgcataataacaaactcctc

SEQ ID NO: 155264 - DNA, 601 bp, Human
tcactctggggactgtgctctatacaggatccttactgatgtcagctactacatctctgatgtacatataggactttctgccatcataagcccctgagtctttatggaaaggcatccctcacatagagatatctaggccacagacttgtccagtcttccctatcctaataagaggctatgtgccctgagagctaacataaaaatccttctcaaaattgcagctagataggaggaatgagttatagtgttctataccactacaggatgactagaattaatattttatgtattttcaaatagygaaaaggatattgggtgttcccaacacaaagaaatgataaatgtttgtgatgatggatatgctaattaccttggtctgatcatccatcatacattatatgtattgaaacatcactatgttgtacaccatgaatatggacacaattatcatttgtcaattaaaattttttattaaaattaatttttgattcctgggcaagatggccgaataggaacagctcctgtctgcagctcccagcgacaccaatgcaaaaggctggtgatttctgcatttccaactgaggtacccggttcatttcac

SEQ ID NO: 155265 - DNA, 601 bp, Human
gccccttacacccatcccaggggacagaaatcttgttttcccttatctgaggtttgatttgggtgtatcatttattcagagaaacctctaggcctattcactagttaaatgtcaaaatatcagcttttgttagatcttccacctcacccccaactccattagtgccctctgcttgcttctggtacatccagttcctctactttgaatgtctctgttctagatattatgggttaaactgtgctctaccccccaccaaaaatatgttgatgacctaacccctggtagccacaaatgtgactayacttagaaataggatctttgcagatgtaatcaggtcacgcttgattgggatgggccttaatccaatataactggtgtctttataattaaagaaacacttgaacacaggcagaatcagagaggccatgtaaagatggaggcagaaaatggaatcttgctgtcacaagccaaaaaaaggcctggagctaccagaagctggaagaggcaaggatctacttctagaggtttcagaggcaagaaggccccgcctacatcctgatttcaggcttctggcctccagaactgtgagacaataaatttc

SEQ ID NO: 155266 - DNA, 601 bp, Human
cctggccaatatggtgaaactccgtctctactaaaacaatacaaaaattagccaggcatgtaatctcagctacttggaaggctgaggcagaattgcttgagcccaggaggcagaggttgcagtgagccgggatcgtgccattgcactccagctggggcaacagagcaagactctgtctcaaaaaaagaaaaaagagaaagaaagaaaaagaaagaaagagagggagagagagacagaaagaaagaaagaaagaaagaaagaaagaaagaaagaaagaaagaaagaaagaaagaaagaagaragaaagaaagaaagaaagaaagaaagaaagaaagaaagaaagaaagaaagaaagaaagaaagaaagaaagagaaaactgtattggtgttgaggagcacattttactaccatgcttttaaaatcccatcatttacagagctctttcacattgatattcattattaaagtagctaaatattcacaggttactgaattattaattgatgcactttacatcttgctttcacttttcatctacagatgtaaaatattcttttcactgtttgtaaatataatgtacttcaaatgaagcaaagagtt

SEQ ID NO: 155267 - DNA, 601 bp, Human
aacaatgcaatgggcattgttcatggtggactcattcatcatgctcatcaatggtgaacttgatgaagtctcctggaggatgtggtacttaagcggaaacttgatgaatgaagaggagttagtcacagaacagtgggacatgaaagggaatgttgctcacagtagaaacaacatatgtcatattacaggaagtgaaagatctataaacttgaagtttaggtgtggaatgaaaagatatgacgctgtaaagattaacaagggacaggccaggcacagtggctcacgcctataatcctagcaytttgggaggtggaggtgggcagatcgcttgagcctatgaattcgagaccagcctgcacaacgtggtgaaaccagatctctacaaaatatacaaaaaaaccccccaaaagattaacaagggatagataatcagggtcttgtcatccaggctaggaagcttgaatttcatccaaagaggagccatggaagaaaaatgggcaacagaaagactctatcttgcttctggcaagtaattatacctatctaagcctcaagttcttaagaataaggacaatatcatctcccatacaaagtggttgta

SEQ ID NO: 155268 - DNA, 601 bp, Human
tgtttcatgagaaagtaatttttctctcagcaatgctaagtcatcctgaccacttctgactttttctttggaatagtgagaggaaccaaagaccagtgtgactgaggtcacaacactggcttcaagtatgttctgtggagtggaagggttcttgaggagtgtcagggtcattagtacagtaagctatacttttaactttttttataccttggatttccatgtaagagctctttgtatgtgtgtgtgtgtacacaggtacatgtgtgcatatgtgcacacgtacttatgttacagatgtgayacagggtagattctgctgcttacaaaaggctttggaatactataggtatagacagtaattcttacaggaaatcagaaattaaggaaaagaaggttggctgacattatcaaagaagacttaaccaaaaagaagtgacttgcagcattgatgaaatttgtcataagctgaaagacctctaggcagaaaggtgcaaatgaatcaaaataagtggattgcaaaaaacaaacaaaaaactggattgaacagagagtatatgtgaaacatctagagataaatcagagaaggatggtgacattatat

SEQ ID NO: 155269 - DNA, 601 bp, Human
ttccaaaattcttcgcatcttctatattccttgcttaatgtatttaaacaaaaattttagatgttcttaatacatagttttaagacataagtgtctttaaaaatcctaaatctcttattagtcatgtcacaaatctgaaatatattttacaaataacgcttgatttccctacagttatattgtatataaagttaatatgtcagaacagaaaaacgttctaaaactctaaataatagctaagtacataaactaggatattttatttcattttaattaacaggtagttattaagtacctgctrtgccataggtgtaatggagaattaaaaaaaatagtcattatttttttgaacttgttgggaagataagcctatatgaaataatttaaaaataatgagtaactttatagttacagtatacaaatacaactgattttctcaaggaacatagagtatgcttgggatatacagacttacacatatgaacagaaaacagatggggcctccagctagttaactgctcctgatctggccttttatcaataaggagacactgacgtttgaccatggacttttctctgtggtccacacatatgtgaaatg

SEQ ID NO: 155270 - DNA, 601 bp, Human
acacatattcataatatgtatttgataagttattaaactgcttcttattgagaaaagtttgccttataaaaccacacaatttctagctgcattaccttataaacattacttcattaaatttccaaaattcttcgcatcttctatattccttgcttaatgtatttaaacaaaaattttagatgttcttaatacatagttttaagacataagtgtctttaaaaatcctaaatctcttattagtcatgtcacaaatctgaaatatattttacaaataacgcttgatttccctacagttatattktatataaagttaatatgtcagaacagaaaaacgttctaaaactctaaataatagctaagtacataaactaggatattttatttcattttaattaacaggtagttattaagtacctgctgtgccataggtgtaatggagaattaaaaaaaatagtcattatttttttgaacttgttgggaagataagcctatatgaaataatttaaaaataatgagtaactttatagttacagtatacaaatacaactgattttctcaaggaacatagagtatgcttgggatatacagacttacacatatg

SEQ ID NO: 155271 - DNA, 601 bp, Human
tttacctctataaaacaaataggtgtcacagtatcttaaactgacttaaatcataacatccataaagtctttgaatattttgaaaatttacatatgtggctgtctctaatttaaacatgaatcgggtcttaagtttcttgtttcttcagtataccacaaatatctaaggaaactatgcaaaaatcatgtttgcctaacatggtatatatggcatataaactgagtgatcatagaaaattaacacaggtgtttggaaaacataaaatagctgctggttcataataaattgtgattcattagyaatcctaatttcaaatttagttaaatttttgtcaattaaaaatgatgagtgttgtttatatactagaattgctaaaaagatcagtcaggattatcaatcaactcttctcccttcctttgacaaaatgcagaaaattgaaacacatattcataatatgtatttgataagttattaaactgcttcttattgagaaaagtttgccttataaaaccacacaatttctagctgcattaccttataaacattacttcattaaatttccaaaattcttcgcatcttctatattccttgcttaatgta

SEQ ID NO: 155272 - DNA, 601 bp, Human
ttattcattctgcttgaagttagtttctggtttttatgtgtattcctcctgtttgaccttagtcaataagtgatgccttctttttaaattactttcttattcattctgcttgaaccagctttcactgtctacagaatgcatagacttctaatttgctttccccaatctcctcctttgcatatgcatactctgttctttttactacatttttaaaggattttaccatcgtgctcagtaaattatgacttgtgtaactggaacaagagaggtatttgtaaaaggcctctgctgcctcatctayaaggagactcagaacttacagatttttttttttttttttttttttaaacaatgaagcaagcaatgtaaggaagaaaaaagcttggcacatggtatgtactaacaaaatgtgaaacagcagacagggcagttatttcagaaactgtctacctaagaaacattttgaatgttctgcaagatttagatagatgaattaaacatctgtaatcaatgtggccatgagtaaactacacaaaaagttgttctatatttttccacattttatccaaatgtatgctatcatatattgaaagctattaag

SEQ ID NO: 155273 - DNA, 601 bp, Human
tatacaataccatcattatgaccacagtgtactattgcaatcaataaaaagtaaattaatgcaacctatgtttatgtttttgtcctaaagatgagtgttctcaccactgagattcttttttttgcagtttttcctccattgattgaatactttaaaagatttaatttattgaataaggaatgcatttttttccatctgataccactatttttccattttagcaccaaataatattataataaagatgcctaattattaagggtttataatagcatcatagcattatataaattatagtcayggttgtggtgccaatatataattacaatatataattacaatatacaattacaatatataattacaagtaagtatgtataacatttatgacagtatttaattaaatttgttcatcaccctgttcttgtgtccaagtttggtcagtcctggaaaccagtggctatttgatatgtgaatttatttacattatgtagtttacaaggtccttgattatcatcaccagcccatcaagagtattggatgaacattataagttgatataatttcagccgaatgtatacaaatttgatcagtacatata

SEQ ID NO: 155274 - DNA, 601 bp, Human
cagtgcagggaaattaaaaaagaaagaataaaatatattgtagattacaatagttattaacaattacaataaaccagtactaaatacttcattcatcccctaattctcagttcgtaactgtaatcagatggaaacaaaacagaatagtctacatgttaaaaactattttatcaaaggcccaagcatatacaataccatcattatgaccacagtgtactattgcaatcaataaaaagtaaattaatgcaacctatgtttatgtttttgtcctaaagatgagtgttctcaccactgagattcttttttttgcagtttttcctccattgattgaatactttaaaagatttaatttattgaataaggaatgcatttttttccatctgataccactatttttccattttagcaccaaataatattataataaagatgcctaattattaagggtttataatagcatcatagcattatataaattatagtcacggttgtggtgccaatatataattacaatatataattacaatatacaattacaatatataattacaagtaagtatgtataacatttatgacagtatttaattaaatttgttcatca

SEQ ID NO: 155275 - DNA, 601 bp, Human
agcttgaaaagaactctgatacagctgtcaccctgaatagaagatacaaaactaatgtaatataaaatatacattttcacataaaattactcaacaatatctttcacttagtgcaaagacttacacatttggtcctatttacttgcctgtatgaaagggaaatccgttaaagaacatcattgggtcaacttgttaacaatgagcaaaaattttataatatcatataatttcatgttaaagtttacgaaaattaggttgtctggggacagaggagtatgttgttaaaaattgtgaaacaatmaatttacaaactgcaaatgaaaactagatttttaatgtatcagcatttcaaaactgttcagcaagactgtgtcaatactacgatttagaagtcaagtgctcttaattcttgactcattatttatttttctataaagaccttttagtttctccaaaatactggcttttatcatcttggaagacttgcatgaagtagaaaaacttcttatacaagtttttccagttcatactaaactaacagatcacaatttttcctttagaaaagacgttactgaatcgtttagcaattttcaccattgga

SEQ ID NO: 155276 - DNA, 601 bp, Human
aatgagaagggataggtgttcaaaacaagaaccaatcttgttttatgtaagtgttaggtatgcaagtctaaataaatttagcaaatctacaaataaatatatattataatttgattattttttcaaagaattatattgtttctaagttcatactggcaattaaattattgcattagagaatgtaaaccaaagtagataatactgaacaccttagggtaaggtttcactataagagctatacaaataatagcttgaaaagaactctgatacagctgtcaccctgaatagaagatacaaaacyaatgtaatataaaatatacattttcacataaaattactcaacaatatctttcacttagtgcaaagacttacacatttggtcctatttacttgcctgtatgaaagggaaatccgttaaagaacatcattgggtcaacttgttaacaatgagcaaaaattttataatatcatataatttcatgttaaagtttacgaaaattaggttgtctggggacagaggagtatgttgttaaaaattgtgaaacaataaatttacaaactgcaaatgaaaactagatttttaatgtatcagcatttcaaa

SEQ ID NO: 155277 - DNA, 601 bp, Human
ttttaaaacatagtttataaataatttttttattcttagagctgagcaaataaatccatattctgaggcattgagaagttggtttgtgagagacatatgtgctttcttgtaatcatatgtgatatctaaaccaagggggaataaatagagaacactggatgggatggtccaagcattgccaggcatggatgccagtacctgctctggggacttccacagctataattggagctgtaaaaactaacataaatagtaaaacacttcttaaaacttttatatattttatatatgtgtgtacatttaagatatgagcataataattttaaaaatatccatcttaaaaacttaattagcacatttttgttaccaaatttttaaataggcaaggataaagcttattagctaacaagtaataatataattactcttctacctatgtatctattgaaattatagttggtatggattacttatcacaagcaccactttctctcaaattgtaggaaactttatatctgtcatacatatgacatgtttcaaaccaaaaattacaaaacagaaaatatatggctggaaaccatgccttcacgtgccctccatt

SEQ ID NO: 155278 - DNA, 601 bp, Human
agaaaaaaagagtcaagtgggttcaatgatgaaataattataaaacaatgaaataaaaatgttacatgctataaattcctgtctttactgtcaagaattagctactaagaacccacagcactataagcatgaagtaggtacaggtggattccattttagaatgtctgcacttggtaatcttaaatactaacaaaatggctgtaaataacaaggatctttactactaatgcatccctttggtagactccaatcatatagcttcttccctctcttgagcatgagatacacagtagaaacaccmgaaacatattcttccatttttgaaaaaatatgttttaaaacatagtttataaataatttttttattcttagagctgagcaaataaatccatattctgaggcattgagaagttggtttgtgagagacatatgtgctttcttgtaatcatatgtgatatctaaaccaagggggaataaatagagaacactggatgggatggtccaagcattgccaggcatggatgccagtacctgctctggggacttccacagctataattggagctgtaaaaactaacataaatagtaaaacacttcttaa

SEQ ID NO: 155279 - DNA, 601 bp, Human
gaggccaaaagtagatcttaacacattatatcctgcaattacaagcaagttattaaaatgttttaaattttatttccttacttgacaaaagatcatagaaaaaaagagtcaagtgggttcaatgatgaaataattataaaacaatgaaataaaaatgttacatgctataaattcctgtctttactgtcaagaattagctactaagaacccacagcactataagcatgaagtaggtacaggtggattccattttagaatgtctgcacttggtaatcttaaatactaacaaaatggctgtaartaacaaggatctttactactaatgcatccctttggtagactccaatcatatagcttcttccctctcttgagcatgagatacacagtagaaacaccagaaacatattcttccatttttgaaaaaatatgttttaaaacatagtttataaataatttttttattcttagagctgagcaaataaatccatattctgaggcattgagaagttggtttgtgagagacatatgtgctttcttgtaatcatatgtgatatctaaaccaagggggaataaatagagaacactggatgggatggtccaa

SEQ ID NO: 155280 - DNA, 601 bp, Human
ttggcaggagatcccccgacttcaaagagcttcatcaaatcaaagaattgtccatgaatgtccccacaaactgaaagaaacaaaattcattttatggtcatattatgttaggactttgaattaaataataaaattacaaaattttagaaccagaattaatttcaagtttatctgagccaaaacattcttttgcagaacaagaagtacgacagaaaagctaagtattttgctcaagtttccaaatttaattagtggcaaacttggctctaatgtctgagtccactagtatacagattaactaaaaaaaaaaaaaaaaaaaaaagaagagaataataacaataatggctatcattgtgcacttaaaaattctttatgagacgctgccaggatgtttacacacattttttaatgtaaccctaaaaatgccatgagatatgttttcattttgcaggtaaaagacgacaccaaagaatggttcaggaatttggcataatctatgtacaactgaggtctgaatacatggccactacacattactgcctcctgaagagaaagaaatgtagatatgtatcataaaacctgcatttcactgaatctagaa

SEQ ID NO: 155281 - DNA, 601 bp, Human
gtgttggcaggagatcccccgacttcaaagagcttcatcaaatcaaagaattgtccatgaatgtccccacaaactgaaagaaacaaaattcattttatggtcatattatgttaggactttgaattaaataataaaattacaaaattttagaaccagaattaatttcaagtttatctgagccaaaacattcttttgcagaacaagaagtacgacagaaaagctaagtattttgctcaagtttccaaatttaattagtggcaaacttggctctaatgtctgagtccactagtatacagattamctaaaaaaaaaaaaaaaaaaaaaagaagagaataataacaataatggctatcattgtgcacttaaaaattctttatgagacgctgccaggatgtttacacacattttttaatgtaaccctaaaaatgccatgagatatgttttcattttgcaggtaaaagacgacaccaaagaatggttcaggaatttggcataatctatgtacaactgaggtctgaatacatggccactacacattactgcctcctgaagagaaagaaatgtagatatgtatcataaaacctgcatttcactgaatcta

SEQ ID NO: 155282 - DNA, 601 bp, Human
aatggaggaaataccaagaatttaacttctcttttgggatttatataccatcaccactccttcttccctcatcatcaccaggaataattaagaaatctgtgatctttaaatgcagacggtattattatgttggcggaaatacatatatgtctacataaacttttctgtgtctgcgtgtagtcagtgactaaaggtgaattaaataaccgaaaaataaaactgatataattgtataaacaaaagctgtttaaggatgacatgcttttcaaccttaaatatccctttagcaaataaaacactsaaataaaaattttgaaatatagaatgtttttctatgattattatgaatatatgatgttggtgtgagacaataatgttgatttctctctttaattaagaataatcattttcctttttaatgatctcttttgatagcccatgtcagctactatacatgaggtctgattctttaaaacttattcaatttcaaaccacttctttcaataaattatttattaacacaacgtgttaggcaccaggaagaacaaagatatgaataaaacaaggtctctgcctttattttgaatgtagttttacttac

SEQ ID NO: 155283 - DNA, 601 bp, Human
cagtgagtcgagaacgcaccattgcactccagcctgggcgacaagagtgaaactccatctcaaaaaaaaaaaaagaaagataacatacagttatagagatactgactataaaaaagattcagttctttggcaaaaagggatctgaaactgaaaacagtctctgttcatgtgcccatgtgtagtgtgttttgtaagagaaagggagaaaaagaggagataatcatggggcctccacttcctagttgtccccagtcaattcaataaataaaacatctaactgatgaacatgagtgtatcttaraaactggagaggatggcccagtctctgcatggaaacatgcccatctggtacccagaatcaggtgttgaccaacatgtgtcttcaaaggcttctgttctgcttaaagaaaagtgaatatacgacctttccaggtaagtgtgtgtcagagaaaaaaaacaaaaacaaaaacaaagaaaaaaccactttactttcagagatactggttggtctttcaaaaacagcagatttgtttggtatatattagctataaaaggcccagctaaggggcacagaataggttctcaataaatgttccttccc

SEQ ID NO: 155284 - DNA, 601 bp, Human
ttatgtgtagattcattcaattaaaatatatagtacaaggaatctttcaatattaaattttaatgggatagtttatattctaccatcccttccattaattaaatgtttaaatgtgagcaagtgactactggattaaaactaacctatttacaaagtggcctccagcaatgacactttcacagtggagctgaataaacaaaagcaaaagtgctttagggaatacattttaaagggagaaatgaattatttattttagaaaaatgtacaaggtattctaacttcattcttttaataatgcatktatttggatgcataacactcaggtaattttaaagtgataacaaatgactcttcatttcaaaagctttcttttcttattgaagaatggttagagtcacctaaacataatggaaccatgaggtgaagggtggattagtggatcgttcacaaacatttcacacaacaaagctaaggcagaagagtacagacagaggttaatatatgggcatgtgggctctgcagtcagtcagctgagtttcaatctcagtgctttctggtatcagcttgtgtcaaccttgggaaaaatatgcagttcctttgt

SEQ ID NO: 155285 - DNA, 601 bp, Human
ggtttaatcattttagggcatttaaagggaaaacaaccattagggtttcagaaaaatatttagcttttctctgatactcctcatagaacatcattactctgatacttataggaacatttatttttcttacaatgcccattcaccttctcatggaaagtatgagaagatacatgagaatcaatccgtgtatcactgttaggcctcctgaatgaaaaacaattggtgcagacatttccccaaaatttttgttggggtttaagtcaacatatgaaagcaaaacaaaggaggaaagaaggaaggyaggaagaaagttaacaaataactttctaaaatgtaaatttgtctcctgttctgtaccttataatgcgctaatgcctacattattgatgaactactttgctgttgtacatgttgttcttcaaaatattgtagccattaagcactatcgtacaataatttattaacatcagaaatgtaaggagagcatggctatcctaatcttttaatttggcagataatttgtaaaattaaatagtcctttgggattatagtacaaatgggtaaggaaaaagggtagacattacttgaaaccaggtaaacc

SEQ ID NO: 155286 - DNA, 601 bp, Human
tactgaactgcagtttttaaaggtatacattttatccatttaaactcaccataatatctagtttcccttgccctcttcaccctttatttataatttgtgtcattttattgatattattagtttatgcatcagtctctccaaccagtttgcaacttcttcaaagaataggtttttaatgcatcttgtagccctgggtgtcctgaatctaggacctctgagtatactttaatctccagactacttaacaatactgaacacaatgtcaatgctatgtagatagttgttaaactgtattatttayggaaaaatgacaaggaaaaaaagtctgtatgtgttcagtatagatgcaactttttcttgaattattttcaatctgaggttgtttgaatccatggatgcagaaccctcagatacggagggctgactgtactgcttttatttttgagatgggatcttgctctgtcacccaggctggagtactgtggtatgaccatggctcactgcagtctcaacctcctgggctcaagatttcctcccactttagccttctgagtagctaggaccacaatcatgcaccaccacacatggctaattttttgta

SEQ ID NO: 155287 - DNA, 601 bp, Human
agctcatcttttctagctggtaagagcaggttaggcattcctgaccatcttcctccctgcacctggtaggacaaaatttctctgcaggactgacttaaaacttaaagagtggtaaagggggaattcaggggtctgcttagaaagaaaaaaattcttccaaggaccttaagacaaacatgcactcctacaattggaattaaaacagagtttaaaaagcaattggtggtgagcacagcacattgattagaactaattattttaaaataaagtaactgacaaaacaaatcctttcatgtaagtrattgagatggtgagtaaagggaacttactagaagtgaagtaagcacagggttagtcttggtaatgttggtaactgtgcaggaataacatgtaccagtgaaatgtgcagtcattttggctatggtacctggtacttagtagatactgaatatatatttgctgagtgaatggattaacataaaaattacaaacatatgtaggtctacacattcttattctctacagtatgttacatttttgttctctatatcataaatactggccagtggactttgcaaaaaacaaacatttattaataggg

SEQ ID NO: 155288 - DNA, 601 bp, Human
taatcttatctctttctgctagctcccaatctgataagttatagacacataggacttttaatatgcattgaatactttaattagcctgtgtgtaaattttgcttaaaattttgaaaacacaaatcttattgttaatatagctaagcagaaataaattaaagcagaagaaactgttcagaaagataaataacttaatgatgtttaacttgacaggaatggaccactgaaggaagttgacaaaagtgagagataaagctcatcttttctagctggtaagagcaggttaggcattcctgaccaycttcctccctgcacctggtaggacaaaatttctctgcaggactgacttaaaacttaaagagtggtaaagggggaattcaggggtctgcttagaaagaaaaaaattcttccaaggaccttaagacaaacatgcactcctacaattggaattaaaacagagtttaaaaagcaattggtggtgagcacagcacattgattagaactaattattttaaaataaagtaactgacaaaacaaatcctttcatgtaagtaattgagatggtgagtaaagggaacttactagaagtgaagtaagcaca

SEQ ID NO: 155289 - DNA, 601 bp, Human
taagtgaggtccatgagacaggaaaccaaggaaattaaattgtctatccctaaaaattatatagcaataatcttatctctttctgctagctcccaatctgataagttatagacacataggacttttaatatgcattgaatactttaattagcctgtgtgtaaattttgcttaaaattttgaaaacacaaatcttattgttaatatagctaagcagaaataaattaaagcagaagaaactgttcagaaagataaataacttaatgatgtttaacttgacaggaatggaccactgaaggaagytgacaaaagtgagagataaagctcatcttttctagctggtaagagcaggttaggcattcctgaccatcttcctccctgcacctggtaggacaaaatttctctgcaggactgacttaaaacttaaagagtggtaaagggggaattcaggggtctgcttagaaagaaaaaaattcttccaaggaccttaagacaaacatgcactcctacaattggaattaaaacagagtttaaaaagcaattggtggtgagcacagcacattgattagaactaattattttaaaataaagtaactgacaaaa

SEQ ID NO: 155290 - DNA, 601 bp, Human
agaccagaggccaatttaaaacagcaatctttttccagacagcctatcaaattcctttatttataagacagaagctaacgaagagagaatcatgacatggtttcctatccagaagcctgtgtgagccagaagactttttgtctgctcagatacacctaaattttttacaagatgaaacacatttcttcttagcctatgttaaaataatagaatgatattgtttcatatgcattgactttcatggccaaataatactgcaaaatctatttcttcatttcatagaatatttttattttacagkatacttatatattgttatatttatattttattttacagtatatttaacagaacaaattaaagcatattatatttgtgttatatttatattttattttacagtatatttaacagaacaaattaaagcatattatatttgcttattagtgttttttgtttgttttaaaaaaatcatcacactgaatgaacaagatttcaaacattgtaaccacatgtggtgggaagtttaagagcctgacaaccaagcagacattagttgaatccaggctctgttgcactttactagctggatgaacttagg

SEQ ID NO: 155291 - DNA, 601 bp, Human
tcttaaaaatggacagactacactcaaatgcccaataactgtcattatttggttattttctgtttaattataagtcactttcacttccaaactctaattggattccatgcacttttgttctctaagatgttgtgttccgtctgtttaatgactccttggttgagtcgcagaagctgactataagcagaattctaactgggtgaaaatgaaagactttacagtagattaggaactttccattgatttttcaagaaacggtcacatattcagctcatgccttacagaggatattgctcccccygcctttgttttttaatatttaccaaggaagcaattaagagccataaaatctgatttggctcaacccctttatcgtgacaaaaacacatcaattttataaagtaataacagaaaataaaaacaaaaaggaataaatctaaatttaataatatcaatttattatctaaaagggaagcagtcataatgcctggatgtctaatcaaagattgctcttgacatggatgaggatataactgtttaataggatttactgaggacataattgtgcatacgtgataagtgctggaagaatgcattcaga

SEQ ID NO: 155292 - DNA, 601 bp, Human
gtttctcctgtgtaatggattttaagggtgtaacggattttaagtgttcaatggattttaaggaaggccagaagagcctaaatttttctccacctctcttgtcataaaacataaccaaattctttggataggaagtcttaaaaatggacagactacactcaaatgcccaataactgtcattatttggttattttctgtttaattataagtcactttcacttccaaactctaattggattccatgcacttttgttctctaagatgttgtgttccgtctgtttaatgactccttggttgagtygcagaagctgactataagcagaattctaactgggtgaaaatgaaagactttacagtagattaggaactttccattgatttttcaagaaacggtcacatattcagctcatgccttacagaggatattgctccccccgcctttgttttttaatatttaccaaggaagcaattaagagccataaaatctgatttggctcaacccctttatcgtgacaaaaacacatcaattttataaagtaataacagaaaataaaaacaaaaaggaataaatctaaatttaataatatcaatttattatcta

SEQ ID NO: 155293 - DNA, 601 bp, Human
tgactacaatctcagtatatattaagagcctgcaatgaatggtgtgatatttggcataaggctattctgtcttacaacccactttgaaagcaacagaagagcctttaaaatgtaattttttttaaaaaagtttctcctgtgtaatggattttaagggtgtaacggattttaagtgttcaatggattttaaggaaggccagaagagcctaaatttttctccacctctcttgtcataaaacataaccaaattctttggataggaagtcttaaaaatggacagactacactcaaatgcccaatwactgtcattatttggttattttctgtttaattataagtcactttcacttccaaactctaattggattccatgcacttttgttctctaagatgttgtgttccgtctgtttaatgactccttggttgagtcgcagaagctgactataagcagaattctaactgggtgaaaatgaaagactttacagtagattaggaactttccattgatttttcaagaaacggtcacatattcagctcatgccttacagaggatattgctccccccgcctttgttttttaatatttaccaaggaagcaatta

SEQ ID NO: 155294 - DNA, 601 bp, Human
ccacccagttttgctgttggctatgaattgtgacaagtgcttcagtacattgtcctacaccaccaggcgcttgagtcctagatttaaaaaaagcaccataagcaatggataattgtttactctgatggaatggcttcaaaattgtagcctttataatttttagtcatgtagctacaaaataatatccccaaagaatactattcccattccatgtttaaatagttgtaaataatgttgtaaacattatgagattaaaatgaaatggctatattactctgttaccaatggcgtataaatatcmcagcaatttgagtcccactatcattcacttagagaaaagtccgtgaataaaatcctcattgatatttagaaatcttatattattctttttttctttgaaattgagttccactttaaatttccccaattttactccagtgcattataaactttaaaatatatacatgttttaaattagacaggatctctccatgtggcccaggctggactaggactcctgggctcaagtgatcctaccgcctcagtctccccagtgaggttacaggtatgctaaactttaaaatatttttgtcactacatt

SEQ ID NO: 155295 - DNA, 601 bp, Human
actttagatatccacccagttttgctgttggctatgaattgtgacaagtgcttcagtacattgtcctacaccaccaggcgcttgagtcctagatttaaaaaaagcaccataagcaatggataattgtttactctgatggaatggcttcaaaattgtagcctttataatttttagtcatgtagctacaaaataatatccccaaagaatactattcccattccatgtttaaatagttgtaaataatgttgtaaacattatgagattaaaatgaaatggctatattactctgttaccaatggcrtataaatatcacagcaatttgagtcccactatcattcacttagagaaaagtccgtgaataaaatcctcattgatatttagaaatcttatattattctttttttctttgaaattgagttccactttaaatttccccaattttactccagtgcattataaactttaaaatatatacatgttttaaattagacaggatctctccatgtggcccaggctggactaggactcctgggctcaagtgatcctaccgcctcagtctccccagtgaggttacaggtatgctaaactttaaaatattttt

SEQ ID NO: 155296 - DNA, 601 bp, Human
cactatatttacttatggcatgaatgaataagccctgaaaatgtagttggaaacgtacagcaatagagcaaaggtagcctcattcaataacggaagggagcaatgatgccctattttccgcttgaacatggctggtcgtgaatgtgctggctaccacagagttctcactgcctttgatgtggtgtctctgagagagcatgataatgcttttcatccttctcatggctacctcttttggcattaagtcattcagttactctttagtgactgtaccaggaagaggatagaaatagcaagaggwgaaatcaaaagagccagtgtcgatactctatgagaaagagttggggcaaaaatttggcaaaaaatttgattattaaattatccaattgtagatgtaatatttcccaaggtgttcctatttactcgctaatatgtatcattttgaattgactgtagactccttacatataaatatatcatattttaaagtaatcttttgaagagaaatgttacattgtattatttagaaataactggagtttccttcaagaaaatatttgttttctaaattaatgcttaataataataatatgattcataa

SEQ ID NO: 155297 - DNA, 601 bp, Human
gaaacatgggttagagcatgcctctaatctcacgaaaataattctacaactcctgattgcctacacacacaaaaattaaatgttttaacatgctattcaaaacactcaaggatatggacttcagtatattttcagtctccttttaaactagattcctcactcaccttcatgtcttttgctagtcagtcctttaatacatttagaattcattactagactactagtattgctaagaatttatactagactacatagcacagttttgagtaagactctcattagtgttgctccccaactgagkgagtttggacactctgcttagcctctctcagattcaatttcctcacagcaaagtgaagtcaccacaaccttgcaagcttcctgtgtcgatgattgtcaaatgtgcataacatggggcatgaacctggcacttagcaagtgccccataaaaggatgccattgatagtgctcttaggattgtgtggctgtgctcctgataatttttccacttccaggaatgccttcaccacatctctccctgccctggaatccagcctatccttcacagcactcctccaattttaacctctttatgaacact

SEQ ID NO: 155298 - DNA, 601 bp, Human
ccgtggctcatacctgtaattccagcactttgggaggcagaggtgggcagatcacttgagaccaggagtttgagaccagcctggccaacatggtgaaacctcgtctctactaaaaaatatataaaaattagccgggtgtgatggcatgctcctgtaatcccagctacttgggaggctgagacatgagaattgctcgaacccaggaggtggaggttgcagtgagcagagatcgtgccactgcactccagccagagcgcaagagcgagaccgtcttaaaacaaaacaaaacaaaaaaacaaamcccccccaaaaacatgggactcatcaaaaaaaacaattacaacccataatgctctgagaaagccaagtaaattattagctttttacctacaaaactcttctggtaatctgaagtattctttttaatcttcaaaattttaattttgtaccaacagtaggaagatctttttgggaaatcacatctttgtgggggtcacactcaggctaacatctcagtcataagactgatgttgggacatcatttaactttcttgggcttcagtttccttatctataaaatcacaactgtaattatgggatt

SEQ ID NO: 155299 - DNA, 601 bp, Human
tcctgtattaaatatgggattcaggctgggcaccgtggctcatacctgtaattccagcactttgggaggcagaggtgggcagatcacttgagaccaggagtttgagaccagcctggccaacatggtgaaacctcgtctctactaaaaaatatataaaaattagccgggtgtgatggcatgctcctgtaatcccagctacttgggaggctgagacatgagaattgctcgaacccaggaggtggaggttgcagtgagcagagatcgtgccactgcactccagccagagcgcaagagcgagacygtcttaaaacaaaacaaaacaaaaaaacaaaacccccccaaaaacatgggactcatcaaaaaaaacaattacaacccataatgctctgagaaagccaagtaaattattagctttttacctacaaaactcttctggtaatctgaagtattctttttaatcttcaaaattttaattttgtaccaacagtaggaagatctttttgggaaatcacatctttgtgggggtcacactcaggctaacatctcagtcataagactgatgttgggacatcatttaactttcttgggcttcagtttcctt

SEQ ID NO: 155300 - DNA, 601 bp, Human
cttggtgtcaaatcctgtattaaatatgggattcaggctgggcaccgtggctcatacctgtaattccagcactttgggaggcagaggtgggcagatcacttgagaccaggagtttgagaccagcctggccaacatggtgaaacctcgtctctactaaaaaatatataaaaattagccgggtgtgatggcatgctcctgtaatcccagctacttgggaggctgagacatgagaattgctcgaacccaggaggtggaggttgcagtgagcagagatcgtgccactgcactccagccagagcgmaagagcgagaccgtcttaaaacaaaacaaaacaaaaaaacaaaacccccccaaaaacatgggactcatcaaaaaaaacaattacaacccataatgctctgagaaagccaagtaaattattagctttttacctacaaaactcttctggtaatctgaagtattctttttaatcttcaaaattttaattttgtaccaacagtaggaagatctttttgggaaatcacatctttgtgggggtcacactcaggctaacatctcagtcataagactgatgttgggacatcatttaactttcttgggc

SEQ ID NO: 155301 - DNA, 601 bp, Human
aaggtgtctcacgtgactcaaacagaattcctgaacttctccccataacctgctgcttccacaatctgtcttcaactcagaaattagcagttccatcttttagttacttaagagtaagggatcactctttaactcttttcatcctaattctatatccattatatcagcaaaaattgagggctctactctcaaaatatttctagtttaaccattctcacaaggctactactgcatctcttttgataacagcttttttgagatataaacttggcacagaattaacctaaagtgttaggattcwatcaatggtcttgaatatattcacagagttgtacaaccatcaccataatcaattttagaacattctcattacccccaaaagaaacttcatacccattaagcagtcactccctatttccttcagccctgtatcacttctagtcactttctgtagatttgtttctcttggacatttcatataaataaaataatacaaaatacagccttctgtgacttccttcttttgctcaccaccagcatcacctacctggattgcaggagccttccgaatggtctctctgctccatccgagtcacactct

SEQ ID NO: 155302 - DNA, 601 bp, Human
cagggagagagtttagtatgtagaattatctactccaaatttttacgaaggtgtctcacgtgactcaaacagaattcctgaacttctccccataacctgctgcttccacaatctgtcttcaactcagaaattagcagttccatcttttagttacttaagagtaagggatcactctttaactcttttcatcctaattctatatccattatatcagcaaaaattgagggctctactctcaaaatatttctagtttaaccattctcacaaggctactactgcatctcttttgataacagctttkttgagatataaacttggcacagaattaacctaaagtgttaggattcaatcaatggtcttgaatatattcacagagttgtacaaccatcaccataatcaattttagaacattctcattacccccaaaagaaacttcatacccattaagcagtcactccctatttccttcagccctgtatcacttctagtcactttctgtagatttgtttctcttggacatttcatataaataaaataatacaaaatacagccttctgtgacttccttcttttgctcaccaccagcatcacctacctggatt

SEQ ID NO: 155303 - DNA, 601 bp, Human
atagcaatattgcaatcctacataaccagaaaaaagtctttaaaatacaaattgtatatatacacatatacacaaacatacatatatttgcgtgtatatatacatacatagagacacacacacacacacaaacacacacacacacacacacacacacacacacacagggagagagtttagtatgtagaattatctactccaaatttttacgaaggtgtctcacgtgactcaaacagaattcctgaacttctccccataacctgctgcttccacaatctgtcttcaactcagaaattagcarttccatcttttagttacttaagagtaagggatcactctttaactcttttcatcctaattctatatccattatatcagcaaaaattgagggctctactctcaaaatatttctagtttaaccattctcacaaggctactactgcatctcttttgataacagcttttttgagatataaacttggcacagaattaacctaaagtgttaggattcaatcaatggtcttgaatatattcacagagttgtacaaccatcaccataatcaattttagaacattctcattacccccaaaagaaacttca

SEQ ID NO: 155304 - DNA, 601 bp, Human
ccccactgatttgctaatataaaattattttcttactcagcatgacaattgttttacaatcaatcagttttaagtacatcattattttaattatatttattaattacttgacactattaatcattttgaattgttaaatcctcataattaaataaccatgactaaataaccactcactctttccacatagcaatattgcaatcctacataaccagaaaaaagtctttaaaatacaaattgtatatatacacatatacacaaacatacatatatttgcgtgtatatatacatacatagagasacacacacacacacaaacacacacacacacacacacacacacacacacacagggagagagtttagtatgtagaattatctactccaaatttttacgaaggtgtctcacgtgactcaaacagaattcctgaacttctccccataacctgctgcttccacaatctgtcttcaactcagaaattagcagttccatcttttagttacttaagagtaagggatcactctttaactcttttcatcctaattctatatccattatatcagcaaaaattgagggctctactctcaaaatatttctagt

SEQ ID NO: 155305 - DNA, 601 bp, Human
agttggggtcaagcctttcagcgtcagcacactctcactctcttctctggaaggcacaatgaggggcgacattaacttttaatttcttttgtgaaaaagaaagaaatgactgaaaggaaaaaaaatgcatataagcacccacatttccctctatcttggctctccggatctttttttaaaattttttttaacatactttattttaatttatttatataccagtaatgttccataaacgattgctaccataaagtttacattatccaattagggaggttctgtttcttttgagtatcgaagmtagatagataaagaaaaccattttgattttgtaatcaggcatctcaatacaaagtgtttgttgtgcattctgtatgttaaaagtgagccatagagaatgctgatgttaagtttttcagccaaggctcagcaaaaataaggggaagtgatttgatttgacggaataaaaaaacagagcatatggagattgaaaaaaaatctgatttgtggattagggaatcaggaattacattcagtggactttgagaaattaaggcatttagtaatttagatgttacatgaaaaacacataaaataatgg

SEQ ID NO: 155306 - DNA, 601 bp, Human
ggttatgtgtgtatgtgttatctcataaatgaaacataaccagaatacttattaaaaatgtgattaaaaagttgtttttgacaacggagtggctcaaagtagtcaaacctattgtgcatgtaggcaacctaaatgagttgtcctgtagctaggctgaatacgtagattaacatgtgaatgagggaatgggggaaaggtggagtaaagaccacattccagagaatgagggagctattatgttggacatgactgatcaaactgattggggtttcagcccttctgccagctgagaagaagaacygaagaccaagacagagcttaaatgaatgaataaatcagggctctaatgacacagctgactgcgatgccccagcacacagtcatacccatcagcctgcttaccgctttgcagggtttgcttccctccagaaagtactccgctggggagcatgccagttggggtcaagcctttcagcgtcagcacactctcactctcttctctggaaggcacaatgaggggcgacattaacttttaatttcttttgtgaaaaagaaagaaatgactgaaaggaaaaaaaatgcatataagcacccacatttc

SEQ ID NO: 155307 - DNA, 601 bp, Human
tcaaaaataaaatgtggttctattcagtctcttgttttcaattgataaatcagagaaaagacacaaatggcttccaatttccattcaagaggataatgaaatcatctcctgaaaatctagacatacaggtatattttagtggttatgtgtgtatgtgttatctcataaatgaaacataaccagaatacttattaaaaatgtgattaaaaagttgtttttgacaacggagtggctcaaagtagtcaaacctattgtgcatgtaggcaacctaaatgagttgtcctgtagctaggctgaataygtagattaacatgtgaatgagggaatgggggaaaggtggagtaaagaccacattccagagaatgagggagctattatgttggacatgactgatcaaactgattggggtttcagcccttctgccagctgagaagaagaactgaagaccaagacagagcttaaatgaatgaataaatcagggctctaatgacacagctgactgcgatgccccagcacacagtcatacccatcagcctgcttaccgctttgcagggtttgcttccctccagaaagtactccgctggggagcatgccagttggg

SEQ ID NO: 155308 - DNA, 601 bp, Human
gaacactattaaatgtgttctaaagcccacagtttctgataatacacttgctgtgccttaaaatgtgcttatcagaaactagatttcagtcagttaggtagatggtacattttggacatgtaaatgatccatttatgctaatgttttagtaagatatttaatttggtagaaaaacttttgtgtgtttttttttttaaagttgttaaaataattcctagctgtaaatttaaaggggacgtttacttctcaatactatgtatcttcctaccttcatttaaaaatttttgtctttttgtaaaacaaaagacactgattcggaatatattcatctgaaaataaagacaattaatgtgatgcagccatgatgtgatcattcagcaatactatattcatgaagttgatcattactcttcatgtagaagtttattgaataatataaatgagaatagtgagtcttctaggttgaagggcagggacagaaaagaaaatacaaaaaagattcaaagaaagatacaggaaaataagcaagaggccgagaatgttttgaaaaatgttatagcatattttcattttaatttttttctgttaaagcctcatctaa

SEQ ID NO: 155309 - DNA, 601 bp, Human
aaaaacttaagtaacgtaagtttaaaagtaaagcaaaacatccagaatcacaccagcactgacatattagaactatgtactgcccactattaaatgttctaaagcgaatgttaaatgaacactattaaatgtgttctaaagcccacagtttctgataatacacttgctgtgccttaaaatgtgcttatcagaaactagatttcagtcagttaggtagatggtacattttggacatgtaaatgatccatttatgctaatgttttagtaagatatttaatttggtagaaaaacttttgtgtggttttttttttaaagttgttaaaataattcctagctgtaaatttaaaggggacgtttacttctcaatactatgtatcttcctaccttcatttaaaaatttttgtctttttgtaaaaaaaaagacactgattcggaatatattcatctgaaaataaagacaattaatgtgatgcagccatgatgtgatcattcagcaatactatattcatgaagttgatcattactcttcatgtagaagtttattgaataatataaatgagaatagtgagtcttctaggttgaagggcagggacagaaaaga

SEQ ID NO: 155310 - DNA, 601 bp, Human
ccacacactctgtacaagctacagcaaaaaaatgaatacacccagcagagcccttatctgttgcaggtacaacagaaaggggactggccaatttaccttcatcagcctcaatagcctcaacagtagctgaagagaagaaagggggtgcaaaatgaatgagaaaaatgagcagaggattttttaactctaagaacaaatcagtgaccatcaaaggagctaagagaactaatgttcctgtaagtgctagattctggcacagacaacaaaacagaaatgctaaaaaaaaaaaaaaaaaaaaaaaagaaaaaaaatgccacagaaattataaatttaatttatgagctgggtacgcctatctgaattaaatgttttggtttttgcccactaaataaataacaaacaaccctttaggaaaacacttaggaaaatttcttttacatggactgaattataagagattatgtaaatctcaactgtgcttctgactcacacagaatactatataacctctgctatgcttggtgatttagttttaaaatgccagacaaaatggcagaatttgaagcagtgccacaatatcagtgggatcattcacactatt

SEQ ID NO: 155311 - DNA, 601 bp, Human
attctattaatgtggtattgttacattgattaatttttagatgttaaaccaaccctgcattcctggaatacattccatttggtcatactgcataatctgttttatatgttactgaattcagtttgctagtattttgttgaggatttttgtatctatgttcaaaagggataccagtctttctttttggggggatgcctttgtctgattttgttatcagggcaatactggcctcatagaatgagttgagaggcattcactcttctattttggaagagtttgagagagattggcattaagtctwctctacatatctggtcaaattaactagtgaagtcatccaggcctggggttttctttgtgggaagtttttgattacgaattcaatcctttcatttattataggtcttgtgcaagggactttctattttaagggaattcacatttctaaagacttccaaatgtcacacaggtgttttataatggataggacctcgttgtagtaatcccacatctgtttggtttggtaccttctcccagatgcagagaatacccttcacacatattcccattgcttaatgaatgcccttgagaaaaattcatg

SEQ ID NO: 155312 - DNA, 601 bp, Human
accagagtcaatactcaaatatatatatacttattactcagtaaaaatatatcctgctagtaaacgtttagtaaaactggacttcaaaagtgtttcttgatctggaaagtgactgggtccctgaagacttcatgaaaaagccaccattcaagtcctggactgctgaaaagaaagagaaataaacctctatcttgtttacaccttcttattttggtttctgacatttgaagacaaatctaattccaactgatatatcaattataatttatatttaatttttaatactgttaataaattcacrttaaataatatatctggtgtcaggaaatttatgtttgattcaatcattcaacaattaattcttgcatatctactttgttttaggccttcaggcaaggtactgtggggaaaacaaagaagaatgaaactcagatgggatacgttgatagaatgatcagtgaaatattatatatgggtctcatctattcaacaaaaattggctgagcaccaaatacaagcaaggagcttttgtcaaatgtcttttctgtatctattgaaataactgtgtagttttgtcctttattctattaatgtggtattg

SEQ ID NO: 155313 - DNA, 601 bp, Human
attttttagctctttttatagattaaaagctgaggtacctccttagatgacccaatcttcaatctggctctgtggaagtatttcatgaaaagcaaaaacagaaccatctcccttaaagaacttgaaagagaaactatagtatcccctgctttggcatagaggcacaagccttttccatatccacttatgtagcatgggaagtactccatttacagtaccaaaaaccctgctctgttatagactcttgggttttccttcttattaggatggatatctggcctctgatatcagttgtgtttcyagctgtaaaagcacaatagcatctatattcaaatcttgaaagcagaccaagctggcagtggattgaggaaaaaacggggaggcaggaggttgtgtgggcaggtaaaaatgtatctggaacctttcaaagcagctggaaatgttacttcagcttctctaccatcaactacatctttcttttcccctactccctgctgtgattgttcaaagggatacgagaacagagctcacctcaaacctgtcacctccaatgtcccaggtatctgaaagtctagtattatgttgttgtcttattctacag

SEQ ID NO: 155314 - DNA, 601 bp, Human
taaaaacttttgtatttcaatggacaccatcaagaaagtaaaaaaacaacccacagaatgggagaaaagttctgcaaatcatgtacctgataaggttcttatatctagaatatataaagaacttccatagctaaacaataaaaagacaaattacccaattatgaaaatggcaaaggatatgaatagacattgttccaaagaagatacatgagtgatgtgcaggagaagcactcctacttccacatgcctgcatatggactctataggtgactataaaaccctcaattacattataacttccatcccaaatctccatctgactttctccctctggatgtcccacatacctaaacttaacacttcaagcccaacccatcaaaaatggaactcattattttcttgtctctctctccatgtctccaacatatagacggtggtcaagttagaaaggttgccatcatttgccatttttctctttcccttcaatatcttatgaaattgatcaccaaatctagatgattttatctcccatctctcagtcttcactgctgctaccttggtagagaccccagcttctctattggatcagcagagctgtgcc

SEQ ID NO: 155315 - DNA, 601 bp, Human
cataggtttaaatcttcacgaacttggattagacaatggttacttgtatatgacaccaaaagtacatgtgaaccaaggaaaaatacatattctggacttcatcaaaattaaaaacttttgtatttcaatggacaccatcaagaaagtaaaaaaacaacccacagaatgggagaaaagttctgcaaatcatgtacctgataaggttcttatatctagaatatataaagaacttccatagctaaacaataaaaagacaaattacccaattatgaaaatggcaaaggatatgaatagacattgytccaaagaagatacatgagtgatgtgcaggagaagcactcctacttccacatgcctgcatatggactctataggtgactataaaaccctcaattacattataacttccatcccaaatctccatctgactttctccctctggatgtcccacatacctaaacttaacacttcaagcccaacccatcaaaaatggaactcattattttcttgtctctctctccatgtctccaacatatagacggtggtcaagttagaaaggttgccatcatttgccatttttctctttcccttcaatatctta

SEQ ID NO: 155316 - DNA, 601 bp, Human
acatgtaccctaaaacttaaagtataataataataataaataataataataataaagaactttcagtctcactccctactccaacctccagggagtggagaagagatattgagtgcagtcaccaataatgtaatcaatcatgcctatgcaatgaaacctccataaagacctaggcatggggttcagagagcttctgggttggtgaacacagtgatgggctaggaaggcacctggaaagggcctggtggtgctgccccacccacccctaacccctcacattttgtcctatgtatctcttccctttggctactcctgagctgaatcctttataataaaagagtaaacataagtattttcctgagttttgtgattggttctagcaaattatcaaatctgaggagagggttgtgggaacacccagttggtcagaagtatgggtgtctcccgagacttgagactggtgtccgaagtgagagcagtcttgtggaacggatcccttaacctgtggggtctatgttaattccaggagttggtgtcagaattgaatggaattgttggacacccagttagtactagagaattggagaactggttgttggtg

SEQ ID NO: 155317 - DNA, 601 bp, Human
ccaaggaaaagccacatgagcacacagccagaaggtggccatctgcaacccaggaagagagccctcaccagaactctgccatgacggctctgtgatctcagacctccagcctccagaactgtgagaaagtaaatttctgttgtttaaatcacctagtctatggtactttattatggcagcccaagcagactaagccacatgggttctagtgacaaataataggaatttcacagatgagaggtataggagataaaaaatgtgcatgtgactaaccacatggtcaagactctgctttttaacrtgctcctcagatgattctgctcctcacccaggtatgggaaccactggcctccagagccatggaatgagtgcactgatataagccaggaggggcagctaatgggggtattccattatattacataagaaatatcttagaaacctcaactttaggtaacgggaaggcttttttggtttagaccaaacctgtcaaagacagggaggcactttgcccacccccactcccacctgttgtcttctccacccacctcccagtatctatgacctgagaaaattagccagagcaatcaggggaggagtc

SEQ ID NO: 155318 - DNA, 601 bp, Human
aggcttatgaagttctaccaacactgagtgcctcccatttaccaggcatagtttccgtctaacacatagaagctgatttatgctttagcaagtctattttaaggagaaagatcagcccccacacagaggctaaataaagtcacacagcagtaaagagtagattcaggatacaaattcatttatctgaccctggaacgcatgctccttgttatcggactttcctatcttcagtagttctcagtctttgttcagccaagacacacatagcagatacagcactgtctatatttttgacagactyccagggcagagccaggggtgctttgatttcctatggcctggctgctataccatcatgttctttccctttcaaccatgcacatgagcaaataaatgggcagagtgctgttatttgggtgggagtggtgggcggggggggaatcctgaatcaaatctaatttatttctaaaaagtaaatattttacaaacaagttatccaaccattaacaagctttacataaaattccatacaactgagtgttatgaactacacatggccaatgtaaaaccaatcccttttctgatgtcaaaacccctttat

SEQ ID NO: 155319 - DNA, 601 bp, Human
catgtaaaggctggacttggcaggtcagcaacttagatccagctgtgggccagaaagcacaaagcatcacaaaggacaaagataatttaggaagacagcttacagaagtggaccaaatgcgggcatcagaatcaaaaagctcgtgtgagtaagttcccttatcccaaacctcagtttcctcatctgatcatgggaataatatataccttgcaaaatattaagagaattcattaaggtaatatctaaaaaaggttctggcacattgatgatgcctaataaatggattaatattattagaacmagtaacctatggatgaattacctttgggaggggcaggggccctcacttcaaatatttttgtattaaaaaaaataaagtttatttgaaacaatcaggtttaagaagaaataaagttgtactttcgagtactggtaaaaagaaaaacttaatgtaagattgagtcaatatataatgtgtacaaaattttcttactaggtgtgcacttacctaagatcatgaagttctgatccagagccagtaattaaaagaaactccccaggagattggtgagaaacagtcagctcagcatacactcgaccc

SEQ ID NO: 155320 - DNA, 601 bp, Human
acatcttggattggagcatataatttgcatcactgtacaactaagatgagaatctgtcagagtaagacatgtattaaataataatattccaaaaatatttggaatattagactaaagactttataatagaatgaagattcatgtaaaggctggacttggcaggtcagcaacttagatccagctgtgggccagaaagcacaaagcatcacaaaggacaaagataatttaggaagacagcttacagaagtggaccaaatgcgggcatcagaatcaaaaagctcgtgtgagtaagttcccttawcccaaacctcagtttcctcatctgatcatgggaataatatataccttgcaaaatattaagagaattcattaaggtaatatctaaaaaaggttctggcacattgatgatgcctaataaatggattaatattattagaacaagtaacctatggatgaattacctttgggaggggcaggggccctcacttcaaatatttttgtattaaaaaaaataaagtttatttgaaacaatcaggtttaagaagaaataaagttgtactttcgagtactggtaaaaagaaaaacttaatgtaagattgag

SEQ ID NO: 155321 - DNA, 601 bp, Human
ttaaatattgcttgaataatgtactttggtaataaattatctctctgaagacatgctttgtgtctagagttatcagaaagtccccagagtgtcatttcatgaaatcacactgatttttaaagttgaggaaaccaagcccctgagatgttaagtgatgattctctttaaatcacccacttataaatttggggggtaatttttcacagtacagaaggatccttcaatttaatgagctctgccacacaattcttttaaatagtgacacagcccttttgcatttaaactaatgattcagccttgmaaaattaatttaaacccaaattttctctaatacctgtacacaggaggcacacttatgttgctaaaggttaataatgtgcctgccacaagacacgtaattgctctgagaatcacaaggaaaagacagaaactctagtttcaatttctatggcttgatgagttattgggacccagctatagggctggtttctaatttattgagcagtccttgagctatctaagtctatcacaaaatgttcatctggatttacacaaagctaagctattaagatggtcccagtacatcttggattggagcata

SEQ ID NO: 155322 - DNA, 601 bp, Human
aatccatctgcgttttagtcatgaacatggtgttaaatattgcttgaataatgtactttggtaataaattatctctctgaagacatgctttgtgtctagagttatcagaaagtccccagagtgtcatttcatgaaatcacactgatttttaaagttgaggaaaccaagcccctgagatgttaagtgatgattctctttaaatcacccacttataaatttggggggtaatttttcacagtacagaaggatccttcaatttaatgagctctgccacacaattcttttaaatagtgacacagcmcttttgcatttaaactaatgattcagccttgcaaaattaatttaaacccaaattttctctaatacctgtacacaggaggcacacttatgttgctaaaggttaataatgtgcctgccacaagacacgtaattgctctgagaatcacaaggaaaagacagaaactctagtttcaatttctatggcttgatgagttattgggacccagctatagggctggtttctaatttattgagcagtccttgagctatctaagtctatcacaaaatgttcatctggatttacacaaagctaagctattaa

SEQ ID NO: 155323 - DNA, 601 bp, Human
taattttaaattttaaattttaaattgaccttttaaatttcagagacttagtccaggttgttttccaatcttaccagtataagatatcctaatagcagtgacaggaatgttggaaacctttaaggacttggtttgaagaaacttgaaaacatcatcactaagatcttcagaggtcagtttctgaaggacctttcttgcctgtggcccagcaactccaagaactccaagctcatcagttatgtttttaatttcaacatcatatccacctttgactgcttcttcttcaatccatctgcgtttyagtcatgaacatggtgttaaatattgcttgaataatgtactttggtaataaattatctctctgaagacatgctttgtgtctagagttatcagaaagtccccagagtgtcatttcatgaaatcacactgatttttaaagttgaggaaaccaagcccctgagatgttaagtgatgattctctttaaatcacccacttataaatttggggggtaatttttcacagtacagaaggatccttcaatttaatgagctctgccacacaattcttttaaatagtgacacagcccttttgcatttaaac

SEQ ID NO: 155324 - DNA, 601 bp, Human
cctgcaggggttgttaaaacagatttgttggcctgactcccagagattctgatttagtagttctagggtgggacctgagaattagcatttcaaacaagctcccaatgaggctgatgctgttagtctgaaggctacattttaagaaccactgatgtaggagttccctttggagtgtcttatcggttatgattatttgggcttatattagcttctcagttaatacccattttatgccgaaaacgtttgaaacgtgttatttgcttatattcagatgttgcagttacccacaaagatgcttgayaagcagatggacagatatgctgaagtgaggctgctccacactgtgagtatccagaaggatcaatgaatgcactatgtttgatcagctaatgtgcaatttcccaagtcaccaggagttactgcaaaatacacaacatggcgcacttccaacataaatgtctactagaatctgacagataatcttcttatccttactaatttttatcttagaatttagatttagcccttaaagatgctggattctgctatcttaaatctgtaagcacactccaatagtttgaactaagcaaatgttgacaaa

SEQ ID NO: 155325 - DNA, 601 bp, Human
agatgcatcagaatcccctgcaggggttgttaaaacagatttgttggcctgactcccagagattctgatttagtagttctagggtgggacctgagaattagcatttcaaacaagctcccaatgaggctgatgctgttagtctgaaggctacattttaagaaccactgatgtaggagttccctttggagtgtcttatcggttatgattatttgggcttatattagcttctcagttaatacccattttatgccgaaaacgtttgaaacgtgttatttgcttatattcagatgttgcagttacmcacaaagatgcttgataagcagatggacagatatgctgaagtgaggctgctccacactgtgagtatccagaaggatcaatgaatgcactatgtttgatcagctaatgtgcaatttcccaagtcaccaggagttactgcaaaatacacaacatggcgcacttccaacataaatgtctactagaatctgacagataatcttcttatccttactaatttttatcttagaatttagatttagcccttaaagatgctggattctgctatcttaaatctgtaagcacactccaatagtttgaacta

SEQ ID NO: 155326 - DNA, 601 bp, Human
ccctaataaggcctgatggcccatctgctcacccagccattttcctccttaaaatgggcaaagcagctattctgatcctatcataaaacacaaaattagttacagcaaaaacatgtgggggaagtgtctattaataaaaggtagtccatacaaacaatatatgttaccagagagagaaattcttgggcagtctttcaagtctgataagcccactgtggaaaaggactttgtgggggaaagtggtgggtgggaaagctccacgatgaggtcagagggtggcgttcgacctaagctaaagcartggcctcccccaggtcactttccctctctgtgcttcagtttcctctgcttcagatgggggaggggagtaccagctgatccccagggacccatctagctctgatacagtcagcttctaccttttcttcacattatggcttaaacgatcatagtgtaaatgcctaagggccaaccagagaattctaaatgtttgctctgaagggaaagaaataactgatttcaaacaattgtaaaatgccagggtttttgctgtgtttgttttggtatcaaatataaatatctctctgtattagctgttgct

SEQ ID NO: 155327 - DNA, 601 bp, Human
cccactctgccaccccaggtagaattgagtcatattcttccttgagcccccactgtccatacctctatcatagcttctgtttgtttgcatttctgcctccacatgttattctttgttttaaatttataaaacttttgtgactttttacaccctcatagaaagttctagagacataagggaatccgtgtaacatcctctgtcccagtaaagcttccttgggaatcaggcacagcactggttgtggaatcaggctactgtgtcttataggcggggaagggctgcagagactgtgatcatcagstactgtaagtggcagagtggagatggaaatccagatgacaggctgtgccactatccttcaatattttcctgaaaagcttctcatttagaatggattttggatcatcatttaaagcaatctgggtgggaatcccgttgcaaagcctatggccatcactcacctacagtctatgacaatctgaactttcttcactcagttgtgcagtaccctgtgcacctgtgacactgtttatgcctcaggaaacttataataaagccataaactggattcattcatttgggggaatgaattcatttaaca

SEQ ID NO: 155328 - DNA, 601 bp, Human
tgtacagcctttcccaaaagtgtctgtacttacattataatctgatctacacaaaaacaccccacagatactggatttggagtccaagagcagtgcattaactcagtcaaagacaggcaatcaacaaactggttaagaaccaagatctcaggaggcctagccctgttcatttcgcctactctgaacagccctaatggagccacttaaatcaatatctgctacacctctggaggcgatgtggtggaagctggccatgaccagctgggggtgctggatgagagctattggggcagagctaggygagggttgagatgtgctggaaaaggagactaactctacctttgtcaaattcacaattttaccaaaggctaagaaggaacatcaggtattagctaaccatgagggaaacaggaaaggtggggggagagtgggcaaaaactttctctagaaaaaaaaatagagtagtaaattcagtttaaaaaataataaaatattaatcagtaacatttacaatttcttatgcccttgctgtgtcacatactaaaatgatggcttcacattcaagagctcatttaatcctcatgacaacactttaagatgg

SEQ ID NO: 155329 - DNA, 601 bp, Human
tagaggtatggacagtgggggcccaaggaagaaaatgacccagttccgcctgggatgggagagcggggatcggggcattctttgagttgagttttgaaagacgagtaggtttcataaaactactgtctgtacagcctttcccaaaagtgtctgtacttacattataatctgatctacacaaaaacaccccacagatactggatttggagtccaagagcagtgcattaactcagtcaaagacaggcaatcaacaaactggttaagaaccaagatctcaggaggcctagccctgttcatttcrcctactctgaacagccctaatggagccacttaaatcaatatctgctacacctctggaggcgatgtggtggaagctggccatgaccagctgggggtgctggatgagagctattggggcagagctaggcgagggttgagatgtgctggaaaaggagactaactctacctttgtcaaattcacaattttaccaaaggctaagaaggaacatcaggtattagctaaccatgagggaaacaggaaaggtggggggagagtgggcaaaaactttctctagaaaaaaaaatagagtagtaaattcag

SEQ ID NO: 155330 - DNA, 601 bp, Human
tgattcatttgaattcatatataggataaattcatgataacaagtcataacaaaccaaagttcactatagttaaaacaggcagagttgacccttgaacaataccactttaagctgtggaggtccacttacatgtggatttttttcaactaaacacaaatagaaaatacagtattcgtgggatttgaaacccatgtatatggaggggctgactttttgtatatatgggttggtggttcttgagtaaactcagattttggtatatgtgggggttctggaaccaatcccccacatacacagagrgatgactatatctaagaaagaattctataacagcaacattttttttttgctatcttttaaaaaggagacttgcaatcatagaataatgatgacaaggggtgcttttcagagttcttgtctatgttggaatcaataactatactgaaaaaattttatgctttattgtgcagagaagcacttaaacaatagtcagtgaccaaattgacttacacggtgtgatttatggaatgccagcagatctgaaattatttcctcacctaccatcatggaatctgaatctttaccattagagattcattt

SEQ ID NO: 155331 - DNA, 601 bp, Human
cattgaccttctttttaccaatgtgaataattctcatttatttttagccttttctcatttctctcgcaaattatgagaagtctctatctgacttccagaagataacatggcaaatggcctttgaaggaagttaacataatttaagtttgatgttctattgtgtttttctttgactgtccccgtgtgttttagtttacaaataataattttaaaaaaccttctaagctctccaaacctctccacaaacctctttttcaaaacttccttccaagctaagcatcttttaataactgagccaccsaatataaagaaagcctttctcatgaccatctttatgccttgatttcaaaaaaattaaacctcatttaaggttataatccctttctccagcactgcccagctccctgttggacttgacctttccccaaggcactaaagaccatctgacatgcaatatactttatttattttgtccattgtctgtctctccctcctctggaatgtaaactccatgaggtcagagattcttgtgttttgttcactgctgtattcccagtgcctagaatatcgctggcatatggtagacacacacacacacaaa

SEQ ID NO: 155332 - DNA, 601 bp, Human
gtaaaagtttatctctggctgattaataactgccaaggtataacacatgctttaaaattgcttttctcctttagatcatagttcagtgatacaggcagggattagggtcagagaggttagaattttaatcattgctttttttttttttttctggtgtggagtaagactactgacactccatatttattgctttatattataagaattaaagaagcagagactagaaaatcacttttggaaatttcacaatcaccaatttgcaacagaaatggaggcataatatttacgctaacaaatatgktggaagaattgtcacctcagcccataactgcaagtggatactcctggattttcacttactccattactcagtgatgaacattttttgttttttttccaaagccttagatgattttcaggtgaatgtgtgttgttcttctccactagtatgtttctggcacagttatgtttaaagtgatctggtcctacagaatccctccataccagcgtgataccaccaccatgatattcctcacatttaaaatctccatgagatgaagaagatgcccaccagctgctctttccccatcatcctcacaat

SEQ ID NO: 155333 - DNA, 601 bp, Human
aggaaggccattggcagtgtgaccccagcccacagtcctagatcccaggtcgtgacaccactcttttgacagcccagattgttacctaacaagaatgactcccaagctcaaccattccaatgccatctcctctggttccagataagattgaagatgagctggagatgaccatggtttgccatcggcccgagggactggagcagctcgaggcccagaccaacttcaccaagagggagctgcaggtcctttatcgaggcttcaaaaatgtaagacccgtgcacgctctgaaggcctggggggsgttcccacgtgaggctacactctccccaatgccaagggagctcataaggcgtttcccatatgtgaggctgtacaaggaaggccagctctataaagggggcatgagagggagatcacctggctagaaaggaaggctccaggcgaggatggagcaacctcaggagacagtaaacggccaactgcccagaaatttcacagggtggcacatcctcaaggaattcaccctggcccagggtcaagccttagcccttaacataatcataccttccaacctggtggtgcccccacaataatgggattt

SEQ ID NO: 155334 - DNA, 601 bp, Human
taactctcagagtgcaatcttattcccaaatcctggagtggtgtggagtggggtgggctacagcgacatgcacctggtcaccctccctccaggtgcagtctgtaggtagagctgagctgggtcagttccaaactgaccacagcctcaatgttctccaaactgctgacccacagggattccagcccctcctgggagttatctgacaggtgctgggatgcctcttccttccacactagccttgactgcacatgccaagtgcccagtttcctaccattagggcttctttccttcgatggcagcwttagcagtgggcagccgagttggagaaggatcctgtgggaaagttttccaggcaggcactgggctcagagggaacagcatccagaaaagagaagaaatctacactgcttggcatctaccatggactcaataccacctaacataggttcataagatacccttggggaagttattgttacccccattttacaggtaaggatattgaggatcagagactggcttggccaaagtcacaaagcttagtattggctgagccaggatttaaacccaggtttttctgatcttaaagccccaaatctct

SEQ ID NO: 155335 - DNA, 601 bp, Human
tgcacagctggtgagtagcaaaccaggattagattccataagggtctgaaacaggttttgccatgctggcaccaccattgtgcagggcacttttgaatcttttccttaaaatagctgagacaagctggaattttgtaaaagaacttcagtaaataccgaagactataaaaataaactaattgaaaaagaggcaggaaacataaagttgtgcttattaagccagtttacaagtgtgccaggcccacaacagctgctctgttgccctgcccgactcctgtgggaaccagctgtgtccccatgrgcctgggaccacatcggtgactcctcctgtggcctccatgtgtcacatgccactttgcatcctgtcaccaagagctgtctcctgcaagacatcttccctggatcctgacaaaatgcaaatccaagtattccaaacacttcttgggccctgtttctcatgggcctttttggcagcagacagatgccttccttggtgtgtggggcccctacccagatcaggtgggggaggcagttttgtcccatgcaggccccagaattgcagtttgctgagttccactgagccactgtttattgagttctc

SEQ ID NO: 155336 - DNA, 601 bp, Human
ccgggcacactgcttcccagtggcagcccctgtacttagggctttgtatgtattaattcatttactccaattcccacaataaccctatagggtagggttttattattgattacctttttacagaagaggagagtaaggcaaagagagatagagtagttttcccaaggtcaaagagcacataaatgataaaggatggatttgaatgtaggcagaatgaccctcaatacagactgttcctacagtccacgtcctcagccactagaccatacggccactgggatgatagacagaccactgcagscatggataaggcaaaaacagggctggctgtgttgatctgtgtctctcagagctccattcttcctcaagggggcaccttgcaaaaaaaaacaaaaaaatggggcagggtagggaactgaaggcaggagctcttcacagagcatagccacatcctccaggcagacaagaggacgcaggaggcaccattctgtgagagtatcacagtctgacccaaagacacagcttcacactgtctgatggcttgatggttaatgtcactctgccttttccccttctcaggactttgtaaccgctctgtcga

SEQ ID NO: 155337 - DNA, 601 bp, Human
gggtagggttttattattgattacctttttacagaagaggagagtaaggcaaagagagatagagtagttttcccaaggtcaaagagcacataaatgataaaggatggatttgaatgtaggcagaatgaccctcaatacagactgttcctacagtccacgtcctcagccactagaccatacggccactgggatgatagacagaccactgcagccatggataaggcaaaaacagggctggctgtgttgatctgtgtctctcagagctccattcttcctcaagggggcaccttgcaaaaaaaaacaaaaaaatggggcagggtagggaactgaaggcaggagctcttcacagagcatagccacatcctccaggcagacaagaggacgcaggaggcaccattctgtgagagtatcacagtctgacccaaagacacagcttcacactgtctgatggcttgatggttaatgtcactctgccttttccccttctcaggactttgtaaccgctctgtcgattttattgagaggaactgtccacgagaaactaaggtggacatttaatttgtatgacatcaacaaggacggatacataaacaaagaggta

SEQ ID NO: 155338 - DNA, 601 bp, Human
tttacagaagaggagagtaaggcaaagagagatagagtagttttcccaaggtcaaagagcacataaatgataaaggatggatttgaatgtaggcagaatgaccctcaatacagactgttcctacagtccacgtcctcagccactagaccatacggccactgggatgatagacagaccactgcagccatggataaggcaaaaacagggctggctgtgttgatctgtgtctctcagagctccattcttcctcaagggggcaccttgcaaaaaaaaacaaaaaaatggggcagggtagggaacygaaggcaggagctcttcacagagcatagccacatcctccaggcagacaagaggacgcaggaggcaccattctgtgagagtatcacagtctgacccaaagacacagcttcacactgtctgatggcttgatggttaatgtcactctgccttttccccttctcaggactttgtaaccgctctgtcgattttattgagaggaactgtccacgagaaactaaggtggacatttaatttgtatgacatcaacaaggacggatacataaacaaagaggtaagtgagctggggccaggggtgtgagag

SEQ ID NO: 155339 - DNA, 601 bp, Human
aggcaaagagagatagagtagttttcccaaggtcaaagagcacataaatgataaaggatggatttgaatgtaggcagaatgaccctcaatacagactgttcctacagtccacgtcctcagccactagaccatacggccactgggatgatagacagaccactgcagccatggataaggcaaaaacagggctggctgtgttgatctgtgtctctcagagctccattcttcctcaagggggcaccttgcaaaaaaaaacaaaaaaatggggcagggtagggaactgaaggcaggagctcttcayagagcatagccacatcctccaggcagacaagaggacgcaggaggcaccattctgtgagagtatcacagtctgacccaaagacacagcttcacactgtctgatggcttgatggttaatgtcactctgccttttccccttctcaggactttgtaaccgctctgtcgattttattgagaggaactgtccacgagaaactaaggtggacatttaatttgtatgacatcaacaaggacggatacataaacaaagaggtaagtgagctggggccaggggtgtgagagggctccagtgaaggtaact

SEQ ID NO: 155340 - DNA, 601 bp, Human
gtcactctgccttttccccttctcaggactttgtaaccgctctgtcgattttattgagaggaactgtccacgagaaactaaggtggacatttaatttgtatgacatcaacaaggacggatacataaacaaagaggtaagtgagctggggccaggggtgtgagagggctccagtgaaggtaactaacccaacagaaaacagccccaggcatgaggatagcactgtctgaatgaggcaggctctgctttggggctaacagagctggtccctggcaaaataaagaaggcctccctcattgcccyaccctgccctgttcccaagcgcccagaaaggattaaacagattcattctcactgggtcacctagattcagtagatattacacagtggataaaaatgacttgtttcagtgtgaagagttactcttccctagggaacctgcatttgggaaggttaggagccacaagtcaaagctaaaagttgaaatggtggaattgtaggcagcacctagaatagaaaagaaagatttttaaggaagaggaacctacaattgggtcatattggccttaaactattttgcctattaatacaaccgccaagggg

SEQ ID NO: 155341 - DNA, 601 bp, Human
gttgaaatggtggaattgtaggcagcacctagaatagaaaagaaagatttttaaggaagaggaacctacaattgggtcatattggccttaaactattttgcctattaatacaaccgccaagggggtaatggaaggtacagctgtctttacagaaattatcacaaataatttctgaatcttcactgctttgcacttttagaacctcagaggacatgtctctagccagtgaaataccctcaggtctatctcaaaactcactttggtatccactgtatcctggtatctcagtggaagctggaarttggcatcctgtaacactccacttgctgagctcctgtgtgccaggcacggtgcctggaggtatagatatcagcaccaatcttcacctcaacccggcaagcttctctctgtaagctcagagagtttatccaactttcattcctcattcatttagtcatgtttttaattaacacagatttgaaggcttattaggtgttctaggtgctggaggtaaagaggtgaacaatcagactaggccccacactggagcagcatagagagatggacaataaacaggccaaaaaggaatcagcaggtagaa

SEQ ID NO: 155342 - DNA, 601 bp, Human
aaggaacagccactagagaggctttgaggcaagatagagcttcatgtgtttcaaaaacagaaaggcttcagatggctgcagatgaaggtatgaagctgaagactagtgcaggatgagcctgacaggtcagcagagtcagatggtggagggctagggtaaggggcccatccatattcccctgggaagctcttagatgaacatgttttttgaaagacacaaaaggcaaaaacagacttaaaaagaatcagaaaatctgactagctctgtattatttagagaaattatattcacagttaaaaamcattcccaaataaaattataggcccagatggtggactggtgaattctaatatcaatcctacaaaaaaattttagaaaatagaggaggatggaacatttcccagcttgttttataagtccaatagtaccctgatacccaaaccaaagaaaaaaaggtcttatgaaaggaaacaactacaaaacagtctccctcgtgagcacagataaaaaagctttcactaaatattagcaaattgaattcagcaatatataaaaaggatgatacaatacaactatgtgagttttattctaggaaggcaag

SEQ ID NO: 155343 - DNA, 601 bp, Human
cctgacaggtcagcagagtcagatggtggagggctagggtaaggggcccatccatattcccctgggaagctcttagatgaacatgttttttgaaagacacaaaaggcaaaaacagacttaaaaagaatcagaaaatctgactagctctgtattatttagagaaattatattcacagttaaaaaccattcccaaataaaattataggcccagatggtggactggtgaattctaatatcaatcctacaaaaaaattttagaaaatagaggaggatggaacatttcccagcttgttttataagyccaatagtaccctgatacccaaaccaaagaaaaaaaggtcttatgaaaggaaacaactacaaaacagtctccctcgtgagcacagataaaaaagctttcactaaatattagcaaattgaattcagcaatatataaaaaggatgatacaatacaactatgtgagttttattctaggaaggcaaggttggtttaacattcaaaaaccaatcaatataattcactatatttaaagaaaccaaagggatatagactggaaaggaagaattaacactgtctttatttgtacatggtataattgta

SEQ ID NO: 155344 - DNA, 601 bp, Human
gttaagatgtggattctccaaatttgatttatagatttagtgtgatctcaatcaaaatcccagcaggtattttgtagcagttgatatgggaatgcaaaaaacctaaaataaccaaaacatctgaaaaagaacaaagttgaaggactaaacctaccttacttcaagacttaatgaaaatgtgcagtagtcaagatggtagggaattggcataaggatagacatatagatcaatggatcaaaatagagagtcaaaaaaactaaaagtagagctaccatatgatccaacaatcccactgctggstatataccccatataaaggaaaccagtatatcaaagagatatctgcactcccatgttttttgcagatctgttcataatagccaagatttggaagcaacctaagtgtccatcaacagatgaatggataaagaaaatctggtacttatacacaatggagtacttctgccataaaatagaatgagatttaatcatctacaacgtggatggaattggaggtcattacattaagtgaaatgaaccaggcacagaaagacaaacatcccatgttctctcttatttgttggatctaaaaatcaaaac

SEQ ID NO: 155345 - DNA, 601 bp, Human
ttctccaaatttgatttatagatttagtgtgatctcaatcaaaatcccagcaggtattttgtagcagttgatatgggaatgcaaaaaacctaaaataaccaaaacatctgaaaaagaacaaagttgaaggactaaacctaccttacttcaagacttaatgaaaatgtgcagtagtcaagatggtagggaattggcataaggatagacatatagatcaatggatcaaaatagagagtcaaaaaaactaaaagtagagctaccatatgatccaacaatcccactgctgggtatataccccatrtaaaggaaaccagtatatcaaagagatatctgcactcccatgttttttgcagatctgttcataatagccaagatttggaagcaacctaagtgtccatcaacagatgaatggataaagaaaatctggtacttatacacaatggagtacttctgccataaaatagaatgagatttaatcatctacaacgtggatggaattggaggtcattacattaagtgaaatgaaccaggcacagaaagacaaacatcccatgttctctcttatttgttggatctaaaaatcaaaacaatatgaagatag

SEQ ID NO: 155346 - DNA, 601 bp, Human
ccagcaggtattttgtagcagttgatatgggaatgcaaaaaacctaaaataaccaaaacatctgaaaaagaacaaagttgaaggactaaacctaccttacttcaagacttaatgaaaatgtgcagtagtcaagatggtagggaattggcataaggatagacatatagatcaatggatcaaaatagagagtcaaaaaaactaaaagtagagctaccatatgatccaacaatcccactgctgggtatataccccatataaaggaaaccagtatatcaaagagatatctgcactcccatgtttkttgcagatctgttcataatagccaagatttggaagcaacctaagtgtccatcaacagatgaatggataaagaaaatctggtacttatacacaatggagtacttctgccataaaatagaatgagatttaatcatctacaacgtggatggaattggaggtcattacattaagtgaaatgaaccaggcacagaaagacaaacatcccatgttctctcttatttgttggatctaaaaatcaaaacaatatgaagatagagggcagaaggacggttaccagaggctgggaaggatagtagggggg

SEQ ID NO: 155347 - DNA, 601 bp, Human
tttcttaaagtagataaatttgactttatcaaagttaaaaattttgtgctttagaagacacctttaagaaaatggaaatgcaagccatggacttggaaaaaatgtttgcaaattatataccagatatataaagataccaggataccaaaccaatataaagactggcatccaaaatatataagggacatttataatttaatacaaagataaacaacttcatataaaataggcaaaagatttgatgagatatttaagaaaagaagatatatgaatggccagtaaacccatgaaaggttgctcyatatcactggtcttcaaagaaatgcaaattataactataatgaaatacaattgcacagaatggccacaattaaaaagactgataataccaagcattggcaaagatgtggagcaatagaaactctcatagatagctggcagaaatgtaaatggtacaaacacgttgggaaacattttggcatctttgataaagctcagcacacacttaacatacaacccagaaatcccattccagtcaggcatggtggcttacgcctataatcccagtactttgggaggctgaggcaggcggatcacttga

SEQ ID NO: 155348 - DNA, 601 bp, Human
ttaagaaaagaagatatatgaatggccagtaaacccatgaaaggttgctctatatcactggtcttcaaagaaatgcaaattataactataatgaaatacaattgcacagaatggccacaattaaaaagactgataataccaagcattggcaaagatgtggagcaatagaaactctcatagatagctggcagaaatgtaaatggtacaaacacgttgggaaacattttggcatctttgataaagctcagcacacacttaacatacaacccagaaatcccattccagtcaggcatggtggctyacgcctataatcccagtactttgggaggctgaggcaggcggatcacttgagctcaggtgttcaagaccagactgggcaacatggcgagacactgtctctactaaaaatacaaaaaaaaaaaaaaaaaaagccagacatggtggtaagcacctgtggtcccagctactagggaggctgaggtgggagaattgcttaaccctggggagtggaggttgcagtgagctgagattgcaccactgcactccagcctgggtgacagagcaagaccctgtctcaaaaaaagaaaaaaagaagaagaaa

SEQ ID NO: 155349 - DNA, 601 bp, Human
attataatgacagcaattcttctctaattaaatttattttattttgaatcaaaatggaagtgttatttgggaaggaaatttggcacaattgttataaagttacattggaagattaatcagatgaaaatagcaaagataattttcaaaaagaagaaaaatggtgggatttgttctaccagatactgaaatatattataaagctgaaactattaaaatattataatatcagagaaggaacaggtagatcaatggaacaaaatagaaatcccaggtacaaataccatcttggttcataataaarggagcatattgaatagagaggtaatgaatcattaaatgattcttggaaaactggttaactattttggcaataagtaagtaaatattcttactcggtaccataaacacaaaatcactatagatatgtacagttgctttttaactaaaaaagaactaaaaatcatatgtgaatatctgatcaaagaatggaaaaagcataaaatcaaagttagaaacaattttttaaattattgatggctttacactgtaaatattttaaaattctgcatatcaaaaaataccataaacaaagttgaaaagt

SEQ ID NO: 155350 - DNA, 601 bp, Human
caaaaagaagaaaaatggtgggatttgttctaccagatactgaaatatattataaagctgaaactattaaaatattataatatcagagaaggaacaggtagatcaatggaacaaaatagaaatcccaggtacaaataccatcttggttcataataaagggagcatattgaatagagaggtaatgaatcattaaatgattcttggaaaactggttaactattttggcaataagtaagtaaatattcttactcggtaccataaacacaaaatcactatagatatgtacagttgctttttaacwaaaaaagaactaaaaatcatatgtgaatatctgatcaaagaatggaaaaagcataaaatcaaagttagaaacaattttttaaattattgatggctttacactgtaaatattttaaaattctgcatatcaaaaaataccataaacaaagttgaaaagtaagtgacaaacttgtttttaaaaatctgcaatttatgatgacagaaaggattgatattcctcagtagacattcatcttaacaaaggcaagagtcatattcatcgtgcttatctttgtatttctttgacacaatatctagcaca

SEQ ID NO: 155351 - DNA, 601 bp, Human
ttttttaaattattgatggctttacactgtaaatattttaaaattctgcatatcaaaaaataccataaacaaagttgaaaagtaagtgacaaacttgtttttaaaaatctgcaatttatgatgacagaaaggattgatattcctcagtagacattcatcttaacaaaggcaagagtcatattcatcgtgcttatctttgtatttctttgacacaatatctagcacatggtagatgcgtaaaaatacctttaaataaattaaaaatctattaagatattttaacaatttaataaatctacaygaatatataaagagctctcacaatccagtcagaaataggtgaacacaatgagcaaagcagatgaaaaaatagttcatgggaaaataaataaaaatagtcaatacatatattagagacctcactaagaaagtaatgtatatctttaaaaacaatgaattatcacttatctattaaattgcaaaggttttgtaaagtctttgttgaaggttggtggaaagtggtttttcatacatagttgctgaaagtgttctgataataaactttctaaaaggtatttgaggaatatgtatcaaaagcatt

SEQ ID NO: 155352 - DNA, 601 bp, Human
aatagtcaatacatatattagagacctcactaagaaagtaatgtatatctttaaaaacaatgaattatcacttatctattaaattgcaaaggttttgtaaagtctttgttgaaggttggtggaaagtggtttttcatacatagttgctgaaagtgttctgataataaactttctaaaaggtatttgaggaatatgtatcaaaagcattgaaagttatgcatcccattctccttataaaaccacaccttggtatatgtcccaaggaaataaagaatagacacaaagacttaaaagcaagaaragtcttcaggtaatagtgccccagaatgtgatagccatgatatccactaacagcagatttgtaaaatgaattacagtaaatacatataatggaatagccagtggccacttaaaatcatgaaagagtaatataaaataaacattagtatgatatattaaatttttaaatatattacattttaaattgataaagtggtatgtatgatatctcaattttataaacaactaaatgcttatatacacatgcaaatatatgatactctaaaatattcaaatactaccttgcaaaacatataaagaa

SEQ ID NO: 155353 - DNA, 601 bp, Human
aattgctctttctgtgattaaaaaaaaatatcagacaggaaaagcatcaatggccatgtagatgtgaagggcttgtaaagcacacatttaaaaataaacacatggatagagacatctatttcctcgttctatctgttgagggcacctcagagcaatgacatccctgtagcagtgagcatactagtacctagactttgatttctaaataccattcttcgataaacagaaccagtcttcttgaagaatagttgattctaagattgggaaagagaaaatacaagatgagcctggagtactttawtatgctgaaggtataaaagtgcttaaaaaaaaaaaactgcaggagtcaacctgaaggagttcccaatagtcagaatgaaagcaatttgagcaaaattaaaaattattaagtactggattataacctgtaaaatatggtaaatgcccacaagtccatgctaatgtaaataaacaactgaatacataaataaatgcaggagagaaggtagctcttccttacagaagaattgtaattaataagtatagaaggaataaaggaaatacaaaattaccatcaggcaaacactacagtaataatttt

SEQ ID NO: 155354 - DNA, 601 bp, Human
gtcaaagccatctatgacatgatggggaaatacacatatcctgtgctcaaagaggacactccaaggcagcatgtggacgtcttcttccaggtaagtgcacacaccctgcacatgagctgtaagcccagcctagatcaagtcaacccacgagcatctgagcaaatgatttgtgtccaaccctgtactaagcatggttggtaacagaaaagaattataagatacattgtcctcaagaaacagatgatctccttaagctgcaagtgtacatgacagaagagaacaagaaagtatattattaaaygctagtggtatagtatgaactctaaatccataaaaatttggggatcagggtaaacacgaaagacttcattaattacaactgtggaggtgttaagcatttgtgtctgggaagtaaggggaaataagattggaaactaggatagggccagattatgagacctttaaatggaagagtttggccttgctctggtacaggatgggcagctagtgctgatccttgactaagggagtggtataatcattggggcattttaggaaaaaattaatctagcggtggagtatcagagaatatcaagagttc

SEQ ID NO: 155355 - DNA, 601 bp, Human
cctgtgctcaaagaggacactccaaggcagcatgtggacgtcttcttccaggtaagtgcacacaccctgcacatgagctgtaagcccagcctagatcaagtcaacccacgagcatctgagcaaatgatttgtgtccaaccctgtactaagcatggttggtaacagaaaagaattataagatacattgtcctcaagaaacagatgatctccttaagctgcaagtgtacatgacagaagagaacaagaaagtatattattaaacgctagtggtatagtatgaactctaaatccataaaaattyggggatcagggtaaacacgaaagacttcattaattacaactgtggaggtgttaagcatttgtgtctgggaagtaaggggaaataagattggaaactaggatagggccagattatgagacctttaaatggaagagtttggccttgctctggtacaggatgggcagctagtgctgatccttgactaagggagtggtataatcattggggcattttaggaaaaaattaatctagcggtggagtatcagagaatatcaagagttcactctagttcaacctcccactttgcagatgggaaaagag

SEQ ID NO: 155356 - DNA, 601 bp, Human
caccagattctgtaaagtgctttctgttatgtctttcagaaaatggacaaaaataaagatggcatcgtaactttagatgaatttcttgaatcatgtcaggaggtaaggagagatctcagggcacaataactctacatctgggaaaggaaacctggggcctggggacctgcagaaggaaggtgatgagaaacctgcacatacctgcaacccctcccatcagagccaacaacaccagcaacaactgtgaagtccacagttccactcctcaacctgacctgcagttggtcttggctaagcacargactgaacagagagcctaagtaggggtctgggggcatgtgaaaactcagagggggtctctgtgaaaatagacttcccgagagggcaacaccattattttttagcctgcctctggcttgatgacccatttcccagactacaaggaagcagctggggggaaaaaaacctacaattgtgtgattctcaaaccacagtgtgcataaaaattgcctggaatgattctgaaaatgcatatttccaggcctcaatcccagagactctagatctgggtcactttaacacaaatgtcctggaccaatgc

SEQ ID NO: 155357 - DNA, 601 bp, Human; identical to SEQ ID NO: 32554

SEQ ID NO: 155358 - DNA, 601 bp, Human; identical to SEQ ID NO: 32555

SEQ ID NO: 155359 - DNA, 601 bp, Human; identical to SEQ ID NO: 32556

SEQ ID NO: 155360 - DNA, 601 bp, Human; identical to SEQ ID NO: 32557

SEQ ID NO: 155361 - DNA, 601 bp, Human; identical to SEQ ID NO: 32558

SEQ ID NO: 155362 - DNA, 601 bp, Human; identical to SEQ ID NO: 32559

SEQ ID NO: 155363 - DNA, 601 bp, Human; identical to SEQ ID NO: 32560

SEQ ID NO: 155364 - DNA, 601 bp, Human; identical to SEQ ID NO: 32561

SEQ ID NO: 155365 - DNA, 601 bp, Human; identical to SEQ ID NO: 32562

SEQ ID NO: 155366 - DNA, 601 bp, Human; identical to SEQ ID NO: 32563

SEQ ID NO: 155367 - DNA, 601 bp, Human
ctctgacacccgttgaatgaactctaggctcctggactctccgctgcctcctcaactcaagtcgtccaccagacccagcactgtgctccctgctccctgtgccaaggcctggagattctcaaagcagcaagcaaccataggcttcaccgcctttgttttccatccctcggtgtctgatgctcaatgtcttgaaaattgctctttcatatattttgcctggttatttggttatttcagttgggaaagtaaatctgatccctattacttaatcttgttcgaaagccaaagttcccatgatatratataaatggttgacgtaccttaggacgatccctcagggaatggtgggaccctggtgaactggggagcacaaatcccaactaaacagggcagcagacatcagatccggctgactattgccacagtagaatataagccctcaattgccacatctttcacttgtttctaaagaggctggattttgtgaaagttttcctgatttcaaagcacagtggtcaccaaatttaacatacctgcagtctgggactagcccaccagccaccaattctgacacctgtgtggaaagttccctcttttgcaa

SEQ ID NO: 155368 - DNA, 601 bp, Human
ctcctttagggactttagatatatatttggttctttgaaattgtcccaaagttccttgatgctttttttttttttttgagatggagtcttgctctgtcacccaggctggagtacagtggtgccatctcagctcactgcagcctccacctcccaggttcaagtgattctcctgcctcagcctcttcagtagctggaactacagtcgcctgccaccaagcctggtgaatttttgtatttttagtagagatggggttttgtcatgttggccaggctggtctcaaaatcctgaactcaggtgatmcacccacctcagcctcccaaagtgctgggattacaggcgtgagccactgtgcccggccccttgatgctcttttcagtgttttgttttagttttttttctctgtgagtttcaatttggacaatttctattactgtatcttcatgtctactactattttcttttgcaatatctaatctgctgttaatcccaagcagtgtatttctaatctcagattttatagtttacatttctagaagttctgtttgggtctttttttgaatttcttatgcccaaatttaacttctagaacacatgaaatac

SEQ ID NO: 155369 - DNA, 601 bp, Human
gctgttgtgatccttgcatttgttcctctgtatgtaatatgtctttttttttttttctgactgcttttaagattttctttttatcattggttttgagcaatttgattgtgatgtgcctcagagctagttttcttcctgtttcttagatttggggtttgttgagcctcttggatctgtgggtttataattttcatccagtttgaaaaatttttagccattatgtcttcaagtgttttatttctgtctctccttccccgctcacatacacattctttcctctcctttagggactttagatatrtatttggttctttgaaattgtcccaaagttccttgatgctttttttttttttttgagatggagtcttgctctgtcacccaggctggagtacagtggtgccatctcagctcactgcagcctccacctcccaggttcaagtgattctcctgcctcagcctcttcagtagctggaactacagtcgcctgccaccaagcctggtgaatttttgtatttttagtagagatggggttttgtcatgttggccaggctggtctcaaaatcctgaactcaggtgatccacccacctcagcctcccaaag

SEQ ID NO: 155370 - DNA, 601 bp, Human
tcaaatgccctcaagggccacgtacatacacagacctaagtagttaccatttctggcacccttcattcctatgtacacatccctttccacttgaaggacttttaaaaagcacctgtggcagtacagttcagattttgtgtgtctgaaaaagtctttatttcgtcttcatttttgaaagatatttttgcctagtattgaactctaggttgacaatatttttcttttgctattttactttcgagaaagctgttgtgatccttgcatttgttcctctgtatgtaatatgtctttttttttttttctgactgcttttaagattttctttttatcattggttttgagcaatttgattgtgatgtgcctcagagctagttttcttcctgtttcttagatttggggtttgttgagcctcttggatctgtgggtttataattttcatccagtttgaaaaatttttagccattatgtcttcaagtgttttatttctgtctctccttccccgctcacatacacattctttcctctcctttagggactttagatatatatttggttctttgaaattgtcccaaagttccttgatgctttttttttttttttg

SEQ ID NO: 155371 - DNA, 601 bp, Human
ctatcattattagcattatacagataaggaagctgaggctcggagagctgagctagcttgccctcaagtctcacagcctgtgaatggaaggattgggtctcaagcatctgacctcagagcctgcgctttttctcactaagctctcctgtctgcctatttataccccaaatagtagcacttaaaattggtgagcttgtagagtctctctaacccattccttccttttatagtttaggaagctgagggtggtctagggatgtgtcccaggtcacacaactcattggaagtagagctggaattkgtccttgttatacatttctgccaagagggacagtgagtctctaagtcacctcatcagggcagcctggaccttcccttgatattttctccatcattctccatattaacccttcatgttctatgggcaggcttcacagtctttctagggtgcacattcaaacacattggaggaggggattacatcgcaggccaagcttttgttttagtttccagagagctaaagaaagatcccaccccagcccattcgcaatgtgttgataattctcccgttcacactaaccagaaaccatttcccacccct

SEQ ID NO: 155372 - DNA, 601 bp, Human
acctgagaagccgggggcagccagatgttttaagactcaggaaggagcctttcaccatcacctgaggcctcggtcgagagtgtaagagtaggacataataatttgaggacacagtgttctccttacttgtcacccatgtcccctacccctgtagttttacatggagtgttttcctggtgcctcacgatcattttcctggtagacaagtataattattctcatttttacaaataaaaaaggcagggctggccaggtgtggtggctcatgcctgtaatcccagcactttgggaggctgaggcrggtggttcacttgaggtcaggagttcgagaccagcctggccaacatggcaaaaccccatctctgctaacaatacaaaaattagccaggcatggtgatgcctgtaatcccagctactcgggaggccgaggcaggagaatcgcttgaacccaggaggcggaggttgcagtgagccaagattgcgccactgcactccagtctgggcaacaagagtgaaactccaactcaaaaataaaaataataataataataggcaaggctctgagggaggcatctgtctaaaggcacgtgaccagcattta

SEQ ID NO: 155373 - DNA, 601 bp, Human
ctccctgcacacattcccactctcagccctgctctcgctctgcattccaatcctccttccaaggaacaaagtgttctttccgtctttaaagaccagcccccttgaaccaagagccaaaccttctaaattctatccttgtcacctgagaagccgggggcagccagatgttttaagactcaggaaggagcctttcaccatcacctgaggcctcggtcgagagtgtaagagtaggacataataatttgaggacacagtgttctccttacttgtcacccatgtcccctacccctgtagttttacrtggagtgttttcctggtgcctcacgatcattttcctggtagacaagtataattattctcatttttacaaataaaaaaggcagggctggccaggtgtggtggctcatgcctgtaatcccagcactttgggaggctgaggcaggtggttcacttgaggtcaggagttcgagaccagcctggccaacatggcaaaaccccatctctgctaacaatacaaaaattagccaggcatggtgatgcctgtaatcccagctactcgggaggccgaggcaggagaatcgcttgaacccaggaggcggag

SEQ ID NO: 155374 - DNA, 601 bp, Human; identical to SEQ ID NO: 32564

SEQ ID NO: 155375 - DNA, 601 bp, Human; identical to SEQ ID NO: 32565

SEQ ID NO: 155376 - DNA, 601 bp, Human; identical to SEQ ID NO: 32566

SEQ ID NO: 155377 - DNA, 601 bp, Human; identical to SEQ ID NO: 32567

SEQ ID NO: 155378 - DNA, 601 bp, Human; identical to SEQ ID NO: 32568

SEQ ID NO: 155379 - DNA, 601 bp, Human; identical to SEQ ID NO: 32569

SEQ ID NO: 155380 - DNA, 601 bp, Human; identical to SEQ ID NO: 32570

SEQ ID NO: 155381 - DNA, 601 bp, Human; identical to SEQ ID NO: 32571

SEQ ID NO: 155382 - DNA, 601 bp, Human; identical to SEQ ID NO: 32572

SEQ ID NO: 155383 - DNA, 601 bp, Human; identical to SEQ ID NO: 32573

SEQ ID NO: 155384 - DNA, 601 bp, Human; identical to SEQ ID NO: 32574

SEQ ID NO: 155385 - DNA, 601 bp, Human; identical to SEQ ID NO: 32575

SEQ ID NO: 155386 - DNA, 601 bp, Human; identical to SEQ ID NO: 32576

SEQ ID NO: 155387 - DNA, 601 bp, Human; identical to SEQ ID NO: 32577

SEQ ID NO: 155388 - DNA, 601 bp, Human; identical to SEQ ID NO: 32578

SEQ ID NO: 155389 - DNA, 601 bp, Human; identical to SEQ ID NO: 32579

SEQ ID NO: 155390 - DNA, 601 bp, Human; identical to SEQ ID NO: 32580

SEQ ID NO: 155391 - DNA, 601 bp, Human; identical to SEQ ID NO: 32581

SEQ ID NO: 155392 - DNA, 601 bp, Human; identical to SEQ ID NO: 32582

SEQ ID NO: 155393 - DNA, 601 bp, Human; identical to SEQ ID NO: 32583

SEQ ID NO: 155394 - DNA, 601 bp, Human; identical to SEQ ID NO: 32584

SEQ ID NO: 155395 - DNA, 601 bp, Human; identical to SEQ ID NO: 32585

SEQ ID NO: 155396 - DNA, 601 bp, Human; identical to SEQ ID NO: 32586

SEQ ID NO: 155397 - DNA, 601 bp, Human; identical to SEQ ID NO: 32587

SEQ ID NO: 155398 - DNA, 601 bp, Human; identical to SEQ ID NO: 32588

SEQ ID NO: 155399 - DNA, 601 bp, Human; identical to SEQ ID NO: 32589

SEQ ID NO: 155400 - DNA, 601 bp, Human; identical to SEQ ID NO: 32590

SEQ ID NO: 155401 - DNA, 601 bp, Human; identical to SEQ ID NO: 32591

SEQ ID NO: 155402 - DNA, 601 bp, Human; identical to SEQ ID NO: 32592

SEQ ID NO: 155403 - DNA, 601 bp, Human; identical to SEQ ID NO: 32593

SEQ ID NO: 155404 - DNA, 601 bp, Human
gtaataaacttaatgattcacctttattctaagagaggcatgaagtaacattaccctaattgtcttatgactctaagatgtttctgtattcatagatctttgctgtgtttaaatcttactgacttctcttgtttttggaaagttatacagatcctcatctgtgttaatacatcagtcaactgtctcttttataaaatatatatagatatgtgtatatatgtggatgcttgttaagtcaagactaagaatatttttcagttttgggctcagtatgtttcaccaattcaaaagttaaaaaaamcaatttttttttttaattgagacagggtctctgtcgctcaggctggaatgcagtggcacgatctccgctcactgcaaattccgcctcccagtttcaggcaattctcctgcctcaacctcctgagtagctggggccacaggcacgcactaccacacctggcaaatttttgtatttttagtaaagatggggtttcaccatggtggccaggctgatctcaaactcctggcctcaagtgatctgcccacctcagcctcccaaagagctaggattacaggcaagagccatctcccccagccaaaa

SEQ ID NO: 155405 - DNA, 601 bp, Human
tttttttttaattgagacagggtctctgtcgctcaggctggaatgcagtggcacgatctccgctcactgcaaattccgcctcccagtttcaggcaattctcctgcctcaacctcctgagtagctggggccacaggcacgcactaccacacctggcaaatttttgtatttttagtaaagatggggtttcaccatggtggccaggctgatctcaaactcctggcctcaagtgatctgcccacctcagcctcccaaagagctaggattacaggcaagagccatctcccccagccaaaacaatamattagtttatagtggtaaattaatactgaccatgaatgataaaaacccctcaatatctgaatcctttctgtttaatataattgagataatttcttcctctaagagaaataagaaaatttgcctgaaaatttacctcatatagccaaataactgaaatcagaacttttctcaccattatcatctttccttattctttccttcccctcccaaattctaaaaatgattgattataggtaaataaggaaatggtaaatgaggatatctgggcttgtgtttcatcctgatttcaaagtacataaa

SEQ ID NO: 155406 - DNA, 601 bp, Human
ttaattgagacagggtctctgtcgctcaggctggaatgcagtggcacgatctccgctcactgcaaattccgcctcccagtttcaggcaattctcctgcctcaacctcctgagtagctggggccacaggcacgcactaccacacctggcaaatttttgtatttttagtaaagatggggtttcaccatggtggccaggctgatctcaaactcctggcctcaagtgatctgcccacctcagcctcccaaagagctaggattacaggcaagagccatctcccccagccaaaacaataaattagtytatagtggtaaattaatactgaccatgaatgataaaaacccctcaatatctgaatcctttctgtttaatataattgagataatttcttcctctaagagaaataagaaaatttgcctgaaaatttacctcatatagccaaataactgaaatcagaacttttctcaccattatcatctttccttattctttccttcccctcccaaattctaaaaatgattgattataggtaaataaggaaatggtaaatgaggatatctgggcttgtgtttcatcctgatttcaaagtacataaagataaat

SEQ ID NO: 155407 - DNA, 601 bp, Human
tctatttttgttttttatgttttgaaacagagtctcactctgtcacccaggctggagtgcagtggcatgatcgcagctcactgcaacctctgcctcccaggttgaagcagttctcctggctcagccccgcaagtagctgggactacaggcacgcaccaccactcctggctaatttttgtatttttagtagagatgaggtttcaccatgttggccaggctggtcttgaattgctgacctcaagcaagccgcccatctcggcctcccaaagtgctaggattacaggcaggagccactgtgccyggctatttataagctattaatttaatagaaataaaatatttgacagatttcttcttcctattctttggtgttacaggatcttcatgaaatccctattttacagtgaggaagcatcaagaaacaaatggtatactctttaataggaacaatatgccatatttatcaaattatagaatatataaagcttgcaaatattatgtagtagataattcctttaaagtgtactcctcatggttatgttctaatcacattcccacaaaagtttctatactctgaataactttaagggaggaatacagt

SEQ ID NO: 155408 - DNA, 601 bp, Human
tgatcacaacaatataataaactgcatccatgtcttttaaaactaggcaagaatagacaaaatgctctaatttctgttggagactagcaatatgcaaaccagaccatttttgttgaaaaattctggagacatttatgaccgagtttttatatcctttaagataattttatcctttcatgattgtatcatttcatgatatgttccttttgtgacaaatgctgctagtatcagtgtcacagattgttactgatgatatacagtgtttatgctttaaattccgaactcacagaatttaatggawacttcagaattctttaaatttcaaaagtcttaaagcatatttatttgggtacaaaattttattgcctttaaaaatctttttcagtatcaagtttattatcaaaagcacaaataataaaatagaatttaaaatatttattttcagaataccactattttaataaatgatcttttgcctatgccagcgtctgctattaacatctagctaatatattttctgtgtctagtaaatatggtaatcagtttcaaagaaaactaggtaggttttgtgaggcaaagttgaaacaccttgaagaaatgg

SEQ ID NO: 155409 - DNA, 601 bp, Human
tagcactctaatctgtgttatataacacagccatgtctaggctgtctagctgagaagccaggaaactagaaagccatctctcccactcaccctttcccaggtcagcaatggaaaggaaatcattagttactcatctgtagtgtggtgaggcgcttccttctgttttctctggatatgtagtagaggatttcagggaacatatctctctcagcctttaactccagccattgaagagcttccttctcttatttcaccacgttttttctctcatttctaccattacaccactttctacaagcagtgaggttggagtgagtaatggcattaacgccaagagattaggaatgctttttgttccatcattcctatgtaaagaaaatttcaagattggtattaataactaaatatgttagcctgagttctctgagaagcaaacatcaataagactttggacactgaagagatttattgggaaaaatacctgtaagaaatgaggcgtctgggagagctgtcagaccctcatgcctctaactctgtgaagaagagagggaagaggatactgtacttgtaagagagctttgacaaagctaacagggagtcc

SEQ ID NO: 155410 - DNA, 601 bp, Human
aaatctcatgtcctcgcatttcaagacaatcattgccttccccacagtcgcctagaatcttaactcattacagcattaacccaaaagtccaagtccaaagtctcatctgagacaaggcaagttccttccgcctgtgagcctgtaaaatcaaaagcaagttagttacctcgtagatacagtggggatacaggcattgggtaaatacacccattccaaatgggagaaattggccaaaacaaaggggctgcaggccccatgcaaatccaaaatccagcagggcagtcaaattttaaaactccaraatgatcccctttgactccatgtctcacatccaggtcatgctgatacaagaggtgggttcccacagtcttgggcagctctgcccctgtgattttgcagggtacagccccattcccagcttccttcacaggctggcattgagtgtttgcggcttttccaggtgcacagtgcaagctgttggtggatctgggtgtttctggggtctggaggatgatggccgtcttattacagctccactagacagtgtcccagtggggactgtgtggaggctccaacccaacatttccctcccacacagttc

SEQ ID NO: 155411 - DNA, 601 bp, Human
caaaagcaagttagttacctcgtagatacagtggggatacaggcattgggtaaatacacccattccaaatgggagaaattggccaaaacaaaggggctgcaggccccatgcaaatccaaaatccagcagggcagtcaaattttaaaactccagaatgatcccctttgactccatgtctcacatccaggtcatgctgatacaagaggtgggttcccacagtcttgggcagctctgcccctgtgattttgcagggtacagccccattcccagcttccttcacaggctggcattgagtgtttgyggcttttccaggtgcacagtgcaagctgttggtggatctgggtgtttctggggtctggaggatgatggccgtcttattacagctccactagacagtgtcccagtggggactgtgtggaggctccaacccaacatttccctcccacacagttccacatggttggggaggcctcagaaaacttacaatcatggcgaagggggagtaaacacgtccttcttcacatgatggcaggaggaagtgccaagcaaaagggggaaaagccccttatgaaaccatcagatctcgttagaactcactatc

SEQ ID NO: 155412 - DNA, 601 bp, Human
aggggctgcaggccccatgcaaatccaaaatccagcagggcagtcaaattttaaaactccagaatgatcccctttgactccatgtctcacatccaggtcatgctgatacaagaggtgggttcccacagtcttgggcagctctgcccctgtgattttgcagggtacagccccattcccagcttccttcacaggctggcattgagtgtttgcggcttttccaggtgcacagtgcaagctgttggtggatctgggtgtttctggggtctggaggatgatggccgtcttattacagctccactaracagtgtcccagtggggactgtgtggaggctccaacccaacatttccctcccacacagttccacatggttggggaggcctcagaaaacttacaatcatggcgaagggggagtaaacacgtccttcttcacatgatggcaggaggaagtgccaagcaaaagggggaaaagccccttatgaaaccatcagatctcgttagaactcactatcaagagaacagcagcatagcgttaactgcccccatgattcagttacctcctaccagatccctccctcctgatttcaagcagttctcccacct

SEQ ID NO: 155413 - DNA, 601 bp, Human
tgatgatgaaacttattgcaagccatggatggctccataggttcaaggcataccatacttcttacactccagagtgagtggtagggcaagtgtgtatattttaagtactcaggcattagattttcactgttaacaaaatggctcaatataaggataagacatgaaaagaacataggtaggagaagatgagagtgccttattctaaagcaagcttgtctaacccacgacctgcgggctgcatgtggcccaggacagctttgaatgcagcccaacacaaatttgtaaactttcttaaaacatkatgaaatttgtttgacttttattttttaagctcatcagctatcattagtgttagtgtatgtgggcccaagacagttcttccagggaagccaaaagattggacaccccgttctaaagctttaaggatcaatctgtgaagagaagcttctgagcagattcccgggccccgtccctgcagattctaattcagttgatcatgggtagacttacaaatctttttcctctctttctccctccctcccttttaaatctgcttaggtggttttgagaaatagccaggtttagggaccactgatctaac

SEQ ID NO: 155414 - DNA, 601 bp, Human
gaaatagccaggtttagggaccactgatctaacgatctattcaacatgtgtttaaaattaccttcctaatttctgagtgatcgtcttttctgtgcttaaacatgtccagtgacaaatgaaatcactcccttcttaggtaacacattccatccttaaatactgtaattggaaagttttctttatactaggtttatatctgtagaattgctgcccattggtcctagttttagtcctttagatcataaatctctttcacatgattaacttttcagatatttagacagctgtcagccctcagtasccttctgacttttttttttctcctgctgattttcctctttgctttactctactgaagttatactggcctccttgacatttctttaatagtccaggcacttttcaactgtaggaattttgtactctatcctcattcacctgtaacagtctcttgcaggtattcttaaaactcactccctctcatcatttacatctcctcgcaaatgttaacttcacagtgaagtttttcttcaatagcctatttaaaattgcaccaagttccccaacctaactggatcttctatctccctctgtgatttgt

SEQ ID NO: 155415 - DNA, 601 bp, Human
tattttattttattttggtttttgtttaaatagtgacaggatctcactatgttgcctgtgctggtcttcatctggcctcaagcaattaattcttttttgcttcagcccccaaaaatgctgggattacaggcatgggctgccacacctggatactatttttaatttctaaagtctcttttttgttctcagaatatttccttttatggcaatcccattctcattttatagttttcacatcatttcttacctctagaatatagtatgtcctcacttaacattgtagataggttcttggaaactrtgactttaaaagaaatgacctacagcagccttcaaataacatcctttcctttgacatcatttcattttaacagtgagggggaaaaattagcttgcttatacatcatttgacttaaagtcacagtttccaagaacctatcaatgatgttaagtgaaggcttactgtattctttataatttgatgattgtgactgtgatagcattggcattttttctttttctttctgtatagcttattatttcttccagattttttatttctttttttaatgttttgtttgctatggtttcttataattta

SEQ ID NO: 155416 - DNA, 601 bp, Human
cagtcttaaactgccctatttgctgtttgtatcttttaatttagtgaataactaagagttatttatatattatggaaggattattacactttggtagatatgctgtgcatatattttctactttgccattacctgttgacttcattttataactacttgacaagtggaagttttgtatattttcttaccttgtttaggaaggctttctctatccccaagaatataaaaatacacacacgtaaatttgcatatttaatccatctggaatttttaacatggaatgtgaagtagaaatttaccrtctttagaatttgcaggcattcatcctcaagcttactgtctcacagtcaaaagatggcaggtactttttcaggcctcgtaactgcattcatacaagaaggaagaagcagcagcaaaaggctgaaatgagcatgccaggagagtctttaaaaaaaaaaaaagcttctttgaacacccacccaataacttttgcttcagtctcactagccaggaaccaccccgaccctcccactcactccatcattggaagatgactaaggatttctgaggtctttcattagctttattttgctgtagattg

SEQ ID NO: 155417 - DNA, 601 bp, Human
gtaactgcattcatacaagaaggaagaagcagcagcaaaaggctgaaatgagcatgccaggagagtctttaaaaaaaaaaaaagcttctttgaacacccacccaataacttttgcttcagtctcactagccaggaaccaccccgaccctcccactcactccatcattggaagatgactaaggatttctgaggtctttcattagctttattttgctgtagattgtctaggtaaaaatatttgcaaatagtgacaatttcgtcttttctttcaattatttttacagtttcttttggtgattgtttttctttacatactttattggcctaaggggctttagaatactgcccagaatagcagttgatacataagggaagactagactatattacatttaagtgtgctgtggccttctagtagatacgtgaaattaagttatggatatttctttctgtacctcttttgccaagttttgcttaattgtgaatttataaaactcttagcatctgttcatgtagtaagttttactgatagcttttctagggtgaaccaatgtttaatttcttttttttttttttttttttttgagacggagtctcacac

SEQ ID NO: 155418 - DNA, 601 bp, Human
ctctaatgactgaaaatgggagggaaagacaccttgctagagagcttttccgtatggatagttggtcttctgagcgtgaaagcgccttttcttgtgtctactataaattacttgggagcactgctctgattttcttgtctcggtatttattaatgactcctacgtcaaaacttttagagatctatcctcatgactttagcctaagggcaactattaggcaccttttatttacccgtttagcaatttgtgggccatgttgcctctgatactagaattggtatgagattcttctaagaatactcccttttttaaaggccctttttcattggattttaccatcaatctgagcctatttttaaataattcagaaattttttatagttctgatctgttagtgacaccctttctggctttttaatactgcagtagacttattttagagtgttgtcattttatttggatttggagagggaaaatcaagtaaaccatcttaatcagaaatctaaggtcatctttgacttctgtgaaccctacaaaggatgagttgccaaatactatgattctgcctctgttacagttcttctactggtctttacttcct

SEQ ID NO: 155419 - DNA, 601 bp, Human
taattagacattagctctaaagattgttccttggtataaaatgtaggattaaagcctacaaataatattggtatcattcaggaaattaaagtgtaaatcttttttgggaaaaattagtctttgtcttccaattaatgtttcttaaaaatctctgttggtcatagttcatacagttctcactatataagcttttatttggaaatagtattgcaagttgatacgagtctaataggacagactgatttggtcatgtaaagcctaaatgtctgacagactggtaacaattggttggcaaataagrtcagtaatggtttgacatgggaaagtcaattaactttatttttactcaacattcacaattcaattcaaacccaatctttcagttacagttgatcctgaattgagttgggcaagaacatatgcctagatccacacaaatttattctctagtggaatctgggaatgtctcctattcactcaacaaatgtttacgccatacctactgtatgtctactgtggtaggctcttgtgattcatcggttaaccaaagatcccatcctcttagaacttatattctaacaggtgagcaatagatacaata

SEQ ID NO: 155420 - DNA, 601 bp, Human
tgagtcaaaattcaaatacagatcttcttagctctgaactttcctactctccaggtcttgccacatgggtactcctgccattggagctgtctgtaactggctatttttatttgttgtaatttgtaggagttagtggtaatcaagaaatggtgttataatatgtacactttgtggcttttcagtgacatgtttctaattccagcctagtttatcatttctgctaaatgctttaaaactgtcttttcacatagtcccaaaatttgttatgtgccatgatacaagtattacttttagtattaayctaaagcaaacagtaaagactttaatttttaacctaaactatttgcaacaaggaaagcatgggggacgggggatatatatgtactactatatttgtataatacaaataaattgttgacagtaaatatgcctttaaacaaataagcagatcttattcttagatgttggaacattgacagttttcccccactttataagcgtttgtatcaccatctagtggaaaacaaaagaactgttaaaaatcctacacttaaataggagctaagttaaaatgtaaaatcatagatctaaaatgaatatc

SEQ ID NO: 155421 - DNA, 601 bp, Human
tataatacaaataaattgttgacagtaaatatgcctttaaacaaataagcagatcttattcttagatgttggaacattgacagttttcccccactttataagcgtttgtatcaccatctagtggaaaacaaaagaactgttaaaaatcctacacttaaataggagctaagttaaaatgtaaaatcatagatctaaaatgaatatccgttgaccttttagtttgctatcagacaggacatgaatcattaaagataatcactgcataatttacatcaggtttaaattcacaaataagaatatytagaaaacaattccatattaggaaagtcttttgtaaccaatataaatgcttctggtttatttcttctttgtatgtaactatttagaaatttaattcacttgctttaaccttgttctgatcattttttacttggaatctgaaatttggttttaagatgtacgataaccttgagccatacaaatgattttaaaataattttaaattattttaaatagcatgtaactatttagaaatttaattcacttgctttaaccttgttctgatcattttttacttggaatctgaaatttggttttaaga

SEQ ID NO: 155422 - DNA, 601 bp, Human
tggaggttgcagtgagctgagatcatgccactgcactccagcctgggcaacagagcaagactccatctcaaaaataataataataataataattttaaatgctttaatgactaattagtcctgttctctaacttcccttgcttgcttattttaaggtttataatgctttttaatattactctcaagttataaatagtaaaaccatttcactttaccttgtccttattttggttttctttgaactaaatctttaaatattggagtgatttctgataaagcatgcttcagagtttccttcccraaaatagaaactctaaaacaaagatcatggagataaatgatatagtatacattagattgattgatcatttgtttattgattgattatttgagatagggtctcactctgtcatccagggtggagtactgtggtgtgatctgtagcttactacagcctggaacttttaggctcaagagatcctcctgcctcagcctcccaaggtgctcagattacagtcatgagccactgtgcccagcccagtatacctttttaaattaacctgctgatttgtaacaaatataaaaagagaagtaacactaa

SEQ ID NO: 155423 - DNA, 601 bp, Human
atgatgtcctttaagccaagtggagagaggacgaagaggtgatcaactgtgtttaacaatgctaataagtcaagtaagatgaagacttcttagaattgaccatgagatttggttgcatgtagatcattgagtgttaaactagtaacatgataaaaattgttaaggtgtaatggtgaccatctgagatctgtctcatgttcaaaggaaactaaggacagagaaagtggaaagagcacacacaaacaagtactcccaagacattttgcagtaaagaggaggagagaacaggacagtggctaargaagaacatgggtcaagggaggattttttttcaagatggaatattatagcatgatcggcatttatttatgttgataggatgatcaagtaaataggagaaaattaataattctggagaaagagggaacaattgctacatccttaaaaaggtcagaggagatgagatccagagcccagttgggagggttggtcaaggttaatcacttattcattttataatagtgtaaaagttacatactgaaagctacaaatcattttatattaacatgtgtgtctgtttgtctgtccatgagtatgtgtg

SEQ ID NO: 155424 - DNA, 601 bp, Human
ctatcttccttatacagtatctgcagcttctctgctggcttattattaagtatatacacatatatgttatcttccatctttaaaaaataatcccccttttaataatctccacctttagctacagcttctcttcagaggtgaaaaagtattaatagtctatactcaatatctctactttactaattcccattcactccaactcactgtaatatggattctattccccaacccccacctgcaagagaggaggagagagcaagagagagggaagggggagggaaggaggaagggaggagagagmaaagtgctagaggagtggggtacaggggaaggtagggagggagacttacagggattgaagagaggagaatgcattcacaaaccctttcttactccttacactggaactgattctgactgtaaacgtcgtcagtgttgctcttctccaaaatatatggtactgtgcctgttctatttctgtctctctatttatttatttattttttgagacggggtctgtccctgtcacccaggctggagtgcagtggcacaaacacagctcactgcagcctcaacctcccaggctcaagtgatcctccca

SEQ ID NO: 155425 - DNA, 475 bp, Human
ctgaggcaggagaatggtgtgaacccgggaggtggagcttgcagtgagccgagatcgtgccactgcactgcactccagcctgggtgacagagcaagactccgtctcaaaaaaaaaaaagaaaaaaaaaattgtttgccttaagatatataggcatcttttcataattttgctatmttttattattattattattattatttgagacagggtcctactctgtcacccagactggagtgcagtggcatgatcacggctcacttgcagccttgacctcccaggctcaggtggatcctcccatctcagccccctggatagctgggactacaagcatgcaccaccacacccagctgatttttttattttttgaagtgactgggtttcgccttgttgcccaggttggtctcgaactactggactcaagccatctgcctgccttggcctcccaaagtgctgggattacaggtgtgaaccacc

SEQ ID NO: 155426 - DNA, 601 bp, Human
ggactacaagcatgcaccaccacacccagctgatttttttattttttgaagtgactgggtttcgccttgttgcccaggttggtctcgaactactggactcaagccatctgcctgccttggcctcccaaagtgctgggattacaggtgtgaaccacccacgcccagcctgctatctttaaaaaagtaattttttttttcagccaccaaacatttctgtagttcaagtgcagtattttttcttgtattcttcattggcaagttattcctttattctgggtttattttccctttttcctgaagyacagtcattagttgtttttccagtgagtgttttagtctctatatgaaaacatttttttcactatcattcatgattttttttgagctttttgtttttatttttttcatggttgctctagggattacagtatctacctacttagccttttacaatctacttggagttaatgtactatttcatgttctgtaactacactttatgtagttcctgtgtattttatctacatatattgaaaaccccatcaatgttatagtttttaattttaaaaaattttaattgaaatataaatcacataccata

SEQ ID NO: 155427 - DNA, 601 bp, Human
attttatttctttttattggataattttttattgcataagtataccatattttaggtatttattagctgacattcaagttgtcacttttttgctattatgaacaatgctgctatgaacatttgtatacaggtttttgtgtggatgtatgttttcatttttcttggattatacctaggagtggaattgttgggccatatgccaattctacattttaccttttgaaagactgcctgttttccaaagcagctacaccatttcacattcccaccagcagtatgtgagggtcccagtatctccacmtcctcactagcacttgttatagctttttgatttttgccatctcgtggttttggtttgcatttccttgactgctgatgatgttgagcatcctttcatgtttattggcaatttgtatatcttctttggagaactgtctatttagatcctttgcccatctttaattgggatatttgtctttttattatggagctgtgagagttctttatatatcttagatataagtcctttaccagacatatgatttgcaaaaattttctattctttaggtcccataatattttaaagtgatgagaatttttg

SEQ ID NO: 155428 - DNA, 601 bp, Human
gttgggccatatgccaattctacattttaccttttgaaagactgcctgttttccaaagcagctacaccatttcacattcccaccagcagtatgtgagggtcccagtatctccacatcctcactagcacttgttatagctttttgatttttgccatctcgtggttttggtttgcatttccttgactgctgatgatgttgagcatcctttcatgtttattggcaatttgtatatcttctttggagaactgtctatttagatcctttgcccatctttaattgggatatttgtctttttattatkgagctgtgagagttctttatatatcttagatataagtcctttaccagacatatgatttgcaaaaattttctattctttaggtcccataatattttaaagtgatgagaatttttgaaatcagttttttaattgcatgctctttccctttacctaagatgtatcctttgaaaatatccagtggagtatagatccgggagcagacctttctcagtataaaatggatgttactgtaatagatacaaaggtaagttaaaaagtaaaaccaaaactcatttgacttttattccaatgagttgttag

SEQ ID NO: 155429 - DNA, 601 bp, Human
tggaataggagacattagtgaggttatattaaaaaaaaaaaaaattaccccataaggtaaaacttttccagcacttagaattggtttaaaatgaaatataccaataaaaattccatattactgccagtatttcaattcagaaaattttcatgcacctactctgttagattttctaggtgctgtgacagaaagatcaacaaggatatactctctgtcttcaggtatttcgcaatcacaaatcaaacaaaaataaatcatcaatttaacattttgctttacaaacagcatacacagaatgttscgaggatgcctagcacaatgcctggtgcatagaagttgtattttatttacatatttgaccttcagcatgcagaataaatgtttaattatcaataaatatcaagcaaaaattttgtagtaggaagtattttaggaactagagataatgaataaacagaacaaaagtacttaccttatggaacgtacattctaatgagagaaataagcaattgtatatataatagatgatggtaagtccaggagaaaggtaaagcaaggtaagagtgagagagtgctgtgcgttgggagaggtggtacttat

SEQ ID NO: 155430 - DNA, 601 bp, Human
gaggtggaacttgcagtgagccaagatcacgccactgtgctccagcctgggcaacagcgcaagaccccgtctcaaaaaaaaaaaaaaaaaaaaaaaaaaactaaaaatggaactgtcatagatccagcagtcccactactgggtgtatatccaaaggaaaggaaatcagtatgttaaagaggtatctgcactcacgtttattgcagcactgttcagaatagccaagatacggaatcagcctaagtgtctacttacagataaagaaaatgatatatagctagataggtgtatatatatatayacacacacacacacatatacatagacacacaaaaatactatttaaccactaaaaagaacaaaattctgtcatttgtgcaaacatcgatgagcttggagaacatcatattaagtgaaataagccaggcacagaaagataaataccacatgttcttattcatatgtggaatctaaaaaagttgatctcatagaagtagagagtagaatagcagttactagaggtggggaaggctgggatagccaaaggtgggttaattggtataaaaatatagctagccaagcaaggtggcaggcacccata

SEQ ID NO: 155431 - DNA, 601 bp, Human
tgagaccctgtctccaaaaaaaaaaagaactgtcattttaaatgtttcatgttaaaggttcactagttttttagaaaatatgtatgagtagttttatttattctgaagcaattagatagctggagaacaagaggtgaatggaagtgtggggatggaggcatggagatgctagaattctcagagttacattgttgctttttccactgagaatactaagactgcaaacctgggaagatggattgtgtagtatcagggacaagaagcttgtttaagtgatgctttgaggtctactacagatgcygttctgctaggagattccctacgtcacgataagacactatagaagtggagtagttaatattcagaagaaaggatatggccaaaatgtgatctgcataatcttaggagtccataaactctttgaaagaaaatatagttgtggcaatattttttgtgtgtacttttctggtttcccttttctaattcacagatcacaccagagctgagggttcttgagttgaaacaaaaaaggacttatacttagagtgactaaaacttttctttttgagggaaagtgcttgccaactagaggggcatgtat

SEQ ID NO: 155432 - DNA, 601 bp, Human
aattaggccagttaagaaccctgcaatggaagcaggcatggtggctcatgcctgtaattccagaactttgggaggctgtgatgagcaaatcgagaccagcctgggcaacatggaagaactccatctctacaaaaaatacaaaaaaaattagctgagcgtggtggcacacgcctgtagttccaactgttatactgcgggaggctgaggtgggaggattgcttgagcccaggaggtcgagactagtgagctgtgatcgcgccactgcactccagcctgggagacaaagtgagatgctgtctcmaaaaaaaaaaaaaaaaaaaaaaaaaaccaactatgatgccctttaagtatacaagtgaaaggaagagttgcacatctcttacttttaaatcaaatgctagaaatgattaagcttaatgaggaagatatttcaaaagccaagatgggtaaaaagctaggccttttacaccagtcagccaagttgcaaatgcaaaggaaagttcttgaagaaaatcacaagtgctactccagtgaacacatcaatggtaagaaagtgaaacagactcactgctgacatggaggaaatttcagtggtctagat

SEQ ID NO: 155433 - DNA, 601 bp, Human
ttatgctcaatctgctgtgcctgtgctttagaaatagaacaacaaagcctggatgacagcacatctgtttatggcatggtttactaaatattttaagcctattgatcagaaaaaaaaaaaagatatcctttcaaaatattgtaatcatccaacagttgttttttctttttttcccaccatacaaatagagctgattcactgagacagtgatattatagtagagaaagagtgtaataattgcagagttagtcaagtgggaggactggagttattatttaaatcaccttcccctaaaatgtgraagctatggttttttaaggatagtttggcagagagggagctgggaacggggaatggagattggttgggttggggatgaaattataggggtcaaaggtgtctttttgcagagtcggtttttgggtgggatcacaagatcaattgaaccagttttttggtatgagttaccagcgcaggtgagcccacctggtccgtcagaatgtagggtctgaaaaatacctcacaccccaaggttttataatagtaatatcatttgtatgtaggagcaattgaggttagaaatcccatgacctctgtctgc

SEQ ID NO: 155434 - DNA, 601 bp, Human
ccagaatccttcattgtcttcccatcccactaagaaaaagaatctaaagtccttatcaaggacaacaaactctggctctgcacttcctctctgatttctgttcaaccactcacccatttgcttgctgtgttacaactgcactcaccgactactgtttctcaaatatgttttaattcagtggcagtgttttttccaataagccctgattctctaaggtcatctcatctcatcccaaagcccagactaaggtaacaaaggcttatacttagggcagtgagaatgatgaaaaagatacctgaatgaagttgtttcacagcttctttaaagcctttaatctgtgtaaaatagaaatgtattaaaagcttttacttcaaacttaaattctagttttaagtctgtcactttcaataggtgatatctttggcaaattaccactttcattttcagtttctcaagtgtaaagtgaaggaatcggctggattaaatatgtgattctgggtggctcacacctgtaatcccagcactttgggagtctgagacaggtggatcacttgaggtcaggaattcgagaccagcctggccaacatatagtaaaaccccg

SEQ ID NO: 155435 - DNA, 601 bp, Human
tctttagtgaaaaaacttaccagtttttattattagtattatgcagatatgccagcagaagaaagagaaaagaaattggcttcctgctcaagacaccgattccgctacattccacccaacacaccagagaatttttgggaagttggttttccttccactcagacttgtatggaaagaggtgagagtatagattgtaacattttataattattttttttaaatacttggccgggcacagtggctcacgcctataatcccaacactttgagaggccaaggtgggtggatcacctgaggtcagsagttcaagaccagcctggccaacatggtgaagccccatctctactaaaaatacaaaaaattagccaggcgtggtggcacatgcctgtagtcccagctactcaggaggctgaggcaagtgaatcacttgaacccaagagacagaggttgcagtgagccaagattgtgccattgcactccagcctgggcgacagaacaagactctgtctcaaaaataaaataaaataaaataaaataaaataaaataaaataaaataaaataaaataaaataaaataaaataaaataaaataaaataaaaaa

SEQ ID NO: 155436 - DNA, 601 bp, Human
aatacttggccgggcacagtggctcacgcctataatcccaacactttgagaggccaaggtgggtggatcacctgaggtcaggagttcaagaccagcctggccaacatggtgaagccccatctctactaaaaatacaaaaaattagccaggcgtggtggcacatgcctgtagtcccagctactcaggaggctgaggcaagtgaatcacttgaacccaagagacagaggttgcagtgagccaagattgtgccattgcactccagcctgggcgacagaacaagactctgtctcaaaaataaaaaaaaataaaataaaataaaataaaataaaataaaataaaataaaataaaataaaataaaataaaataaaataaaataaaaaaataaaataaaataaataactgtatatgcccaaatgtgaacatgcacctttttttctgtgattctctttaccttttgctgcaggttgggtgctagttttgtgacataaaaacattcctaaagataaaaggactcttcagtaatttatttggaattagagattggtaatatcactttaatgtgattgtgcttatattattctggtttaccaaatttcaaaa

SEQ ID NO: 155437 - DNA, 601 bp, Human
cacagtggctcacgcctataatcccaacactttgagaggccaaggtgggtggatcacctgaggtcaggagttcaagaccagcctggccaacatggtgaagccccatctctactaaaaatacaaaaaattagccaggcgtggtggcacatgcctgtagtcccagctactcaggaggctgaggcaagtgaatcacttgaacccaagagacagaggttgcagtgagccaagattgtgccattgcactccagcctgggcgacagaacaagactctgtctcaaaaataaaataaaataaaataaaataaaataaaataaaataaaataaaataaaataaaataaaataaaataaaataaaataaaataaaaaaataaaataaaataaataactgtatatgcccaaatgtgaacatgcacctttttttctgtgattctctttaccttttgctgcaggttgggtgctagttttgtgacataaaaacattcctaaagataaaaggactcttcagtaatttatttggaattagagattggtaatatcactttaatgtgattgtgcttatattattctggtttaccaaatttcaaaaagcaatttctcttt

SEQ ID NO: 155438 - DNA, 601 bp, Human
tcacgcctataatcccaacactttgagaggccaaggtgggtggatcacctgaggtcaggagttcaagaccagcctggccaacatggtgaagccccatctctactaaaaatacaaaaaattagccaggcgtggtggcacatgcctgtagtcccagctactcaggaggctgaggcaagtgaatcacttgaacccaagagacagaggttgcagtgagccaagattgtgccattgcactccagcctgggcgacagaacaagactctgtctcaaaaataaaataaaataaaataaaataaaataaaataaaataaaataaaataaaataaaataaaataaaataaaataaaataaaataaaaaaataaaataaaataaataactgtatatgcccaaatgtgaacatgcacctttttttctgtgattctctttaccttttgctgcaggttgggtgctagttttgtgacataaaaacattcctaaagataaaaggactcttcagtaatttatttggaattagagattggtaatatcactttaatgtgattgtgcttatattattctggtttaccaaatttcaaaaagcaatttctcttttattctatc

SEQ ID NO: 155439 - DNA, 601 bp, Human
ggccaaggtgggtggatcacctgaggtcaggagttcaagaccagcctggccaacatggtgaagccccatctctactaaaaatacaaaaaattagccaggcgtggtggcacatgcctgtagtcccagctactcaggaggctgaggcaagtgaatcacttgaacccaagagacagaggttgcagtgagccaagattgtgccattgcactccagcctgggcgacagaacaagactctgtctcaaaaataaaataaaataaaataaaataaaataaaataaaataaaataaaataaaataaaataaaataaaataaaataaaataaaataaaaaaataaaataaaataaataactgtatatgcccaaatgtgaacatgcacctttttttctgtgattctctttaccttttgctgcaggttgggtgctagttttgtgacataaaaacattcctaaagataaaaggactcttcagtaatttatttggaattagagattggtaatatcactttaatgtgattgtgcttatattattctggtttaccaaatttcaaaaagcaatttctcttttattctatcatcaaaatgattttttttttttataggg

SEQ ID NO: 155440 - DNA, 601 bp, Human
gccaaggtgggtggatcacctgaggtcaggagttcaagaccagcctggccaacatggtgaagccccatctctactaaaaatacaaaaaattagccaggcgtggtggcacatgcctgtagtcccagctactcaggaggctgaggcaagtgaatcacttgaacccaagagacagaggttgcagtgagccaagattgtgccattgcactccagcctgggcgacagaacaagactctgtctcaaaaataaaataaaataaaataaaataaaataaaataaaataaaataaaataaaataaaatataataaaataaaataaaataaaataaaaaaataaaataaaataaataactgtatatgcccaaatgtgaacatgcacctttttttctgtgattctctttaccttttgctgcaggttgggtgctagttttgtgacataaaaacattcctaaagataaaaggactcttcagtaatttatttggaattagagattggtaatatcactttaatgtgattgtgcttatattattctggtttaccaaatttcaaaaagcaatttctcttttattctatcatcaaaatgattttttttttttatagggc

SEQ ID NO: 155441 - DNA, 601 bp, Human
ggtggatcacctgaggtcaggagttcaagaccagcctggccaacatggtgaagccccatctctactaaaaatacaaaaaattagccaggcgtggtggcacatgcctgtagtcccagctactcaggaggctgaggcaagtgaatcacttgaacccaagagacagaggttgcagtgagccaagattgtgccattgcactccagcctgggcgacagaacaagactctgtctcaaaaataaaataaaataaaataaaataaaataaaataaaataaaataaaataaaataaaataaaataaaataaaataaaataaaataaaaaaataaaataaaataaataactgtatatgcccaaatgtgaacatgcacctttttttctgtgattctctttaccttttgctgcaggttgggtgctagttttgtgacataaaaacattcctaaagataaaaggactcttcagtaatttatttggaattagagattggtaatatcactttaatgtgattgtgcttatattattctggtttaccaaatttcaaaaagcaatttctcttttattctatcatcaaaatgattttttttttttatagggcttcactctg

SEQ ID NO: 155442 - DNA, 601 bp, Human
gtcaggagttcaagaccagcctggccaacatggtgaagccccatctctactaaaaatacaaaaaattagccaggcgtggtggcacatgcctgtagtcccagctactcaggaggctgaggcaagtgaatcacttgaacccaagagacagaggttgcagtgagccaagattgtgccattgcactccagcctgggcgacagaacaagactctgtctcaaaaataaaataaaataaaataaaataaaataaaataaaataaaataaaataaaataaaataaaataaaataaaataaaataaaataaaaaaataaaataaaataaataactgtatatgcccaaatgtgaacatgcacctttttttctgtgattctctttaccttttgctgcaggttgggtgctagttttgtgacataaaaacattcctaaagataaaaggactcttcagtaatttatttggaattagagattggtaatatcactttaatgtgattgtgcttatattattctggtttaccaaatttcaaaaagcaatttctcttttattctatcatcaaaatgattttttttttttatagggcttcactctgtcacccaggctggag

SEQ ID NO: 155443 - DNA, 601 bp, Human
tcaggagttcaagaccagcctggccaacatggtgaagccccatctctactaaaaatacaaaaaattagccaggcgtggtggcacatgcctgtagtcccagctactcaggaggctgaggcaagtgaatcacttgaacccaagagacagaggttgcagtgagccaagattgtgccattgcactccagcctgggcgacagaacaagactctgtctcaaaaataaaataaaataaaataaaataaaataaaataaaataaaataaaataaaataaaataaaataaaataaaataaaataaaatataaaaataaaataaaataaataactgtatatgcccaaatgtgaacatgcacctttttttctgtgattctctttaccttttgctgcaggttgggtgctagttttgtgacataaaaacattcctaaagataaaaggactcttcagtaatttatttggaattagagattggtaatatcactttaatgtgattgtgcttatattattctggtttaccaaatttcaaaaagcaatttctcttttattctatcatcaaaatgattttttttttttatagggcttcactctgtcacccaggctggagt

SEQ ID NO: 155444 - DNA, 601 bp, Human
gagttcaagaccagcctggccaacatggtgaagccccatctctactaaaaatacaaaaaattagccaggcgtggtggcacatgcctgtagtcccagctactcaggaggctgaggcaagtgaatcacttgaacccaagagacagaggttgcagtgagccaagattgtgccattgcactccagcctgggcgacagaacaagactctgtctcaaaaataaaataaaataaaataaaataaaataaaataaaataaaataaaataaaataaaataaaataaaataaaataaaataaaataaaaawataaaataaaataaataactgtatatgcccaaatgtgaacatgcacctttttttctgtgattctctttaccttttgctgcaggttgggtgctagttttgtgacataaaaacattcctaaagataaaaggactcttcagtaatttatttggaattagagattggtaatatcactttaatgtgattgtgcttatattattctggtttaccaaatttcaaaaagcaatttctcttttattctatcatcaaaatgattttttttttttatagggcttcactctgtcacccaggctggagtgtag

SEQ ID NO: 155445 - DNA, 601 bp, Human
agttcaagaccagcctggccaacatggtgaagccccatctctactaaaaatacaaaaaattagccaggcgtggtggcacatgcctgtagtcccagctactcaggaggctgaggcaagtgaatcacttgaacccaagagacagaggttgcagtgagccaagattgtgccattgcactccagcctgggcgacagaacaagactctgtctcaaaaataaaataaaataaaataaaataaaataaaataaaataaaataaaataaaataaaataaaataaaataaaataaaataaaataaaaaaataaaataaaataaataactgtatatgcccaaatgtgaacatgcacctttttttctgtgattctctttaccttttgctgcaggttgggtgctagttttgtgacataaaaacattcctaaagataaaaggactcttcagtaatttatttggaattagagattggtaatatcactttaatgtgattgtgcttatattattctggtttaccaaatttcaaaaagcaatttctcttttattctatcatcaaaatgattttttttttttatagggcttcactctgtcacccaggctggagtgtagt

SEQ ID NO: 155446 - DNA, 601 bp, Human
ataaaataaaataaaataaaataaaataaaataaaataaaataaaaaaataaaataaaataaataactgtatatgcccaaatgtgaacatgcacctttttttctgtgattctctttaccttttgctgcaggttgggtgctagttttgtgacataaaaacattcctaaagataaaaggactcttcagtaatttatttggaattagagattggtaatatcactttaatgtgattgtgcttatattattctggtttaccaaatttcaaaaagcaatttctcttttattctatcatcaaaatgattttttttttttatagggcttcactctgtcacccaggctggagtgtagtggcatgcataatcatggctcactgatgcctccgacttatgggctcaaactctacctcagccttccaagtagctaggactacagccttgtgccgccatacccagcacttttttttttttccccctagagacagggtctcactatgttgctcaggctggtcgtgaactcctggcctcaagtggtcctcctgccttgacctcccaaaacactgggattacagccatgagccactgcacccagccaaaatgacttt

SEQ ID NO: 155447 - DNA, 601 bp, Human
tccacccgcctcggcctcccacactgctgggattacaggcgtgagccaccatgcccaacgtctttctttttttttttttctttttcttttttttttttgagacggagtctcgctttgttgcccaggctgtagtgcagtggcgcgatctcggctcactgcaagctccgcctcctgggttcaagcgattctcctgcctcagcctcccgagtagtgggaccacaggtgcccaccaccacacccggctaattttttgtatttttagtagaggcggggtttcaccgtgttagccaagatggtctcratctcctgacctcgtgatccgcccaccttggcctctttcttttttaattgagacagggtctcactctgtcacccaggctggagtgcagtggcatgatcacatctcacactgtgccttgaccttgcaggctcccacctcggcctcctgattagctggactacaggccagtgccaccacacctagctaatttttgggttttttttgagacggagcctcgctctgtcaccaggctggagagcagtggcatgatctcagctcactgcaacctccgcctcctgggttcaagcaattcttcttcct

SEQ ID NO: 155448 - DNA, 601 bp, Human
cactgctgggattacaggcgtgagccaccatgcccaacgtctttctttttttttttttctttttcttttttttttttgagacggagtctcgctttgttgcccaggctgtagtgcagtggcgcgatctcggctcactgcaagctccgcctcctgggttcaagcgattctcctgcctcagcctcccgagtagtgggaccacaggtgcccaccaccacacccggctaattttttgtatttttagtagaggcggggtttcaccgtgttagccaagatggtctcgatctcctgacctcgtgatccrcccaccttggcctctttcttttttaattgagacagggtctcactctgtcacccaggctggagtgcagtggcatgatcacatctcacactgtgccttgaccttgcaggctcccacctcggcctcctgattagctggactacaggccagtgccaccacacctagctaatttttgggttttttttgagacggagcctcgctctgtcaccaggctggagagcagtggcatgatctcagctcactgcaacctccgcctcctgggttcaagcaattcttcttcctcagcctcccaagtagctggga

SEQ ID NO: 155449 - DNA, 601 bp, Human
tcagcctcccgagtagtgggaccacaggtgcccaccaccacacccggctaattttttgtatttttagtagaggcggggtttcaccgtgttagccaagatggtctcgatctcctgacctcgtgatccgcccaccttggcctctttcttttttaattgagacagggtctcactctgtcacccaggctggagtgcagtggcatgatcacatctcacactgtgccttgaccttgcaggctcccacctcggcctcctgattagctggactacaggccagtgccaccacacctagctaatttttggrttttttttgagacggagcctcgctctgtcaccaggctggagagcagtggcatgatctcagctcactgcaacctccgcctcctgggttcaagcaattcttcttcctcagcctcccaagtagctgggactacaggtgcatgccaccatgcccagctaatttttatatttttagtagagatggggtttcaccatgttggccaggatggtctcgatctcttgacattgtgatcctcccaccttggcctcccaaagtgctgggattacaggtgtgagccaccgcgcccagccaatttttgtattt

SEQ ID NO: 155450 - DNA, 601 bp, Human
gccaagatggtctcgatctcctgacctcgtgatccgcccaccttggcctctttcttttttaattgagacagggtctcactctgtcacccaggctggagtgcagtggcatgatcacatctcacactgtgccttgaccttgcaggctcccacctcggcctcctgattagctggactacaggccagtgccaccacacctagctaatttttgggttttttttgagacggagcctcgctctgtcaccaggctggagagcagtggcatgatctcagctcactgcaacctccgcctcctgggttcaarcaattcttcttcctcagcctcccaagtagctgggactacaggtgcatgccaccatgcccagctaatttttatatttttagtagagatggggtttcaccatgttggccaggatggtctcgatctcttgacattgtgatcctcccaccttggcctcccaaagtgctgggattacaggtgtgagccaccgcgcccagccaatttttgtatttttgtgtagagatcggatttcaccatgttgcctaggctggtcttgaactcctgggctcaagcagtaccccacccccttccgccctggcctct

SEQ ID NO: 155451 - DNA, 601 bp, Human
ttgtgacaaacgtataatactaatgcaaggtattaataggataaactaccgagtgtagtatttgggaactgtactgtcttggcagtttttttctagttttttaaaagtaagactattctaaaaccaaaaaaattttaaaaaatggattagtgttgttatgtagtcccagattatttttttcagagccacttgtcttgagttgaaaaattacttacttaaatattctgcttagattatgtcttctagctgtatggttagaaaggggaccttcctgtaggttatgtttctcttgactcgcttycagtagaggactgaatttttgttgctgtgtgcctctttcatgtttgctggttttcttttttttttttggagacagagtctcactctatcgcccaggctggagtgcagtggtgcaatcttggctcactgcaacctccacccctgggctcaagcaattcttgtgcttcagtctccagagtggctgagactacaagtgtgcatcaccacgcctggctagttgttttttttttttttgtattttagtggaaatggggtttcactgtgttgcccaggctggtgtcgaactcctgagctcaagcaa

SEQ ID NO: 155452 - DNA, 601 bp, Human
tgtgcagccaggcaggtgggggagaatgcggtagtagtgaagaaccccaaggaacagagttcagtggtggcagttttgcaaaggagaggaaaacagggtgggtcttagggttatttagcaacaggaaagaaagaaccaggaggctggttaaaagcttgatggatgtcctttgaagtagaatcgctgactggaaaggattgtatggggtgtcccatcagattgtgacactatagggagtttgtgttgatgaatggaatagtaggaaatgactttggatagctaggacagagcaagattatgragggcgtttcccccatcttgttagattttttacaaaaagcggtttactgaagagtcacagatgacagaggattcccttatatacaacctatggtacctgttcataggaggagcctgcagtaaattttctgagcacttgggatagcaaaccactgtgcctatagggaaaacgcagcgggtcttcccccgaccccagaagctgtccgtctcacagcctggaaaaagtgtatggagggcttttaattgttggcttgaagagtttgggtttgatttcaaagtatgggagtggcagcctttctga

SEQ ID NO: 155453 - DNA, 601 bp, Human
ttaggatgctctgaaagtaacccagcgaatgggataccttggagtagaattatggaagagggatggaaagagttgggcaagttcaggagatgcttaggcatcttactaaatagtaaaggtcttaatcaataggctataaaatataatcatttgctgctgctaagtaaagcatcttgctccctcagaaattatgaatttgaaataaacctacagtttgatttcaagaaggctgaggcaggagtatgtcactgaggaaggtcaactgggtctgacagaatattactgtgtgtattggtattgktttaagagcctgtttctcagcttctaaagttcagaaataaaattggggctgcttgggtacacctgaatccagcactttgggagctgaggggtcagatcacctgaggttaggagttcgagaccagcctagacaacttggcaaaaccctatctctactaaaaatacaaaaattagctgggcatggtggcttatgcctataatcccagctactcagaaggctgaggcaggagaatcgcttgaacccggggaggtggagattgcagtgagccgagtatcgcgccactgtactccagcctgggtg

SEQ ID NO: 155454 - DNA, 601 bp, Human
tgtgtattggtattgttttaagagcctgtttctcagcttctaaagttcagaaataaaattggggctgcttgggtacacctgaatccagcactttgggagctgaggggtcagatcacctgaggttaggagttcgagaccagcctagacaacttggcaaaaccctatctctactaaaaatacaaaaattagctgggcatggtggcttatgcctataatcccagctactcagaaggctgaggcaggagaatcgcttgaacccggggaggtggagattgcagtgagccgagtatcgcgccactgyactccagcctgggtgacagaggaaactgtctccaaaaaaaaaaaaagaaataaaatttaaaaaaaaatgtgttgtttgttcttgctatttttttttttttttttttggcagggggtctcattctgtcacccaggctggagtgcagtggcgcgatctcgactcactgcaaccctaacctcccaggttcaagcgattctcctgcctcagcctcctgagtagctgggactacaggcatgcaccaccacagcccgctaattgtttgtatttctggtagagatggggtttcaccatgttggccag

SEQ ID NO: 155455 - DNA, 601 bp, Human
cagaatagaggtataggaagactaatcttttcaatgaactcttttagttttatatttttctttgaatctcatttggtaatttactcttagattcaaatgtcttttcagacaacgttgaatgcagcaatgtagtctttgctatttttatatacctggcttatttcaattgcctttagcaaaaccggttcccactcctaaaaagggctttattggaaaaggaaaagatatcaccaccaaacatgatgaagtagtatgtgggagaaagaacacagcaagaatggaaaatgtaagttacagaaartatctatctctgaatttagagttttgtttgaatacctttcaaaaacaggattctaaatataataccttagatttctaaaaatgtctttctttctaaagatgtttttagataacaatatggcaatatcatggaaactgagacattaatgaaaatataaagtacctcagaataaaattccataacagtgttgaaaaactattttgactcacattgattctaaaattaataaatagttattatgaaattaacatttattcttcatcatatctctataaaatagcatccctacccaaaaaacag

SEQ ID NO: 155456 - DNA, 601 bp, Human
ctccccggtagcggggattacaggtacacactaccatgcccggctaatttttgtatttttagtagagacggggtttcaccattttggccaggctggtctcaaattcctgaccttgtgatccaactgcctcagcctcccaaagtgctgggattacaggcgtgggccactgtgcctgggtcaaagctctggtttctgtcactctcaggttggtcaggcaatcaacaattattcaaacagtaatttgtgctagattactcagggaataaaatataagacatattttttactctcaaagagcttragctttagctaaaaggagaacattacagtaagaaccattatggtcaatgaaagataattacataatagagtacccagttatgcaaacgagaccttatatgggataggaatagcgaatagaacaagatcattgccaggcacattcagggaagatatcataatgaagttggatctcaatctggattttaaaaataggttaaaaaaagaaatccgttggaggaccgatgggggcggatcacgaggtcaggagatcgagacgatcctggttaacacggtgaaactccgtctctactaaaaaata

SEQ ID NO: 155457 - DNA, 601 bp, Human
agcctggggaagggtagggtgaggactcagcatgagttttgttttgggcatattaaatttgagatgcctgttagacttctaagtgatgtcatgtagttgttggataaatgggcctgaagttctagggaaagtcaggactgggatagaaatgtgggagttatcggccaggcgcggtggctcacgcctgtaatcccagcacttttggaggccaagatgggtggatcacctgaggtcaggagttcgagaccagcctggccaacatggtgaaaccccgtctctactaaaaatacaaaaattagcygggcgtggtggcatgcacgtgtaatcccagctactcaagaggctgaggcaggagaatagcttgaacccgggaggtggaggttgcagtgagccaggattgcaccactgtactccagcctgggtgacaaagtgagactctgtctcaaaaaaaaaaagaaatgtgggagttgtctatatagagatgatatttagagccatggggctaagtgaaattgcccaggaagagaaggaaggtttcttagaaccaggtgaaggactttaaccttttgagactaaatggaagaggagtcagctgggagaa

SEQ ID NO: 155458 - DNA, 601 bp, Human
gagttatcggccaggcgcggtggctcacgcctgtaatcccagcacttttggaggccaagatgggtggatcacctgaggtcaggagttcgagaccagcctggccaacatggtgaaaccccgtctctactaaaaatacaaaaattagccgggcgtggtggcatgcacgtgtaatcccagctactcaagaggctgaggcaggagaatagcttgaacccgggaggtggaggttgcagtgagccaggattgcaccactgtactccagcctgggtgacaaagtgagactctgtctcaaaaaaaaaaagaaatgtgggagttgtctatatagagatgatatttagagccatggggctaagtgaaattgcccaggaagagaaggaaggtttcttagaaccaggtgaaggactttaaccttttgagactaaatggaagaggagtcagctgggagaatatggtacagaaggaggtttgattcagattctgtcctttggaaatatagttcctttctttcccagattaacatcctatcagatatttaaaggtaaatattaatattgtttctcattccatccactttttcattcccactgccaccatcatgact

SEQ ID NO: 155459 - DNA, 601 bp, Human
tttttgcattaggataaaaaaatccatgctttcttttacattcatttatagaaataatgaaaggccaggtgtataacctcgattcatacttttaggatgaaaaagccattttcttttttctttcctcaatgaagcttgagggaaatctgggcattttctgccttagacactttatcatatatctaaatgccatttttaaattgcttttatcacgaagtaaaacttccagcatccaattaggcttagcataaaaaaatggtttcttttttgtttcagaaaatgtttgttgcatttaatttgktaattttgtgggagtaagttcttaccaatcaaattacattttgttttaatttttatacttgtatctgaattttctaagcaatttattttctatcaaagaatttgttttgtcaaccaagaaattcagtaataatccttctcattaaaaacctttctattatcttaatttattaaaagcttaattttagtttgttattttctaaagatatttgctttcaaaagtaattattcatatatatcagttacaaaattcttctactgagagttccccaccaaaataagccaggcatggtgtgcacgt

SEQ ID NO: 155460 - DNA, 601 bp, Human
ctcactatgttgcccaggctggtctcgaactcctgggctcaagtgatcctcttgcctcagcatcccaaagtgctgggattactggtgtgagccaccacacccagccattgaatgttacagctttaacagtgaaggaaaggaagcaggtctggtctcatcataagagagtgatgatgaaaattgaaaacagtagggagtgcaggtgttaagttggaaggcatgttgggaatctcaaggaaactacatgctttgaaatagcaactgaattcaatctgagggccttccaggttgagacaatgcwcctaatactgccattatccctctgtgttttaattgaacactggagaaacttaatgtgctactttatgcaatctccacatgaagctgtcatgtaatgcagccattgatctagatatggaaattttaatccaaattaatttttaaagatatagctagaaaggtgatccacctttctctgcctccaaaggtaaacattgaaaggaaaatcaagtatgtttttctggcctctttgggaggtggggtggctggggaagagattaaatagtgatgaaacttttctatttaattctattaaggctgg

SEQ ID NO: 155461 - DNA, 601 bp, Human
tgatcgatgtcagtcagtcagtagaacctacccaccctcacggcctggagttcttgttccgggactgcaggaatgtctcgcaggtagacgtgtaaaccaatatgcctttttttgttggatgtaacagctgcaggtatttttctcactcctaagataagtaagaggaccatattcttagaaattgaaggaagggatacgggctgctttcaggacaaggatataaagatcaatttgtcatatttcattttgcaagaatttgattccatgtcttacagttgggtaaaatgttcaaggggtgccrggtatggtggctcacgcctgtaatcccagcactttgggagggtgaggtgggtggatcatttgatgtcagaggttcaagaccagcctggccaacatggtgaaaccccatctctactaaaaatgcaaaattagccgggcatggtggcaggcgcctgtaatcccagctacttgggaggctgaggcaggagactcacttgaacctgggaggcagaggctgcagtgagccaagaacgtgctactgcactccacccagcctgggcaacagagtgaggctccgtctcaaaaaaaaaaaaaaaaaaat

SEQ ID NO: 155462 - DNA, 601 bp, Human
ctagcctaaggctagagagaaataacagaaagatggtaaattcattcttccagcacaatacagttgctcagtaagtaagtgatactgttgtttgatgaatggtagagttttctttttcctgtttctggaatgttttatagaatacatttcaaaacatagatgattccaattgctagctggataaagatagtaaatattgacccttgcaatcaagttaaaaaaaatacatgtatgtatgactatttgtgtatacttggatgcacgcacacacacacacacacacacacacacacacacacayagtaatttcaactcaaaggcagaatcattaggaataacctagtttttaagcgagtaaaaattactggctcagccaggcatggcagctcactcctgttatatctgttatcccaacactttgggaggccaaggagggaggatctcttgagcccaggagtttgagaccagcctgagcaacataaactccattaaaaaataaaaaataaaaaaactggctggacacggtggctcacgcctgtaatcctagcactctgagaggccaaggcgggtggaacacctgaggtcaggagttcgagaccag

SEQ ID NO: 155463 - DNA, 601 bp, Human; identical to SEQ ID NO: 36976

SEQ ID NO: 155464 - DNA, 601 bp, Human; identical to SEQ ID NO: 36977

SEQ ID NO: 155465 - DNA, 601 bp, Human; identical to SEQ ID NO: 36978

SEQ ID NO: 155466 - DNA, 601 bp, Human; identical to SEQ ID NO: 36979

SEQ ID NO: 155467 - DNA, 601 bp, Human; identical to SEQ ID NO: 36980

SEQ ID NO: 155468 - DNA, 601 bp, Human; identical to SEQ ID NO: 36981

SEQ ID NO: 155469 - DNA, 601 bp, Human; identical to SEQ ID NO: 36982

SEQ ID NO: 155470 - DNA, 601 bp, Human; identical to SEQ ID NO: 36983

SEQ ID NO: 155471 - DNA, 601 bp, Human; identical to SEQ ID NO: 36984

SEQ ID NO: 155472 - DNA, 601 bp, Human; identical to SEQ ID NO: 36985

SEQ ID NO: 155473 - DNA, 601 bp, Human; identical to SEQ ID NO: 36986

SEQ ID NO: 155474 - DNA, 601 bp, Human; identical to SEQ ID NO: 36987

SEQ ID NO: 155475 - DNA, 601 bp, Human; identical to SEQ ID NO: 36988

SEQ ID NO: 155476 - DNA, 601 bp, Human; identical to SEQ ID NO: 36989

SEQ ID NO: 155477 - DNA, 601 bp, Human; identical to SEQ ID NO: 36990

SEQ ID NO: 155478 - DNA, 601 bp, Human; identical to SEQ ID NO: 36991

SEQ ID NO: 155479 - DNA, 601 bp, Human; identical to SEQ ID NO: 36992

SEQ ID NO: 155480 - DNA, 601 bp, Human; identical to SEQ ID NO: 36993

SEQ ID NO: 155481 - DNA, 601 bp, Human; identical to SEQ ID NO: 36994

SEQ ID NO: 155482 - DNA, 601 bp, Human
ttggggtctgcaggagggaggagacctgcagcagtgtgacagtgacaatgcccggacttgctatcctcatagagacagaagtgggcagaggagaggcctgagccaggcagcgcttacctcggggctggagaagtgggggggcttgctgccctcactctcgctggagctgctctcggtctccgagtcagatccggagctgctctctgagtcgctggaggagctgctgctgccgctgctgctgctgctgctgctgcccttgctggaaggcaccgaggttctgcagttgggctgctggaccacrgcgctgccagcccgcgaggcccccgggaagcagagggaaggaaagccaagtgagcaaacaggaaaacaccaccaagctgtcatgcaccctaaagagggaggaggcacgcagcctacacatctgtcaaccatgacctggaactcaaagagcaggcatcgaggtcaaagtcatcctaaaggttaaagcaactcatatacagaaataaaattgggggtgaagttggtgccccttggtagtcgggcactggttattcgtgtggccattttggaagggaaggtggtataacatccaaatggctgt

SEQ ID NO: 155483 - DNA, 601 bp, Human
cagctctctgtaaggtgacctgggccagctccgccagaccaggcagcacagctgtggaggacacacagggtgatgttacttcctgcctttgccatttgcagtctgcaaactcattttctttctaaagggtgtgtgtgtctgtattatccttaggaaaagtgttaaaagaactttacttttattccaacaaatacatttctttcctgcagaaagaacgaacgtgcagcgtggctaacacatcacctgctgcttctgcagtcctctgtgtagggaagccaggaatccaaaaccacacatagcmtcaggtgacttaaacttttaggactgactcctttaggaggctcttgcccctctccttagcgaggggcctctgatagctgctggaagaaatgacaagagcctcctttcatcacccaggagttcaagtctttgtaattatctcagtgacatttagaaagcatttgcttaaagcactttataactgtactgctctttttttctttctttctttttctttgagacggagtctcgctctgtcacccaggctggagtacagtggtgtgatcttggctcactgcaacctccgcctccagggttcaag

SEQ ID NO: 155484 - DNA, 601 bp, Human
aatgacagaattagatctgaattttggagaaaacaccaagaacactccaaacagtacttgttgccctctgttatactcaattgcgttgtcttttgatgttcgtatttgtttcatgtgtatatatgtcttgtgtcttcaaaaaagccaaatgcttctttcaggcaagggccaggtctctgtttctttagtatcccttgcagcatctatactaggtcagggaggcagattgccacatctctcctcctaataagaacaactcacaatgaggtgtcactcaaattgtaccatttattcctttatyatcatcattttccccccgacaacctcacaggttaggcagagcatgattatctgccattctggaaatgaggcaattgtggccaaggaagctgcaaggatacagagtttagtggcagtgaggaggggaacctcaggctgcagacgccaggccactggcatgcggctggccacagtccgcctcctgagccgtccatccggggtttctgcccaaggttctggtttgtttgctggctcactgctttatattttcagccatgactctcctccctaattgatcttccctctgactcacgcaccagct

SEQ ID NO: 155485 - DNA, 601 bp, Human
cactgtgtctcccactgtttggcatagcctcgtgaaagggggaccgcattcctttgagaaatgtcagtcttcaacttaaaatgacagaattagatctgaattttggagaaaacaccaagaacactccaaacagtacttgttgccctctgttatactcaattgcgttgtcttttgatgttcgtatttgtttcatgtgtatatatgtcttgtgtcttcaaaaaagccaaatgcttctttcaggcaagggccaggtctctgtttctttagtatcccttgcagcatctatactaggtcagggagrcagattgccacatctctcctcctaataagaacaactcacaatgaggtgtcactcaaattgtaccatttattcctttatcatcatcattttccccccgacaacctcacaggttaggcagagcatgattatctgccattctggaaatgaggcaattgtggccaaggaagctgcaaggatacagagtttagtggcagtgaggaggggaacctcaggctgcagacgccaggccactggcatgcggctggccacagtccgcctcctgagccgtccatccggggtttctgcccaaggttctggttt

SEQ ID NO: 155486 - DNA, 601 bp, Human
agcttctcggccaagggggatccctcacctcccctgagattagctgagagtgcctgaaaactaatttggtggcaaaaatcaatggcttctaattttgtctccctcaacccccatttctctcatcaagtcagtgccttcgcctgtgcctcagcttccctagacaaatgggacacagtaaacaggaatggatgctgaaggggcctcttgcagaaagggtgcacatattggaagagggcacacacacacacggcagaacacacccctcacactggccccgccactgcgtttcacactagttctccctcactgctaccatccggagccttctatagcccacatctcatatgtgagagaagtctgtttgtagccaaaacacagctgcacacaggaaaattcacactgaaacttcctagcaggagcattaacagaagggcagaatttaatacatttagtacaggcccactgcctggtatgctttagggtcattttttctgcacttcacagctgaggaaatcagtttgaagtacccactttcaacacatcactaaatcatacttttttttccctcaaggatctacaataacctcctattgcctctcaa

SEQ ID NO: 155487 - DNA, 601 bp, Human
ttaataaaattttaataaaaataataaatacatttaaataataaaatttgaaaaggttcctttgaagtatcaaggtttgtttttcaacagtgaggcctgtattaagagcagaactcagggctcttggcctcaccccaggcactgaggatttcagaaggggaataagagggctgtatcatagaagcaggggccttggctgagtccgggcacaactcagggaaatgggaagcctctgatgggccagaacgggttggggccaagaggaattggccacagagcgtggggatcaggcaaccagagmtatgacagggaccatggacatcttgctggttgccccaaaccagatgggaccaactgccctttggggcagactggcacagggtgtctggtgacttggagaagcaagaaaatttcagtgaaggccagaatgaggatgaaggccccttccctgggctgtgaggatgcggaagcccatcctggagtgcaggtggggaaggggggaccccctggccccgacacagattctggtctttgacgtgacatttttctttgcttgttttcatggccaccaacggaaccggggcaccagagaaatatgcaa

SEQ ID NO: 155488 - DNA, 601 bp, Human
gggataataggctgggcgtggtggctcatgcctgtaatcccagcactttgggaggctgaggcaggcagatcacttgaggtcaggagttcgagaccagcccggccaacatggtgaaaccctgtctttactaaaaatacaaaaaaattagctgggcatggtggtggacacctgtaatcccagatactcgggaggctgaggtaggagaatcgcctgaacctgggaggcagaggttgcagtgaaccgagattgtgccatcgtactcctgcttgggcgacagagtgagactccctccccccacccmcaaaaaaagggataataatggtacttccctcactgagcagttctaaggactaagttagatgttaagtgcttacaacagtgtctggatatagaaagtaccctagaagtgtgtgttaggtaaggacacacaaaactcctgcggcagcctaccgtcccaaacagcagcctatgggtgctctatccaagtacccacaagttaagagatagccccttcccctccacgcccccgcaccccagtcagccccaggcctaccttgcgtttcctcttggattttggcaaagccttttctgcaggtgtgtc

SEQ ID NO: 155489 - DNA, 601 bp, Human
aatagggataataggctgggcgtggtggctcatgcctgtaatcccagcactttgggaggctgaggcaggcagatcacttgaggtcaggagttcgagaccagcccggccaacatggtgaaaccctgtctttactaaaaatacaaaaaaattagctgggcatggtggtggacacctgtaatcccagatactcgggaggctgaggtaggagaatcgcctgaacctgggaggcagaggttgcagtgaaccgagattgtgccatcgtactcctgcttgggcgacagagtgagactccctccccccmcccccaaaaaaagggataataatggtacttccctcactgagcagttctaaggactaagttagatgttaagtgcttacaacagtgtctggatatagaaagtaccctagaagtgtgtgttaggtaaggacacacaaaactcctgcggcagcctaccgtcccaaacagcagcctatgggtgctctatccaagtacccacaagttaagagatagccccttcccctccacgcccccgcaccccagtcagccccaggcctaccttgcgtttcctcttggattttggcaaagccttttctgcaggtg

SEQ ID NO: 155490 - DNA, 601 bp, Human
atgtgtttagctttctcacaggccctacatccagctgcgtgtgcacacgcttgataaatatttcctattttgacatgcagtgggacaaggcttaattacctataactataaaatagggataataggctgggcgtggtggctcatgcctgtaatcccagcactttgggaggctgaggcaggcagatcacttgaggtcaggagttcgagaccagcccggccaacatggtgaaaccctgtctttactaaaaatacaaaaaaattagctgggcatggtggtggacacctgtaatcccagatactygggaggctgaggtaggagaatcgcctgaacctgggaggcagaggttgcagtgaaccgagattgtgccatcgtactcctgcttgggcgacagagtgagactccctccccccacccccaaaaaaagggataataatggtacttccctcactgagcagttctaaggactaagttagatgttaagtgcttacaacagtgtctggatatagaaagtaccctagaagtgtgtgttaggtaaggacacacaaaactcctgcggcagcctaccgtcccaaacagcagcctatgggtgctctatccaag

SEQ ID NO: 155491 - DNA, 601 bp, Human
acgtgcagtggctcatgcctgtaatcccagcactttaggaggccgaggcaggcggatcacctgaggttgggagttcgagaccagcctgaccaacaatggtgaaaccccgtctgtactaaaaataccaaattagccaggcatggtggcacatgcctgtaatccaagctactcgggaggctgaggcaggagaatcacttgaacccaggaggcggaggttgtggtgagccaagatggtggagcatcattgcactccagcctgggcaacaagagcgaaactctgtctcaaaaaaaaaaaaaaaawtttttttttctttgcatccataccaaggaaaagcaaaaagctgccccttgaacatatttcttttcatgaactttcttgcaagggcttcaaattctactttatagggataaattacttaatgttattaatattatgtgaagaaaaacatcctttggtactttattttttattttatttatttatttctttgagatggcgtcttgctctgttgcctaggctggagtgcagtggcatgatcttggctcactgcaacctccgcctcccaggttcaagtgattctcctgtctcagctgcctgagt

SEQ ID NO: 155492 - DNA, 601 bp, Human
atacagggtttcaccatgttggccaggatggtctcgatctcttgatctcgtgatctgcccaccttggcctcccaaagtgctgtgattataggagtaagccaccacggccggcccagatgtcagcattttctagatggagaaactgatgttcagagaaagtaaggtcacctgattaaggtcactgaggaggccaaggaccataaataaccttctgggtctagcgcaaaatgaaaacgctgggccctttgttcaaaaagcaggaaaagagtgatgttataaagccctcaaatagaaaacattytccattctttcacagtctctgtcatggaggtgtctacagtatttgctatacacactgtacttctttgggcatggggatacttggggaggcaagtgtagcctctcaagggctctgtctgcccttggacaaggtatatgtgtgcagcccaccagtgtgggcgttccccttctgccaatcagaggccctacctgtggtgcccgagttgtcaggcatttccccaacaacccacagcaagtgggcaacccccaggggatttcaagaccctctttggaatgtcttactacctggatgagggatggg

SEQ ID NO: 155493 - DNA, 601 bp, Human
ctgcctccagggttcaagcgattctcctgcctcagcctcctgagtagctgggattacaggcacgcgccaccacgcccagctatttttgtatttttagtagatacagggtttcaccatgttggccaggatggtctcgatctcttgatctcgtgatctgcccaccttggcctcccaaagtgctgtgattataggagtaagccaccacggccggcccagatgtcagcattttctagatggagaaactgatgttcagagaaagtaaggtcacctgattaaggtcactgaggaggccaaggaccayaaataaccttctgggtctagcgcaaaatgaaaacgctgggccctttgttcaaaaagcaggaaaagagtgatgttataaagccctcaaatagaaaacattctccattctttcacagtctctgtcatggaggtgtctacagtatttgctatacacactgtacttctttgggcatggggatacttggggaggcaagtgtagcctctcaagggctctgtctgcccttggacaaggtatatgtgtgcagcccaccagtgtgggcgttccccttctgccaatcagaggccctacctgtggtgcccg

SEQ ID NO: 155494 - DNA, 601 bp, Human
tttccaatctgtctatatattaccaatgtctatctctgcatatttcatgtgtatatttccatcagcgtattcagttagccatccatcccagaggtaatagccacactcattcccagatgattaactgattgattgattcctacactcaacaaagactgagcaccagcaagtagtaaggaagacagggtgtgtagagaaaaacaggaggaatagcaggtagggaagaaaatgagctgccaagtattactgagttgcattgttggaacatattgtgtgaatctgacaacacccctgcaaagaygtcaacattttttttttttttttttttttttttgagacagagtctcactctattgccaggctggagtgcaatggcatgatctcagctcagtgcagcctctgcctccagggttcaagcgattctcctgcctcagcctcctgagtagctgggattacaggcacgcgccaccacgcccagctatttttgtatttttagtagatacagggtttcaccatgttggccaggatggtctcgatctcttgatctcgtgatctgcccaccttggcctcccaaagtgctgtgattataggagtaagccac

SEQ ID NO: 155495 - DNA, 601 bp, Human
gaataaactaaagtcaatcagcactggatttcaagaggtattatgagttcccaggcaccgacttccacagagcaaggcctcctgggagccccactcacctggcttccccgaagcacagcctgagcagctgtgcccctgccatagcttccccattagctcctcaacaagcaaggatgaaatctgtcagttttacaattgacagctgatggagaggagaggcacgacgccatgattcaacattttgaattctgaaagctgctctgccatcaaccggcttaggatttagccctccaactggtcygagttcccactgcagctccagcggcactcaccttggcatttcttggtatcagaataaagtacagcaagtgtgtgttctctgggattcatgccataagggcagtggcaagcctggacttttctgttttaaaaattcttgctttggccaggtgcggtggctcatgcctgtaatcccagcactttgggaggccgaggcaggcgaatcacgaggtcaggagatcaacaccatcctggccaacatggtgaaaccccatctctactaaaatacaaaaaattagccaggtgtggtggtgcacgcctg

SEQ ID NO: 155496 - DNA, 601 bp, Human
gccttcatgacacagttgttctctctcaattttccccagccaagaattcccctgtcactaattatgataccaagtaacttacagctcatggctttgcactaataagatcagtttctaggcctcaagttgaatcaagtgttgtcattcattgacacaaattcttacagatccgttttttaaacaaaagtttgataaccacactagtgtcaccttaatactgtggctgtcaagtagtgaatgttgtgcgtttgcttaatgtcaggggaggaggtgaggtcacactgccaccaatatgagcccmcaacatacaaaggacaggctgacctgattacatttttaaaaataaatgttattcttctcagttctgtctgtatcccaaaggaactaactggtgcctgtttacaggcattatagggattacaggcacatgctaacacgcccggctgattttttggtaagtaacctaggaaaacgggcttggaaacccattaatttacattcacctgcatgtagattccttatagtcatagaaaaaaaaaattgcaggcactcttccctgggaatgtaatttataattcagctgggttcattcaacacttgt

SEQ ID NO: 155497 - DNA, 601 bp, Human
ttgaacaacaagttcctcggcgcggcagaaattggatgattttcttagggaagttgaaatccaaatcagacaaataggcaactgcataccaaatgaattcatcatctgctatccgatatgtcagcttgtcatctgataagccccagaggtgttaatatgtcccaagctttgaggagaatgcataagaaattaagtaattatttttaatacacagagtcagtgaagactatggatgagggcacttcagagtcagccactccaggatgctggcactgcctttataggcacttccccacagatscaggtagattgcatttgggtagcaaggattcaaacacagcttttatttccacaactttgatgtcggctggggctcagagtccctggaaccgggcttctcccaggcacaagcggtcattcactgtttcttcaggccacaggactgcttccctctcagccggccacagaaggcagggtttgctctgcaggacgctcaggctaagtggggcgggtgttgaatcaaaagtaactttctgttgaaatgggaaattatcaatctgatggttgtttttctctgagtgtgacatttaaaataatctta

SEQ ID NO: 155498 - DNA, 601 bp, Human
gcaggtctcccttgaatgaatggcactgaattcattttgagcttagaaaagagtggtgccttccgatggggtgcagcatcgcatccaatgagccagagagtgtctccatggcaacctgaaattctccacatcattatctgttctatactctagtatataagttaggtcattttttttttcttgccctgttttgtcactaacagttcactacttcaaatgcatttcattaaaggattatcttggtaataagctatggtatcttagtttccaccagccttctaagttacccttatggatggcrgtggctcacaattcctaatataagctccttaatcaatattgttttcatctgcagcataggggcatatttttaaatcctgatatggaggctgagtcacagactctcaccatagcacatgtgggtaagtaacacacctaattttctgaccgtatcagagcagctataatcagagcagtaacctgagatgctaatagcataggtaccatctggaggccacttaacgaacacatttgttagaactctcatctttgcatagaatggagggctcactataatgagtcactgaagattgcctgatga

SEQ ID NO: 155499 - DNA, 601 bp, Human
tgttgccttggtgagttttccttctttgtccacatattgacacatattgtaagaatgtccatatattgtctggtctttggttccaactctggcaattgatgttatttttgttgttgttttttgagaaaggttctcactctgtcgcctaggctggagggcagtggtacaatcacccatactgcagcatcaaccacctggggttaagcgaccctcccaccacagcctcccaggtagctgggactacaggtgtgtgccactatgcctggctaactttttgtatttttagtggagacggggtttygccatgttgcaaaggctggtcttgaactcctgaggtcaagtgatccacctgcctcggcctcccaaagtgctgggattacatggcttccatcacatcaccatcctgctcacagacctaaaatcaatctccagggtctacgagataaaatctcagttcagatccccaataatcttgcccaacccacttaatcatattgcttactcacgaaggcccttgaccaaagtcagaggtggctcctcattgtcttgataacatggcatcctggtccgaggagctctgctcatcacttcccccacctgg

SEQ ID NO: 155500 - DNA, 601 bp, Human
attagtaatgatagcttcaaaaccagaaatgcagagcaaaacttcctctccttagcaaatcaaaattttaaactgcttataaaggtagtgtaggctataatgcaacatttcttttttcttttttttttttttggagacagggtctcactctgtcacccaggctggagtgcagtggcatgatcttggctcattgcaatctctgcctcccgggttcaagcgagtcttctgtctcagcctcccaagtagctgggattacaggtgtgcaccaccacacctggctcatttttttttttttttttgkatttttagtagaaacagggtttcaccatgttggccaggctggtctcgaactcctgacctcaaatgatccacctgccttagcctcccaaagtgctgggattacaggtgtgagccaccgtgcctggcctataatgcaacatttcttgataacactttcagatgaagtcatttcatttagtattaatatttcctaaagcacccaattctgtggtatgtgcactccacaagcgaaagctctttccaggaacatataatagacttggagagagaaaatgtacacctacaagacagttcaaagtgc

SEQ ID NO: 155501 - DNA, 601 bp, Human
gggattatctgtagctgtcgaaatttgtgttattctttccccacatcagcaagggcagccacaaatcagctttatattcttaagatctcatcagtctaaacttatgcatcaagttcctggttccataccttactactctttgtaggtaattacatattctaactctggattgcagaatctccccagttttcaaatgattcattcatcaattaaaacagaatgacataatactcaaatactattccaagtcttgccactaaaaatacaaaaaaaacttcattagtaatgatagcttcaaaamcagaaatgcagagcaaaacttcctctccttagcaaatcaaaattttaaactgcttataaaggtagtgtaggctataatgcaacatttcttttttcttttttttttttttggagacagggtctcactctgtcacccaggctggagtgcagtggcatgatcttggctcattgcaatctctgcctcccgggttcaagcgagtcttctgtctcagcctcccaagtagctgggattacaggtgtgcaccaccacacctggctcatttttttttttttttttgtatttttagtagaaacagggttt

SEQ ID NO: 155502 - DNA, 601 bp, Human
cctctcctctgagacttccatgacacaaatgttggattttttcttattgtgcttgaggctgtgttcatttaattttttcagtctatttcttctttactgctcagattgggtaaattatattttttgtcctcaagttcattgactctctcctgtcatctccactctactactgagtccatttttggggtttatattatcaaattctacagtttcacaatttccatttagttctttttaaaataacttccatttctttgaaaagattttctggttttgtttgttgagtgataactgtgattaytgaagcatttttacgatggctgctttaaaaatccttgtcagataattgcagcaactgattcatctttgcattgaggtcttctgatcatcttttttcatgccagtggtgactgtcctagttcttggtatgatgagtgagttcctatggtatcctggacattttgaccattaggttaggagactcttgagtcctattttaaacccagccaccctgtttaggtctagcaggaaggccctagcctactttgggggctgtggttccaatgataatttaattttcagagcctttctgatactattt

SEQ ID NO: 155503 - DNA, 601 bp, Human
cactctgggaggctgaggcaggcagatcacttgaggtcaggagttcaagaccagcctgaccaacatggtgaaaccccatctctactaaaaatacaaaaattaggccgggcacagtggctcatgcctgtaatcccagcactttggtaggcctgtcgattttcaatcactgtgaattcagatcatgtatagtacggcagcaaaaaatggtctggactttccctggtcattagaactgctctggggctttgtatgttagaagacattgggcaaacactatgcctttcagcacctggtttgccartgatggcatgcgaggctggggctgctattctaagcggagatgggcactcaccataatgcagccagttgtttgtcttctggtgtggcattggggcctgagtgggtttttagtctcatagcataccttagaaaaagcggggaggaggaatagaataaaaaacataaaaagcaaagaaatagtaaaactagcttttttattaacagaacttctatgatggtagttctccctgcctgatccttagcttttcatagtacttgctgataattctttcttaaaagctagctggtgctgctccatttt

SEQ ID NO: 155504 - DNA, 601 bp, Human
attattaatgtaaggtcgacctcacaacagtacatcagcgaaggcttttaaaaatttattctcccagtgaaaataatttcattccctgagataagtaaaaggtggcatggtttgcaattttatccctatagctacacactgctatctactgcttctgagttctaacaagccatctcttaccattttaaataacgccattaaaaattaaataagctactagagactggctaagagggaatggctctaaggggttacttctaaggaaaagaagctctaagtgagcatgaggaatttatgttasctataaagatgaatttcctaggacagtggaacgagtaactggatcttctttctcttgaagccataaaaatacctggacaaggctgggcgtggtggctcacacctgtattcctagcactctgggaggtggaggcggggagatcacctgaggtcaggagttcgagaccagcatgaccaacatggtgaaaccccatctctactaaaaatacaaaattagccaggcgtggtggtgtgcgcctgtaatctgagctacttgggaggctgaggcaggagaattgcttgaacccaggaggcggaggtt

SEQ ID NO: 155505 - DNA, 601 bp, Human
gctgttggagatagagacggcataatttctagtttctatagataaacagagaagaggaccagaaatctcaaattaattattaatgtaaggtcgacctcacaacagtacatcagcgaaggcttttaaaaatttattctcccagtgaaaataatttcattccctgagataagtaaaaggtggcatggtttgcaattttatccctatagctacacactgctatctactgcttctgagttctaacaagccatctcttaccattttaaataacgccattaaaaattaaataagctactagagactrgctaagagggaatggctctaaggggttacttctaaggaaaagaagctctaagtgagcatgaggaatttatgttagctataaagatgaatttcctaggacagtggaacgagtaactggatcttctttctcttgaagccataaaaatacctggacaaggctgggcgtggtggctcacacctgtattcctagcactctgggaggtggaggcggggagatcacctgaggtcaggagttcgagaccagcatgaccaacatggtgaaaccccatctctactaaaaatacaaaattagccaggcgtg

SEQ ID NO: 155506 - DNA, 601 bp, Human
tatgtattagtgggctgcagagaatattaagaacttgtatcccttaaaagtttgttgtagcccctggcggcttacagaattcagcttccttctttattcaagcattttccttgactgtaataattctctttagtagtagatcttacgttctggatttttgaacactattgatgttgactttaggcacctgaaggaaagggaaggctcagtgctggttcttgtcctgaagacacaggacggtcaatgggctgagaaagtgatgtccatggcctagcacctggttactctacatgcacaattrgaaggcagtgtgctgaacataccccaggaacccccagcacagcctggccattagagatcacctctagaggaggttgggcatgaacagatctcaaatgatggttgtgtatctgacaaagggctgttggagatagagacggcataatttctagtttctatagataaacagagaagaggaccagaaatctcaaattaattattaatgtaaggtcgacctcacaacagtacatcagcgaaggcttttaaaaatttattctcccagtgaaaataatttcattccctgagataagtaaaaggtggc

SEQ ID NO: 155507 - DNA, 601 bp, Human
atcaaaacatcacattatacataagtacacgcaatttgttgttgattaattaaaaaaattttaaaaatagcttttgatgaagggtaaatgacattaattccttgaggagcaactctgattttctggttgtgttttccttttttttttttttttttgagacaaagtctcactctgtcgcccaggctggagtgcagtggcgccatctctgctcactgcaacctctgcctcccgggttcaaacgattctcgtgcctcagcctccctagtagctaggattacagatgcctgccaccacgcctggygtgttttctacccattctgtatgtattagtgggctgcagagaatattaagaacttgtatcccttaaaagtttgttgtagcccctggcggcttacagaattcagcttccttctttattcaagcattttccttgactgtaataattctctttagtagtagatcttacgttctggatttttgaacactattgatgttgactttaggcacctgaaggaaagggaaggctcagtgctggttcttgtcctgaagacacaggacggtcaatgggctgagaaagtgatgtccatggcctagcacctgg

SEQ ID NO: 155508 - DNA, 601 bp, Human
aggtgatggatatgttaattagcttggtttaatcattccacaatgtataaatatatcaaaacatcacattatacataagtacacgcaatttgttgttgattaattaaaaaaattttaaaaatagcttttgatgaagggtaaatgacattaattccttgaggagcaactctgattttctggttgtgttttccttttttttttttttttttgagacaaagtctcactctgtcgcccaggctggagtgcagtggcgccatctctgctcactgcaacctctgcctcccgggttcaaacgattctygtgcctcagcctccctagtagctaggattacagatgcctgccaccacgcctggcgtgttttctacccattctgtatgtattagtgggctgcagagaatattaagaacttgtatcccttaaaagtttgttgtagcccctggcggcttacagaattcagcttccttctttattcaagcattttccttgactgtaataattctctttagtagtagatcttacgttctggatttttgaacactattgatgttgactttaggcacctgaaggaaagggaaggctcagtgctggttcttgtcctga

SEQ ID NO: 155509 - DNA, 601 bp, Human
aaaggcttgggggttgcagaaacagtccagtaaaggctactgaatggaggaagaaggcagtgactcacgcctgtaatcccagcactatgggaggctgaggtgggtggatcacctgaagtcaggagtctgagaccagcctggatgacatggtgaaaccccatctctactaaagatacaaaaaattggccgggtgtggtggcacacgcctgtaatcccaactacttgggaggctgagacagaatcgcttgaacctgggaggtggaggttagggtgagccaagattgtgccactgcactccagyctgggtgacggagcgagactccgtctcaaaaaaaaacaacaaaaaaagaagtcttgagttctcttcctctaccactaagccccatgcccaagaaataccggtaggaacaaagttctttttttttagagatagctctgtactgataaaacacatatagccaaattgtcttgggtacctaaagatttcatggtttctgaactcaaagtagcatttaaatagcccttgaggctgggtgtatggctcacattggtaatcctagcactttgggaggccaaggcagtaggctcgctggaggacagg

SEQ ID NO: 155510 - DNA, 601 bp, Human
tctcaagctggtgctactggactgatcactttgtttccacttcatcctgtggttctgagaacgtgatctatagaatgcatgttctggatataagaacactaatggcagaaggggagaaaggcttgggggttgcagaaacagtccagtaaaggctactgaatggaggaagaaggcagtgactcacgcctgtaatcccagcactatgggaggctgaggtgggtggatcacctgaagtcaggagtctgagaccagcctggatgacatggtgaaaccccatctctactaaagatacaaaaaattrgccgggtgtggtggcacacgcctgtaatcccaactacttgggaggctgagacagaatcgcttgaacctgggaggtggaggttagggtgagccaagattgtgccactgcactccagcctgggtgacggagcgagactccgtctcaaaaaaaaacaacaaaaaaagaagtcttgagttctcttcctctaccactaagccccatgcccaagaaataccggtaggaacaaagttctttttttttagagatagctctgtactgataaaacacatatagccaaattgtcttgggtacctaaagatt

SEQ ID NO: 155511 - DNA, 601 bp, Human
gtaatttagtctgcttaggagtggatggggtggctataaggaaatgctgctttgaagaagcaacatttgacctgggttttgaagtttgagtaagagttcatcagggaaccataagtgtaaaggcatggaggtacaactattatgtacccacaaaaactaaaaaaataaaaggcatggagacatgaaagatcatggattaggacaattcagaattaaaaactctgtttcccttattacccttggaataatgtgcttaacatagcaatttttttttcttctttttgagacagagtctcactcygtcacccaggctggagtgcagtggtgcaatcttggctcactgcaagctctgcctcccgggttcacaccattctcctgcctcagcctcctgagtagctgtttacaggcgcccgccaccacgcccggctaattttttgtatttttagtagagatggggtttcaccgtgttagccaggatggtctccatctgacctcatgatccgcctgcctcggcctcccagagtgctgggatcacaggcgtgagccaccacacccggcctaacatagcaatcttaagtctcccctatcagtatctgtggaa

SEQ ID NO: 155512 - DNA, 601 bp, Human
aaacctactagtatttattgagtgccaggcactgttttaggtactgaggaaataaacgtgaacagcaaagtagcagggcgaggaaatgtagtccttaaataaacaaataagtattgggctttccttttttcctttttttctttacccatttgttagtttcgtttacaggtttctctggcggcctttaaaagttaagttctccagggctcagtgctgggtccacttctcttatttccctcaattctctatctacttgatctcattcattctcttgactctcaatccatttcttggctggtgwctccggtgtttgtatttcagcccacatttctttcttgcatatccataggcttacactaattgctaaattgccaggtttcgatcctgatttctcaaaccaccaccttccccagcctgtttatatcagtcttttctgtctaaatgagtagtgcccctgcttagccatatatgcaaactaaatacctacagtaacccttgattttctccatcacacttcatgcctcaattttaagtaatttatttcatttttatctctaaaatccatgtgcaatttcctgtctgcttctctctagctctactc

SEQ ID NO: 155513 - DNA, 601 bp, Human
ttaagttctccagggctcagtgctgggtccacttctcttatttccctcaattctctatctacttgatctcattcattctcttgactctcaatccatttcttggctggtgactccggtgtttgtatttcagcccacatttctttcttgcatatccataggcttacactaattgctaaattgccaggtttcgatcctgatttctcaaaccaccaccttccccagcctgtttatatcagtcttttctgtctaaatgagtagtgcccctgcttagccatatatgcaaactaaatacctacagtarcccttgattttctccatcacacttcatgcctcaattttaagtaatttatttcatttttatctctaaaatccatgtgcaatttcctgtctgcttctctctagctctactccaaacaccctggtccaagataccatcatgtctggcatggagttttgaaatcgcctcctaactcatcttcctgcttctattcttgatcccttttcgattgttcttcacaggaagaacaggagttaaacttttttcaggagttaaacttgaaaagtttaaaccatattagtgtcatctccgtagttacaattc

SEQ ID NO: 155514 - DNA, 601 bp, Human
tggtggcttcccatcgtaccctgaataaaaataacccttcttgccatgacctacgaggatccacagctccagtcaatcgtactccctactttgttccacgcattctggccctgagtcacaccggcctcttcccacctcaaggctatcaacacattggatgggatcaacaatgggaggctatcaacctcccattccttgtgtagcgagtttcaaagtcacccactcagagagggctgcctgactgccctgtctgagtagcacccccctacattctctgttgcagtctcctttttttttttawaaaaaaaacagagtctcactctgtcccccaggctggagtgcaatggtgcgatctcggctcactgcaagctccgcctcccgggttctcgccattctcctgcctcagcctccccagtagctgggactacaggcgcccgccaccacgcccggctaattttttgtgtttttagtagagacggggtttcaccgtgttagcctcctgacctcgtgatcctcccgccttggcctcccaaagtgctgggattacaggcgtgagccgccatgtccagcctttttttttaaagctccatagcattttttg

SEQ ID NO: 155515 - DNA, 601 bp, Human
gccaactagactagaagtttattttggaagattcctgaaccctggtagccagcctcctggtcgttaatagctttaagtggtcgctggggtagaagcatttgccaaaacatccagagaggattgggggttatgtttaacttctccgtgggcgccttaaaaacagcttggtaaggagcatctttcaaatgtgtaaattcttagtccaaagcaaataaaaacacaaagacaaacagggacctacttggcattacatgaaaaaaaagagtgtgtatgtttatggcagagaactcgggttaacccrtagccgtactattttctagctatgtgtaatcctggcaactttctaagcctagttctctcaaataaaatcggcccaaataaaatgggcttgtctggttcgagttggtgtttgaaaaataaaaataaaataaaatggggtttccagcccactcttacatgcaatcagtgggtgccattagtaactgaattgcaggccttcctcctctcactttgtggattatcaacaacatgttttcagtctttaatggcttaccccaatcttatttatttatttattttttgagacggagtcttgctcttt

SEQ ID NO: 155516 - DNA, 601 bp, Human
tgtggaaggattgggggaagggtgaatgatttagagctgaggacggtttctgttaaggttgttttaggatgtgagaaattgaacttgctgaagtgctaattgctaagaaccagcagagagggagagttgaagatgtgggatggggagcagcaactgaggaggtgggagaggatgaggactggagcacaggtgttggcctgtgtcttaggtctttccttcctccattggggaaaaaggaaagtggcaaaggtgtgctgggatacagagctttggaggttttggcctcaggtgtttgcaagcrctgtactaattctagccaccttctcaattaaaataagaatacaagaatgaaatgcagtctcccaaatctcttttctttgccagcttatacatttatacacctcactgatatgtcttttgatgttttaaaattttggacagcactatttttaacttttacaactataactattagttatttactagttatagtataaacttttaatatttactttttataactcctagatgtcttgtagatcaaaagatctaaagtgtcatctttgtctattttatatcttgtttaatagtaataaatgtt

SEQ ID NO: 155517 - DNA, 601 bp, Human
ttcttaaagttcactgatttaaatattactcactttaataccttcacagaaaaatctagtgttggcttatgatcacacaactgggtactataacttaggcagtctgacacatgaaattaatagggtgttggggaataaaattaacacagctgtcatcaagcctccatttcctaaggaaaattattataatccacataaatatggtattttgcttttgaatctctctaacagagtctgggtctcaaattgtcttcatgcacagtgtcatgcttaccctcacaatcacttactggaggcaggsaaggagggtgagtattccttgccaccttttacagatgtggaaaaagaaactcagagatgagacttatctagggatacagcttgtcttctggtctgttcaggctgctataacaaaaattccacagactaggtggcttaaataacaaaggtttatttcacagttctggaggctgggaagtcaaaaccaaggtgctggcagattccgtgcctggggagagactgcttcctgattcataggtggctgtctttcattgtattcacatggcagaagagatgagagagctctctggggcttctttta

SEQ ID NO: 155518 - DNA, 601 bp, Human
gggactcgtgttattccagtcaagattatccagccttcgcaacatgtaaatatatctggagcattttgacggtaataacctaaaagtcaccggcatttctcacacttggtcacttaggactgcaatttcctggaaagtgctttaaatatttctggagattgccgggcatggtagctcatgcctgtaatcccagcactttgggaggccgaggcgggcggatcacagggtcaggagatcgagaccatcctggctaacacggtgaaaccccgtctctactaacaatacaaaaaattagctggaygtggtggcgggcacctgtagtcccagctactcaggaggctgaggcaggagaatggcatgaacccaggaggcggagcttgcagtgagccgagatcgtgccactgcactccagcctgggcaacagagcgagactctgtctgaacaaaaaaaaaaaaaattctggagatcatagagcaaacaccatatatgatcctaagcaaaatgaattggtccacttccgtgggacagttacccattttccccttttcctccccttgtccccttaagttcggcaccaccatgcccttcagctatgattgtc

SEQ ID NO: 155519 - DNA, 601 bp, Human
acacggtgaaaccccgtctctactaacaatacaaaaaattagctggacgtggtggcgggcacctgtagtcccagctactcaggaggctgaggcaggagaatggcatgaacccaggaggcggagcttgcagtgagccgagatcgtgccactgcactccagcctgggcaacagagcgagactctgtctgaacaaaaaaaaaaaaaattctggagatcatagagcaaacaccatatatgatcctaagcaaaatgaattggtccacttccgtgggacagttacccattttccccttttcctcccsttgtccccttaagttcggcaccaccatgcccttcagctatgattgtctcccattacagctggtgggtgcccccaagctatgcagcctcagggtgttctgttgtagtgggtgctgacttgggagggcaacgggaaatcccctcagtgtatgctatggtctgaatgtttgtgtctcccccagattcatatgttgatgcctaatccccactgcaatagtattaaaagatagggtctttgggggtgattagaccttgagggcttcacccttacaaatgggatccatgcccttatgaaagaggcc

SEQ ID NO: 155520 - DNA, 601 bp, Human
ctctactaacaatacaaaaaattagctggacgtggtggcgggcacctgtagtcccagctactcaggaggctgaggcaggagaatggcatgaacccaggaggcggagcttgcagtgagccgagatcgtgccactgcactccagcctgggcaacagagcgagactctgtctgaacaaaaaaaaaaaaaattctggagatcatagagcaaacaccatatatgatcctaagcaaaatgaattggtccacttccgtgggacagttacccattttccccttttcctccccttgtccccttaagttcrgcaccaccatgcccttcagctatgattgtctcccattacagctggtgggtgcccccaagctatgcagcctcagggtgttctgttgtagtgggtgctgacttgggagggcaacgggaaatcccctcagtgtatgctatggtctgaatgtttgtgtctcccccagattcatatgttgatgcctaatccccactgcaatagtattaaaagatagggtctttgggggtgattagaccttgagggcttcacccttacaaatgggatccatgcccttatgaaagaggccagaggaagctcatttgc

SEQ ID NO: 155521 - DNA, 601 bp, Human
ctgaacaaaaaaaaaaaaaattctggagatcatagagcaaacaccatatatgatcctaagcaaaatgaattggtccacttccgtgggacagttacccattttccccttttcctccccttgtccccttaagttcggcaccaccatgcccttcagctatgattgtctcccattacagctggtgggtgcccccaagctatgcagcctcagggtgttctgttgtagtgggtgctgacttgggagggcaacgggaaatcccctcagtgtatgctatggtctgaatgtttgtgtctcccccagattyatatgttgatgcctaatccccactgcaatagtattaaaagatagggtctttgggggtgattagaccttgagggcttcacccttacaaatgggatccatgcccttatgaaagaggccagaggaagctcatttgccctttccaccgtgggagaacacaggagacggagccactgtgaggaacaggccctcaccagacacagaatctacaggcactttaatcttggacttcccagccccacaactgtgagcaataaatttcagctgtttgcatatcacttggtctaaagtattttttacagca

SEQ ID NO: 155522 - DNA, 601 bp, Human
gagcaaacaccatatatgatcctaagcaaaatgaattggtccacttccgtgggacagttacccattttccccttttcctccccttgtccccttaagttcggcaccaccatgcccttcagctatgattgtctcccattacagctggtgggtgcccccaagctatgcagcctcagggtgttctgttgtagtgggtgctgacttgggagggcaacgggaaatcccctcagtgtatgctatggtctgaatgtttgtgtctcccccagattcatatgttgatgcctaatccccactgcaatagtawtaaaagatagggtctttgggggtgattagaccttgagggcttcacccttacaaatgggatccatgcccttatgaaagaggccagaggaagctcatttgccctttccaccgtgggagaacacaggagacggagccactgtgaggaacaggccctcaccagacacagaatctacaggcactttaatcttggacttcccagccccacaactgtgagcaataaatttcagctgtttgcatatcacttggtctaaagtattttttacagcagcctgaatggaccaagacagtgtgccttgatatc

SEQ ID NO: 155523 - DNA, 601 bp, Human
ctcccccagattcatatgttgatgcctaatccccactgcaatagtattaaaagatagggtctttgggggtgattagaccttgagggcttcacccttacaaatgggatccatgcccttatgaaagaggccagaggaagctcatttgccctttccaccgtgggagaacacaggagacggagccactgtgaggaacaggccctcaccagacacagaatctacaggcactttaatcttggacttcccagccccacaactgtgagcaataaatttcagctgtttgcatatcacttggtctaaagtrttttttacagcagcctgaatggaccaagacagtgtgccttgatatccctaaatactagagattttttagggaaacatagctttattttttttgcccctctgccccacaactttctgtaggattcacatgggggtgttggacatggagacaaagctaagcactgggaaccataggttctaaaaatcccaacctttccattgaccactaaggcattatttattgtctggtgccttgcagttggcaagccgactcctctttccttcagtctgagctttctcctggaggtttctaagttcctca

SEQ ID NO: 155524 - DNA, 511 bp, Human
ttattagatctaatttttgtctatccactttaagatttgtttctttccattttcacatgtagacttaaaactacagttctttaagctatttagcagcagtagaggaagacttgaggcaagttggaggagagatgaaggggagtgcttttgtataaattggagatcacctcaactatagaattaactgagccctgaagttggaagaagagggaagaatggcgagagaggaggtagtgcagaggtgtgcggtcaggatttcctgtaatggccaccaggtggtgccatctgcccgggacgattwgatgtctctggtgcaggagagcggagagctggggagagtattaataaggtggtcacaagcgaggtgattggagtgccattcatacatgtgggacattagttgggcctctgtaattaacctgtcaatgatcatgagttggtgcacgtgtgtttgtgtgtagagcggggaagagaagattagggctgttaaaaaaaaagaatatatatatat

SEQ ID NO: 155525 - DNA, 451 bp, Human
agacttaaaactacagttctttaagctatttagcagcagtagaggaagacttgaggcaagttggaggagagatgaaggggagtgcttttgtataaattggagatcacctcaactatagaattaactgagccctgaagttggaagaagagggaagaatggcgagagaggaggtagtgcagaggtgtgcggtcaggatttcctgtaatggccaccaggtggtgccatctgcccgggacgatttgatgtctctggtgcaggagagcggagagctggggagagtattaataaggtggtcacaagygaggtgattggagtgccattcatacatgtgggacattagttgggcctctgtaattaacctgtcaatgatcatgagttggtgcacgtgtgtttgtgtgtagagcggggaagagaagattagggctgttaaaaaaaaagaatatatatatat

SEQ ID NO: 155526 - DNA, 601 bp, Human
ggagtctgagctgcttgggatttttttcagtgccaccagtgattctaatgattgtctagctgtaagcagtgggactcaagttttgaacagaggcatgagaagaaaatggcatttccctgcagatgggctgtaccagctgcagcttcaagtccagtgcctcttgtgggaaaggagccactcccttgtcattcgccacatctacactgcaacgctggtttatgtcagactatcatctttgactcggcatgacaacagtgcatatttgaaggccatcaaaccaatgatattagccttgtttackgtttagctggaaaatatctcccatgtggtatagtaagaagagcactgaatttgaattctgaagctcaccagagtgttccactgactagtctcagggctactgtgagcacccagtgagagtggccatgagaggtgacacactgcacaagtcagggcactggaatcatgggacaagatgggaccttagagaatgtcttgtctgcctgcctcatttcatagtagagaaaatgaggccctgagaggtaaagttcttcactgaaggtcatacgccagctattagtagtgtagccagcaccagggt

SEQ ID NO: 155527 - DNA, 601 bp, Human
tacgtagggatatgttacataagatgcacatacatactttatttctattagcctgtgaaacagtgaacatgcctgctcttataaagcttctagtaaaggaactacaaaagaaacacatctactgggcattctcacactggctgaggtaggttggaaccatctggattcttgcctgtggcatagttaacctcgtgactatccagttttccaattatccaggcccatttacctctgctcccactcagcgagccctttggctatttctctgttcattggcacctaaagtcaaggagaaagaaaygaacatttattaagtgctatgtttgtaccagttaatcttctcaatgaagtattattatcacccctgttttacagagaaggaaactaatattcaaagaggtaagataacttgttcaggaccacatatgtttttaagtatagagctcatgcattataaagtgaccaccctagctaacatttattaagcacaatatttgccagaattcttgcaaaaagccttacaaggactattttattttatcctcataccaacggcttaaggatggtattacttaagtattcttgttttacagatgaggtc

SEQ ID NO: 155528 - DNA, 601 bp, Human
ccacgtgccttctcctctcgaggctagaattaaccctcaccccaccaccagctgccaaaaaatagtagtagctgctgggaactcagaaacagaaaagaattttctatgagattactgtctaaaacaaatgtttattctagccatttataaagaacacttatggatttacagcagcttaggatagtgaaaaagaagtagaggaatggtaattaattcaggtacgaatttgtaaggccaagtgagaatcacgttccttgtcgtggcccaaaaggccttgtcagactcagatggagtctcctcrttttagtctacagacatatgggtggaagtgacatgatggaataattacattcccaagccgtgtacccaaaatctgtgctaggaccactcccctggccagtgcggaaccaggtcagctggtggaaggggctctgaatgggcacagcgctgccaggccctgccactcccacctcatcccatccagaatgggtccaacacagttcctgctaacccttatccacacctcctcaaccatagtccccagtgacctgcttcctctgtgaagcccaggctgactggaaggtgaccctcaacagaaacc

SEQ ID NO: 155529 - DNA, 601 bp, Human
gcttttctaaaataaacaactctgcttgtgatcctaaattgggaccacatgtagatgtgaaagctacaaatgcagtgcactcagaatttgcgtctctgccttcactgtttgcgtgcctctgagtagatgatgataatgttggctttggtccccaaggagcctgagttttttagatcctagtatgagggggaaaagcagaagaagaaagagaaggaatgaaaacaaatgcctttcaagacaaaatatccgaatgggtttcattttgcttatctgccaacaggctcaacccaatttagatctstcctacaaggacaggatagtgccagccagggtgtctgcccttgccggctatgtggggcagtccctgtgagggaccaggctcgaattcagagcagaaggatcactctagcaaactgccagggccagccctctgccctgaggcaagtcaatgaattagccaattcagcacagatagaatcattcctttgttttcctcaattaccaaatgctgtgtgctttgggggtcacttgtcatgtgagtttagagaatgtggatattgcaacataaaccctcaccattctaaacagcttaaactaaatt

SEQ ID NO: 155530 - DNA, 601 bp, Human
aagcagaagaagaaagagaaggaatgaaaacaaatgcctttcaagacaaaatatccgaatgggtttcattttgcttatctgccaacaggctcaacccaatttagatctctcctacaaggacaggatagtgccagccagggtgtctgcccttgccggctatgtggggcagtccctgtgagggaccaggctcgaattcagagcagaaggatcactctagcaaactgccagggccagccctctgccctgaggcaagtcaatgaattagccaattcagcacagatagaatcattcctttgttttyctcaattaccaaatgctgtgtgctttgggggtcacttgtcatgtgagtttagagaatgtggatattgcaacataaaccctcaccattctaaacagcttaaactaaattctgttactggggaggagagctgaggtgataatatccatctctaagtataaactattgtgtgttcattttcccattatgggagacaaatttctcttctccgctagtgctcatgatctcttccaccaggcacaaacatcagatgtgtgtttatgtggacatattttgtcccctattattggagagcaagctcct

SEQ ID NO: 155531 - DNA, 601 bp, Human
ggacaggatagtgccagccagggtgtctgcccttgccggctatgtggggcagtccctgtgagggaccaggctcgaattcagagcagaaggatcactctagcaaactgccagggccagccctctgccctgaggcaagtcaatgaattagccaattcagcacagatagaatcattcctttgttttcctcaattaccaaatgctgtgtgctttgggggtcacttgtcatgtgagtttagagaatgtggatattgcaacataaaccctcaccattctaaacagcttaaactaaattctgttactrgggaggagagctgaggtgataatatccatctctaagtataaactattgtgtgttcattttcccattatgggagacaaatttctcttctccgctagtgctcatgatctcttccaccaggcacaaacatcagatgtgtgtttatgtggacatattttgtcccctattattggagagcaagctccttgagagaagggattatgctgcctggatttgtaactttgttaggcaaagcatgactttatttagttttgaattgatgaggaggcactgatgttagtaaaaagctcaaatgtcctgagc

SEQ ID NO: 155532 - DNA, 601 bp, Human
taggtttgtttgtttgtttgttttgagacggagtctcactttgccgcccaggctggagtgcagtggcatgatctcggttcactgcaacctctactccccaagttcaagtgattctcctgcctcagcctcctgagtagttgggattacaggcgcctgcctgtaattgtatttttagtagaaatggggtttcaccatcttggccaggctggtcttgaactcctaaccttgtgatccacccgcctctgcctcccaaagtgctggcattataggtgtgagccaccgcacccggcccatttaatayagttttatatccgaatgccctttaatactctgagaatacactgttacaacactgtatagtcattgatattcccagtaatagtcccaaattatcaagaacaggcaaagtcatattctcctgctgtttaaagtatttacctaatgttcatagtggaaaattctcctttaaaatggttaaataaatcttgatcttaaaccgatgcttcagtgatctgaatactacatgaaacagcacgttctctctaaagagataagtgagatggtactataatcggaaacctctgttaattcggattttgtt

SEQ ID NO: 155533 - DNA, 601 bp, Human
aatccttgtcacttcactcctgagtttcagcaacactcttagagaagaacttcttaatttctctccaacctagctttgtacaatggtctgttctctataccaccatctattgtctatactacaatacattatgttgggaatatatcttattatgtactactggcttattgtgttagtcatgggtaaccaactagaatgaagaacgaactagagaacaggaactatgtctttcacatttatgtcgtctatagcacctaacgtaattattgctacacagtatgttgctacagggagtcttccrtggcctagatctgggctagatacttctcctctacacaactgtgacacactgccgtatcctggttacattatcagtgcattacaactggctgtattacgtttgtttctttttgtttctctatgaactatgagagcagagcctacatttatctggttcatcactgaccctctagtacctagcccaggttttgattatatattatgtgctcaatgcatatttttagattatttgttgttggttagtgcagtaagatagttaaggaggctgggatgaatagaccaaatggcatccatagcatca

SEQ ID NO: 155534 - DNA, 601 bp, Human
accaccatctattgtctatactacaatacattatgttgggaatatatcttattatgtactactggcttattgtgttagtcatgggtaaccaactagaatgaagaacgaactagagaacaggaactatgtctttcacatttatgtcgtctatagcacctaacgtaattattgctacacagtatgttgctacagggagtcttccgtggcctagatctgggctagatacttctcctctacacaactgtgacacactgccgtatcctggttacattatcagtgcattacaactggctgtattacrtttgtttctttttgtttctctatgaactatgagagcagagcctacatttatctggttcatcactgaccctctagtacctagcccaggttttgattatatattatgtgctcaatgcatatttttagattatttgttgttggttagtgcagtaagatagttaaggaggctgggatgaatagaccaaatggcatccatagcatcatattattttgtttgacttggcttcaggtacaatagatcaatataacctaaatattataatgaaccagataactgcatttggccctttgcaactgtata

SEQ ID NO: 155535 - DNA, 601 bp, Human
aagttggataattcctggcacttaatgctagggtgctttcaaaagttgagacatgtactgacacaccagagagcctgccctatagcaagcacagtggtgtctatagtgccaacattatataaagcttcaaatatatcaataccaagtgtactgatatgtctaacctttgcatctattgggttaatgtggaatcataggtatccctacactagctctgaaggtagctatcacaaatgagctggatgaatcatcagaaagatacagaaaggttaaaaataaaaggataatcaaagatttaccmattaaacacaaatcaacagagtgagagtggcaagctaatagaactataaatcaacatctgatttatcaatttatatttagcagccaattgccaacacaattaaaatgaaacatttatacccttggatatgctaactagtacagcatcaaaatgataaaaacagtaagaaataagagaatgacagtcacttattgttagtagtagattttaacatatagccatcagattacgatagactagagataaaatatgaatatggatataaaaagaatataattataaatgttgataaattggcta

SEQ ID NO: 155536 - DNA, 601 bp, Human
atgattctactgaatatattaacatttccaatgggggaaaaaagtgtgaatccaacgaagagctggctcagccaaaacaaacaaaggcaagtgctagtgttcatccagggacaagggagcctcattcaactagacttaactaatccagcctgtggcaggatcctccttcatgagaagatggaagcatggtgttgtttttgcctggttttgctcaaatgtcatgcacaccaaggcaccttttgattgtaaaccagcctttcctgtattggtctgcgtacaccatgattgtcccttaggggarctgtgagtgtggggctcctctgtcctcatggagttggtaagtatgaaatccttctaagaaatgatctgctgtggtcctggaaaaggaagcttcatgagccttatagaatgttaaggctacaaggaaagaaagtccagaaattaacatgcattggtatgttaacttggtaacttagtaaaacaagttatggagtagaagttgttcttattcactgctgtgttttggtgctcagagtaggttttcgtatgtatgagacacttaagtatttggtagagacatgaaacaagtaggaaaggacag

SEQ ID NO: 155537 - DNA, 601 bp, Human
cctgtggcaggatcctccttcatgagaagatggaagcatggtgttgtttttgcctggttttgctcaaatgtcatgcacaccaaggcaccttttgattgtaaaccagcctttcctgtattggtctgcgtacaccatgattgtcccttaggggagctgtgagtgtggggctcctctgtcctcatggagttggtaagtatgaaatccttctaagaaatgatctgctgtggtcctggaaaaggaagcttcatgagccttatagaatgttaaggctacaaggaaagaaagtccagaaattaacatrcattggtatgttaacttggtaacttagtaaaacaagttatggagtagaagttgttcttattcactgctgtgttttggtgctcagagtaggttttcgtatgtatgagacacttaagtatttggtagagacatgaaacaagtaggaaaggacagaattatttagcaaatgctggtgggataattgattaactgtttgacatacactaaaataaataacatggattaaagagttaacttacaaatagaaaattaaaagaatgatccaaatgtcagtagtacttctgaaggggcaacgattttg

SEQ ID NO: 155538 - DNA, 601 bp, Human
accttttgattgtaaaccagcctttcctgtattggtctgcgtacaccatgattgtcccttaggggagctgtgagtgtggggctcctctgtcctcatggagttggtaagtatgaaatccttctaagaaatgatctgctgtggtcctggaaaaggaagcttcatgagccttatagaatgttaaggctacaaggaaagaaagtccagaaattaacatgcattggtatgttaacttggtaacttagtaaaacaagttatggagtagaagttgttcttattcactgctgtgttttggtgctcagartaggttttcgtatgtatgagacacttaagtatttggtagagacatgaaacaagtaggaaaggacagaattatttagcaaatgctggtgggataattgattaactgtttgacatacactaaaataaataacatggattaaagagttaacttacaaatagaaaattaaaagaatgatccaaatgtcagtagtacttctgaaggggcaacgattttgtgcatttagaaggataagaagaaatcacaaggggaataaaaatgacaaatctgactacataaatattaaaaacgtatgttagcaaa

SEQ ID NO: 155539 - DNA, 601 bp, Human
aaaccagcctttcctgtattggtctgcgtacaccatgattgtcccttaggggagctgtgagtgtggggctcctctgtcctcatggagttggtaagtatgaaatccttctaagaaatgatctgctgtggtcctggaaaaggaagcttcatgagccttatagaatgttaaggctacaaggaaagaaagtccagaaattaacatgcattggtatgttaacttggtaacttagtaaaacaagttatggagtagaagttgttcttattcactgctgtgttttggtgctcagagtaggttttcgtaygtatgagacacttaagtatttggtagagacatgaaacaagtaggaaaggacagaattatttagcaaatgctggtgggataattgattaactgtttgacatacactaaaataaataacatggattaaagagttaacttacaaatagaaaattaaaagaatgatccaaatgtcagtagtacttctgaaggggcaacgattttgtgcatttagaaggataagaagaaatcacaaggggaataaaaatgacaaatctgactacataaatattaaaaacgtatgttagcaaaatactataatagt

SEQ ID NO: 155540 - DNA, 601 bp, Human
tatttcatattttgctgctgatggcttataaattggtacctcgtttttggaaaacagtttggcaatacaatatcaagagtcattaaaatgttttatagcctttgacctagtaatttgacttctgggaatctatcctgaggaaaattaatccaaaatatggaaaacattaaatgtctaaaatgaattgggaaacactaaatgtctcacaataggggattggttaatatgttgtagtacagccattggactaaaaactacatagccatttataattacaggaatagagaccatgcagccaaawggaaagatgcttgtgcttcaatattaaatagaaatgaatatatacttagtataaaaagatacgtagcaacaattggagtcagtacaccaaattttaagtggttgagctaaaatagcaggataacagtgaccttatcttttttcataatgtgctttcagcctgtatttctggatggcaattgccttcctttcttgacccaagtcctgcccaagctccacgcccagcttccagagccctacccatctgtgttgatgccacttagtttccagcttttccaagaagccctcccatcccatcagc

SEQ ID NO: 155541 - DNA, 601 bp, Human
taattacaggaatagagaccatgcagccaaatggaaagatgcttgtgcttcaatattaaatagaaatgaatatatacttagtataaaaagatacgtagcaacaattggagtcagtacaccaaattttaagtggttgagctaaaatagcaggataacagtgaccttatcttttttcataatgtgctttcagcctgtatttctggatggcaattgccttcctttcttgacccaagtcctgcccaagctccacgcccagcttccagagccctacccatctgtgttgatgccacttagtttccarcttttccaagaagccctcccatcccatcagccaaatggaactctccctttcccatgctctttttttttttctttttttgagacagagttttgctctgtcactcaggctggagtgcagtggcatgatcttggctcactgcaacctccacttctcgggttcaagtgattctcctgcctcagcctcttgagtagctgggattacaggcacctgccaccatgcctggctagtttttgtatttttgttttttagtagagccggggtttcattatgttggccaggctggtcttgcacttagacctc

SEQ ID NO: 155542 - DNA, 601 bp, Human
acaattggagtcagtacaccaaattttaagtggttgagctaaaatagcaggataacagtgaccttatcttttttcataatgtgctttcagcctgtatttctggatggcaattgccttcctttcttgacccaagtcctgcccaagctccacgcccagcttccagagccctacccatctgtgttgatgccacttagtttccagcttttccaagaagccctcccatcccatcagccaaatggaactctccctttcccatgctctttttttttttctttttttgagacagagttttgctctgtcrctcaggctggagtgcagtggcatgatcttggctcactgcaacctccacttctcgggttcaagtgattctcctgcctcagcctcttgagtagctgggattacaggcacctgccaccatgcctggctagtttttgtatttttgttttttagtagagccggggtttcattatgttggccaggctggtcttgcacttagacctcaggtgattcgcctacctcggcttcgcaaagtgctgcaatgacaggcatgagccaccaggcctggcccctttcccatgctcttgtgatgctgtattaacat

SEQ ID NO: 155543 - DNA, 601 bp, Human
tgatcttggctcactgcaacctccacttctcgggttcaagtgattctcctgcctcagcctcttgagtagctgggattacaggcacctgccaccatgcctggctagtttttgtatttttgttttttagtagagccggggtttcattatgttggccaggctggtcttgcacttagacctcaggtgattcgcctacctcggcttcgcaaagtgctgcaatgacaggcatgagccaccaggcctggcccctttcccatgctcttgtgatgctgtattaacatttcttttacaggataatatacartttgccttgtatggaaataatatgtgtacagtatgtgtctgtttctgcaactaaatttctaaacccctagagggcaagaaccatttcatttatttttctctccccacagcagaaggcacagggcttttcctgtgtgatatgcctgaataaatattggttgaaattaattgaattgcactgcaatgaactacttctgattccctcgcaggtggagctcatgaaggacttcagcatttgggtccttttggcaacatccccaacatcgtggcagagttgactggagacaacattcctaaggac

SEQ ID NO: 155544 - DNA, 601 bp, Human
tcaggtgattcgcctacctcggcttcgcaaagtgctgcaatgacaggcatgagccaccaggcctggcccctttcccatgctcttgtgatgctgtattaacatttcttttacaggataatatacagtttgccttgtatggaaataatatgtgtacagtatgtgtctgtttctgcaactaaatttctaaacccctagagggcaagaaccatttcatttatttttctctccccacagcagaaggcacagggcttttcctgtgtgatatgcctgaataaatattggttgaaattaattgaattgyactgcaatgaactacttctgattccctcgcaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacaggtaacagatatgcctttgggttcccatgaaaagttggggctttggaaggaaatcagaaattctaacatcagctacaaatattcccagaaattgttatttccattctgatgagcccatg

SEQ ID NO: 155545 - DNA, 601 bp, Human
tccaccctcctcggcctcccaaagtgctgggattacagtcgtgagccactgcgcccggcctgcacttgctactcttttaatgaaaggggaaacacttttttttccttttccatgatacaacttctgctgagttttaatgtctttggaactagttagtttgtggattatccatgcctgtttgttctcctcgttgatcatgacagtcaacattctaacagtgtcatgcatcaacaccgagttagcatctatcctaaaatcctgtttatttgggggccaggaggtggcatgggagagaagaggwtcaggaagaagctggttaaggaagaaggttgaaattttccatgttgttcatgcatcccacccactttcctacccactaatgccatagagaatggtgagtgggcttcacttacatccggctttgagcagctgaccttggtggttaagagtagtggctctagactctgactacctgagttcaaactccaggtcaacctgtgtgaccttaaacaagttaattaaccacttcgtacctcaatttccttatttgcaaaatggaggtcattgtgggaattaaataaaattatccatgtaaagcatt

SEQ ID NO: 155546 - DNA, 601 bp, Human
cctgcacttgctactcttttaatgaaaggggaaacacttttttttccttttccatgatacaacttctgctgagttttaatgtctttggaactagttagtttgtggattatccatgcctgtttgttctcctcgttgatcatgacagtcaacattctaacagtgtcatgcatcaacaccgagttagcatctatcctaaaatcctgtttatttgggggccaggaggtggcatgggagagaagaggttcaggaagaagctggttaaggaagaaggttgaaattttccatgttgttcatgcatccmacccactttcctacccactaatgccatagagaatggtgagtgggcttcacttacatccggctttgagcagctgaccttggtggttaagagtagtggctctagactctgactacctgagttcaaactccaggtcaacctgtgtgaccttaaacaagttaattaaccacttcgtacctcaatttccttatttgcaaaatggaggtcattgtgggaattaaataaaattatccatgtaaagcattttagcacagcacctagcacagagtaaggactctttaaatgtcatcctgattataatta

SEQ ID NO: 155547 - DNA, 601 bp, Human
aaaggtgccatatgcagattgcctgaactctcttgaattggtatattttcctacatgttaattgctatatattgtgtaagttagataaatagctcactgaaaagtggagagccgcattagggatttgttcagaatgctgatgacttccacactagctgtatactgctaagagctgagagactgtgtactgaaagcttaagagcagtgtcaagaactagacaacctggctaattgtaaatggcccccctttcagcattgactttgatgtctcattatgtctttcaaatgagaccctccttcytccccctaaccctgcacaaaattcacaatccctcctctgtccccctttttattgctgttgtctaaaatatattagacatgggaaaaatgactcatttttagagcatcatgcctagtaataatagaatttacataaaagcagcatctgagagagatagccttctttctttggtttgaatggaaaacttgcttgatttcaaagggaagtcatagtataaactgtcagtcaaagggagataatgggaagggaactaaaacatattgcaaacctattatgtgccgggtgttctaaatgtaatca

SEQ ID NO: 155548 - DNA, 601 bp, Human
agagactgtgtactgaaagcttaagagcagtgtcaagaactagacaacctggctaattgtaaatggcccccctttcagcattgactttgatgtctcattatgtctttcaaatgagaccctccttcctccccctaaccctgcacaaaattcacaatccctcctctgtccccctttttattgctgttgtctaaaatatattagacatgggaaaaatgactcatttttagagcatcatgcctagtaataatagaatttacataaaagcagcatctgagagagatagccttctttctttggtttsaatggaaaacttgcttgatttcaaagggaagtcatagtataaactgtcagtcaaagggagataatgggaagggaactaaaacatattgcaaacctattatgtgccgggtgttctaaatgtaatcatctctattcctcacagcaatcccgtaggtaagtatttgattatttgcatctcacacatacatgaacaaacttggagagaccaagttaactttccaaaggaactaagcctatctatatcttaggagctgggatttgatccttgagctctgctcttgtctgactccaaagcttaagc

SEQ ID NO: 155549 - DNA, 601 bp, Human
gtgtcaagaactagacaacctggctaattgtaaatggcccccctttcagcattgactttgatgtctcattatgtctttcaaatgagaccctccttcctccccctaaccctgcacaaaattcacaatccctcctctgtccccctttttattgctgttgtctaaaatatattagacatgggaaaaatgactcatttttagagcatcatgcctagtaataatagaatttacataaaagcagcatctgagagagatagccttctttctttggtttgaatggaaaacttgcttgatttcaaagggmagtcatagtataaactgtcagtcaaagggagataatgggaagggaactaaaacatattgcaaacctattatgtgccgggtgttctaaatgtaatcatctctattcctcacagcaatcccgtaggtaagtatttgattatttgcatctcacacatacatgaacaaacttggagagaccaagttaactttccaaaggaactaagcctatctatatcttaggagctgggatttgatccttgagctctgctcttgtctgactccaaagcttaagctgttatcacaataaaacacaacatcaagt

SEQ ID NO: 155550 - DNA, 601 bp, Human
tgtgatctctaaactaagggagatgatctctgcagaatcaagggaataaagatgccagagcttagaaacagatatatataattctgctttatagaaagagaaaaaatattccgtgatgtgtagcagtgagattgctgtcagtcctaggtaagtgcatatagctgtcagttaagggagttgtttataagcacttggaaagataaatcatgaccatttggcatcagtgtgctaaaaacaagtcttgccaatctaattatattcttccatttgccagcattattcatttatttgccagcttgawgagggaaatgcagtgggcatggtgcatttggacttttgcaaagcatttgacaagatcgttttatgttcccctattggaagaggtggaaagatacagcctaggcaacagaatgtcaccaaaatggggcttgttaaagagtccatgtaaatagggagggagatttcacatggtattctgtgtgtcttagcactaccccactccacatttttatcaatgtttgtaataatatagaacttgtacttatcagattcccagaggatgacatgaagttggaagagataccatcagatgacagagttg

SEQ ID NO: 155551 - DNA, 601 bp, Human
tccagtgccccagtatgaggccaaccacggtccttcattctctgtgcttccttctcgaaacactgacttgagtttctctcagtgtttcctattctttgtccacattagagctaaagactagaatctaggatcaaatgtaaaaggaaaatattagagatcaatgaccaggaacaatgtttagataccttttatcatctgcaattatgtgtttacttaaacttaggtctccttgtttattttctcattactacctaccagtaaaacattgtttccttggttttcacatggaagtgggaattgwgtatgtcttgcttttctaaactgggaaccacaaaccttcctcagtgcttatatggaatgacagtctcaagcttgtcttcagcccagccatcctttaagttaacagagtcatcatctttcatgatagaacagcacaaagaccctgcttccttatctgctaataacgcttccttgtttttgacagtagctggagctgagctgcatctttaacagtgattcacatattacacatttcagtgtctgtcttgtttcctgcatttctctcttcgttagtgcatcaagacacatttattaacgacac

SEQ ID NO: 155552 - DNA, 601 bp, Human
aattgagtatgtcttgcttttctaaactgggaaccacaaaccttcctcagtgcttatatggaatgacagtctcaagcttgtcttcagcccagccatcctttaagttaacagagtcatcatctttcatgatagaacagcacaaagaccctgcttccttatctgctaataacgcttccttgtttttgacagtagctggagctgagctgcatctttaacagtgattcacatattacacatttcagtgtctgtcttgtttcctgcatttctctcttcgttagtgcatcaagacacatttattaaygacacatcatatgccttccgggccccgtgttaggtaatgggaatacaaagatgaatgataatagtaattgtattacataatacataatactatataatacaatagtaaatagtaatatttattgaccacatactatatgccagactcctttctaaatactcagtaatcttattcaatctgcccatccttgtcattctcactttccagatgagaaaatgcaggcttggggagctgaggagcctgctcagcccacagagctgggatttgaaccccatcatctgactccagagtactttacaa

SEQ ID NO: 155553 - DNA, 601 bp, Human
attaataggccgggcacagtggctcacacctgtaatcccagcactttgggaggccgaggcaggcggatcatgaggtcaggagatcgagaccatcctggctaacacagtgaaaccccgtctctactaaaaatacaaaaaaattagccgggcgcggtggcgggtgcctgtagtcccagctacttgggaggctgaggcaggagaatggcgtgaacccgggaggcggagcttgcagcgagccgagatagtgccactgcagtccggcctgggcaaaagagcaagactccgtctcaaaaaaaaaaaraaaaaaaaaaagaaattaatagttactctgtgggaagaagttttggggctgtgtaaatattctgctcctcgttcaacttttaaccaacaaatataacatccattgatgatgcttaccagattcaataatgatgatagctgcaaaatgatgattttcttactccgctattctttctgcatttactagttgacattctattctaagcaagagtttcccctgctgttctatttatttatttatttataaatgtgtttatttatatagtataagtatggattcatggattccataatgcatatt

SEQ ID NO: 155554 - DNA, 601 bp, Human
ttttcttggtgattacagcttccaatagcagatggtgacagaaagggtccaaagggtataatgtggtcttgagggaacatcaagaaattctattctaggaactcaaaatacacataatttaccagtaacacggcttgaatatctccctacaacacaacaagaacatttccaaataagagcaatgactgacccaaaatcaataacttagcttgaaactttaattgtctctacttcctggcccaccattccttctgccctgactcagtgaatgaccatggtcacgatttaggtcatttttccstgagactagtgattaccaaaactcagaatgctggctaagacacatgctataaaggattttactttagcctcaatttcctccacataggaaaggcttagaatttaggaaaagaagggtcactttgacccagagatatcaagttcttcctgttcttgggcatctacaaagacccattctcatgccataaaccatgggcctctctggattgataaggaagcacgttggccctgcccatcatgaggtctcagatgatgttcccatcttgattaaagacattaacactgccccaccaccaccccc

SEQ ID NO: 155555 - DNA, 601 bp, Human
attaccaaaactcagaatgctggctaagacacatgctataaaggattttactttagcctcaatttcctccacataggaaaggcttagaatttaggaaaagaagggtcactttgacccagagatatcaagttcttcctgttcttgggcatctacaaagacccattctcatgccataaaccatgggcctctctggattgataaggaagcacgttggccctgcccatcatgaggtctcagatgatgttcccatcttgattaaagacattaacactgccccaccaccacccccagtacatgaatsaatataaagaaactatacgctttcttttttgaacaatgaagtcttccttcagtgaagctcagcatctgctgtgagtttccagaggacattgtaagcaaagatccaatcccagtggttcttccagttgtgaaatgggaatcatgttctctgtgtgccctacccaatctcttgcccaagtgagagaagacaaatatagaagtgccttgagtttttcagagcacaattaaagccaaggctcagctaggcatggtggctcacgcctgtaatcccagcactttgggaggccgaggagggtggatc

SEQ ID NO: 155556 - DNA, 601 bp, Human
ctcatgccataaaccatgggcctctctggattgataaggaagcacgttggccctgcccatcatgaggtctcagatgatgttcccatcttgattaaagacattaacactgccccaccaccacccccagtacatgaatcaatataaagaaactatacgctttcttttttgaacaatgaagtcttccttcagtgaagctcagcatctgctgtgagtttccagaggacattgtaagcaaagatccaatcccagtggttcttccagttgtgaaatgggaatcatgttctctgtgtgccctacccartctcttgcccaagtgagagaagacaaatatagaagtgccttgagtttttcagagcacaattaaagccaaggctcagctaggcatggtggctcacgcctgtaatcccagcactttgggaggccgaggagggtggatcacctgaggtcagtagttcaagaccagcctggccaacatggtgaaaccccatctctactaaaagtacaaaaattagccgggcgtggtggtatgctcctgttatctcaggtactcgggaggctgaggcaggagaatcgtttgaacctgggaggtggagtttgcagt

SEQ ID NO: 155557 - DNA, 601 bp, Human
gccagaaacaattcttttcttttcttttttcttttttttttgagacaaaatcttgctctgtcgcccaggctggagtgcagtggcatgacgtctgctcactgcaagctccgcctcccgggttcacgccattctcctgcctcagcctcccaagtagctgggactacaggcacccaccaccacgcccggctaattttttgtatttttagtacagacggggtttcaccgtgttagccaggatggtctcgatctcctgacctcgtgatctgcccacctcggcctcccaaagtgctgggattacagrcgtgagccaccgcgcccggccccagaaacgattcttgttcatttcttttctgagatgtctgtatctgatgttcacatataacaccaaaccacatggtttttgtttgtttgtttttcagagtgtcaatccatatctacaaggacagagactggataatgttgttgcaaagaagtctgtcccccatttttcagatgaggataaggatccagagtaaagagaagatgctagacgaaaacccacattacctgttaggcctcagcatggcttatgtgcacgtgtaaatggagtccctgtgaatga

SEQ ID NO: 155558 - DNA, 601 bp, Human
taaccaaaactcctcaactagtaagtggcagagttggaacttgaatttaggcctctgggactccacagtagacactctcccctgtaccacactaccacctgttaaaagagaaaccttagacagattaaactgaacagactttgagtaaagagcaatttgcaaaacaggttcagagagactctgcactgccgtgtggttgaagacaaccgatggacagcaaaaggaaagtgaggtacacgaaaagtgagggacagaaacagccgtattggttacatttcagtgtttgccttatctgaacatrgtttgaacagttggccacctttggccgaatctcagtgattggcacaagagtaggttacagcctgtttacacatccagctaggttacagtttgctatgtacagagaaaactttaggccgagctttcactatgtaaggaggcagctttgggctgaacttaatttggcacacctaatacttgtttacttattatatatgtgcctcattcaactgggttataagctccttgaagccataggctgtgtctcatttttctttttatcttgatatcttgcacgcggcctaacaaaggcaataataac

SEQ ID NO: 155559 - DNA, 601 bp, Human
cgtgggacggccctgctcaccatcaaggcagatctgtgggcagacagagcattgggttctgctgtgggttttcatcgaccagtgttccctctctgaccatgggaaagccacatgggcagtgcagaaggcatatcccagcccttcactggtatcatgtgctgtggcaacagccttggggattagaacagagaaacctggggaaacattggccactcaatgagaagcaaacttggagggtaggaggaaagtcctaaggaggggtcagggaagtatccaggccatcaactttcaaagtgctccrggacataatttagaaagtcaattggcacacctagccaggagtatatcttgagaaagtagtattctttgaagcctcctgaagcctgggttttaccaacagcctagtcctggcaagattcggggagcttgtacttcacatactcaactttctgtttctaaagggaaaggagactctaccaagcctttttggccatcaggctgctcttccaaaattgtctggtgacttaagtgtaggtgaatcagaaacatgtggatcaaatttcctgctaaaatacacatgggtttggcaattaaaagaaaa

SEQ ID NO: 155560 - DNA, 601 bp, Human
atcaactttcaaagtgctccaggacataatttagaaagtcaattggcacacctagccaggagtatatcttgagaaagtagtattctttgaagcctcctgaagcctgggttttaccaacagcctagtcctggcaagattcggggagcttgtacttcacatactcaactttctgtttctaaagggaaaggagactctaccaagcctttttggccatcaggctgctcttccaaaattgtctggtgacttaagtgtaggtgaatcagaaacatgtggatcaaatttcctgctaaaatacacatgkgtttggcaattaaaagaaaatgtgtagaatatggcagatttggtggccagaaagccccgtgagaaggcaagggccactgaaaattatcataactatatagtaaaagaaaacttgattccaaatgggcacagaggaatccatggagaaagttggtaagacatttatgggtgtcacacatcggcttctgaaggccacaagtaaaggcagggtgtttgcaaagattcttgtagaaccatgtccttgaatttgggtttaaaaacttattaacttataagttgcaaaagaaaggctcttttagaa

SEQ ID NO: 155561 - DNA, 601 bp, Human
gtagtattctttgaagcctcctgaagcctgggttttaccaacagcctagtcctggcaagattcggggagcttgtacttcacatactcaactttctgtttctaaagggaaaggagactctaccaagcctttttggccatcaggctgctcttccaaaattgtctggtgacttaagtgtaggtgaatcagaaacatgtggatcaaatttcctgctaaaatacacatgggtttggcaattaaaagaaaatgtgtagaatatggcagatttggtggccagaaagccccgtgagaaggcaagggccrctgaaaattatcataactatatagtaaaagaaaacttgattccaaatgggcacagaggaatccatggagaaagttggtaagacatttatgggtgtcacacatcggcttctgaaggccacaagtaaaggcagggtgtttgcaaagattcttgtagaaccatgtccttgaatttgggtttaaaaacttattaacttataagttgcaaaagaaaggctcttttagaaaagagctgctataagatgggctgagttagaaaaacctaacagcccatcctaatagactgaatgttctattgtttga

SEQ ID NO: 155562 - DNA, 601 bp, Human
aaatacacatgggtttggcaattaaaagaaaatgtgtagaatatggcagatttggtggccagaaagccccgtgagaaggcaagggccactgaaaattatcataactatatagtaaaagaaaacttgattccaaatgggcacagaggaatccatggagaaagttggtaagacatttatgggtgtcacacatcggcttctgaaggccacaagtaaaggcagggtgtttgcaaagattcttgtagaaccatgtccttgaatttgggtttaaaaacttattaacttataagttgcaaaagaaagkctcttttagaaaagagctgctataagatgggctgagttagaaaaacctaacagcccatcctaatagactgaatgttctattgtttgatgaatgttatgtgccagtagaacttgttgataagccattcttccgaacagaaaccataactatatacacaggaaacaaaaatatttgtaatggcttttagcagtggcaactgaacacctgaggagtgagatgcatcttaataaagcccatttggaaactatagtgacttccccacaaggtgtcaccttccttgttaggactcatcacgatacc

SEQ ID NO: 155563 - DNA, 601 bp, Human
gggtgtttgcaaagattcttgtagaaccatgtccttgaatttgggtttaaaaacttattaacttataagttgcaaaagaaaggctcttttagaaaagagctgctataagatgggctgagttagaaaaacctaacagcccatcctaatagactgaatgttctattgtttgatgaatgttatgtgccagtagaacttgttgataagccattcttccgaacagaaaccataactatatacacaggaaacaaaaatatttgtaatggcttttagcagtggcaactgaacacctgaggagtgagaygcatcttaataaagcccatttggaaactatagtgacttccccacaaggtgtcaccttccttgttaggactcatcacgataccattcatttattcattcagcagtaacttatcaaggatctattctatgtgccaaatactgagctatattctgggactggggagtcttactaaagaggtataagatataggctcttccttcatggagtttaaagcacatttgcaaccataaatattcagctatttgtacactattattacacacttgatcccatggcatcacagtttaacagagtagttag

SEQ ID NO: 155564 - DNA, 601 bp, Human
tgcatttgacgggttctgtgacttacaagttgtgtggccttgagcaaataattccatctcactaaaccttagttctttcatgtaaccaatgggaaaggtaatacttaccttatcatattgatgtgaagatcctgtgatgtgaaattccctgcaatatggcacctgtgttaaacctctatttagatgccaaattcagaattcatcagatttcagggcaagaaacaaactctttactctggatatttccatatgaaagggatttaatgcaaggaattatgtgcttacaaaattatttaaagamgtggaggagcatgaggcagggatccacagttcggtttaaccagttcaaggtcacgcacatagctggaatccagaggtcaggaaatagtggttggtgtcactgccaccaccacatcactaccaatgatgtgtgatactcccaaagtcattgtcttgacacaagaatggtgagtctgcctgcagctaccatctctcatagcagaaacagcagcagaaaaatagatgtttttctttctcttccaacttcaacatctgtgggagtgcatctatttggtgttccagtttgcttccaaaagcctgt

SEQ ID NO: 155565 - DNA, 601 bp, Human
tgtggccttgagcaaataattccatctcactaaaccttagttctttcatgtaaccaatgggaaaggtaatacttaccttatcatattgatgtgaagatcctgtgatgtgaaattccctgcaatatggcacctgtgttaaacctctatttagatgccaaattcagaattcatcagatttcagggcaagaaacaaactctttactctggatatttccatatgaaagggatttaatgcaaggaattatgtgcttacaaaattatttaaagaagtggaggagcatgaggcagggatccacagttsggtttaaccagttcaaggtcacgcacatagctggaatccagaggtcaggaaatagtggttggtgtcactgccaccaccacatcactaccaatgatgtgtgatactcccaaagtcattgtcttgacacaagaatggtgagtctgcctgcagctaccatctctcatagcagaaacagcagcagaaaaatagatgtttttctttctcttccaacttcaacatctgtgggagtgcatctatttggtgttccagtttgcttccaaaagcctgtctcctgaggagtcaggtatcagctacatcagg

SEQ ID NO: 155566 - DNA, 601 bp, Human
acataggaaccatccccatgacatagaccccaaaagtacaatggtatgaatgaaaaaggtgacagcggaggctgatctttatcatttttcactatgcttggcttttttgttattgttgatttttgagttggaatgtgagcttatttatcctccacagcttttggaagatttcagcctggctcatcctacgttagagtgtctgacaggggaataacgcgtggtatttagatggcaccagttatccaagaaggtcaaatttctttgcaattagtctgtcgtactccagaaagccctgagagaygagacgttggggtgtgagagagggagttatcttcatttaacagcagatagacttaggaagcggcaggggccaatgaaaaagcaggaacgagaatggaaaatgtcccaacactatctcccttcccccaccaacaacccaggaaaaattttccaaatcactttctacatatgccttgactgttgattcatcaaagatgtcttcaatagattcacaactcaaaccacattgtggtatttaagtaaaggggagcattgaaaatgtgaatatagtatttcttctatttttgcaaatggatgtgtt

SEQ ID NO: 155567 - DNA, 601 bp, Human
cccatgacatagaccccaaaagtacaatggtatgaatgaaaaaggtgacagcggaggctgatctttatcatttttcactatgcttggcttttttgttattgttgatttttgagttggaatgtgagcttatttatcctccacagcttttggaagatttcagcctggctcatcctacgttagagtgtctgacaggggaataacgcgtggtatttagatggcaccagttatccaagaaggtcaaatttctttgcaattagtctgtcgtactccagaaagccctgagagacgagacgttggggtrtgagagagggagttatcttcatttaacagcagatagacttaggaagcggcaggggccaatgaaaaagcaggaacgagaatggaaaatgtcccaacactatctcccttcccccaccaacaacccaggaaaaattttccaaatcactttctacatatgccttgactgttgattcatcaaagatgtcttcaatagattcacaactcaaaccacattgtggtatttaagtaaaggggagcattgaaaatgtgaatatagtatttcttctatttttgcaaatggatgtgtttgataccaaacact

SEQ ID NO: 155568 - DNA, 601 bp, Human
tggcaccagttatccaagaaggtcaaatttctttgcaattagtctgtcgtactccagaaagccctgagagacgagacgttggggtgtgagagagggagttatcttcatttaacagcagatagacttaggaagcggcaggggccaatgaaaaagcaggaacgagaatggaaaatgtcccaacactatctcccttcccccaccaacaacccaggaaaaattttccaaatcactttctacatatgccttgactgttgattcatcaaagatgtcttcaatagattcacaactcaaaccacattgyggtatttaagtaaaggggagcattgaaaatgtgaatatagtatttcttctatttttgcaaatggatgtgtttgataccaaacactgtcagcagctaatactattactatgtttgctaatatgctcagatcagctgggcacacaaccaaaacccataacattcctgagtgaagtatgatcagatgctcccaaatgcaatttgccttcttccctcgcatcgtaagagaaaaggcttttgttggatatgttttgtgaacaccaaagagagtaaatagctttttgaagaagccaaagtgttttc

SEQ ID NO: 155569 - DNA, 601 bp, Human
ttccaaatcactttctacatatgccttgactgttgattcatcaaagatgtcttcaatagattcacaactcaaaccacattgtggtatttaagtaaaggggagcattgaaaatgtgaatatagtatttcttctatttttgcaaatggatgtgtttgataccaaacactgtcagcagctaatactattactatgtttgctaatatgctcagatcagctgggcacacaaccaaaacccataacattcctgagtgaagtatgatcagatgctcccaaatgcaatttgccttcttccctcgcatcrtaagagaaaaggcttttgttggatatgttttgtgaacaccaaagagagtaaatagctttttgaagaagccaaagtgttttcctcctgattcattgtgaatgcctgcaagagtgtttccttttaagttaaaacaatttacgaattcttcctactaaatcaatctacatatttttatcactgctatttttaataagtaacttttctttctgaaaatttatttcactttgccccaacctttctgtgattcttgggagacaagaaacagagttcatgtaaaacactcttgtttatgatggatga

SEQ ID NO: 155570 - DNA, 601 bp, Human
ttgactgttgattcatcaaagatgtcttcaatagattcacaactcaaaccacattgtggtatttaagtaaaggggagcattgaaaatgtgaatatagtatttcttctatttttgcaaatggatgtgtttgataccaaacactgtcagcagctaatactattactatgtttgctaatatgctcagatcagctgggcacacaaccaaaacccataacattcctgagtgaagtatgatcagatgctcccaaatgcaatttgccttcttccctcgcatcgtaagagaaaaggcttttgttggatrtgttttgtgaacaccaaagagagtaaatagctttttgaagaagccaaagtgttttcctcctgattcattgtgaatgcctgcaagagtgtttccttttaagttaaaacaatttacgaattcttcctactaaatcaatctacatatttttatcactgctatttttaataagtaacttttctttctgaaaatttatttcactttgccccaacctttctgtgattcttgggagacaagaaacagagttcatgtaaaacactcttgtttatgatggatgaaaccacaaactttgtgtgatgttaa

SEQ ID NO: 155571 - DNA, 601 bp, Human
caatttacgaattcttcctactaaatcaatctacatatttttatcactgctatttttaataagtaacttttctttctgaaaatttatttcactttgccccaacctttctgtgattcttgggagacaagaaacagagttcatgtaaaacactcttgtttatgatggatgaaaccacaaactttgtgtgatgttaacccactcacagaaggagaatctgaacttcagagtattttgtgtttggagagaaggctcactaagggaaatgggctcacttcaattcaatatattataggaaggaaargatcaaggaagagctggtcttaaaactgtcaaaatataagaatttgatgggaagaaagaaggaaaacagagcagttggaaatgcaaagataaaagaactggatccagacatgtctatgtaatttcccaggaatggaaattgtactggcaatttggaaagagatatcgaaaaacaatatacattaaatgttgagcttttcttgcagcaatgcacttggaaggctcttagaacacatggcataatggtattatgattcatctacatatggcctgatccttggtgactgatgaaaggggaaac

SEQ ID NO: 155572 - DNA, 601 bp, Human
atttcactttgccccaacctttctgtgattcttgggagacaagaaacagagttcatgtaaaacactcttgtttatgatggatgaaaccacaaactttgtgtgatgttaacccactcacagaaggagaatctgaacttcagagtattttgtgtttggagagaaggctcactaagggaaatgggctcacttcaattcaatatattataggaaggaaaggatcaaggaagagctggtcttaaaactgtcaaaatataagaatttgatgggaagaaagaaggaaaacagagcagttggaaatgcraagataaaagaactggatccagacatgtctatgtaatttcccaggaatggaaattgtactggcaatttggaaagagatatcgaaaaacaatatacattaaatgttgagcttttcttgcagcaatgcacttggaaggctcttagaacacatggcataatggtattatgattcatctacatatggcctgatccttggtgactgatgaaaggggaaaccaagtttcataaggaatcaaacacagaagaggaagctaaacacttttttagagaaaaaaactcttttaagcttctaggtcatcag

SEQ ID NO: 155573 - DNA, 601 bp, Human
taagggaaatgggctcacttcaattcaatatattataggaaggaaaggatcaaggaagagctggtcttaaaactgtcaaaatataagaatttgatgggaagaaagaaggaaaacagagcagttggaaatgcaaagataaaagaactggatccagacatgtctatgtaatttcccaggaatggaaattgtactggcaatttggaaagagatatcgaaaaacaatatacattaaatgttgagcttttcttgcagcaatgcacttggaaggctcttagaacacatggcataatggtattatgaytcatctacatatggcctgatccttggtgactgatgaaaggggaaaccaagtttcataaggaatcaaacacagaagaggaagctaaacacttttttagagaaaaaaactcttttaagcttctaggtcatcagcagagtattaactaacgcagcctactaaatttgcattgggatagatcacatatgtaatttcctttaattcttcaataaccctgtgacataggcatcattttctctgtttcctgatagcccaagagttgccatctctaaagttgcttaggtagttggtggttgagcttag

SEQ ID NO: 155574 - DNA, 601 bp, Human
gaatgtgctctctgattccacgacaaaactaaggactgaggctcccctaggctcagttgtagattttgaggctcttgagtttcagttctccaatgagttccaggtaaaatgcagaaaccaggccaggcgccaatggctcatgcctgtaatcccagcactttgggaggccaagatgagtggatctcttgcccccaggagttcgagaccagcctgggcaacatggtgagaccccatctctacaaaaaatacaaaaattagtgtgtgcctatagtcccagctacttgggaggctgaagtgggcrggtcatttgagcctaggaggtcaagggtacagtgagctgtgatctcaccactgcacgccagcctgctgggtgagagtaagagcctgtctcaaaaaaaaaaaaaaaaaaaaaaaatgaaggaggagaaatcagaaacagaagcaaggcaaaaagggggctagagcaagggttataacaggaaggaaaataagaacagctgcacttttaatctattcattcaacaaaggtctgggagcatctatgtactccaagtgccatgtagaggccggggattcagtgagccacacagagacggttctt

SEQ ID NO: 155575 - DNA, 601 bp, Human
aatgagttccaggtaaaatgcagaaaccaggccaggcgccaatggctcatgcctgtaatcccagcactttgggaggccaagatgagtggatctcttgcccccaggagttcgagaccagcctgggcaacatggtgagaccccatctctacaaaaaatacaaaaattagtgtgtgcctatagtcccagctacttgggaggctgaagtgggcgggtcatttgagcctaggaggtcaagggtacagtgagctgtgatctcaccactgcacgccagcctgctgggtgagagtaagagcctgtctcaaaaaaaaaaaaaaaaaaaaaaaatgaaggaggagaaatcagaaacagaagcaaggcaaaaagggggctagagcaagggttataacaggaaggaaaataagaacagctgcacttttaatctattcattcaacaaaggtctgggagcatctatgtactccaagtgccatgtagaggccggggattcagtgagccacacagagacggttcttgcccccacagagcttacaggcacgtggaggaaacagacaaaaaccaagcaaatctacaaattgcataatttaaaaatttggtaagagccag

SEQ ID NO: 155576 - DNA, 601 bp, Human
ctgccactggccgcgacactttggagaaactctagcagttagttcttccgacacagttcctacaggtgacgggataaaaatagaagacagcaggggaaatgatgaggagacctggagcactttagttacgattcaactcagcctgtgctagggccacagggactcaaagaggaggaaggagacactttctccatgcaaggagtctacatttcattgaagaagatgtgtccagcatacatgtaactacaataaaggaaaaatatgacaagaataatagaaaaggcagaaggctctgagaagraggcttgaggtcagagtaggaattcaaccagaagagagaagggtgggaacttctgaggggagggaggagcaagagcaaacgtgtgaacatggtggtctgtggtatgtgctcagctcctgctgggctcaaatgttgcatgtgcacagagaacattagctggagaccatcaggctggcactgaacaccaggggcaggagtggatgcttgctactcagctgtgcactcctctcatgttcttttctacatgtgtgcaattgaatgtctgtgttatatgtgcgtattaaaagcgaactctcacct

SEQ ID NO: 155577 - DNA, 601 bp, Human
ttgaatgtctgtgttatatgtgcgtattaaaagcgaactctcaccttgaaattcttcttagtggcaagattcttttctctagattgacagtgcagagctcacatagtaatcactgctgttaaaatagatatttaggactatagagttaaagcttaaataccatttaagggaagctgctgttatctgaaataatttgtctttcttattgaaaagaaccaataccctccctccctctttccctccttccctcccttccttcccttttttctttcttccttcgttggaagagtggaaacataaygaggggttctggctagtgtcctgaggtgttggctaggtaaactttctggagttgctcgtgccaagagaccagcacatacatttctctaggggaagtacatcctaattattccacagacatccatggatcactctggctagcagagtagcactgcaaaaatcattacgatttttttttttcagaaagttgttctactttggcttaatgtccacatgaccaagaatcacactttacagtctttaagggcctatcccatgctcagccactttcctacaaaatcgtggcgacgtggaaaggcag

SEQ ID NO: 155578 - DNA, 601 bp, Human
gttaggtgcaggggctcatgcctgtaattccagcactttgggtggttgaggcaggcggatctcttgaggtcaggagtttgagacaagccgcggtcaacatggcaaaaccttgtctccactaaaactaccaaaaaaaaattagcagggcgtggtggcgagtgcctgtagtcccagctactcaggaggctaaggcaggagaatcgcttgaaccaaggaggcagaggttgcagtgagctgagattgtgccaatacactccagcctgggtgacagagtgaggctccctctcaaaaaaaaaaaaawatgtatatatatatatagagagagagagagacagacagacagacagagagagagagagatagacagagagagactgatacagtcattaataactaatggcaataaggcaggctttggtttttgtaggaaacctcaagacaggccatatgggttttctttttttctttttcttttctttttttttctttcttttttttttttgagatggagtctcgttctgtcacccaggctggagcgcagtggcgcaatctcggctcactgcaaactccacctcccggcttcatgccattctcctgcctc

SEQ ID NO: 155579 - DNA, 601 bp, Human
taaactgatatttttgaagaattttaataatgtccgcaaaaataatcaaaatattaggttaaatttaaaagttaaataaagcatcttattatatacagcatcttctctctctctctctctttctctcacatacacatgcacacacatacacatgcacacacacatatacacacactatataattagaaggaaatccatatatgtacatatatatacagtgtgtgtgagcaaacagtggttatttggggattgtgagattacggcatacttttattttctttgtatttttctctatttccargttttctgtgatgagtttgtaatatttttacaataacttcatgttataaaatattttataagatgtaatgaatcagtccaagtgacatattaggagagcggcagcaagagcaaaatcacacgtatacttccatgccttcaaaaaaggacacaagagtgaaaacgtgaatcctaaaatgacttctagtaaatagcagagacatcaaggaaacaaagactgggaagggactaaataagccaaaagtcaaaaaaaaaaaaaaaaaagtgaggagcaggatagccagagacagcggggtaaaac

SEQ ID NO: 155580 - DNA, 601 bp, Human
gaaggaaatccatatatgtacatatatatacagtgtgtgtgagcaaacagtggttatttggggattgtgagattacggcatacttttattttctttgtatttttctctatttccaagttttctgtgatgagtttgtaatatttttacaataacttcatgttataaaatattttataagatgtaatgaatcagtccaagtgacatattaggagagcggcagcaagagcaaaatcacacgtatacttccatgccttcaaaaaaggacacaagagtgaaaacgtgaatcctaaaatgacttctrgtaaatagcagagacatcaaggaaacaaagactgggaagggactaaataagccaaaagtcaaaaaaaaaaaaaaaaaagtgaggagcaggatagccagagacagcggggtaaaaccttgcaaccttcagtttaataggtactttcaacagatcttccccaaggcactagcattttaaaattgcattaaaatgagcttttttcaaagagaaaccctccaccaaaaaaaatttagaaaatgaagaacacaagctataagggaaaacacaaaattattaactgaataaagtcccatcacattt

SEQ ID NO: 155581 - DNA, 601 bp, Human
ctgttttattgtgttagctcccagttgaactctagtatctatgcagacactgatgtttattaggtgcctggcactttcacagagcttgttttacttaattccagcatctacccagaagtgggtgttatcaccattcctataatacagatggttgaatttcagcccagaggctttaaatacctaattgagacattcagcttctaaggggaagtatcaggaatttactctgactttcctgactccgagttccgtgctttttcccactgtgccagaactattgactgtgaaggattatgttcayagtttgaagccttcaccttttgatactgcactgcacgtggagtatatgcaataaatatgtgcatgaaatagggcaagaattgtattacaatggtcctgaataactcattccatatacctgtatttggcaacattgtccagaattttcacatgcacgtgcattttccatacacaggaaactggttaggcatacacctcagacaggtcagcagacatacacacttacataagggcttgtttgcattctgaaagcatgcctactcagattggagcttgttacaaagaacacatgggaagcaaa

SEQ ID NO: 155582 - DNA, 601 bp, Human
agggcttgtttgcattctgaaagcatgcctactcagattggagcttgttacaaagaacacatgggaagcaaaaatgttcagtttacaaatgatgctcaaaatcactcttgaaatcataatagaaacatcacatttgttttaaatttgagggtttaaaacattatcaacatgtagagagagttatctagcaaacacatccatgtacccatcacccagaaattcaaattgtccacattttgtcatatttctttcaagattttttttaagacataagatttttaaatggtttgtaatgttgaartttcttttgtcgtccatgcctgatccacctcctcccctcctcattctggtgaacatcattaaaggtatggattccaagtcactatttatccatgcacatgaccatatgtttcacaagcaatttatgctatttttatatgtttactataaaatacacataatggtatcatactacttatatcattctgcagcttccttttttttttaaaaaaaagcatctctatgttttgagctctatgttaaaatataaaaatctaatcaatttcttttattagctatgtagcattttgccatatgaata

SEQ ID NO: 155583 - DNA, 601 bp, Human
gcattctgaaagcatgcctactcagattggagcttgttacaaagaacacatgggaagcaaaaatgttcagtttacaaatgatgctcaaaatcactcttgaaatcataatagaaacatcacatttgttttaaatttgagggtttaaaacattatcaacatgtagagagagttatctagcaaacacatccatgtacccatcacccagaaattcaaattgtccacattttgtcatatttctttcaagattttttttaagacataagatttttaaatggtttgtaatgttgaaatttcttttgtygtccatgcctgatccacctcctcccctcctcattctggtgaacatcattaaaggtatggattccaagtcactatttatccatgcacatgaccatatgtttcacaagcaatttatgctatttttatatgtttactataaaatacacataatggtatcatactacttatatcattctgcagcttccttttttttttaaaaaaaagcatctctatgttttgagctctatgttaaaatataaaaatctaatcaatttcttttattagctatgtagcattttgccatatgaataaaataatttct

SEQ ID NO: 155584 - DNA, 601 bp, Human
ctcttgaaatcataatagaaacatcacatttgttttaaatttgagggtttaaaacattatcaacatgtagagagagttatctagcaaacacatccatgtacccatcacccagaaattcaaattgtccacattttgtcatatttctttcaagattttttttaagacataagatttttaaatggtttgtaatgttgaaatttcttttgtcgtccatgcctgatccacctcctcccctcctcattctggtgaacatcattaaaggtatggattccaagtcactatttatccatgcacatgaccrtatgtttcacaagcaatttatgctatttttatatgtttactataaaatacacataatggtatcatactacttatatcattctgcagcttccttttttttttaaaaaaaagcatctctatgttttgagctctatgttaaaatataaaaatctaatcaatttcttttattagctatgtagcattttgccatatgaataaaataatttcttatgccttctcctatatttgttgatggacattaagattgttacaaacaataccttgataaacatgcttatacaagtttctagtcctcatacac

SEQ ID NO: 155585 - DNA, 601 bp, Human
catcacccagaaattcaaattgtccacattttgtcatatttctttcaagattttttttaagacataagatttttaaatggtttgtaatgttgaaatttcttttgtcgtccatgcctgatccacctcctcccctcctcattctggtgaacatcattaaaggtatggattccaagtcactatttatccatgcacatgaccatatgtttcacaagcaatttatgctatttttatatgtttactataaaatacacataatggtatcatactacttatatcattctgcagcttccttttttttttwaaaaaaagcatctctatgttttgagctctatgttaaaatataaaaatctaatcaatttcttttattagctatgtagcattttgccatatgaataaaataatttcttatgccttctcctatatttgttgatggacattaagattgttacaaacaataccttgataaacatgcttatacaagtttctagtcctcatacacacgttcaaatttttctaaggtgtttacctagaagtgtaatgtctgggtggcatactaagtgcatgtttaatattaatgcaaattgacaaattactttctgaa

SEQ ID NO: 155586 - DNA, 601 bp, Human
tatattctatgtgcttcatgtaatcaaagtgacctagacaaaatccctgcccttatgaaccttacattctagtggcaggaaatactataatgccagggagaagggagagagaaatgagaatgaagaaaaatgatgcagtgatgcatagccctctctatctctttgggatacagagagggggcgtgtgttgtggggaggaggtgggggctctattataaaaaatatggcctgagaaactgcatgaggaagagtcatcatgatttgatacatggagatagagaaaaccacagtgtcagggctcccaaaaaaaaaaatcacttccattttgggaggtaatttcagcttctttgtatttgatttggggcagtatataagtcttgggaaaaaaagaagtgactaaagcttttattttagatgaggaggacttaatgaatttgtaaaatatgctcccttttgtggggagaagtacagcagtttgcacgttgggagaacagctggctccaatacagcttggtggtgggcttcgactgaactggtcatcgcctaagtattttgtgtatttctgattacctatctctccaggagcccacgtgagcaagac

SEQ ID NO: 155587 - DNA, 601 bp, Human
ttatgaaccttacattctagtggcaggaaatactataatgccagggagaagggagagagaaatgagaatgaagaaaaatgatgcagtgatgcatagccctctctatctctttgggatacagagagggggcgtgtgttgtggggaggaggtgggggctctattataaaaaatatggcctgagaaactgcatgaggaagagtcatcatgatttgatacatggagatagagaaaaccacagtgtcagggctcccaaaaaaaaaaatcacttccattttgggaggtaatttcagcttctttgtatttgatttggggcagtatataagtcttgggaaaaaaagaagtgactaaagcttttattttagatgaggaggacttaatgaatttgtaaaatatgctcccttttgtggggagaagtacagcagtttgcacgttgggagaacagctggctccaatacagcttggtggtgggcttcgactgaactggtcatcgcctaagtattttgtgtatttctgattacctatctctccaggagcccacgtgagcaagacaggtcttcaagctggttcaatgctcccattctgtaggcaactacaaactgtg

SEQ ID NO: 155588 - DNA, 601 bp, Human
gtggtgggcttcgactgaactggtcatcgcctaagtattttgtgtatttctgattacctatctctccaggagcccacgtgagcaagacaggtcttcaagctggttcaatgctcccattctgtaggcaactacaaactgtggctcactgcatgacttaacaacaactgattgagaattgtaaagtgcagcctcgagttcatgtgtagaaactgccatctgcacaaacaaaacattgagaggactaagattttaaggatactaatgcagacgtccttcttgcttcatttatttaaaaatatcyatttcacgttcctaacagcatctagtagatgtttcttgcttcttccccctaacgccggactaaagagaaaaaaaaaataggctgttttctggtctggttttgttttcctagtcaagtacttaaattacgggtgtttcgtaagtatcttttgatggatttcattgttttgtttatttcgcgttagacaatacagacaccttcatatttccttctgtagcaaatctttttcaaagtcttcatttgacgtggctgatggagctggtctgcagatcttgcagacgtgttaatttttgcacggac

SEQ ID NO: 155589 - DNA, 601 bp, Human
acttggtatccggaatgtgacattggttttacacgtcggtaggtttttgtcctaaatttctgggaagttacttcctcatctaacgttttattttcctgacttattcgtctttgatatgctacagaaaacccctctcgcccagtggctgttttctctctgtctcttaagataatttaggaacagaagccttgacttttgacggtcatttagttttattctcctcccgtgactcccctctgtacactcacaggggaggccgccggcatctgggctgaaagaacccttggcgggcgaggagagsagggtgtcatgttggcgacaggctcctgctggcggccagcgagcccgccaggttaacgggggcgccggggtcagcgccctcgaagttgggggcctcgggcggggccgccggggagccacgacggccgctcgaccagagcatcccgcagtcccgttccctccagaggggaagaatggccgaatctggcacgatcccacggagatctcgctcttcccagcgcagtctccgctactgagcgcgggaccaacgcaggcgatgccgggcggccgacagggaaagcccagacctggggcagagaag

SEQ ID NO: 155590 - DNA, 601 bp, Human
ttattcgtctttgatatgctacagaaaacccctctcgcccagtggctgttttctctctgtctcttaagataatttaggaacagaagccttgacttttgacggtcatttagttttattctcctcccgtgactcccctctgtacactcacaggggaggccgccggcatctgggctgaaagaacccttggcgggcgaggagagcagggtgtcatgttggcgacaggctcctgctggcggccagcgagcccgccaggttaacgggggcgccggggtcagcgccctcgaagttgggggcctcgggmggggccgccggggagccacgacggccgctcgaccagagcatcccgcagtcccgttccctccagaggggaagaatggccgaatctggcacgatcccacggagatctcgctcttcccagcgcagtctccgctactgagcgcgggaccaacgcaggcgatgccgggcggccgacagggaaagcccagacctggggcagagaaggaatgaggggccgccagccggggggatttcctcccgctcttccctctccaacgggagcggaaaatgtgatttgctgtgcattccaggcgcggttccctgg

SEQ ID NO: 155591 - DNA, 601 bp, Human
ttagttttattctcctcccgtgactcccctctgtacactcacaggggaggccgccggcatctgggctgaaagaacccttggcgggcgaggagagcagggtgtcatgttggcgacaggctcctgctggcggccagcgagcccgccaggttaacgggggcgccggggtcagcgccctcgaagttgggggcctcgggcggggccgccggggagccacgacggccgctcgaccagagcatcccgcagtcccgttccctccagaggggaagaatggccgaatctggcacgatcccacggagatctygctcttcccagcgcagtctccgctactgagcgcgggaccaacgcaggcgatgccgggcggccgacagggaaagcccagacctggggcagagaaggaatgaggggccgccagccggggggatttcctcccgctcttccctctccaacgggagcggaaaatgtgatttgctgtgcattccaggcgcggttccctggggtgacctctcccagccggcccgggcggggggagcagacaaagaggcgaggcgggcggagaggggaccccgcggggaagcaggaggggtgcggggggcgggggcag

SEQ ID NO: 155592 - DNA, 601 bp, Human
gtcttggggcgcccattggagtccgcgggttggagcatccggagaatccatgatgtgtgcatttgccgatccccgaggtgagatggagactggcaagggcagagccgctgtgttcagccacagcggaaaaccgaacggtgggtaatccgacagctgcggtgcggggcgcggccctggccgcggggtccagcgaacccgcagtgctcacaaggcagacaccacacgcgctcgcggaccggccacgcactcgcgggcgctcgcttctctactccagcctcttccccgccccgcgcacgcccgrgctgaatggtagacgttctggcgccgggcagcggccaccggctggttcccacttccgcgcgcaccccttaaactgtgttctagaggccccagcctcgccttgcagcgcctcactagctcctgaggactagggactggcggctgaggcgggttggcggctgcaacgagctgggcgtctttcgttctctctcgctgcctggctggctccgctggcccctccacagcttgcggagcaaggccatagcaggggagtgggaggtatattggggctgtcacctccttgctggccggagttatttgt

SEQ ID NO: 155593 - DNA, 601 bp, Human
ccctccacagcttgcggagcaaggccatagcaggggagtgggaggtatattggggctgtcacctccttgctggccggagttatttgtagactacagactccggaagaacagacgcgccaccgctctcgcttggcattgccttcggatcgcagctcctccttgggggtgccccagcttggcgtttatttgcctgcgccaggctctggcgacggtcaccgggccaggcggggagggacggacggcaggtgaccagcctctgctgtgaagaaattcctgcgcgcccggagctgtccctaatgcrttcccgggtcgaatccgtctactgccttcccctcctcgaccgactccgaatctcggctcttatagacagaaatacagcctcagcgttaggggttaaaatccccctcttaaacggtccgagggcagagaggtgaccaccgataggtaattggatctcctgctggaaagagcaaatctgagcggtgtgcgcgtctgtttatgttccccttcgagatggtgccaggacacgaactgattaaaacaatctattgtgttaagtgggtcactagggttttaagctgtcccagggaccccagagtag

SEQ ID NO: 155594 - DNA, 601 bp, Human
cccagagtagtggcttccttctggctgtacacacaagttaaataaatagcgtagaagaggttaagataaccccattctagggtgaggagtcctctttcatccctagggcttccccctccccttttctctttttttggaaggagggggagcatgagagtcttgagggggggatgtacttttcaaagcaaggagggaaagatcttaagaaaactatatattctcactgccccccaagccaagtctataacagtaggtgatttgattactatctctggataaatggcactgtcaaattgttaayattaactatttcagggatttttagcagggtagtggcagtatgtgtgcgtgtgtgtgtgtgtgtctgtgtgtgtgtgtttaacctccaggtcattgtaggaattagagtcttttgtaaactttgtaatttcacaggtttcctattttcttaaaagttcatttttagtgaaatgttttggtaacccacgctctgtaggaaatccaggttggctaatgcggtctttatgtgagtagttacacagggaaggataaaaaccttttatgtcctacatctctgaatgagggctgcctaccctgtctt

SEQ ID NO: 155595 - DNA, 601 bp, Human
aatagataattattttatttatagcactcttcaaattgtattgcattagaaaacatatccattgacccactgttaaggacagcactgggtgtcaataggacagtggttaaggacctgtgtttggggctagatagaattgggtttaaactgctggctgggctgggcacagtggctcacaccggtaatcccagcactttgggaggccaaggaggacggatcacctgaggtcgggagttcgacaccagcctgaccaacatggaaaaatcccgtctctactaaaaacacaaaattagccaggcawggtggtgcatgcctgcaatcccagctacttgggaggctgaggcaggagaattgcttgaaaccgggaggcggaggttgtggtgagcccagatagcgccattgcattccagcctgggcaacacgagtgaaaactccgtcaaaaaaacaaaacaaaacaaacaaacaaaaaaatgctggctttcccacttatgagctgtgtgaccttggacaaatttccaacttttctgagtgtagattccctgattggtaaaaggaagatgatattatctacctcatattttgttatgaaaaataaatgata

SEQ ID NO: 155596 - DNA, 601 bp, Human
aggaagatgatattatctacctcatattttgttatgaaaaataaatgataaaattgggtcagaaatcagcataatgcctggcacagtaagggcttcaaaataaaaggtagctcttattattagtaatggtgttaggaaaagtagcaatgttatacagaaccaggatatatcacagggcagttctgaaattaaatcctgaatcctggccgggtgaggtggctcacgcttgtaatcctaagcactttcggagactgaggcaggcggatcacgaggtcaggagtttgagaccagcctggccaasacactgaaatcccgtctctactaaaaatacaaaaattagctgggtgtggtggcaggcgcctataatctcagctacttgggaggctgaggcaggagaatcacttgagcccaggaggcggaggttgcagtgagctgatatcgtgccagtgcactccagcctgggtgacatctcttaaaaaaaaaaatcctgaataccacactacgcagtgactaacacatctttcactacagaacagaacctgtaacttggccgtctctcagcagtgctgctcagtgaacatttaataatttattactttct

SEQ ID NO: 155597 - DNA, 601 bp, Human
ctacagaacagaacctgtaacttggccgtctctcagcagtgctgctcagtgaacatttaataatttattactttctaactcgtttcttgttgacctcaagaattgtacatagtcattaactttcctaagaaaatctttgacaaacatagagctcctgagatatttcacaaccaggtggtctcctccctgtcctatgcaatgttgggccccagcctgatttagccgacctggtcttcagacttgagaggctgtttagggttcttacaacacaaaggggatgagactttatcctctacctgtstgccaacaagggattcttcttatctccttggtgcaacttgtctgaaaaagaaagtcaacacaattatcttcttaaaagttaaagatcaaattaaaaataagctatagttttcccaaagatttagacctgagaaaaaggaatagatctttctaaaacctggcctgcacttagagcatttgtagtcacttccactatttcttatgctgagagaataatttgatgtcatgcctattgaatgtctttctaaagcttgattcatcaggaggaactgaccagaagtccatgcacagacatttggct

SEQ ID NO: 155598 - DNA, 601 bp, Human
aagcatgctgtagagaggacctgctttgagagtatgtgtcctctgggacaagtggaatgaaagagaggatagaggcaaagagaaaaaaaggtggagatggggtgagacttgctggtggacagttgcaaagaaaactcatgatgagaataacatcacatttcttgaagaagctgaactgcattgatgggaagttgaggcagagtttgaaaagaagatatactgtctgcaaaaaagaatcaacggagatgtcaggtatcttgatgcaccctgagtctatgagatgcagcttaatttaatttartgatatgagtaggccatttcataagtggtggaaattaccataaagtgtttgcagctaatgacggcgcatgaatgatgtcataggaacctaagtctggatgagctatggattgaatttttactatgggacacccttctacatgttgctgtggaaaagaattgtcctcaagaaatgtacatcttctgcatttcctctacatctctgatatttacaaagtgcacattatttggtgatactacaactgggatttcaagtgcacatcactactatttccttcactgaagaatcaagagcagtctg

SEQ ID NO: 155599 - DNA, 601 bp, Human
gcagagtttgaaaagaagatatactgtctgcaaaaaagaatcaacggagatgtcaggtatcttgatgcaccctgagtctatgagatgcagcttaatttaatttaatgatatgagtaggccatttcataagtggtggaaattaccataaagtgtttgcagctaatgacggcgcatgaatgatgtcataggaacctaagtctggatgagctatggattgaatttttactatgggacacccttctacatgttgctgtggaaaagaattgtcctcaagaaatgtacatcttctgcatttcctctrcatctctgatatttacaaagtgcacattatttggtgatactacaactgggatttcaagtgcacatcactactatttccttcactgaagaatcaagagcagtctgggggtggggagagcttgagtgattgacaaggatgtggcagagccctggttccactatgaattatagttcttaccctgcttactgtcactcatgtagagcagctagtgtgcctcagagcactgctgttctctgagaagctgaggtctcgattgacattcttgaagttggtgtttacttctctctgaataaacaaagg

SEQ ID NO: 155600 - DNA, 601 bp, Human
actctagaccctttggcttagaaggtaggcacactcacatagaaacagaaagtctgtccaaattaaaactgaaaaccacagttgactaattttgaatttatagctctgctgttggcttctgcgatagtattaatttcaatggcttcaattagaaaatgaaacccatagcattccatatgagaacaggtaaaaagtcagggacatttggagttttccaagaaaaagaaagacaagtcttaggaagctctctaggatggaaggaatttgccacactgagagttagacatccaaaggatagcarttggctcttctgctcatgggcactggtgaaggcattttaaaatgcgaagaatggtacctctgtaaatcaatgaggttcataataatcatgcatttaccaaatttttataagcacctgccttgtgccaggcactgagggtaaggtgatgaataagccctcatcaactgtcagactagatatttactcaataacagatgtgaaaatgccaagaaggaaaagttgagtataaagaaagccttaagttggttcagagaaataaaattgcatttttcggatagatgtttatggaatcggccttat

SEQ ID NO: 155601 - DNA, 601 bp, Human
tggtgaaggcattttaaaatgcgaagaatggtacctctgtaaatcaatgaggttcataataatcatgcatttaccaaatttttataagcacctgccttgtgccaggcactgagggtaaggtgatgaataagccctcatcaactgtcagactagatatttactcaataacagatgtgaaaatgccaagaaggaaaagttgagtataaagaaagccttaagttggttcagagaaataaaattgcatttttcggatagatgtttatggaatcggccttatgaggtaaacttgtcctatgcagtsaacatacattcccagttagtctcagattggcctctgtgatgacaaactcagagggtcctggtctaggaggggtgaatttgtctggaggccattttcaggaggtatggaggaagactggggcataggcctggggccatcccatgtactcctcctctgaaatggggagcaactgaattgtgttttattttagatcttcgtccaacttgaataccagaaattcgtgaaaccttctcaaattcacactatattttgagaccaggagaaggctccttgagaaattgccacactgtcttatcctag

SEQ ID NO: 155602 - DNA, 601 bp, Human
tctctctctgtctatggtttcctattttttgtcggttttccctcacctcacctccttgttattttttgccattgttcacatatcactgccctttcagacccatatctagcttctgacccatccactaatccattgccactaatttattcagcatgcccatgccatttattaatgtaaatatttgcacatacttgttctatcatgcccatttttctaccttttaaattgtatatacacagacacatgtgaatgacatatttcactatttaaaaggtagaaaaatgtatatcgtggtacaaaatgatacattgagtatctgtgcccagtttcaagatgagaataagtgagaggtgaagcctcatgagtcacgtcacctacacgctactgtctttcattccatctgcagtactgccacacatttggttagttctccaattgctgtcacattgacatcgagttggatctgaacagcgtacctggggagacgaagtattggtatctttgcttaaatggagtgatttactgagagacaaagtgacatctttaagatcagatagcaagttactgcaccaggagcgcgacctttcctgttttgttgttt

SEQ ID NO: 155603 - DNA, 601 bp, Human
agacaaagtgacatctttaagatcagatagcaagttactgcaccaggagcgcgacctttcctgttttgttgttttccctctgtcaaatgccttctggtctccatgaatctctccttccacatatgataaaaatgcaaagtctcataagcattcacagctcaggaagcctcaggctagttggggagaaaagactgggaggtttccggaggaatgaagtcctctgagcagagaggttaattcatcttgctgtaaaacaaaatagaaaataagttcccctcaataagtgaacgtaatacaaagwcaaatgtggttggtgccagaggccaggaagaagttcttgtgagaataggtgcagagaagagctaggccctggctgagtttaaaccttgacttagtcactgtgggactctgggtgagttactccatggattgatggctgggtcatggagataatagtacctaattcatacaggtactgtgagaagtaaatggaatatttcacgttaagtgtttaacggtgcgtttaaatgctaggtgctattattattaatttttaaattaactttgccatgttttgtgtcttcccctctctgtgcttcct

SEQ ID NO: 155604 - DNA, 601 bp, Human; identical to SEQ ID NO: 37006

SEQ ID NO: 155605 - DNA, 601 bp, Human; identical to SEQ ID NO: 37007

SEQ ID NO: 155606 - DNA, 601 bp, Human; identical to SEQ ID NO: 37008

SEQ ID NO: 155607 - DNA, 601 bp, Human; identical to SEQ ID NO: 37009

SEQ ID NO: 155608 - DNA, 601 bp, Human; identical to SEQ ID NO: 37010

SEQ ID NO: 155609 - DNA, 601 bp, Human; identical to SEQ ID NO: 37011

SEQ ID NO: 155610 - DNA, 601 bp, Human; identical to SEQ ID NO: 155511

SEQ ID NO: 155611 - DNA, 601 bp, Human; identical to SEQ ID NO: 155512

SEQ ID NO: 155612 - DNA, 601 bp, Human; identical to SEQ ID NO: 155513

SEQ ID NO: 155613 - DNA, 601 bp, Human; identical to SEQ ID NO: 155514

SEQ ID NO: 155614 - DNA, 601 bp, Human; identical to SEQ ID NO: 155515

SEQ ID NO: 155615 - DNA, 601 bp, Human; identical to SEQ ID NO: 155516

SEQ ID NO: 155616 - DNA, 601 bp, Human; identical to SEQ ID NO: 155517

SEQ ID NO: 155617 - DNA, 601 bp, Human; identical to SEQ ID NO: 155518

SEQ ID NO: 155618 - DNA, 601 bp, Human; identical to SEQ ID NO: 155519

SEQ ID NO: 155619 - DNA, 601 bp, Human; identical to SEQ ID NO: 155520

SEQ ID NO: 155620 - DNA, 601 bp, Human; identical to SEQ ID NO: 155521

SEQ ID NO: 155621 - DNA, 601 bp, Human; identical to SEQ ID NO: 155522

SEQ ID NO: 155622 - DNA, 601 bp, Human; identical to SEQ ID NO: 155523

SEQ ID NO: 155623 - DNA, 511 bp, Human; identical to SEQ ID NO: 155524

SEQ ID NO: 155624 - DNA, 451 bp, Human; identical to SEQ ID NO: 155525

SEQ ID NO: 155625 - DNA, 601 bp, Human; identical to SEQ ID NO: 155526

SEQ ID NO: 155626 - DNA, 601 bp, Human; identical to SEQ ID NO: 155527

SEQ ID NO: 155627 - DNA, 601 bp, Human; identical to SEQ ID NO: 155528

SEQ ID NO: 155628 - DNA, 601 bp, Human; identical to SEQ ID NO: 155529

SEQ ID NO: 155629 - DNA, 601 bp, Human; identical to SEQ ID NO: 155530

SEQ ID NO: 155630 - DNA, 601 bp, Human; identical to SEQ ID NO: 155531

SEQ ID NO: 155631 - DNA, 601 bp, Human; identical to SEQ ID NO: 155532

SEQ ID NO: 155632 - DNA, 601 bp, Human; identical to SEQ ID NO: 155533

SEQ ID NO: 155633 - DNA, 601 bp, Human; identical to SEQ ID NO: 155534

SEQ ID NO: 155634 - DNA, 601 bp, Human; identical to SEQ ID NO: 155535

SEQ ID NO: 155635 - DNA, 601 bp, Human; identical to SEQ ID NO: 155536

SEQ ID NO: 155636 - DNA, 601 bp, Human; identical to SEQ ID NO: 155537

SEQ ID NO: 155637 - DNA, 601 bp, Human; identical to SEQ ID NO: 155538

SEQ ID NO: 155638 - DNA, 601 bp, Human; identical to SEQ ID NO: 155539

SEQ ID NO: 155639 - DNA, 601 bp, Human; identical to SEQ ID NO: 155540

SEQ ID NO: 155640 - DNA, 601 bp, Human; identical to SEQ ID NO: 155541

SEQ ID NO: 155641 - DNA, 601 bp, Human; identical to SEQ ID NO: 155542

SEQ ID NO: 155642 - DNA, 601 bp, Human; identical to SEQ ID NO: 155543

SEQ ID NO: 155643 - DNA, 601 bp, Human; identical to SEQ ID NO: 155544

SEQ ID NO: 155644 - DNA, 601 bp, Human; identical to SEQ ID NO: 155545

SEQ ID NO: 155645 - DNA, 601 bp, Human; identical to SEQ ID NO: 155546

SEQ ID NO: 155646 - DNA, 601 bp, Human; identical to SEQ ID NO: 155547

SEQ ID NO: 155647 - DNA, 601 bp, Human; identical to SEQ ID NO: 155548

SEQ ID NO: 155648 - DNA, 601 bp, Human; identical to SEQ ID NO: 155549

SEQ ID NO: 155649 - DNA, 601 bp, Human; identical to SEQ ID NO: 155550

SEQ ID NO: 155650 - DNA, 601 bp, Human; identical to SEQ ID NO: 155551

SEQ ID NO: 155651 - DNA, 601 bp, Human; identical to SEQ ID NO: 155552

SEQ ID NO: 155652 - DNA, 601 bp, Human; identical to SEQ ID NO: 155553

SEQ ID NO: 155653 - DNA, 601 bp, Human; identical to SEQ ID NO: 155554

SEQ ID NO: 155654 - DNA, 601 bp, Human; identical to SEQ ID NO: 155555

SEQ ID NO: 155655 - DNA, 601 bp, Human; identical to SEQ ID NO: 155556

SEQ ID NO: 155656 - DNA, 601 bp, Human; identical to SEQ ID NO: 155557

SEQ ID NO: 155657 - DNA, 601 bp, Human; identical to SEQ ID NO: 155558

SEQ ID NO: 155658 - DNA, 601 bp, Human; identical to SEQ ID NO: 155559

SEQ ID NO: 155659 - DNA, 601 bp, Human; identical to SEQ ID NO: 155560

SEQ ID NO: 155660 - DNA, 601 bp, Human; identical to SEQ ID NO: 155561

SEQ ID NO: 155661 - DNA, 601 bp, Human; identical to SEQ ID NO: 155562

SEQ ID NO: 155662 - DNA, 601 bp, Human; identical to SEQ ID NO: 155563

SEQ ID NO: 155663 - DNA, 601 bp, Human; identical to SEQ ID NO: 155564

SEQ ID NO: 155664 - DNA, 601 bp, Human; identical to SEQ ID NO: 155565

SEQ ID NO: 155665 - DNA, 601 bp, Human; identical to SEQ ID NO: 155566

SEQ ID NO: 155666 - DNA, 601 bp, Human; identical to SEQ ID NO: 155567

SEQ ID NO: 155667 - DNA, 601 bp, Human; identical to SEQ ID NO: 155568

SEQ ID NO: 155668 - DNA, 601 bp, Human; identical to SEQ ID NO: 155569

SEQ ID NO: 155669 - DNA, 601 bp, Human; identical to SEQ ID NO: 155570

SEQ ID NO: 155670 - DNA, 601 bp, Human; identical to SEQ ID NO: 155571

SEQ ID NO: 155671 - DNA, 601 bp, Human; identical to SEQ ID NO: 155572

SEQ ID NO: 155672 - DNA, 601 bp, Human; identical to SEQ ID NO: 155573

SEQ ID NO: 155673 - DNA, 601 bp, Human; identical to SEQ ID NO: 155574

SEQ ID NO: 155674 - DNA, 601 bp, Human; identical to SEQ ID NO: 155575

SEQ ID NO: 155675 - DNA, 601 bp, Human; identical to SEQ ID NO: 155576

SEQ ID NO: 155676 - DNA, 601 bp, Human; identical to SEQ ID NO: 155577

SEQ ID NO: 155677 - DNA, 601 bp, Human; identical to SEQ ID NO: 155578

SEQ ID NO: 155678 - DNA, 601 bp, Human; identical to SEQ ID NO: 155579

SEQ ID NO: 155679 - DNA, 601 bp, Human; identical to SEQ ID NO: 155580

SEQ ID NO: 155680 - DNA, 601 bp, Human; identical to SEQ ID NO: 155581

SEQ ID NO: 155681 - DNA, 601 bp, Human; identical to SEQ ID NO: 155582

SEQ ID NO: 155682 - DNA, 601 bp, Human; identical to SEQ ID NO: 155583

SEQ ID NO: 155683 - DNA, 601 bp, Human; identical to SEQ ID NO: 155584

SEQ ID NO: 155684 - DNA, 601 bp, Human; identical to SEQ ID NO: 155585

SEQ ID NO: 155685 - DNA, 601 bp, Human; identical to SEQ ID NO: 155586

SEQ ID NO: 155686 - DNA, 601 bp, Human; identical to SEQ ID NO: 155587

SEQ ID NO: 155687 - DNA, 601 bp, Human; identical to SEQ ID NO: 155588

SEQ ID NO: 155688 - DNA, 601 bp, Human; identical to SEQ ID NO: 155589

SEQ ID NO: 155689 - DNA, 601 bp, Human; identical to SEQ ID NO: 155590

SEQ ID NO: 155690 - DNA, 601 bp, Human; identical to SEQ ID NO: 155591

SEQ ID NO: 155691 - DNA, 601 bp, Human; identical to SEQ ID NO: 155592

SEQ ID NO: 155692 - DNA, 601 bp, Human; identical to SEQ ID NO: 155593

SEQ ID NO: 155693 - DNA, 601 bp, Human; identical to SEQ ID NO: 155594

SEQ ID NO: 155694 - DNA, 601 bp, Human; identical to SEQ ID NO: 155595

SEQ ID NO: 155695 - DNA, 601 bp, Human; identical to SEQ ID NO: 155596

SEQ ID NO: 155696 - DNA, 601 bp, Human; identical to SEQ ID NO: 155597

SEQ ID NO: 155697 - DNA, 601 bp, Human; identical to SEQ ID NO: 155598

SEQ ID NO: 155698 - DNA, 601 bp, Human; identical to SEQ ID NO: 155599

SEQ ID NO: 155699 - DNA, 601 bp, Human; identical to SEQ ID NO: 155600

SEQ ID NO: 155700 - DNA, 601 bp, Human; identical to SEQ ID NO: 155601

SEQ ID NO: 155701 - DNA, 601 bp, Human; identical to SEQ ID NO: 155602

SEQ ID NO: 155702 - DNA, 601 bp, Human; identical to SEQ ID NO: 155603

SEQ ID NO: 155703 - DNA, 601 bp, Human; identical to SEQ ID NO: 37006

SEQ ID NO: 155704 - DNA, 601 bp, Human; identical to SEQ ID NO: 37007

SEQ ID NO: 155705 - DNA, 601 bp, Human; identical to SEQ ID NO: 37008

SEQ ID NO: 155706 - DNA, 601 bp, Human; identical to SEQ ID NO: 37009

SEQ ID NO: 155707 - DNA, 601 bp, Human; identical to SEQ ID NO: 37010

SEQ ID NO: 155708 - DNA, 601 bp, Human; identical to SEQ ID NO: 37011

SEQ ID NO: 155709 - DNA, 601 bp, Human
actatatgagaaataatcattaaatactaataagctttgaagttctcttacaggcccacttgaatactcagaatagctttgcaaggttagtgggaggatctttattacggataaagtagatgggtgatttgcctaatttagagtgatgttattaatcacaaatagcatttttagacttcctgaaatgtaccttttccatcttgcaaatagatcttgacgtattgtcctttcccaaagcaattctaaatttgagtatctaacattagcaaagtatttcaaattctttcaaggtttcattacttttttttttttttttcaggtgtccagtgatttggagaatattgacacaggagttaattctaaagttaagagtcatgtgactattaggcgaactgttttagaagaaattggaaatagagttacaaccagagcagcacaagtagctaaggtaacaatgatgaagactgaatgtgaatacagaggccgattctgtatagtgctgagtcccacaacgctggctgtcttgcgctattcatgtttctttttccttatagaaagctcagaacaccaaagttccagttcaacccaccaaaacaacaaa

SEQ ID NO: 155710 - DNA, 601 bp, Human
tctgaaggcaaggaacagatttgtcagctttcttcacagagatgatggttgaaagctctttgctctttatgagaactaaagcttagaaaaagtagttgagatgggacttcatttaaaaagccttccctagaaggtttctataacagtgacctcctgaaagccaaacccaaaggctggttttcagaccttgatctcttagcagttgtgcagtgttttacatgtgtaatggtttgaatgtggttcctcccacatcgcaggagggcgatttggcagtatatgtatatatttttggggggggacrgagtcttgctctgtcgcccaggctgcagttcagtggctcgatctctgctaactgcaacctccgcctcccgggttcaagcgattctcctgtctcagcctcccgagtagctgggattacaggtgcatgctaccatgcccagctgattttcactatgttggcctggctggtctccaactcttgacctcaggtgatccacctgcccccgcccctcaaagtgctgggattacaggtgtgagccactgcgcctggcggtagtatatttcaaatggttattctccatacccagtagctttgtttttt

SEQ ID NO: 155711 - DNA, 601 bp, Human
gattacaggtgcatgctaccatgcccagctgattttcactatgttggcctggctggtctccaactcttgacctcaggtgatccacctgcccccgcccctcaaagtgctgggattacaggtgtgagccactgcgcctggcggtagtatatttcaaatggttattctccatacccagtagctttgttttttatccaaagaaaatgatcagagggataatcaagtacttttagatagtgctatgatgagtgtctcttatagagtagagaaataccctagttaaatccatttaaggaaatactaygcagccataaatatcatgttttagtagaatatttaaaggcatcaaaatgcttgtaacattaagtggaaaaatcagattataacaatatataaacagtgcaaccccagatttgcttttaaaatgtacatttgtatgcagaatattgatggtagttatttttgaatattatgttggacttaagattgactttcattttcttccttaaaacgtcaaactttggccgggtgcagtggctcacgcctgtaatcccagcactttgggaggccgaggcgggcggatcgcgaggtcaggagatcgaga

SEQ ID NO: 155712 - DNA, 601 bp, Human
cacatactatataaactatagaattttagaagtataggtattatgagaaaaaacagaataatacacatataaactatagaatttagaagtataggctttatgagaaaaaacagaataatacacatattaactatagaattttagaagtataggttttatgagatgagacatatgggtagggtaggaggacagggattggaggcaggtgataattttgttttttgtttatttggttggttttgaggcggagtcttgttccgtccagcccaggctggagtgcagtggcgtgatcttggctcaytgcaacctctgcctcagcctcctgagtagctgggactacaggggcgcaccatcacgcccagctagtttttgtatttttaaagtagagatggggttttgccatattggccaggctggtcttgaactccggggctcaagccatccacctgccttggcctcccaaagtgctagaattacaggcgtgagccaccgtgcatggcctgataattttaaataggagttaggatagaccccattgagaatgtaacatttaagtaaaacttgaagtaagggaattacccatatggacataggggcaaga

SEQ ID NO: 155713 - DNA, 601 bp, Human
atatggacataggggcaagagcattctgggtaagaagaacctggcttgagtgaagcagtcaagggagagaagcaggagatgggtcagcgagggaactggggagggccagattatataaggtctgtaggccattgggaggacttaagttttcagtttgagtgaaattagagagttttaaacagagaagtgtctcttgaagaacttcacatactatatcttgaattattcacctcttggtatgaaatttgttgtgtctttaacatatttcagatgtgcgtatgatattgatatttaagccagytggctctgcatgtatttatggttaaggctgctcctacatgtgcctaaatttgttggtgtagggtccttctcccacacctgaggatgtctccatgaaggaagagaatctctgccaagctttttctgatgccttgctctgcaaaatcgaggacattgataacgaagattgggagaaccctcagctctgcagtgactacgttaaggatatctatcagtatctcaggcagctggaggtaggtgggcctttgtgttttggttgtataagcaatgtggaatttaccacacagctgggaagcaaaca

SEQ ID NO: 155714 - DNA, 601 bp, Human
actttaaattgtaattaagtggaaataaacaatgtaactacatgtgaaattggtaacagaacacagaggaaagaattaatttaagtacttgttgcttgagcccagcctgggtagcgtagcaagacccccatctctataaaaaattaaaaaattagctgggtatggtggcacacacctgtagtcctagttactcaggaggctgaggcaggaggattgcttgagcccaggagttcaaggctgaagtagctatgatcctgccagtgcactccaacctgggcaacagagcaaaaccctgtctccaaaaaaaaaaaaaaaaacaaatctgtaacctgaacacagcattctgactgtgcatccttagtgggatttaaagtatgacaaaataaaggactaaagtggtaacatcaagtttacttagtaggttcattgttaatagtaatctgttattataattttggaactagtttatgtgtattgtaggataaaacaaatttattcatgttattaaggactaaaattttcaatataggaagagttttaaattattaattcattaattttttcttatacagggtcttgctttgtcatccaggctggagtg

SEQ ID NO: 155715 - DNA, 601 bp, Human
ctcccaaagtgctgggattacagacgtgagccactgtgcctggcctaagagagaaaatattaacaattaaaaacaaaaggttagtcctcacgtaggaaatagcaaaacaaaaacaaaggaaaacccctattatgttttggaaataacagcaaattcataataaagggtctcagaaacagtgacaactcagtagtagtgagcatatttagtgcccacatcttggatactaaataccattatctactggcaactagggctgtttagtgaaattgctgatttcagggctatggcaggggaagtmcaaggtgagcctagaacaatttgtgccagatagcacacaaattctcaaagatcaatgaggtcacatcaaaaggacataggagagctggtcatggtagcatgtgcctatagtcccagatactcaggaggctgaggcaggatcccttgagcccaggagttggaggctgcattgacctatgattgcaccacaataaaataggaaggaagggaaggagggagataggaactggcttgaaaggactctggctgactgaattagagcattaaaaagaataatgacagtaatagattatagtgtata

SEQ ID NO: 155716 - DNA, 601 bp, Human
ggaaaacccctattatgttttggaaataacagcaaattcataataaagggtctcagaaacagtgacaactcagtagtagtgagcatatttagtgcccacatcttggatactaaataccattatctactggcaactagggctgtttagtgaaattgctgatttcagggctatggcaggggaagtacaaggtgagcctagaacaatttgtgccagatagcacacaaattctcaaagatcaatgaggtcacatcaaaaggacataggagagctggtcatggtagcatgtgcctatagtcccagmtactcaggaggctgaggcaggatcccttgagcccaggagttggaggctgcattgacctatgattgcaccacaataaaataggaaggaagggaaggagggagataggaactggcttgaaaggactctggctgactgaattagagcattaaaaagaataatgacagtaatagattatagtgtataaaaaaaaggattcctgggaccataatgacataaaaaataaaagaggggttcatttttaaaaatcagaataccagctaattaaagtagaatgatagagttagaaaccactaattttca

SEQ ID NO: 155717 - DNA, 601 bp, Human
tggtttccaccttcacccagtgattaagctcagcattaccactggcagacgacctgagttgccatgccgtgttgtgcagtaagatgtatacattatcacctattcatgcccaaaatgtttgacatgaattaaatcttgaggaaatatgcaaatccagaatgtgagacattttaaaaggaactgcctcgatgcttaaaaaaaaaaagtcactggtgacagtgtttcttatgtgagaatggtgttatggataggtacgaaaacgtactttttagaatatgcttctgaaacatttagcagggawgtgctgtgatatctgcaaatcgctttcaaatggcatagcaaaaattgtgtgtgagtatacacagagagggagaggagggaaacgtggcacatgttcatgattgatcagtctacatgaaggatatatagaggatcattctttcagtttttctgtagatttggaattttttgaaataaataaaacatttgaggcaaaaatgtcactggtacatggtaccaatggctcatttttagtcaccttactcttaaatgtgcttcgctctcccagttttctgagaatttatttcaaaaggctagaaat

SEQ ID NO: 155718 - DNA, 601 bp, Human
tggtgacagtgtttcttatgtgagaatggtgttatggataggtacgaaaacgtactttttagaatatgcttctgaaacatttagcagggaagtgctgtgatatctgcaaatcgctttcaaatggcatagcaaaaattgtgtgtgagtatacacagagagggagaggagggaaacgtggcacatgttcatgattgatcagtctacatgaaggatatatagaggatcattctttcagtttttctgtagatttggaattttttgaaataaataaaacatttgaggcaaaaatgtcactggtacmtggtaccaatggctcatttttagtcaccttactcttaaatgtgcttcgctctcccagttttctgagaatttatttcaaaaggctagaaattgtgcattatttcagtttttactcgtttcctctttcttcccttcaaagtattttaggattaaattgtgtagactgggcacagtggctcacacctgtagtttcagcagttttggaggctgaggcagacagattgcttgagcccagcagtttgagaccagctgggcaacatggcgaaacctcgcctccacaaaaaaacagagaaactggctg

SEQ ID NO: 155719 - DNA, 601 bp, Human
gcttaactacacagggttcaacaagagaatcataggtagtcctagttcttctggatttgatagattgttgcttgtagcacagtttatttcttatttccgaacatctttccctgactgacagtatgtctgtttgggctcttgagctcataacagggacagctgggcagggctttgatgcagggttgtgtgagatgtggccagcactgtaaaggggcactttgttttaagtgtctccttttccatcccctttcagtgttgttacttgaaggactcttacctgtgcaacgtctttgaaagatcstatgggacctttggcacttgatttagtctggtctcagggccagaatcatcttgcatttaccagctgctttagtgttgctggtactgtgagagtggttagggctttgattgaatttccagaaggtaagaatattcttgtacagcttttacataagtaatgtcatcatgtacaagatgtgttcttctaaagaagcagaggttttctcttgcccctcagtcatgtctgtctgtctgcttcttgtgtttcagaacttaaagcagcagtattacacaggatacacagagaatgaagtattggaag

SEQ ID NO: 155720 - DNA, 601 bp, Human
agcaagcatggttaagagggaagaggcccattcagggggcatcctgagggcatggtgtctatctctgcatggcccacctatgaggaggagccaaaggagacttagtgctgtcctgtgcttgtgtgacaccaaacatcagagctcaccaagtgtgtggtggcaaagagcaaggtatttgaacctcagaagagtctcaagtgtcctcacaacatgatttgcttcatggaagtgtaatatgtgttcagtcctgagaggactgtctgggatttgttaagcactagttgccaccctcttttattgkcttttattgtcttttaattgttcctattgctgccaggcctggtgaacctgttatgtcctgatggcacttaggtgtcgtaaacacagctccccctcccatccctctggtagcctacaagaggaagcctgctacttggaccttgaaatcatttgttcctatcacctgtgctaccagctgtgttttattcattaatggggatggaaggaaatggtcaggcacatgttatgagcccagagctttcactggcttcagcgattgggcatcatcaatgtgatcatgattgtagccgtggacctttga

SEQ ID NO: 155721 - DNA, 601 bp, Human; identical to SEQ ID NO: 22841

SEQ ID NO: 155722 - DNA, 601 bp, Human; identical to SEQ ID NO: 22840

SEQ ID NO: 155723 - DNA, 601 bp, Human; identical to SEQ ID NO: 22839

SEQ ID NO: 155724 - DNA, 601 bp, Human
cgtgggaagattaaactttcattctgagcatatgactgcatcacagctttttgtttctgttcttcttgcagttaagatccttctattctacgtaatattttatggctgcctggctggcatcttcatcggaaccatccaagtgatgctgctcaccatcagtgaatttaagcccacatatcaggaccgagtggccccgccaggtaaaatccacatgaatagcttcatttccttcagagatagcatgggtgtcactttttctattgagaaaaaattctttggaaaattactctataatgtagtyttaaagcaaccatgaaaagggaaaagagaaacttctctcggctgcagccagatgtcctacccgcattgcaggcagagctcccacgggttgcagacatcttatttgcccagttctagagtgagggtgaagcgtcctggttcttggccagcctgctacccaccagctatgtgactgtgaacagattgagttctgatgggggcctctgtcttctcatttttcatattctagggtttggttagtgggatcctttccagaccttttcaactctaacagacatttttttacttcttgaggggggct

SEQ ID NO: 155725 - DNA, 601 bp, Human
aactgttttccacaagaggtgggtctgtggaaaggttgaagcaagaattctggagtatgcagagaagctgaaacatgttttacgttgggtatggtgatagggaagcattgtgtcttttcatgtcctcttctgctagaactttgtggtaccattagttgtaattttaattggtgcggatattttgtttttgttctttgttatgccatttaaaagttattcttccatcatgatgtgattttataattcttttttttttttgagacagagttttgctctgtcacctaggctggagtgcagtggygcaatctcggctcactgcagtctccgcctctcaggttcaagcgattctcctgtctcagcctcccaaatagctgggattataggcatgcaccaccatgcctggctaatttttgtatttttagtagagacaaggtttcaccatgttggccaggctggtctcgaactcctggcctcaggtgatccacccacttcggcctcccaaagtgctgggaggtgtgagcatgagctaccatgcctggcctgctgctgttttataattcttatactcaaagccaaatacgactacaaagtcaaatatttt

SEQ ID NO: 155726 - DNA, 601 bp, Human
ccacaagaggtgggtctgtggaaaggttgaagcaagaattctggagtatgcagagaagctgaaacatgttttacgttgggtatggtgatagggaagcattgtgtcttttcatgtcctcttctgctagaactttgtggtaccattagttgtaattttaattggtgcggatattttgtttttgttctttgttatgccatttaaaagttattcttccatcatgatgtgattttataattcttttttttttttgagacagagttttgctctgtcacctaggctggagtgcagtggcgcaatctcrgctcactgcagtctccgcctctcaggttcaagcgattctcctgtctcagcctcccaaatagctgggattataggcatgcaccaccatgcctggctaatttttgtatttttagtagagacaaggtttcaccatgttggccaggctggtctcgaactcctggcctcaggtgatccacccacttcggcctcccaaagtgctgggaggtgtgagcatgagctaccatgcctggcctgctgctgttttataattcttatactcaaagccaaatacgactacaaagtcaaatattttcttcaggaa

SEQ ID NO: 155727 - DNA, 601 bp, Human
tctggtgatccacccgcctcagcctcccaaagtgctgggattacaggcgtgagccaccgcacctggtccagggtttttatagccctatctttctactagaagcagcagtttcttctttttggacactaaatttccagatatgacagggatgctttgcacacttagattttcatggagtcaataaaaccttagctttccatggaaatgtttaagagacatttgggaaacatgtttttaaaaattttaaagtgaatttaaatggcattgtatttgttgtgcagtctctccctttaacaaaccyatgcttgttgggttagcgcctgccaagcttttctccagaggagacccccttaggcagtcctgcagtgctgctctgcagcatcgcttctcatctgttgatgcagttggatctggggagagacgcagcaattagctatgctggagagggctgagcaggcacaggcacgcacacccacgtgcatgcccacggacatgcaagcgtgcacacacacgcatgctcatggatatacacacacactcaggctaccaagccctggccctgatttgaccctgcttgccttgctgcctgcccagtggtgta

SEQ ID NO: 155728 - DNA, 601 bp, Human
tagcttagacaggaggaatgatttctttaccctgagtgttggtaaacatccagattggctgtagagacagtccggggattcagttttctaagactttgtaaagggagcagattctgagtgtcggagggtgtgaatgtgaccctgcctgcaggcagggagatttattccttgctaatctcagagcctgagtctgggagctggaggcagaaggtgagtcaaaggtggctagtttccagaaagtgcaaaggcgccttttttctgtgcctctccccttactttgctaggtaagttgataccaacycacagatgtaaaacaaaaataaacaaacaaaatccagaaatatcttaggtcctacagagtggcacttaaaggagaaatttctatctcatatatgtgcgtatgcatacatatgtgtgtgtttatgtgtacatatacgtgtgagtatgtatgaattcatacctctgtgtattttttttaaaattggaaattacttttcaactcggaatgtataggagacacatgatttgtgcatggctacatttaaaagcatttctttgcttcctgtgcccttctcagtcatatgggtaccttcctggaggt

SEQ ID NO: 155729 - DNA, 601 bp, Human
atgtgaccctgcctgcaggcagggagatttattccttgctaatctcagagcctgagtctgggagctggaggcagaaggtgagtcaaaggtggctagtttccagaaagtgcaaaggcgccttttttctgtgcctctccccttactttgctaggtaagttgataccaactcacagatgtaaaacaaaaataaacaaacaaaatccagaaatatcttaggtcctacagagtggcacttaaaggagaaatttctatctcatatatgtgcgtatgcatacatatgtgtgtgtttatgtgtacatayacgtgtgagtatgtatgaattcatacctctgtgtattttttttaaaattggaaattacttttcaactcggaatgtataggagacacatgatttgtgcatggctacatttaaaagcatttctttgcttcctgtgcccttctcagtcatatgggtaccttcctggaggtttccatgggaaatgattcctatttagagatttgatctagtgatttatcagatgtattaaatgacaggtgcaagcagctgtgcatttgaataacttacaaggttgaaatggctacattctagtttaaatacttt

SEQ ID NO: 155730 - DNA, 601 bp, Human
tcagagcctgagtctgggagctggaggcagaaggtgagtcaaaggtggctagtttccagaaagtgcaaaggcgccttttttctgtgcctctccccttactttgctaggtaagttgataccaactcacagatgtaaaacaaaaataaacaaacaaaatccagaaatatcttaggtcctacagagtggcacttaaaggagaaatttctatctcatatatgtgcgtatgcatacatatgtgtgtgtttatgtgtacatatacgtgtgagtatgtatgaattcatacctctgtgtattttttttwaaattggaaattacttttcaactcggaatgtataggagacacatgatttgtgcatggctacatttaaaagcatttctttgcttcctgtgcccttctcagtcatatgggtaccttcctggaggtttccatgggaaatgattcctatttagagatttgatctagtgatttatcagatgtattaaatgacaggtgcaagcagctgtgcatttgaataacttacaaggttgaaatggctacattctagtttaaatactttaaactcacatgtagattgagaaatgatgaacttgctacattata

SEQ ID NO: 155731 - DNA, 601 bp, Human
ttaggtcctacagagtggcacttaaaggagaaatttctatctcatatatgtgcgtatgcatacatatgtgtgtgtttatgtgtacatatacgtgtgagtatgtatgaattcatacctctgtgtattttttttaaaattggaaattacttttcaactcggaatgtataggagacacatgatttgtgcatggctacatttaaaagcatttctttgcttcctgtgcccttctcagtcatatgggtaccttcctggaggtttccatgggaaatgattcctatttagagatttgatctagtgattyatcagatgtattaaatgacaggtgcaagcagctgtgcatttgaataacttacaaggttgaaatggctacattctagtttaaatactttaaactcacatgtagattgagaaatgatgaacttgctacattataaacctaaagaaacaaaatcctttccctcaagccttttcccccttgtgctatcaacacttactaaagctaaacatggaggatcttccttatttctcaagagatggggaccaaaggcaggtaaatgtgtctttgaaaagcaagtgggaagccagaagttttttctaaatc

SEQ ID NO: 155732 - DNA, 601 bp, Human
gtgcatggctacatttaaaagcatttctttgcttcctgtgcccttctcagtcatatgggtaccttcctggaggtttccatgggaaatgattcctatttagagatttgatctagtgatttatcagatgtattaaatgacaggtgcaagcagctgtgcatttgaataacttacaaggttgaaatggctacattctagtttaaatactttaaactcacatgtagattgagaaatgatgaacttgctacattataaacctaaagaaacaaaatcctttccctcaagccttttcccccttgtgctrtcaacacttactaaagctaaacatggaggatcttccttatttctcaagagatggggaccaaaggcaggtaaatgtgtctttgaaaagcaagtgggaagccagaagttttttctaaatctaaatcttatgtaaagttgaaatactcattgaaaaccaaatattaaaattttacatacccagattatgatttctgcctcttcaagtggctttgttaattaatgatatatagcttaaggcaaatgatcctatcagaacaaagctgtctctagagctcagggtggttaatgtaaattcaagttt

SEQ ID NO: 155733 - DNA, 601 bp, Human
ttccatgggaaatgattcctatttagagatttgatctagtgatttatcagatgtattaaatgacaggtgcaagcagctgtgcatttgaataacttacaaggttgaaatggctacattctagtttaaatactttaaactcacatgtagattgagaaatgatgaacttgctacattataaacctaaagaaacaaaatcctttccctcaagccttttcccccttgtgctatcaacacttactaaagctaaacatggaggatcttccttatttctcaagagatggggaccaaaggcaggtaaatrtgtctttgaaaagcaagtgggaagccagaagttttttctaaatctaaatcttatgtaaagttgaaatactcattgaaaaccaaatattaaaattttacatacccagattatgatttctgcctcttcaagtggctttgttaattaatgatatatagcttaaggcaaatgatcctatcagaacaaagctgtctctagagctcagggtggttaatgtaaattcaagtttagaagactggagagggaaaaggttagatttgtttcctggaatataacttgaaattgcgtgccagcgattgggtg

SEQ ID NO: 155734 - DNA, 601 bp, Human
gcaagcagctgtgcatttgaataacttacaaggttgaaatggctacattctagtttaaatactttaaactcacatgtagattgagaaatgatgaacttgctacattataaacctaaagaaacaaaatcctttccctcaagccttttcccccttgtgctatcaacacttactaaagctaaacatggaggatcttccttatttctcaagagatggggaccaaaggcaggtaaatgtgtctttgaaaagcaagtgggaagccagaagttttttctaaatctaaatcttatgtaaagttgaaatrctcattgaaaaccaaatattaaaattttacatacccagattatgatttctgcctcttcaagtggctttgttaattaatgatatatagcttaaggcaaatgatcctatcagaacaaagctgtctctagagctcagggtggttaatgtaaattcaagtttagaagactggagagggaaaaggttagatttgtttcctggaatataacttgaaattgcgtgccagcgattgggtgttctgctgtctttggccctctgggagttaccagtgcaaacagagctcatccttgtccagagtcataac

SEQ ID NO: 155735 - DNA, 601 bp, Human
ttcctggaatataacttgaaattgcgtgccagcgattgggtgttctgctgtctttggccctctgggagttaccagtgcaaacagagctcatccttgtccagagtcataactaacaactttaagaagtgggcagtagaaagaggggcatgatgggagaaagcgtctggtctagtgtgaaatatgactcatgagaactccagtcagcaaggtgggatttgtgcagcccttggagaatgtcatggttggagaatttgggtgtggcctcaaaatgcagatgctcttcgatttaggatggggttaygttctagtaacccattgtaagtcgaaaatactgtgagtcaaaaatgcatttactaaccctgctaaacccactgtgaagctgaaaaatcataaggcaaacattgtaagttgggaactgtctgtaataattaccaaatccaatcccattgctttctatctcttcttaacagtctgataatcctaaagtaaatgatttaaaggatttggacatcctttcaaaggtctttcatctttctcttgtgagtatctagttgctttagagaaataacttgagaagaggaatttttctaatctttggaga

SEQ ID NO: 155736 - DNA, 601 bp, Human
aatataacttgaaattgcgtgccagcgattgggtgttctgctgtctttggccctctgggagttaccagtgcaaacagagctcatccttgtccagagtcataactaacaactttaagaagtgggcagtagaaagaggggcatgatgggagaaagcgtctggtctagtgtgaaatatgactcatgagaactccagtcagcaaggtgggatttgtgcagcccttggagaatgtcatggttggagaatttgggtgtggcctcaaaatgcagatgctcttcgatttaggatggggttatgttctartaacccattgtaagtcgaaaatactgtgagtcaaaaatgcatttactaaccctgctaaacccactgtgaagctgaaaaatcataaggcaaacattgtaagttgggaactgtctgtaataattaccaaatccaatcccattgctttctatctcttcttaacagtctgataatcctaaagtaaatgatttaaaggatttggacatcctttcaaaggtctttcatctttctcttgtgagtatctagttgctttagagaaataacttgagaagaggaatttttctaatctttggagaagacctc

SEQ ID NO: 155737 - DNA, 601 bp, Human
cataactaacaactttaagaagtgggcagtagaaagaggggcatgatgggagaaagcgtctggtctagtgtgaaatatgactcatgagaactccagtcagcaaggtgggatttgtgcagcccttggagaatgtcatggttggagaatttgggtgtggcctcaaaatgcagatgctcttcgatttaggatggggttatgttctagtaacccattgtaagtcgaaaatactgtgagtcaaaaatgcatttactaaccctgctaaacccactgtgaagctgaaaaatcataaggcaaacattggaagttgggaactgtctgtaataattaccaaatccaatcccattgctttctatctcttcttaacagtctgataatcctaaagtaaatgatttaaaggatttggacatcctttcaaaggtctttcatctttctcttgtgagtatctagttgctttagagaaataacttgagaagaggaatttttctaatctttggagaagacctcatcaaaaactgtcctaattaagactatccagaacagaacagacccgggggctgatctgtggtaatttccaggagaagttctcaggccatcaggcttc

SEQ ID NO: 155738 - DNA, 601 bp, Human
tttttagtagagatggggtttcaccatgttggccaggctggtctcgaactcctggcctcaagtgatccacccaactcatcctcccaaagttctgggattacaggcattagccaccattcccggccatattcctagatgattaacaacagaggcacttacaagaaagatttgtcatagtctatcagtaaacatgaacttagttttggtcatagcccctaggctcctggggaatgcactagccttatcattttgttagtaaagagcccagaggactgagtgagagttgctgatgttttgagtytgacacatgtcccctggtcacttttaatagtggaaaccgtggacttgacatcgtgaaggaatgaaaagcgctcagcataatacctcctcctgttcttactctccttttttttgtgtgggagaatctgagaaatggcatcactattcctcatactcatatcaaagtaatggaaccttgagcagccactggaagagagaatgcaagcagccagaaagtgagaggcaaaccactggagaggctcactgaagccaggccagggagaacaaggatgtttgtgacacttgcttcgcaatccaggtt

SEQ ID NO: 155739 - DNA, 601 bp, Human
tggcctcaagtgatccacccaactcatcctcccaaagttctgggattacaggcattagccaccattcccggccatattcctagatgattaacaacagaggcacttacaagaaagatttgtcatagtctatcagtaaacatgaacttagttttggtcatagcccctaggctcctggggaatgcactagccttatcattttgttagtaaagagcccagaggactgagtgagagttgctgatgttttgagtctgacacatgtcccctggtcacttttaatagtggaaaccgtggacttgacatygtgaaggaatgaaaagcgctcagcataatacctcctcctgttcttactctccttttttttgtgtgggagaatctgagaaatggcatcactattcctcatactcatatcaaagtaatggaaccttgagcagccactggaagagagaatgcaagcagccagaaagtgagaggcaaaccactggagaggctcactgaagccaggccagggagaacaaggatgtttgtgacacttgcttcgcaatccaggttttaccatgtttactctcaacatgaccttctagggtcactcctcctttcagct

SEQ ID NO: 155740 - DNA, 601 bp, Human
cttccctgaaggtcagatgagatccctccttggtttctgacatttgctctccttcacttgtctagccatccaccaccctcctgccttgtctttcccaagcctggaaacactgtttaaccttgtgtacataagtccatttctgttcctgactcccaaacatcacacagaatacttggaggaggttcctgcagacctcctgcctgagcgatgcacaggcatttgtctctctctctggctgcctatgcactggctcttcgggtggcccctcagcatgaccgtccctcaaggctccattctctcytgactccaggattctcccattctgaattttgttgagcctctggctttgggtctgctggtgtacttcccccaggtccaggcaagtcaccttgacttaagtgtcttatttacaacttaaaccaggagtgaccctccctacccgacttccccatttcactgggtaactctgtttaccattgctgtctcaagcattaactatctgtggaagcttctgctcacctttatttttgcaggtatctcttctctttacaatactgctgttttgcaccataaatgatcacaatgccaattttaacataga

SEQ ID NO: 155741 - DNA, 601 bp, Human
ataaatgatcacaatgccaattttaacatagaaaaagattgttcagggtatatttaaattgctttagaaatactaaaaaattatggcttgtaggcatttttacaaaattttaaactgtaatctgtgtttattttaaactgaagatttttatgagcaaattctgctacttcccctttgattcatttctatcactgttgaaatttttgtcccccataattcttcaggttctacatcatccttttcaggatgattttttttttttttttttttttttaaattgcgatagagtcttgctaggttgcctgggctggtcttgaactcctgggctcaagcgatccttccatcttggcctcccaaagtgctgtgattacaggcatgagccactgcacctggcctgaagatgattgttaatgtccttaagtcctttgccctgggcacccctgtgccttgctccagtgattacttgtcttcctctctatcccttccattcctctagggaactacatgtgtgaaaaagcatatctatacaaccccctgagcccacctcattatgtaaccacttttaaagcatcctcaatcactagaaagaatagcatttagt

SEQ ID NO: 155742 - DNA, 601 bp, Human
gtaggcatttttacaaaattttaaactgtaatctgtgtttattttaaactgaagatttttatgagcaaattctgctacttcccctttgattcatttctatcactgttgaaatttttgtcccccataattcttcaggttctacatcatccttttcaggatgattttttttttttttttttttttttaaattgcgatagagtcttgctaggttgcctgggctggtcttgaactcctgggctcaagcgatccttccatcttggcctcccaaagtgctgtgattacaggcatgagccactgcacytggcctgaagatgattgttaatgtccttaagtcctttgccctgggcacccctgtgccttgctccagtgattacttgtcttcctctctatcccttccattcctctagggaactacatgtgtgaaaaagcatatctatacaaccccctgagcccacctcattatgtaaccacttttaaagcatcctcaatcactagaaagaatagcatttagtcgagccttactgatgcctgcttctcaagccctacaaatggtgctgcactctagttatcacttccacattcgttaacgtcgttgtcttca

SEQ ID NO: 155743 - DNA, 601 bp, Human
ctaggaagtctcatgaaggcagcggcttttggatattaaagaatgtaacagagttttagagagtgcaaacccaaggcatacggactttgaattttatctgaccggcactgacatgctgagactttcagattggaaagcatttgtggttactgcatgtatgtcccaaattcttcccgtttaggttaaaagatccaaagaaatatcttggttaggtaggcttgagtctagagaatttggaatggttatacatttactgacaataaggattataaaagaagacctctgtgtccaaggcttacaygtaattagggagggtaaagccacctgcacacaatgctagctagcagggtattttaaaaaactgtgcacgttggggtactagaaacataatgggctttggagtacagcacacctgggttggaattctggttctaccactttctgtgcagccttggcccaggtagttaatctttcagtgcaagcagtgttgtcattcataaaatggaggtgatgcctaccatgaagtgttgctatggaaattaactgatctgtgatattaaagcatagtcactggtacttggggttacctaatctaaatgcc

SEQ ID NO: 155744 - DNA, 601 bp, Human
ttgaattttatctgaccggcactgacatgctgagactttcagattggaaagcatttgtggttactgcatgtatgtcccaaattcttcccgtttaggttaaaagatccaaagaaatatcttggttaggtaggcttgagtctagagaatttggaatggttatacatttactgacaataaggattataaaagaagacctctgtgtccaaggcttacacgtaattagggagggtaaagccacctgcacacaatgctagctagcagggtattttaaaaaactgtgcacgttggggtactagaaacrtaatgggctttggagtacagcacacctgggttggaattctggttctaccactttctgtgcagccttggcccaggtagttaatctttcagtgcaagcagtgttgtcattcataaaatggaggtgatgcctaccatgaagtgttgctatggaaattaactgatctgtgatattaaagcatagtcactggtacttggggttacctaatctaaatgccagaggagtgatttaacaagggaggcaagaccctttctttttagccaagtggagttagcaaagtatgttttgtatgtggaaagtcta

SEQ ID NO: 155745 - DNA, 601 bp, Human
tctggttctaccactttctgtgcagccttggcccaggtagttaatctttcagtgcaagcagtgttgtcattcataaaatggaggtgatgcctaccatgaagtgttgctatggaaattaactgatctgtgatattaaagcatagtcactggtacttggggttacctaatctaaatgccagaggagtgatttaacaagggaggcaagaccctttctttttagccaagtggagttagcaaagtatgttttgtatgtggaaagtctacttttgaattgtcttcgtttctgccttcctactaatgwttttctctctgcctggtctaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcggtaagtagactcattgtagatgtctgtggctagttttctttctctttaactcttatttcccacttctattttttgtttaatgatcgagagataatcctgaaataatgaaagattgaactctgg

SEQ ID NO: 155746 - DNA, 601 bp, Human; identical to SEQ ID NO: 22838

SEQ ID NO: 155747 - DNA, 601 bp, Human; identical to SEQ ID NO: 22837

SEQ ID NO: 155748 - DNA, 601 bp, Human; identical to SEQ ID NO: 22836

SEQ ID NO: 155749 - DNA, 601 bp, Human; identical to SEQ ID NO: 22835

SEQ ID NO: 155750 - DNA, 601 bp, Human; identical to SEQ ID NO: 22834

SEQ ID NO: 155751 - DNA, 601 bp, Human; identical to SEQ ID NO: 22833

SEQ ID NO: 155752 - DNA, 601 bp, Human; identical to SEQ ID NO: 22832

SEQ ID NO: 155753 - DNA, 601 bp, Human; identical to SEQ ID NO: 22831

SEQ ID NO: 155754 - DNA, 601 bp, Human; identical to SEQ ID NO: 22830

SEQ ID NO: 155755 - DNA, 601 bp, Human; identical to SEQ ID NO: 22829

SEQ ID NO: 155756 - DNA, 601 bp, Human; identical to SEQ ID NO: 22828

SEQ ID NO: 155757 - DNA, 601 bp, Human; identical to SEQ ID NO: 22827

SEQ ID NO: 155758 - DNA, 601 bp, Human; identical to SEQ ID NO: 22826

SEQ ID NO: 155759 - DNA, 601 bp, Human; identical to SEQ ID NO: 22825

SEQ ID NO: 155760 - DNA, 601 bp, Human; identical to SEQ ID NO: 22824

SEQ ID NO: 155761 - DNA, 601 bp, Human; identical to SEQ ID NO: 22823

SEQ ID NO: 155762 - DNA, 601 bp, Human; identical to SEQ ID NO: 22822

SEQ ID NO: 155763 - DNA, 601 bp, Human; identical to SEQ ID NO: 22821

SEQ ID NO: 155764 - DNA, 601 bp, Human; identical to SEQ ID NO: 22820

SEQ ID NO: 155765 - DNA, 601 bp, Human; identical to SEQ ID NO: 22819

SEQ ID NO: 155766 - DNA, 601 bp, Human; identical to SEQ ID NO: 22818

SEQ ID NO: 155767 - DNA, 601 bp, Human; identical to SEQ ID NO: 22817

SEQ ID NO: 155768 - DNA, 601 bp, Human
ggggtgaagcccaaacagtgaagtccagaagctctccaagcaatcccaggagaaatttctgtttaaaaaaaaaaagaagaagaaagaaaagaaaagagaaaagaaaagcaagcacagacctagaaggtaaccaactggatagaagagcgctgatccaacatacacctgttaatggccctcgtgggggcgtggggcagtgctctgccactcagaaaagcaaaaagactccaagatctagggagattcagatcagtgttgagacagtcacatacacaccaccccatactcttaataaagcgcrttaatgtgaatctgtgaacatgaaaaatgccatgatgaacaatgcaaacacataatgtttgttcaaaacaggttattagactcgatgccttaccctaaattttctgtttcattactctagagacttagtaacattagtggaattcagggtgctgtaagaaatacggagagcgaggagactgcaggaacagcccgtgggaagggggaaagagataacggggagaaggtcgggaggaccggacaactttaagtgcccatccgcccgaagacttggaaagctaagtaagtaggaccccagagc

SEQ ID NO: 155769 - DNA, 601 bp, Human
acagagaatgggtcaggggaaaactggggtaaccaaaaggattgctgagtagtatgaagaaacaaggggtggtgggtgagggctctgtttctaaattcatagctataactatctaaagatctttctatcctccagtccgttatccataagtgcttaaaagatatggtagttaagtgaattaactagaaccctctcaaacataggggtgaattaaaataatctataggcttatttaaaatgcaaataccgagctccattcctttcattcagaatttccaggggtgaagcccaaacagtgaaktccagaagctctccaagcaatcccaggagaaatttctgtttaaaaaaaaaaagaagaagaaagaaaagaaaagagaaaagaaaagcaagcacagacctagaaggtaaccaactggatagaagagcgctgatccaacatacacctgttaatggccctcgtgggggcgtggggcagtgctctgccactcagaaaagcaaaaagactccaagatctagggagattcagatcagtgttgagacagtcacatacacaccaccccatactcttaataaagcgcgttaatgtgaatctgtgaacatg

SEQ ID NO: 155770 - DNA, 601 bp, Human
ttatactccatcatgtttagaaaggagaaatgaagagggcaaaagacagggtttgtaaagggaaggtttgaaaatgtcttcacagagaatgggtcaggggaaaactggggtaaccaaaaggattgctgagtagtatgaagaaacaaggggtggtgggtgagggctctgtttctaaattcatagctataactatctaaagatctttctatcctccagtccgttatccataagtgcttaaaagatatggtagttaagtgaattaactagaaccctctcaaacataggggtgaattaaaataayctataggcttatttaaaatgcaaataccgagctccattcctttcattcagaatttccaggggtgaagcccaaacagtgaagtccagaagctctccaagcaatcccaggagaaatttctgtttaaaaaaaaaaagaagaagaaagaaaagaaaagagaaaagaaaagcaagcacagacctagaaggtaaccaactggatagaagagcgctgatccaacatacacctgttaatggccctcgtgggggcgtggggcagtgctctgccactcagaaaagcaaaaagactccaagatctagggag

SEQ ID NO: 155771 - DNA, 601 bp, Human
cccacaaaattatccttgaaaaccacaacttccaagctgtcagggaggcggattttagaaatatttcccatccttccactcaactgccttgcctccattaaactctttctctgctgcaactcctgcattctcaatgtttggcctttctgggaagtgggcaagaagaacacgttggcctgtaataggagaataaataagtttggcaagcaacaagagggtgcaagtattctgtgtagaaggaattgcaagtgcaaagtagaaagaggaggcatactaccagtttgaagttgcttggtatgtwcaatgaaaagcaagtagctaaaaggcaagagaattttttttttttaagtatggaaagggaaaggcaaaagctagacagaaaagtgcttgttcatggaggaacttgtgtgccattctagacattttactgtaggaaatagggaatctagagttttaaggaggtgagtaaatcaacaggttgggtttttaaaaattccttcttgtggcagagaaaataatggattggagaatttccagaccagactgtaaaagtcactattaaaataatcacgaaatgaggagatgacaaactaaaatttga

SEQ ID NO: 155772 - DNA, 601 bp, Human
acctctttttctttttttcttgatttcacagtgtggaggggaaagctctgaatatctgcatagattttaaatttgtatttatttatacttttttagagacaaggtctcgctatgttgctcaggctggccttgaactcttggcctcaagcaatcctctgacctcagcctcttcaatagctgggactacacacatatgccaccgcacctgactcgactcaaccctctttgagtagggaaggaaggcatcacagaaaagacacctacactgggtctggaagtgaatccacctttgcaaaaattrtaacagtgagagaaatctaacctaactgactccatattgcttctaacctcacaaagctaactgcccttgctcatacctgggcataggcaagctaactatgggagaaatttatagtttaactttgaagcaaggatggtaatagtcccttccaaaactgaccccctctagggactaaaacagccttgtaagactaatagaaggccgcaaggttaggactatgggagggacctaaaatctgctaaaatataggcataggtaagcaataaccagctactgttccttgcttttctataatttctt

SEQ ID NO: 155773 - DNA, 601 bp, Human
atactacataaaatggtgacaaaaagaatgaacaatcaacctctttttctttttttcttgatttcacagtgtggaggggaaagctctgaatatctgcatagattttaaatttgtatttatttatacttttttagagacaaggtctcgctatgttgctcaggctggccttgaactcttggcctcaagcaatcctctgacctcagcctcttcaatagctgggactacacacatatgccaccgcacctgactcgactcaaccctctttgagtagggaaggaaggcatcacagaaaagacacctrcactgggtctggaagtgaatccacctttgcaaaaattataacagtgagagaaatctaacctaactgactccatattgcttctaacctcacaaagctaactgcccttgctcatacctgggcataggcaagctaactatgggagaaatttatagtttaactttgaagcaaggatggtaatagtcccttccaaaactgaccccctctagggactaaaacagccttgtaagactaatagaaggccgcaaggttaggactatgggagggacctaaaatctgctaaaatataggcataggtaagca

SEQ ID NO: 155774 - DNA, 601 bp, Human
ttctttccacagagaggccttcattgaccacctaatttgaaagagccccagcctgcaatcccggcaggaggagtgggaacaggagttcattcattgcccttagcattcctgggaagtttgataacataatgtaagacaggcaaaaaccaaaaacagtattgagcaaatgtcactttctacctccctatgccattgcacaggtcatagaattctaactattgaaattctattccattttcttcatgacaacttttctgactctgactgagaagcagggactcaattgtacaatttgcccccwattactttgtattctctcagaccacttagcgcattctttcttattttgtattcattccgcaaacatttgagtgcctaatatgatctaggcaatactgtgaacaacataagcatgaattcctccaacagttcacattttagtaagagtgacagatctataaacaaataatttcaaccgaatgaggcaagtacaataggagagatgtatactacataaaatggtgacaaaaagaatgaacaatcaacctctttttctttttttcttgatttcacagtgtggaggggaaagctctgaatatct

SEQ ID NO: 155775 - DNA, 601 bp, Human
cagaatccagtacacatccaatacatatacaattaaacaaaagttcatgaacgttacccttacaacatgtagtgaatatgttaagttgctattttatgtcatctttttaatgctggctacataccacaaatttgagtaatgagtcatcaggtacagtttgagaaacactgctgtacgtatacgtgtggtctggcctctgcctacctccctaaccacatttcatggtattttgcaccatattttccctactgcagccacccctgcaccatcccaccacccagtttctattattttattacaytgaaccataagttcctaaaatataccaatctcttttctgcctcagggtatttgatcttgttgttagcgtggcctggactcctccagatcactgcactttgtattatattatgcaggtctcaatataaaagttctttccacagagaggccttcattgaccacctaatttgaaagagccccagcctgcaatcccggcaggaggagtgggaacaggagttcattcattgcccttagcattcctgggaagtttgataacataatgtaagacaggcaaaaaccaaaaacagtattgagcaaatgt

SEQ ID NO: 155776 - DNA, 601 bp, Human
gtccaagaccaggctgggcagcatagtgagaccctgtctctgaaaaaaaaaaaaaattagctgggcatcatggcacacacctattatcctagctgctcggaaggctgaggctggaggatcacttgaacttgggaggttgaggctgcagtgagccatgatctcaccactacattcctgctgggtgacagggcaatatcctgtctcaaaaaaaataaataaataaaaataaaataataagataaaacaaataaagtatatattattcaaagtaccctgtgtcttgaactttgtggatcaggastcacagtaagaaatatattttacatcagaatccagtacacatccaatacatatacaattaaacaaaagttcatgaacgttacccttacaacatgtagtgaatatgttaagttgctattttatgtcatctttttaatgctggctacataccacaaatttgagtaatgagtcatcaggtacagtttgagaaacactgctgtacgtatacgtgtggtctggcctctgcctacctccctaaccacatttcatggtattttgcaccatattttccctactgcagccacccctgcaccatcccacc

SEQ ID NO: 155777 - DNA, 601 bp, Human
gaggagagtgatctggatgcacaaagaaacttgaaaattttactctagccaattttaggctttcgttaattcaaagctgtatctgccatacaacaagaacattttcactagatcaaaagaggaataagaatatctgcaggccttgagatttcaactattttgccttttaaactatatattagctgaacgtggtggctaacataaacataatcccaacactttgagaggccaaggtgggaggatcacttgagcccaggggtccaagaccaggctgggcagcatagtgagaccctgtctctgaaaaaaaaaaaaaattagctgggcatcatggcacacacctattatcctagctgctcggaaggctgaggctggaggatcacttgaacttgggaggttgaggctgcagtgagccatgatctcaccactacattcctgctgggtgacagggcaatatcctgtctcaaaaaaaataaataaataaaaataaaataataagataaaacaaataaagtatatattattcaaagtaccctgtgtcttgaactttgtggatcaggactcacagtaagaaatatattttacatcagaatccagtacacat

SEQ ID NO: 155778 - DNA, 601 bp, Human
gtaacaaactagatgaagacagaagctgattagataaactgcagtggtcaggaagcctcaccaacagagcaaacaacctccatcttcagctgcttattgagaggccataatcctttgctgcaatacatacaacagtggctagactgaacacagagaagggacatctgtttcttaggcctgttctttctcataaatgattgatggcaaatatggaggagagtgatctggatgcacaaagaaacttgaaaattttactctagccaattttaggctttcgttaattcaaagctgtatctgccayacaacaagaacattttcactagatcaaaagaggaataagaatatctgcaggccttgagatttcaactattttgccttttaaactatatattagctgaacgtggtggctaacataaacataatcccaacactttgagaggccaaggtgggaggatcacttgagcccaggggtccaagaccaggctgggcagcatagtgagaccctgtctctgaaaaaaaaaaaaaattagctgggcatcatggcacacacctattatcctagctgctcggaaggctgaggctggaggatcacttgaacttg

SEQ ID NO: 155779 - DNA, 601 bp, Human
tttagattagttcttatggaacatagctaataatctttaaagtcctttattacactaacagttcatctggagtaatgatattctaataaatgctatattttagaagatacataatattaatatctttgtcaaatatatcttagaattaccttctctgtcctctttataatatgtaaaagaaattgatgagtccagcatacgcttcatcttaaatgaggtgtatgagaaacatgctaaactatggttccctatctctgcttcacaatataaaggtgattccagaatttggaagcctcaactrtaacaaactagatgaagacagaagctgattagataaactgcagtggtcaggaagcctcaccaacagagcaaacaacctccatcttcagctgcttattgagaggccataatcctttgctgcaatacatacaacagtggctagactgaacacagagaagggacatctgtttcttaggcctgttctttctcataaatgattgatggcaaatatggaggagagtgatctggatgcacaaagaaacttgaaaattttactctagccaattttaggctttcgttaattcaaagctgtatctgccat

SEQ ID NO: 155780 - DNA, 601 bp, Human
ccaggaggcagaggttgcagtgagtggaaatcgcgccactgcactccacagccgggtcgacagaacaaaactctgtctaaaaaaaaaaaaaggcaggtgctaaaaacaaaaccagaaaagctattaggagaaacgtcataaagttggaaactgaaaagcatttcatttcatggaataaaattttgttcttcagtaattatgaaactgtctttgaaaactctgttaaaaacaactttgactcatgcctgtaatcccagcacttggggaagccgaggcaagtggatcacttgaggtcaggagytcgagaccagcctggccaacatggtgaaaccctgtctccactaaaaacacaaaaattagccaggcatggtggcacatgcctgtaatccaagttactcacaaggtggaggcaggagaatcgcttgaacccaggaggcagaggttgcagtgacccgagatcacaccactgcactccagccagggtgatagagtgagactgtgtctcaaaaataaataaatacataaacaaacaaacaactttgagacattttacttcaaaggtttagattagttcttatggaacatagctaataatctttaa

SEQ ID NO: 155781 - DNA, 601 bp, Human
aaaatacaaaagttagccaggcgtggtggcatgcgccagtagtcccagctactcgggaggctggggcacaagaattgcttgaacccaggaggcagaggttgcagtgagtggaaatcgcgccactgcactccacagccgggtcgacagaacaaaactctgtctaaaaaaaaaaaaaggcaggtgctaaaaacaaaaccagaaaagctattaggagaaacgtcataaagttggaaactgaaaagcatttcatttcatggaataaaattttgttcttcagtaattatgaaactgtctttgaaarctctgttaaaaacaactttgactcatgcctgtaatcccagcacttggggaagccgaggcaagtggatcacttgaggtcaggagctcgagaccagcctggccaacatggtgaaaccctgtctccactaaaaacacaaaaattagccaggcatggtggcacatgcctgtaatccaagttactcacaaggtggaggcaggagaatcgcttgaacccaggaggcagaggttgcagtgacccgagatcacaccactgcactccagccagggtgatagagtgagactgtgtctcaaaaataaataa

SEQ ID NO: 155782 - DNA, 601 bp, Human
tgggtgccaagcttcatgcctataatcccagcagtttggaaggccgaggcaggcggatgacctgagatcaggagtttgagactagcctggccaaaatggcgaaaccccgtctctactaaaaatacaaaagttagccaggcgtggtggcatgcgccagtagtcccagctactcgggaggctggggcacaagaattgcttgaacccaggaggcagaggttgcagtgagtggaaatcgcgccactgcactccacagccgggtcgacagaacaaaactctgtctaaaaaaaaaaaaaggcaggtsctaaaaacaaaaccagaaaagctattaggagaaacgtcataaagttggaaactgaaaagcatttcatttcatggaataaaattttgttcttcagtaattatgaaactgtctttgaaaactctgttaaaaacaactttgactcatgcctgtaatcccagcacttggggaagccgaggcaagtggatcacttgaggtcaggagctcgagaccagcctggccaacatggtgaaaccctgtctccactaaaaacacaaaaattagccaggcatggtggcacatgcctgtaatccaagttactca

SEQ ID NO: 155783 - DNA, 601 bp, Human
tccatgagttaggggccactgtgtgctatcttattaatcaatgtatacccaccagttaccagtatatggaaagtactcaataaatactttctcgaatagaagaataactggtgaatgagaaagaattgggaataaaaaggcagaaaaaggaaagcaaaaataaataaaaagctacatgaaaaaaattatggcattatattaaccacttactattccgttctccaaataccactgtttcctactaaacaagaatataacaggctctaaactgcatttgtaatacaatatataggaaaataarcttttaagagtttcatatctgcaatttatgccctgtgctttctgattcactttttgtaaataaaatcctgtggatctttggaactgcaattcttccaaatcagcaattcaagtaacaaaaggaattctggatgactaaaaagcagatgctgtctgggtgccaagcttcatgcctataatcccagcagtttggaaggccgaggcaggcggatgacctgagatcaggagtttgagactagcctggccaaaatggcgaaaccccgtctctactaaaaatacaaaagttagccaggcgtggtgg

SEQ ID NO: 155784 - DNA, 601 bp, Human
agctgtcctctcattccctaggccccagccacactagctccctcctgttcctctaatgcacctctgtgctcactattgactctgcctggaatgctcttctcctaggtttcacctggcaagctgctttctatcattgacatctcagcttaaaagtcacatcctcatgaggaccgtccctgattgtcctactcaaggctacttgctcttggaaccaaccaatattgcattacttagtttaattttcctcatagtacttatcatcatatgaggtcatcattcgtttatttattcatgtaaactgtttttctctcaaactaaggaaaaaaacaattaaagagttttatcatcaaagagactttccctcaccaccccaggctagttcagatcactctattttattactaacttccacctcaccttgtcatttttcttttgtaatccaacttatacttgtaatttattttccaatatctgtttttctccataaattccatgagttaggggccactgtgtgctatcttattaatcaatgtatacccaccagttaccagtatatggaaagtactcaataaatactttctcgaatagaagaataactggt

SEQ ID NO: 155785 - DNA, 601 bp, Human
ggcaactataagggatgaaattaggagtctctgaagttcaaagacaaaagaagctcagaaaaatatttcccaaagcttataagatcataaattttacagataagataaaaataagcaccaagagaccaaattaatatggcaaaagtttaaggcaaatccaaggaaaataaaatattttgatggaataggtaaaatatataagatgtataatactactgcatttagaataaaatccaaaatccctcccaagttccataagtctcagtattcctggctccttcctgcctctcagatctcttcycctccagctgtcctctcattccctaggccccagccacactagctccctcctgttcctctaatgcacctctgtgctcactattgactctgcctggaatgctcttctcctaggtttcacctggcaagctgctttctatcattgacatctcagcttaaaagtcacatcctcatgaggaccgtccctgattgtcctactcaaggctacttgctcttggaaccaaccaatattgcattacttagtttaattttcctcatagtacttatcatcatatgaggtcatcattcgtttatttattcatgt

SEQ ID NO: 155786 - DNA, 601 bp, Human
gaaagcctaaaaatgcacatgacctctcgcacctagttatttcctttttaatttattgtaaggaaataattatggatgtctataaaaatgtgttcgcaaaaatatgttagtattgtgttaacagaacaaattaataaatggattggttaaatcagagtaaatgaaagaataaaacgtagagctgtccctcagtatttgcaggggattggttccaggactcctacagataccagaatccttagacgctcaagtcccttacatacaatgatatagcatttgcatataacctatgcatatcctycagtatattttaattcatctctaaattacttacaacacctaatacaatgcaaatgctatgtaaatacttgttatagtgctttgtttttatttgtattttttatcattgtattgttatttttttttttcaaatattttcaatcctcaattggttgaatctggatgcagaacccatggctacccagggctggctgtagttcttaaaactgatctggaaaaatgcaaaagatatattaagtgggataaaacagatttctaaacaatgaatataatagaatcatattttaaaggatatgtatct

SEQ ID NO: 155787 - DNA, 601 bp, Human
agaacatacagtaatttatatttctctcaatattctgagcaaagcaggtgacagttttattaaaagttcaaatctattgttagacatatgtatgtaatgtatagaaataccagtttagagtttagaagaaacaggcaccatggtatactgctagcagagtattcactggcaaaactattttgggagtagtctggcaatgtatattgaaagcctaaaaatgcacatgacctctcgcacctagttatttcctttttaatttattgtaaggaaataattatggatgtctataaaaatgtgttcrcaaaaatatgttagtattgtgttaacagaacaaattaataaatggattggttaaatcagagtaaatgaaagaataaaacgtagagctgtccctcagtatttgcaggggattggttccaggactcctacagataccagaatccttagacgctcaagtcccttacatacaatgatatagcatttgcatataacctatgcatatccttcagtatattttaattcatctctaaattacttacaacacctaatacaatgcaaatgctatgtaaatacttgttatagtgctttgtttttatttgta

SEQ ID NO: 155788 - DNA, 601 bp, Human
ggctcccacctcagggtctttggatgtactatttcctctacctagacagctctagggctaggattcccagggctctccacatcatcacttcattcaggtctccactcatatgtcagcaatgtaaggaggcttctctgaccagctaactaaataccaacttcttcactctctgtcttgtttgattttttttccataacacttatcaaaacctcaaattatactacatatttgtttattctgcatctccccagaaattttagctccataagggtgggactttgtcactgattgctcagaacastgcctggcactcaagagaaacttaaaaataattgttgaatgaatgaagctagagctctctctcagaataaaagagtccactgtttttgacccataattctagatttttctctagaggtgaacagcccttgatcaaaactgtttgtccactcctggtctctaccaagtaactagcagggaaattcagtggaaagttaccttcctttcttctcaactgtcttttcagaggattatctttcttccttggatgtttgtgcctttctgctccctgatgatattgatatcttttctctgtaaatac

SEQ ID NO: 155789 - DNA, 601 bp, Human
catatacctgctatgtacccataaaaattttaattttgtttaaaaaagactgatttcatgccacataagccttgtatgatctggtctcaggctacctctttatctcatctgcctcacctgcctctgccaccctctccctcaccttctctgctccagttacaccggccttcttgctggttactaaataaaccaagcaggctcccacctcagggtctttggatgtactatttcctctacctagacagctctagggctaggattcccagggctctccacatcatcacttcattcaggtctccaytcatatgtcagcaatgtaaggaggcttctctgaccagctaactaaataccaacttcttcactctctgtcttgtttgattttttttccataacacttatcaaaacctcaaattatactacatatttgtttattctgcatctccccagaaattttagctccataagggtgggactttgtcactgattgctcagaacagtgcctggcactcaagagaaacttaaaaataattgttgaatgaatgaagctagagctctctctcagaataaaagagtccactgtttttgacccataattctagat

SEQ ID NO: 155790 - DNA, 601 bp, Human
ctacagattcaatgcaatcactatcaaaatatcaatgatattcttcaaagagtagaaatagaaaaaacaatcctaaaatttataaaagactcagaatagccaaaaccatcctaagtaaaaagatgaaaactgaaaaaaatcacactatctgacttcaaattatactacagagctatagtaaccaaaacagcgtggtactggcataaaaacagacacatagatcaatggaacagaatagagaaccctgaaacaaatccatacatctacaatgaactcattttcaacaaagtttccaagaacrtatattggagaagacagcctcttcaataaatggtactggaaaaactgggtatttatacacagaagaatggaacaagacccctttctctggtcatatacaaaaataaaatcaaaatggatttggattaaagacttaaatttaatacctctaactatgaaactactacaagaaaacattgaggaaaattcccaaggtattggtctgggcaaaaatttcttgaccaccaccacacaggcacaggcaaccaaagcaatcatggataaattggggcacatcaagttaaaaagcttctgcatagca

SEQ ID NO: 155791 - DNA, 601 bp, Human
ttagcctaatcctttctttaaggctatagatttctcatttgtattagtaagaatgtaactgtataaaaggaacagtatctcaaaagctcagtgtattaattagaatagttttctaagcaagctattactgagggactacaagagtgagtaagaaataagccctacctccatggtgtctcatgcctgtaatcccagcactttgggaggccgaggcagatggattgcctgaggacaggagttcgagaccagcctggccaacatagtgacaccctgcctctactaaaactacaaaaacatagckgagtgtggtggtgggtgcctgtaatcccagctactcaggaggctgaggcaggagaatcacttgaacctggaaggtggaggttgcagtgacccaagatcgtgccaagaaagaaagaaagaagaaagaaaggaaggaaaggaaggaaaggaaggaaagaaaggaaagaaagggagaaaagaaagaaagaaagaaagaaggaaggaaggaaggaaggaaggaaggaaggaaggaaggaaggaaggaaagagccctgctctcaaggagctcactctccttagtacattactgagtcccaactca

SEQ ID NO: 155792 - DNA, 601 bp, Human
cctgaaagtgtccaatgatggaagagtgccacctagtgttcaatgtggatttaacatatcctgcccaaaaagccatttcacaaagccatttcacaaagccatttcacaaataccctcaattttagccctgtagttattcattaaaccatagtaattttgcagagccctagtcaagtatcaaaatatgaattatgaattcctgaaaaaaatgtatatcacctatatccactagaaactgagtttttgaaaaggaagttaaatttctatagctacataaaagcaaaagaaagagttaactcaaaaaaaaaaaaaaattttaaacatcgtgaccctaagtagtaggctagaaagaacatgaggttctaggctaaataggttcaaatttgggccctaccgctttctagcgtataatcttgggtattttaaaaaactgaggtttccttatgtgaaaagaatatacagtaggcattcaataagtgatagatattaactattaagaaaaagagatttcccattcttttttaaagaataagttaataagtttctttttttaaagaaaagtgagagcaagtttattaagaaagtaaaggaataaaagaat

SEQ ID NO: 155793 - DNA, 601 bp, Human
gctctatgcaaaatatgcaaaccaaaatggttccattttttcctgtatgtcatataccaaatgctgcagatgctaaatatacatatagatttacatgcattgcaaattactactattctgcattagctacagttggctactgattctgatagcattttcatcatgagaaaaagaatgagtctttttgaatattagtcaatggagaaaatactgtgtttacaataaagtgatacagacttaagtggctgtaaccactaatgtacctttataaaagtggtaaaagtcttaaatacatccacamgtgttagaagtagtgatcatcagacagtctatctgaagaagatattaagacagtgttttctttggaatgcatttgcctatattacctcatgtaattcaaacattatttttattttgtagtttcctgattaagtttttaaaaataagtcaaaggatattttggtaaagtaacagattccaaaaaaaagcaaaaaaaaaaaaaaacccacattttcaagcttaatcccaaagatgaccatttgtttcatcatttaggctaaagttttctaatttaggaaagaaaaacgtgtgtctttgactt

SEQ ID NO: 155794 - DNA, 601 bp, Human
gaccatagatctaattcatcaggaaatcctattagatctacctgcaaaacatatacacattctagccactttactacctccactgcaaaccccctactccaagccaccatactccctcacctagattatagcctcataactaacctctctacttccatctttgccccctacagcttctctcaaaaaaatacagccagagaggattctgtaaaaatataaattgtatcacctcattcctctgcttaaaatttgccaactcagcctatgagaataatgtcaacccactttcaatagcccacaragccctccaagatctggcctccagtgatccgtctgacttcatctcccacaactgtcactcttgcttactttgccttagccacactgtttcttgaacatacggcatgctcccacctaaaaaagtctgtccgctgactgtcttatttcctggaatactttttccccaatatttacatggcttatcttttctcaccctcaagactttgctcaggtatcatcatcttctccacaagactaactctggccacttccctttaaattacattcaacaccactatcagtacccccaacattcattacc

SEQ ID NO: 155795 - DNA, 601 bp, Human
ggtgtcattgtaagtggagttaatttcttaatctctttttcagagtgttcattatagtatatggaaatataattaatttttgtgaaatcaattggtcttgtattctgcaactttgatgaacacattagttgtagtaacttttttgtggaatccttaggattttctatatacagggtcacatcctctgtgaataaaggcagttttatcctctccggtctagatgtctttcatttatttcttgcctgactgtaccagctagaacttccattccagtgttgtataaaattgtgagagcagacakcctagccttgttcccaatctcaggaagaaagcattcacacttgccatttaaatatgttgctagctgcagctttttcatgaatccccttagttcaaagttcacttctacttctaatttgttgagaatttttattatgaatggtatttgattttgtaaagtgtttttctgtgtctaacgataattatgtgtgttttatcctttatttcactattttttgtgttatattcattgatttttgatgttaaatctttttggcataaatcccactggatcatggtatataatccattctatgtattg

SEQ ID NO: 155796 - DNA, 601 bp, Human
ctgctggggcagagccctcatggagagcctctactagggcaatgcagagggaaaatgtggggtcagggtgcccacacagagtccccactggggcactgcctggtggggctgtgagaagagggccaatgtcctccagaccccagaatggtagatccactcacagcttgcaccatgtgcctggaaaagccaggggcactcgatgccagcctttgaaagcagccatggggactgtcccctacagatccacagggaaggagctgccaatgccctgggagctcacctcttccatcagcatgccctrggtgtgagacatggaatcagaggagaccattctggagctttaatgaattaaaaaaaaatttttttaacaagtaccctgccaggttttggacttgtatagggcctgtggcctctttggtttggccaatttctcccatttcgaatgggaacatttacccaatgcctgtgcccccactgtatcttagaactaactaacttgcttttgattttataggctcacaggtagaaaagacttgccttgtctcagatgagactttggacttggactcttgagctaatgctggaatgagttaaggctttg

SEQ ID NO: 155797 - DNA, 601 bp, Human
agaattggtaccagcagagtggggtactgctataaagataacctgacaatgtggaagcatctttggaactgggtaacaggcaggggttggaaaagtttggaaggctcagaagaaaagaagatgtgggaaagttgtggacttcctaaagaattgttgaatggttttgaccaaaatgctgacagtgatatggacaatgaagtccaggctgaggtggtctcagatgaagatgagaaacttagtgggaactggagtgaaggtcactcatgctatgctttagcaaagagactggcggcattttgcstctgccttagagatctgtggagctttgaactcaaaagatgatttagggtatctggcagaagaaatttctaagcagaaaagcattcaagaggtgacctggcattttctgaaagcattcagtcagatgtattcacagagatggtttgagattggaacttatgtaaaggtttggaaaacttgcagcctggccctgtggtagaaaagaaaaacccattttctagggaggaattcaagctggctgaagaaatttgcataaaaaatgaggaacggaatgttaataccaagacaatggggaaaatgc

SEQ ID NO: 155798 - DNA, 601 bp, Human
cttgtttcttcacgggcagactgatgttcccacagtagaacactgggttgtcgtctaattttgtattatacaatacaaattgtctctctaataaaattatgaaattctcaaagaagctgtaacatttatttctcttgaaacttcaaggtggctctcctagttctgggaccataaaatactcaaataaatatttaccaaaataaagatctaaaggagtaaataaatgtgcacagcaatagatcttgacaaaatggcaaaaatccactcttccatattcaaaaaactcccccccaaactctartatttgtttgtaagtctgtttacttatatttccagaaagattctcaaagaggacatcttttcttacttttttggtaagtatgggcttctctgactaccatcttaaaagaatatacttgataaagtattaagtaactccaggacatgagttacccatgagagatcacttgccaacaattaactgaaccacaatattccaaaaagagagatggctcttaatcaataaataaattctgggtctaattataatggcatgaaaatatttaagcaattataaactactcaatgttcagatagaaaa

SEQ ID NO: 155799 - DNA, 601 bp, Human
gtggtcgatgggactgggcgccatggagcagggggcggcgcttgtaggggaggctcgggctgcacaggaacccacggagtgggtgggaggctcaggcatggcgggctgcaggtcccgagccgtgccccgtgggaaggcagctaaggcacgcggtgagaaatcgagcgcagcgccggtgggctggcactgctgggggacccagtacaccctccgcagctgctggcccgggtgctaagtccctcattgcccagggccagcagggctggccgactgctcccagtgcagggcccgccaagcccaygcccacccggaactccagctggcccgcaagcgccgcacacagccctggttcccgctcacgcctctccctccacacctccctgcaagctgagggagtgggctctggccttggccagcccagaaaggagctcccacagcgcagcggtgggctgaagggctcctcaagtgccgccaaagtgggagcccatgcagaggaggtgccaagagcgactgaggactgtgaggactgccagcatgctgtcacctctcaatagcagatcattaaaaatgtattatctacacagtaggcaaacaagcatag

SEQ ID NO: 155800 - DNA, 601 bp, Human
gtgccgtgtgcccgcactcctcagcccttgggtggtcgatgggactgggcgccatggagcagggggcggcgcttgtaggggaggctcgggctgcacaggaacccacggagtgggtgggaggctcaggcatggcgggctgcaggtcccgagccgtgccccgtgggaaggcagctaaggcacgcggtgagaaatcgagcgcagcgccggtgggctggcactgctgggggacccagtacaccctccgcagctgctggcccgggtgctaagtccctcattgcccagggccagcagggctggccgrctgctcccagtgcagggcccgccaagcccacgcccacccggaactccagctggcccgcaagcgccgcacacagccctggttcccgctcacgcctctccctccacacctccctgcaagctgagggagtgggctctggccttggccagcccagaaaggagctcccacagcgcagcggtgggctgaagggctcctcaagtgccgccaaagtgggagcccatgcagaggaggtgccaagagcgactgaggactgtgaggactgccagcatgctgtcacctctcaatagcagatcattaaaaatg

SEQ ID NO: 155801 - DNA, 601 bp, Human
cacccagtggatcccgcaccggggctgcaggtggagctgcctgccagtcccagtgccgtgtgcccgcactcctcagcccttgggtggtcgatgggactgggcgccatggagcagggggcggcgcttgtaggggaggctcgggctgcacaggaacccacggagtgggtgggaggctcaggcatggcgggctgcaggtcccgagccgtgccccgtgggaaggcagctaaggcacgcggtgagaaatcgagcgcagcgccggtgggctggcactgctgggggacccagtacaccctccgcagcygctggcccgggtgctaagtccctcattgcccagggccagcagggctggccgactgctcccagtgcagggcccgccaagcccacgcccacccggaactccagctggcccgcaagcgccgcacacagccctggttcccgctcacgcctctccctccacacctccctgcaagctgagggagtgggctctggccttggccagcccagaaaggagctcccacagcgcagcggtgggctgaagggctcctcaagtgccgccaaagtgggagcccatgcagaggaggtgccaagagcgactgaggac

SEQ ID NO: 155802 - DNA, 601 bp, Human
acatagtgtgtccggaattggtgggttcttggtctcaccgacttcaagaatgaagccgtggaccctcgcagtgagtgttacagctcttaaggtggcgcatctggagtctgtcccttctgatgttcagatgtgttcggagtttcttccttctggtgggttcgtggtctcgctggctcaggagtgaagctgcagacctttgcggtgagtgttacagctcttaagacagcgcgtccggagttgttcgttcctcccggtgggctcgtggtctcgctgggctcaggagtgaagctgcagatcttcrcggtgagtgttacagctcataaaagcagcatggacccaaagagtgagcagtagcaagatttattgcaaagagcgaaagaacaaagcttccacagtgtggaaggggaccttcccttccacagctagctcaggcagcctgcttttattctcttatctggccccacccacatcctgctgattggtagagccgagtggcctgttttgtcagggcactgattggtgtgtttacaatccctgagctagatacaaaggttcttcacgtccccatcagattagttagatacagagtttggacacacag

SEQ ID NO: 155803 - DNA, 601 bp, Human
aatgatagactggataaagaaaatgtggtacatatacaccatggaatactatgcagccataacaaggaatgagatcatgtcctttgcagggacatggatgaagctggaagccatcatcttcagcaaactagcacacgaacagaaaaccaaatactacacattctcactcataagtgggaggtgaacaatgagaacacatagagaggggaacaacacataccagggcctgttgtggggtgggggatgagggaagggaacttaggggacgagtcaataggtgcagcaaatcaccatggcacaygtgtacctatgtaacaaacctgcacgttctgcacatgtatcctgatttttttagaagaaatatatataatatatatgtttatatattttatatatattaaataaataatatatatttaatatatacttttatatattaaatatatatttatatatatgtttcagaagagatatatatatatacatatatatagaaagaaatcaacaccatctaagaacctgctccctcaagccagctgcttccagtaagggtgagtgaaaagtggcttctaaacaaggaaattttcactttgccttgaac

SEQ ID NO: 155804 - DNA, 601 bp, Human
gtaaattatgtagatgataaaggttacagttcaacaagcttctaaagtttagtctgagtctccatgaacccacattcaccttgaatgacattataatagaaatcaacagcatgagtaatcaaaacagcatggtatgggtagcaaaacagacacatacaccaatggagcagaatagagacctcacaaataataccacacatctacaaccatctcatctttgacaaacctgacaaaaacaagcaatggggaaaggatctcctattcagtaaatggtgctgggcaaactgactagccatatgcrgaaaaatgaaactggaacgcttccttacactttatagaaaaattaactcaagatggattaaagacttaaatgtaaaacccaaaaccataaaaaccctggaggaaaacctacacaataccattcaggacataggaatgggcaaagacttcatgacaaaaaggccgaatgcgattgcaacaaaagcaaaaattgacaataggatctaattaattaaactaaagagcttctgcacagcaaaagaaactatcatcagagtgaacaggcaacctatagaatgggagaaaatttttgcaatctacc

SEQ ID NO: 155805 - DNA, 601 bp, Human
acaggtacaaaaaaaataaaattaaaaagaatgactaagacctaatatttgatagcagagtagggtgactgtagccaataataacttaattgtacattttaaaataacttaaagagtgtaactgcattgtttgtaacaaaaggatatcaaaaggataaatgtatcaaaaggataaatgcttgaggggacagagcacattcaccatgatatgcttatttcacattgcatgcctgtatcaaactatctcatgaaccccataaatatatatatctactatgtacccataaacatttaatatttwaaaaaaaaagaaatttgccaagatcacacagcttataaacagaggtgaacccaggcagcttgactccagatctgctcttagacactctccttaactgtggcaagaagggatggaaactcccttctgagagacactggactaagcagcctatataagctgcagtgtttgctcgatttctagaaacagcaactatattctttcaatttaaccccctattaagacaaatcaggttttaaaaaccaacacaaccacaacaataaaaatcaggacatacttatcagacttgtaattctaacagtg

SEQ ID NO: 155806 - DNA, 601 bp, Human
acaaacatcacatgttctcacttatctgtgggttctaaaaaatgaaaaaaaattgaactcatggacatggagagtagaaagatggttatcagaagttgggaagagtagtgggaggctgtagggaaggtgggggtgaataacaggtacaaaaaaaataaaattaaaaagaatgactaagacctaatatttgatagcagagtagggtgactgtagccaataataacttaattgtacattttaaaataacttaaagagtgtaactgcattgtttgtaacaaaaggatatcaaaaggataaatgaatcaaaaggataaatgcttgaggggacagagcacattcaccatgatatgcttatttcacattgcatgcctgtatcaaactatctcatgaaccccataaatatatatatctactatgtacccataaacatttaatattttaaaaaaaaagaaatttgccaagatcacacagcttataaacagaggtgaacccaggcagcttgactccagatctgctcttagacactctccttaactgtggcaagaagggatggaaactcccttctgagagacactggactaagcagcctatataagctgca

SEQ ID NO: 155807 - DNA, 601 bp, Human
agacaaacatcacatgttctcacttatctgtgggttctaaaaaatgaaaaaaaattgaactcatggacatggagagtagaaagatggttatcagaagttgggaagagtagtgggaggctgtagggaaggtgggggtgaataacaggtacaaaaaaaataaaattaaaaagaatgactaagacctaatatttgatagcagagtagggtgactgtagccaataataacttaattgtacattttaaaataacttaaagagtgtaactgcattgtttgtaacaaaaggatatcaaaaggataaatgtatcaaaaggataaatgcttgaggggacagagcacattcaccatgatatgcttatttcacattgcatgcctgtatcaaactatctcatgaaccccataaatatatatatctactatgtacccataaacatttaatattttaaaaaaaaagaaatttgccaagatcacacagcttataaacagaggtgaacccaggcagcttgactccagatctgctcttagacactctccttaactgtggcaagaagggatggaaactcccttctgagagacactggactaagcagcctatataagctg

SEQ ID NO: 155808 - DNA, 601 bp, Human
tgaagtaccattaagccataaaaaagaatgagatccagtcatttgcaacaacagggatggaactggagatcattatgttaagtgaaataagctaggcaaagaaagacaaacatcacatgttctcacttatctgtgggttctaaaaaatgaaaaaaaattgaactcatggacatggagagtagaaagatggttatcagaagttgggaagagtagtgggaggctgtagggaaggtgggggtgaataacaggtacaaaaaaaataaaattaaaaagaatgactaagacctaatatttgatagcrgagtagggtgactgtagccaataataacttaattgtacattttaaaataacttaaagagtgtaactgcattgtttgtaacaaaaggatatcaaaaggataaatgtatcaaaaggataaatgcttgaggggacagagcacattcaccatgatatgcttatttcacattgcatgcctgtatcaaactatctcatgaaccccataaatatatatatctactatgtacccataaacatttaatattttaaaaaaaaagaaatttgccaagatcacacagcttataaacagaggtgaacccaggc

SEQ ID NO: 155809 - DNA, 601 bp, Human
actctcaaaaaactgaatatagaagtaacatacctcaacataataaaagcatatttgacaaatatgacagacccacagctagtatcatactgaatggggaaaaactaaaagcctttcctctgagatctgaaacatgacgagggtgcccattatcactactgttgttcaacataataatggaagtcctagctagaacaatcagacaagagaaagatataaagggcatccaaattgaaaaggaagaagtcaaattatccttgtttacagatgatatgattttatatttggaaaaacctaaagrctccactgaaagactcttagaactgataaattcagtaaagttgcaggatacgaaatcatacaaatatcagtggtatttctatatgccaacagtgaacaatcttaaaaagaaattttaaaaagttatcccatttacaatagccacaaataaaataaaatacctaagaattaacaaaagaaatgaagatctctacaatgaaaactatgaaacactgatgaaataatttgaaaaagaccaaaaaaaaaaatgggaagctattccatgttcatggaattggaagaattaacattgttaaaatgt

SEQ ID NO: 155810 - DNA, 601 bp, Human
tgatatcaaaagaatgaaagataaaaaccatacaatcatgtccattgatgttgtaaaagcatttgataaaactcaacataccttcatgatgaaaactctcaaaaaactgaatatagaagtaacatacctcaacataataaaagcatatttgacaaatatgacagacccacagctagtatcatactgaatggggaaaaactaaaagcctttcctctgagatctgaaacatgacgagggtgcccattatcactactgttgttcaacataataatggaagtcctagctagaacaatcagacaasagaaagatataaagggcatccaaattgaaaaggaagaagtcaaattatccttgtttacagatgatatgattttatatttggaaaaacctaaagactccactgaaagactcttagaactgataaattcagtaaagttgcaggatacgaaatcatacaaatatcagtggtatttctatatgccaacagtgaacaatcttaaaaagaaattttaaaaagttatcccatttacaatagccacaaataaaataaaatacctaagaattaacaaaagaaatgaagatctctacaatgaaaactatg

SEQ ID NO: 155811 - DNA, 601 bp, Human
cagacaatgacacatcaaaataaataaataaataaaactacaggtcaatatctctgataaatattgatgcaaaacttgtcaacaaaatactagcaaactgaattcagcaatacattagaaagatcattcattatgaccgagtgggatatatccctgggatgcaaggatggttcaacataagcaaatcaatcaatgtgatatgtgatatcaaaagaatgaaagataaaaaccatacaatcatgtccattgatgttgtaaaagcatttgataaaactcaacataccttcatgatgaaaactcycaaaaaactgaatatagaagtaacatacctcaacataataaaagcatatttgacaaatatgacagacccacagctagtatcatactgaatggggaaaaactaaaagcctttcctctgagatctgaaacatgacgagggtgcccattatcactactgttgttcaacataataatggaagtcctagctagaacaatcagacaagagaaagatataaagggcatccaaattgaaaaggaagaagtcaaattatccttgtttacagatgatatgattttatatttggaaaaacctaaagactcc

SEQ ID NO: 155812 - DNA, 601 bp, Human
acacctgtaatcccagcactttgggaggttgaggcaaaaggatcacgaggtcaggagttcaagaccagcctggccaacatagtgaaacccccatctctactaaaaatacaaaaattagccaggcatggtggcaggcgcctgtagtcccagctatttgagagtctgaggcaggagaattgcttgaacccgggaggaggagattgcagggagccgagatcgcaccactgcactccagtctggtgacagagcaagactctgtctctaaataaataaataaataaaatccattacaaatgttacwggagaaattaaaaaaatctttagtggctactacaagcaactatatgccaataaactgaaaactctagaagaaacagaaaaataaccagatatatacaatctaccaagattgaaccaggaagaaattcaaaacctaaagagaccaataacaagtaatgagatcaaagccataataaagactcccagtaaagaaaagtccaaaaaatagaggaggagggactacttccaaactcattctacgaggccagtattaccctgataccaaaaccagacaatgacacatcaaaataaataaataaat

SEQ ID NO: 155813 - DNA, 601 bp, Human
caaatcaaaaccacaatgtggtaccatctcacaccagtcagaatggctactaagaagtcaaaatggctgggcgtggtggatcacacctgtaatcccagcactttgggaggttgaggcaaaaggatcacgaggtcaggagttcaagaccagcctggccaacatagtgaaacccccatctctactaaaaatacaaaaattagccaggcatggtggcaggcgcctgtagtcccagctatttgagagtctgaggcaggagaattgcttgaacccgggaggaggagattgcagggagccgagatcrcaccactgcactccagtctggtgacagagcaagactctgtctctaaataaataaataaataaaatccattacaaatgttactggagaaattaaaaaaatctttagtggctactacaagcaactatatgccaataaactgaaaactctagaagaaacagaaaaataaccagatatatacaatctaccaagattgaaccaggaagaaattcaaaacctaaagagaccaataacaagtaatgagatcaaagccataataaagactcccagtaaagaaaagtccaaaaaatagaggaggaggga

SEQ ID NO: 155814 - DNA, 601 bp, Human
gcaaataaacaatggagctccaatacatctagcaacagacttttcaatgggaactttacaggccaggagagagtgtcattacatatttaaagtggtgaaggaaaaaaagactgttaccctataatagtatatttagttaaaatatccttcaaacatcaaggagaaataaagactttcccagacaaacagaagctgagaaatttcatcaacaccagacctgttctatgagaaatgttaaagggagtacttcaatcagaaagaaaaagacattaatgagcaacaaataatcacctgaaggtamaaaactcactggtaatagtaagtacacagaaaaacacaggatattataacactgtaactgtggcgtatagagaaatgcaaatcaaaaccacaatgtggtaccatctcacaccagtcagaatggctactaagaagtcaaaatggctgggcgtggtggatcacacctgtaatcccagcactttgggaggttgaggcaaaaggatcacgaggtcaggagttcaagaccagcctggccaacatagtgaaacccccatctctactaaaaatacaaaaattagccaggcatggtggcaggcgcctg

SEQ ID NO: 155815 - DNA, 601 bp, Human
cttttcaaatacatgtaaagccttcctaagaaggatgggtacaaacatgccaagattgcagactacagtaaatacctaacttttcagtgcccagacacagatgaacatccacaagtatcaagatcatccaggaaaatatgaacttaccaaataaaccaaataaggcacaagggaccaatcctgaagaaacagagatatgtgacctttcagacagagtattcaaaatagctctgctataggtttcaaaatcaaccctggctaggggcctgaagcaaaccagtttagtgctaacaacaacaamaaaaaaatctgatctaatttttttcactttactttctctcccacatattccttatttctcactctaccgctccaagcttcaacttccttgttcctaaatattttatgaaaaagttcaaaacactttttcttctggataagtaatatttgtgttttcttaatgtcatgctgtggtttgaattttcaaatttcatgaaaatttgtgtttcctgaaaaaaaaaaaaaaaaaacctctgctaaggaaacccaagaaattcaagataacacagagaagaaattcagaattccatcaaataaattt

SEQ ID NO: 155816 - DNA, 601 bp, Human
tgagaatgccacaacctaatgattacacagacaatcattagctccttcttccctgaagattccaacttctatcaaaagtactttatgaggaacatttaaagattacactgcatcaaaaagagactttcttaaagaagccaaatcatttttcctcttttgaacattttaaatataagttatacataataaaagagttgatccctcacacataatcacactttgttccagaaatcttaaagtcttaaaggaaaatgtgtattattataccagaagtcttgaagtgacttgaactggacaatgwggtattattatacccagaagccttagtatcttaaagtcttaaggtctctgtctatacagagagaactttcctagagcaccagtcttactcgatggtaagtaacgtaaacaatttttacattgcaacatgcatatatgtgtatataaatatatgttattgagtggaatgtaaaattcatataagttttataacaaaaaataggtgattttatggaaatattgaccaatattggaattgcaagtgaaattatatttgaagattaaacaagtctttggagaaataaatcacaccaccacctct

SEQ ID NO: 155817 - DNA, 601 bp, Human
taaagctatatatcattttgttttaactcttcactttatggataaagaaactgaactccagataatataaatgactagcataaggtcacagagctggttaataactgagccaaaactggaaactacatttcctatgactcagatatttccatatcactagccttccagggccaactcaagagagagaaactaacactttagtagcacatagatacaccttgagttgtctgtcacagatgctctgatgagaatgccacaacctaatgattacacagacaatcattagctccttcttccctgragattccaacttctatcaaaagtactttatgaggaacatttaaagattacactgcatcaaaaagagactttcttaaagaagccaaatcatttttcctcttttgaacattttaaatataagttatacataataaaagagttgatccctcacacataatcacactttgttccagaaatcttaaagtcttaaaggaaaatgtgtattattataccagaagtcttgaagtgacttgaactggacaatgtggtattattatacccagaagccttagtatcttaaagtcttaaggtctctgtctat

SEQ ID NO: 155818 - DNA, 601 bp, Human
tattaaagctatatatcattttgttttaactcttcactttatggataaagaaactgaactccagataatataaatgactagcataaggtcacagagctggttaataactgagccaaaactggaaactacatttcctatgactcagatatttccatatcactagccttccagggccaactcaagagagagaaactaacactttagtagcacatagatacaccttgagttgtctgtcacagatgctctgatgagaatgccacaacctaatgattacacagacaatcattagctccttcttccytgaagattccaacttctatcaaaagtactttatgaggaacatttaaagattacactgcatcaaaaagagactttcttaaagaagccaaatcatttttcctcttttgaacattttaaatataagttatacataataaaagagttgatccctcacacataatcacactttgttccagaaatcttaaagtcttaaaggaaaatgtgtattattataccagaagtcttgaagtgacttgaactggacaatgtggtattattatacccagaagccttagtatcttaaagtcttaaggtctctgtc

SEQ ID NO: 155819 - DNA, 601 bp, Human
gcttctggctatgacaaagtagctcacagcaaaccaatgctacttctaagaacaactagaaaagtaggatatcaaagatttggagagcttttaaggcagccaggatctgaggatccaagatccagaaagacaggaagcccattgaagtgaaaccaacattcattgcgttgtctttactcgtaagacatgtgctgagtctcaagtcaagcagacaagtgactgagaagcctaagaagctggtagagggagcccaccaagggacagagaaacaggtacaaaagtgagctgaaacctgtgcttrttcagtagagcttttggaaacgaactcccaagctagtgctgtttcctctgtgggaaaaggtttattactccaagtacaaattatattcaaacttgatttaaacttaactttctggtttacctttacagtaaaaactgtgtttacttcctagagttaaaagatgtacctggagatataacagtggtacatctggacttgggataaaacatcacagtgaggttggcctttcaactacctgcctgacacacatgcacatacacacaccatccagaccaaagccacccttaaaatttaaagaaa

SEQ ID NO: 155820 - DNA, 601 bp, Human
ggctaccacagagagcaaaaaatgaaaaaaataagtcaaagatgggtccttttcccttgactattgagcaggacttcccatcatatatgttagtaaaaataccctcgccccaaagatcttcattataataagcaaataaaagcatagggaagaagggaatctaggagttttattgctaattctggatttgccatctgatgctctggttagggaaaatttgggggttctttttaagttaataattgacttataaattctaatggtagaagttgtgtgtctaatgatgtttataatatatccrtaaactataacgtagatgacacttttatttttaagacacttttatttttcccacaatcatccaaagacatatttaaaccatgctgattactcaagagaaaataaatgtaaaataagagacatactatgacatttgtaaaagcctttcatcatatatatttttcatattgattataacaatacagcttttttgagtttaggtttcactgtgcattctagtattgtactcacctacaaataaaaatttaaatattagtagattattaaaatttttactatccataataaaatatttatttaa

SEQ ID NO: 155821 - DNA, 601 bp, Human
gctagagccaggtgactcccaaggacagggaggggccagctttagtatccctgctcctctcaatcagtggctgggagcagcctttgggaagcaagtgctcagcacaaaagcagcagtggatttcagagaacagcagctgggacccttggtcacttaggttgcctgtagttggaggtctgtgaagtacactcttagggctaccacagagagcaaaaaatgaaaaaaataagtcaaagatgggtccttttcccttgactattgagcaggacttcccatcatatatgttagtaaaaataccctygccccaaagatcttcattataataagcaaataaaagcatagggaagaagggaatctaggagttttattgctaattctggatttgccatctgatgctctggttagggaaaatttgggggttctttttaagttaataattgacttataaattctaatggtagaagttgtgtgtctaatgatgtttataatatatccataaactataacgtagatgacacttttatttttaagacacttttatttttcccacaatcatccaaagacatatttaaaccatgctgattactcaagagaaaataaa

SEQ ID NO: 155822 - DNA, 601 bp, Human
tctgtaagcccatcaggaagtgctagagccaggtgactcccaaggacagggaggggccagctttagtatccctgctcctctcaatcagtggctgggagcagcctttgggaagcaagtgctcagcacaaaagcagcagtggatttcagagaacagcagctgggacccttggtcacttaggttgcctgtagttggaggtctgtgaagtacactcttagggctaccacagagagcaaaaaatgaaaaaaataagtcaaagatgggtccttttcccttgactattgagcaggacttcccatcatrtatgttagtaaaaataccctcgccccaaagatcttcattataataagcaaataaaagcatagggaagaagggaatctaggagttttattgctaattctggatttgccatctgatgctctggttagggaaaatttgggggttctttttaagttaataattgacttataaattctaatggtagaagttgtgtgtctaatgatgtttataatatatccataaactataacgtagatgacacttttatttttaagacacttttatttttcccacaatcatccaaagacatatttaaaccatgct

SEQ ID NO: 155823 - DNA, 601 bp, Human
aaatgtgtttttaaaaagcaattatataaaaggcaatggttcccatgttcaccccctttgccaacattcaagcaaagaaaggcttatttaccatttcaacagatccatcccctgggtaaaataaaagctcataacgtcgaagaagtgaagcatttggatcataccactctgcaatgaaaacgaatctttcactatgattctgcaaagaaagacagaagaattttaacactaacatataaagaacaagcactcttctgtaagtcacacaaaatgaaattaccaatatgcaagaaacaaaatyacttctacctattatattgaatgtttctgcttttcaacaaagtatcagttatcaacacaccctcagcaatatttcctttcaatttctcactaaatacccttagatatctcaaagatgacttatggattgctttttactttacagccatctaatcatcctgagtaaattaacgttttctgagaacatgagctcctgattttactattgtaacaattcagtccttctgaaagcaagtttacatacagactatcaataaactaatataagaataaatttctgaggagagctctcaattatatg

SEQ ID NO: 155824 - DNA, 601 bp, Human
acacacatacatataaatgtgtttttaaaaagcaattatataaaaggcaatggttcccatgttcaccccctttgccaacattcaagcaaagaaaggcttatttaccatttcaacagatccatcccctgggtaaaataaaagctcataacgtcgaagaagtgaagcatttggatcataccactctgcaatgaaaacgaatctttcactatgattctgcaaagaaagacagaagaattttaacactaacatataaagaacaagcactcttctgtaagtcacacaaaatgaaattaccaatatscaagaaacaaaattacttctacctattatattgaatgtttctgcttttcaacaaagtatcagttatcaacacaccctcagcaatatttcctttcaatttctcactaaatacccttagatatctcaaagatgacttatggattgctttttactttacagccatctaatcatcctgagtaaattaacgttttctgagaacatgagctcctgattttactattgtaacaattcagtccttctgaaagcaagtttacatacagactatcaataaactaatataagaataaatttctgaggagag

SEQ ID NO: 155825 - DNA, 601 bp, Human
gtcttatcaaagataggttatattctgtttcttttttgttacaaatataaatcataatttttaataacttccatatttcctaatccaatctggtaataacataaaagcttcttattacaaatttaatactcttaaaaacctgaatagaaagatttgtttattaccaaatcatttcagcaaagtagtccttacaaaatgctaaagaaagagtcatacacccaaatttctgctttcttgtgtacacaaaatcccaataccaaaaagatctacttgttaaaattgtgttgccagtgaaagaacmcaaagaaacagaagtctcttagcttgagcctcttcaatttgactttttgtagcaataacagctttcaataatgaggacgtatttatgaccataataatccttatctataatcacttgtttatttcttatccaaaacatgaataatcccatttcagtctttttttttttttttttttttttttgagacaagagtctcatgcagtcgcccaggcaggacaggcaggagtgcagtggcgtgatctcagctcactgccacctccacctcctgagttcaagctattctcctgcctcagcctcccg

SEQ ID NO: 155826 - DNA, 601 bp, Human
atataacaaacaaacaaaaaaagttatgaataaggaaagttaatctcatcataaggtagaaataattcttaattctgtcttatcaaagataggttatattctgtttcttttttgttacaaatataaatcataatttttaataacttccatatttcctaatccaatctggtaataacataaaagcttcttattacaaatttaatactcttaaaaacctgaatagaaagatttgtttattaccaaatcatttcagcaaagtagtccttacaaaatgctaaagaaagagtcatacacccaaatwtctgctttcttgtgtacacaaaatcccaataccaaaaagatctacttgttaaaattgtgttgccagtgaaagaacacaaagaaacagaagtctcttagcttgagcctcttcaatttgactttttgtagcaataacagctttcaataatgaggacgtatttatgaccataataatccttatctataatcacttgtttatttcttatccaaaacatgaataatcccatttcagtctttttttttttttttttttttttttgagacaagagtctcatgcagtcgcccaggcaggacaggcagg

SEQ ID NO: 155827 - DNA, 601 bp, Human
actaacacccacactaagaatccaatcacctcaagagctataaagtgcttatacagaaagactatggaagtcacagaaagagatatcatattactataagagtgactcagacgttaggcaatcagctagtcatttgagtagtagatctcaaaaaatagtttgattgatttgttttccctattgaattaaatcatttttggagccttttatacatatagccttaacttctacaaataatccctattttaattacagcaccaatcactctacaggaaaaaaaaactccccaaaccatacaaartataagctacagaaattaaagccaagaaagatgacaaaggaattaaaatttcacttcaaatataattaattctagtctcagaaagttgaaattcataaatgtagagactgaaaattaaaatgtcatcttgctaatactgaaaatcagtattcagaaggaaaacatcaaaaatccttgttttcttgttttctataagtctaattttcagctgtatctacaagttgttctttctcttccattttttttcttagccccttttacagatgactgtatctcttctaaatcaaaactgagaaaaag

SEQ ID NO: 155828 - DNA, 601 bp, Human
atccatcaccatttgtgtactaacacccacactaagaatccaatcacctcaagagctataaagtgcttatacagaaagactatggaagtcacagaaagagatatcatattactataagagtgactcagacgttaggcaatcagctagtcatttgagtagtagatctcaaaaaatagtttgattgatttgttttccctattgaattaaatcatttttggagccttttatacatatagccttaacttctacaaataatccctattttaattacagcaccaatcactctacaggaaaaaaaaattccccaaaccatacaaagtataagctacagaaattaaagccaagaaagatgacaaaggaattaaaatttcacttcaaatataattaattctagtctcagaaagttgaaattcataaatgtagagactgaaaattaaaatgtcatcttgctaatactgaaaatcagtattcagaaggaaaacatcaaaaatccttgttttcttgttttctataagtctaattttcagctgtatctacaagttgttctttctcttccattttttttcttagccccttttacagatgactgtatctcttctaa

SEQ ID NO: 155829 - DNA, 601 bp, Human
tacatctccaagaggacaggaaaatgcatactgtgactgagttcctgctgtgatggagcctcaaataacttgggcttagaccttgggatcaaagattatacacacagttgacttcataatttttcttctgaaaaacaggggggtcttcctttcactgaaagttaatagatgggcacaagaatttcatgtatttaacatctactataatgttgttcacccaacctactgatgcctttctccctttaatttgattagatggcttgctttctggctgagactcaaaaggaatgaggattgctcmatgtaaatatgtggctcagtacttaaaattaatggatttttaaataggatactagcattatttttcattgatttttataaacttcttactaaagatataagctatcaaagtaaacatttaatacctcacttatcacatggggaatagctgtctattcatataaaattcctctatcattcatacacatgcatacatatacatattgactcatcatatgaaaactttaattatttctggtttgaggtaataaatttttagaaagacacaaattgtatcgtgtctccaaatctaaacaacaat

SEQ ID NO: 155830 - DNA, 601 bp, Human
aacatatatctgatgatactgccaaatcttcacatagaaaaaacgtatagttcatatgagtcaaattctaatattagaaaatgtatgttcatccataagaattgttaaactacataagtctagaaaacatataaagtattatttcagtaccttttaaaaaattatcaattaagcaaatgcttggaatttttgggctgtatttaaaaattcaaaaggtgatttagttcaaaaggttatttaggtcaatctccctacctccagggagaagtattcttaagccccttccaagcacaggtctcayctaaaatacggcttgtttttttatccatataccatttcagtacatctccaagaggacaggaaaatgcatactgtgactgagttcctgctgtgatggagcctcaaataacttgggcttagaccttgggatcaaagattatacacacagttgacttcataatttttcttctgaaaaacaggggggtcttcctttcactgaaagttaatagatgggcacaagaatttcatgtatttaacatctactataatgttgttcacccaacctactgatgcctttctccctttaatttgattagatggc

SEQ ID NO: 155831 - DNA, 601 bp, Human
agtcatggagtacatagaatcccctgggagagtatatagaatgagaaaaaaagggccatgaacagaaccctggggaataccaggagtcttttttgcctctgagaaggaatgactctgagaaaaaatagccagagagatagagatggaagcagcggtgggggtagcggtggtgaagtgccataacaaccaggggaagacagaataataatttttaaagtattctaaacttaatttattccagttgggatggaagaacagaagaggtacattttttgtatttattaaaattaaatttaattttattttaattttaattttaatttaatttttaaatttaattttaattaaaattaaaatgtcttttaagtcattcatacattatgatatcccaatactgtaatcctgctaaactatataatacctgaacactgaagttgtttcaaacttgatatagccaagattttatgacatttccttccaatgaaatttcttcaaacatatatctgatgatactgccaaatcttcacatagaaaaaacgtatagttcatatgagtcaaattctaatattagaaaatgtatgttcatccataagaattgtta

SEQ ID NO: 155832 - DNA, 601 bp, Human
attgttgaagtcatggagtacatagaatcccctgggagagtatatagaatgagaaaaaaagggccatgaacagaaccctggggaataccaggagtcttttttgcctctgagaaggaatgactctgagaaaaaatagccagagagatagagatggaagcagcggtgggggtagcggtggtgaagtgccataacaaccaggggaagacagaataataatttttaaagtattctaaacttaatttattccagttgggatggaagaacagaagaggtacattttttgtatttattaaaattaaatttaatttaattttaattttaattttaatttaatttttaaatttaattttaattaaaattaaaatgtcttttaagtcattcatacattatgatatcccaatactgtaatcctgctaaactatataatacctgaacactgaagttgtttcaaacttgatatagccaagattttatgacatttccttccaatgaaatttcttcaaacatatatctgatgatactgccaaatcttcacatagaaaaaacgtatagttcatatgagtcaaattctaatattagaaaatgtatgttcatccataag

SEQ ID NO: 155833 - DNA, 601 bp, Human
tacagctggggtgatgacataaatttggaaagcaacacattgttgaagtcatggagtacatagaatcccctgggagagtatatagaatgagaaaaaaagggccatgaacagaaccctggggaataccaggagtcttttttgcctctgagaaggaatgactctgagaaaaaatagccagagagatagagatggaagcagcggtgggggtagcggtggtgaagtgccataacaaccaggggaagacagaataataatttttaaagtattctaaacttaatttattccagttgggatggaagarcagaagaggtacattttttgtatttattaaaattaaatttaatttaattttaattttaattttaatttaatttttaaatttaattttaattaaaattaaaatgtcttttaagtcattcatacattatgatatcccaatactgtaatcctgctaaactatataatacctgaacactgaagttgtttcaaacttgatatagccaagattttatgacatttccttccaatgaaatttcttcaaacatatatctgatgatactgccaaatcttcacatagaaaaaacgtatagttcatatgagt

SEQ ID NO: 155834 - DNA, 601 bp, Human
ctcaaacacgctttcacaagacagcctaagtaaaattaatacttaatattttgatctacatctatctcctgtgttagttcttcatcagttagtaatttggagggaagaatggagactaactgagctcaagagatgacaagaagctgttttaaggaggaatgtaaaagataaaaaagagaagagaaataagagagatctatgaaggagacaagtaaattggtaagattaggtccccatgtggatttagggataaaatacatatggaactcaaggacagccaccaattttgtaagtatgtaattaggtgaatattgtgttagtgcatacagaagtaggtttttcaatgaaagagaattaatttaattttgaatttgtcaattaattcaattttggatttttaagttcctgtgaaaaatctacatggaaacgttcaggaaaaagcttaaacatatggttttacagctggggtgatgacataaatttggaaagcaacacattgttgaagtcatggagtacatagaatcccctgggagagtatatagaatgagaaaaaaagggccatgaacagaaccctggggaataccaggagtcttttttgcct

SEQ ID NO: 155835 - DNA, 601 bp, Human
gggatagaggaaataggaatagaaagaaagcctcaaccattctcaaacacgctttcacaagacagcctaagtaaaattaatacttaatattttgatctacatctatctcctgtgttagttcttcatcagttagtaatttggagggaagaatggagactaactgagctcaagagatgacaagaagctgttttaaggaggaatgtaaaagataaaaaagagaagagaaataagagagatctatgaaggagacaagtaaattggtaagattaggtccccatgtggatttagggataaaatacayatggaactcaaggacagccaccaattttgtaagtatgtaattaggtgaatattgtgttagtgcatacagaagtaggtttttcaatgaaagagaattaatttaattttgaatttgtcaattaattcaattttggatttttaagttcctgtgaaaaatctacatggaaacgttcaggaaaaagcttaaacatatggttttacagctggggtgatgacataaatttggaaagcaacacattgttgaagtcatggagtacatagaatcccctgggagagtatatagaatgagaaaaaaagggcc

SEQ ID NO: 155836 - DNA, 601 bp, Human
caagctggagctgaaaaggaaattcaactctaatctgttaactgaccaaggaccatatgactgagaattgtagaatggaaaggcagaattcttattttacagaaaaaaatatcaatttctccctgggaatttaataatgagaaggcattcttcattgtattatttgggaggcagttacactgttgttgggtctatcgtataatcaatagcatgccatcttagacaacgatactatagataagtaaagatgagaaaaagattgggggtgagtttttagcaaggcctctgttactgaactaargtattcctctaaggcattagggtgcccttctgcagccaaaactcaactgctcaccactggtcctaggacaatatacaaagcaacagtaattggtattgagggaaaggtttcccaaaggtgagagcaagactaaactaatattcatctggtctgttccccgagaagtagccatagtctactagagcatggcagccaattggcttaaaggtataaaacccagaaaacaactaggaatgtgtactcttgctcctcatgagtaaagtaacttctatccctgttcccataagaaagtgctctctc

SEQ ID NO: 155837 - DNA, 601 bp, Human
gatggctcaagctggagctgaaaaggaaattcaactctaatctgttaactgaccaaggaccatatgactgagaattgtagaatggaaaggcagaattcttattttacagaaaaaaatatcaatttctccctgggaatttaataatgagaaggcattcttcattgtattatttgggaggcagttacactgttgttgggtctatcgtataatcaatagcatgccatcttagacaacgatactatagataagtaaagatgagaaaaagattgggggtgagtttttagcaaggcctctgttactraactaaggtattcctctaaggcattagggtgcccttctgcagccaaaactcaactgctcaccactggtcctaggacaatatacaaagcaacagtaattggtattgagggaaaggtttcccaaaggtgagagcaagactaaactaatattcatctggtctgttccccgagaagtagccatagtctactagagcatggcagccaattggcttaaaggtataaaacccagaaaacaactaggaatgtgtactcttgctcctcatgagtaaagtaacttctatccctgttcccataagaaagtg

SEQ ID NO: 155838 - DNA, 601 bp, Human
taacttggtagtaatttgttataacttcaatagaaaaccatataatagaaaaaaaaaactgaagagaggaagaaaaatttcttcaactaatccaaagaaaaggcaagaagaaaaaaatagaaaaacaggaaaacagtaaaatagaaacatatacaaaaataacaataatcacagcatatttcaatgtacatgtattaactttaccaatgaaaatataaccattccagattaaattgaaaaaaaacctatatgttatttacaagagacatatctaaagcataacagggcaagtataaaagakatggcaaaaagatattaattaacccaaatacgctatcaatcaaaccctttctaaggaaagatggctcaagctggagctgaaaaggaaattcaactctaatctgttaactgaccaaggaccatatgactgagaattgtagaatggaaaggcagaattcttattttacagaaaaaaatatcaatttctccctgggaatttaataatgagaaggcattcttcattgtattatttgggaggcagttacactgttgttgggtctatcgtataatcaatagcatgccatcttagacaacgatacta

SEQ ID NO: 155839 - DNA, 601 bp, Human
ctttagagaaccagagagatgtcagtgtgaggaggactcaagcctgctattggtggctttgaagatggagaaaggtggccccaaaccaaggaatgtggatggcttcaagatgttggaatgtgcaaggaaattgattctttcctagagcctcaagagaaatgcagtcttatcaacacctgatctttacctgatgagatctgattggacttctgacagaactgtaagatcataaatttgtattgtttaagtgactaacttggtagtaatttgttataacttcaatagaaaaccatataatagaaaaaaaaaactgaagagaggaagaaaaatttcttcaactaatccaaagaaaaggcaagaagaaaaaaatagaaaaacaggaaaacagtaaaatagaaacatatacaaaaataacaataatcacagcatatttcaatgtacatgtattaactttaccaatgaaaatataaccattccagattaaattgaaaaaaaacctatatgttatttacaagagacatatctaaagcataacagggcaagtataaaagagatggcaaaaagatattaattaacccaaatacgctatcaatcaaaccct

SEQ ID NO: 155840 - DNA, 601 bp, Human
gaataaagaaaattggtcaataaccatcaacttagaattgtgtgtctagcaatagtatcattaaagaaagagggtaaaataaaaaacgtgcagattaaaaagaaacgggtagtttacaatgaagaaatgaagaataacaagaagagaaaatattctaaaaggacaggttgatatgcaagaaaaattggtgaacaaatgtttaggtaaatctaagcaaatgttgtttctatcaaaataaataaataaataaataaaagaatgtctaacatgcaggcaaaaaaactgaatgtccaaaaacaamaataataacaaaactatgtaagatttaagagagaagattagagctaaagtgtcctaatcttgttgtatgagttgggagagagccatattattatagaactgtaagttaaatatatgaaaaaatttcaagcctaaccaataaagaacaagtataaaaatcacataacctctaaagcaacagagaatatagtaggcagaataacactacccctcaaaaatgtccacattataatctccagaacgtataaatatattacctcacctgccaaaaaggactttgcagatgtgattaagattacag

SEQ ID NO: 155841 - DNA, 601 bp, Human
acagtagatgcagattataaaactgtatttataaaaaaatttttttaaaaagataatctgattggattttaaagcctagatgataggttgaaaggtgcagcaaaccaccatggcacatgtatacctatgtaataaacctgtacattctgcacacgtatcccggaacttaaagaaaaaaaaagatataaaaaacaaacaaacaaaaacaaaaactaatgaaaggcacacatagaagagaatactgaaaatctaaagtaaaaagaatggaaaaggtataccatgcgaatgttaactaaaagaragccagtgcagctatagtaatatcagagaaagtacagtttaaagtaaaaggcattgctagagatgaagatggtctcttcatagtaataaaagattcaatttaccaagaagatataacaatttaaatcacctagtaacatacccttaaaattataatataaagactaacataactacaagaagaaatagacaaatgataattacattagaaaattttaataaaaccttggcaattgatagaataagctgcccaaaaattagtaaatatgtgaaagatttgaacatcacaattcacagactt

SEQ ID NO: 155842 - DNA, 601 bp, Human
agagaaaaactgtaaagtatctgtgcaaactatggttaaaggactaaaagacaagctacaaaacattatcaggtaatagaaaactgtaagctacaaaatggaataagcagatctgaaaaagaatatattagaatatcttgtgatgaaaatacaataatgaaaatgagaactagataaagggtttgacagaagaaagcagattcagaatgaagcacagagaaacaaaaagatacaacagagataagaaaatagtttcatgaatgtaagtgaaataaagacattttcagatgagtgcaaactaagttttctattagtaaacacactcaaaaggaaaatattttttaaaaatgtaatttaagcaaaggtaaaataatcccaaacagaatgtttgagataaaagaaaggataaaaagcaaaaagtgaagaaacctaaatgaatactcattacataaaacaataatagtaaatcattaggttcatggaaaaaaaacaaaaaaaaatacacaacaaaaacagcatataattcagcaaaaatcccaacaaaaattgagctaaagtcttctgagattcttagattttaaagaaggaggttaaaatatta

SEQ ID NO: 155843 - DNA, 601 bp, Human
aaagtaaacctattctaaacatcaaggctaaatttttggtttttctcatactttgtttacaagcataaagtgtatatctgccccatggataaaggaaaactgtctcaaatgaggcacctgtaatttggtggaaaattcagtgatcaagacttttgcttggcaacaatagcaaaattattcagaacaattcttccaccaaaaactaaaaaagttgatatttttaaaaaatcttttaaaaattaaagataaattgactagatcataaataattactgggacaaaagtgaaaaaaaaaaaaaaacaaccaaagaatgaaaagtaagaatgaaagttgtttttgacttgacagcattgcctatctggaaaatctgaactttgatttgcagtacatcattgggaaagggtaacagaacccaagagatgatccttcctaaaataatttggacccaaaggctataccacccccgcttaaggtgaatcagaaacaaccaggtcttgaatggcaatacaagttcacatcatctaagcagtctcaaaacttagaatttttgaactaccaatcatacagactgctaatgcctatgggaaaaagacagaagca

SEQ ID NO: 155844 - DNA, 601 bp, Human
caaaagaaattgttcatcttagtgtgtttattacaaattataccagataatgtttttctttattttaaagcagatgagtcagttatattactttatattgtctggcttcattgaaaacacacttaaaactcttcactttttaattcatattatttaaatattttaatccagactaacctataaactgtttatgctaaactctggaagaacatttcactgaccatggctcttaaagaaaaaataaaacatggcagtagtcatcaatgtctataaacaagaagcaatgtgaaaagtctaaaaytgacaaacagcttaaaatgtaatctgattttctcttaaatgcctacaagagacaaaggattgactatgtgataaataactctaaataaattcctctgtcatgtctttgctgcttaatttttcagtaagtaatagtaaattgtattttggagggaaaataagagagagatcagcatcatatgtgttaatttaaaaataaagacagcacatgaagaaacaatagggtgacaaagatatatcagtagtatctctgttatctgtaactgcataacaaaccatccacatatgtagtggcgtaaaa

SEQ ID NO: 155845 - DNA, 601 bp, Human
tctgtccttccacatcacaaataatgttactattaatattattaaaaaggggcatcatcaccaaatcctcaagaatactatttgcaaatgcaacataaaaactatattagctggagtaattctgcttttgtgataaagaattgctgctacttttccctctgcatttccagttgttcttataacactggcattaattcaaggaatccataaaaggagaaaggttggtcttttcattttggatttttttcaccaataagacaaacttagctcaggataaaattcaaatatcctggccgggcgyggtggctcacgcctgtaatcccagcactttgggaggccgaggcaggcggatcaagaggtcaggagatcgagaccatcctggctaacacggtgaaaccccgtctctactaaaaatacaaaaaattagccaggcaaggtggcgggctactactagtcccagctactaaggaggttgaggcaggagaatgatgtgaacccgggggtcggagcctgcagtgagccaagatagcaccactgcactccagcctgggcgacagcgagactccatctcaaaaaaaaaaaaaaaaaaaaaatcaaatat

SEQ ID NO: 155846 - DNA, 601 bp, Human
agatgaagatcacctgagtgtcctcattttactaatgatgaaactaggcctaccaaggtaacatgacaaaggttacacagctggtcagcaacattttcaggacaaaacacccagtttaccagactcctaggtctgtccttccacatcacaaataatgttactattaatattattaaaaaggggcatcatcaccaaatcctcaagaatactatttgcaaatgcaacataaaaactatattagctggagtaattctgcttttgtgataaagaattgctgctacttttccctctgcatttccarttgttcttataacactggcattaattcaaggaatccataaaaggagaaaggttggtcttttcattttggatttttttcaccaataagacaaacttagctcaggataaaattcaaatatcctggccgggcgcggtggctcacgcctgtaatcccagcactttgggaggccgaggcaggcggatcaagaggtcaggagatcgagaccatcctggctaacacggtgaaaccccgtctctactaaaaatacaaaaaattagccaggcaaggtggcgggctactactagtcccagctactaagga

SEQ ID NO: 155847 - DNA, 601 bp, Human
atcctagatcatcaaaatttgaaattaattgtatagaaaagtgtattaaagacatcccttaaaaacttacacaaagtaagcttagtatttttcccatgaacatcaaaattagatactaaacttgggggagggagaagcttaggaaaaaaagcactaaaatttaattatttttaatatatccaaatgagaaaacacaggcatttagaatctccatttcttagaatacattttatacaaaggactaatctctaaaacattgcattaaatatattatgagcttggtttttggtctcttagactycaacatatgtatgctatatagtcagttcaacattgatttggaaataattataaattcttctattgactctttattcataacatgggtgactgcatgaagaatcaaatgtcttcttatacaacaatgtatatgaatacgtaacaacatgctaacttttaaaatcatgtttttctccaggaggatacatcagaacaatgcattctccactctccccctctgaagattcagaattaagagaaatttggagatgaagatcacctgagtgtcctcattttactaatgatgaaactaggcctacca

SEQ ID NO: 155848 - DNA, 601 bp, Human
tttgtgagccacactcctgtttctcaattccacagacactgaataaagcctgcactgcttgatactcactttcggttttgtatatgggcttcatgacactgaataggaaaagatcaaatcttttagggggccggctttgtcagtaacattctagatgaactcctgtcagttcccattttggttaagttactattctattctttgtcattcaatacgaggttttttaattttaaacaatgacaagaaagacagaaaatgattttttaaaaaggaatcagacattacataactgaaaatgataaaaaaattaccttgaaagcatcatcattttgagtttggttatagtaaatccagctttgtttattatttcaattatttctccagcctttgatattgcatctggtttaattagggctagcgttctataaggaaacaaaaaataagtttgcaaataaaaatagttcaacagtttttatttataattcccaagcagcagtattctcaacaatcatcctagatcatcaaaatttgaaattaattgtatagaaaagtgtattaaagacatcccttaaaaacttacacaaagtaagcttagtatttt

SEQ ID NO: 155849 - DNA, 601 bp, Human
ctatactcatctcccttcttcatcttccagaatgtttcagtctttgctttgtccatttggtaggaaattttttaaaaacaaatgtccaatatcatggaaaaatcactagttttttttctaaaggatctctaaaaaaaactgaagagaaggttttccctatcctttgtttgtacgttgttaatattctccttgccattcttacggggttagagttacttacttcatgatagaaagggataagtaaatgtataagtcttattttcactaaataacttagaaaatatctggtcaaacaggttgkactgcttgttagataggtatatttacctatctaggtaaaaaataaataggtatatttgcctattatttataataagaagagctaaatgtaaacatttccaaatgcatcatctttggaaatctcaacagtaaatcctcttgtcaaataaaaataatcagacatcatttcctctattaattttatacagtgtgttatccttatatattaagaaatgattataattatcaagcactggtgttataaaagcagatggggttttgaaagacaataataattaaatgaggcatgcataatttgaca

SEQ ID NO: 155850 - DNA, 601 bp, Human
attataaatcccattttaagccaggcgcggtggctcatgcctgtaatcccagcactttgggaggctgaggcgggtgaatcatttgaggtcaggagttcaagactagcttggccaacatggcgaaactccgtctctactaaaaatacaaaaattacccgggcgtggtggtgtgctcctgtagttccagctacttgggaggccaaggcaggagaattgcttgaacctgggaggtggaggttgcagtgagccgaaatcgtgccactacactccagcctgggcaacagagcaagactccatctcaaaaaaaaaaaaaaaaatcccattttgcaaatgaagaaataaacacagtggtcaactgttcagtcacacacctagtaagtagcacagttacaagcaatctggtctaaatactgtgctctgaaatgtaagcctcctgtctctctagaaaatatgtaaactaggagatcatacataagggaaaaattccaattaaacatgtcattgtcagggtaaaatggagggttttgtgttaaagtttctcggaatcagatgtattgaagctgacttgaatgtctactgctccccattgtccctgctctca

SEQ ID NO: 155851 - DNA, 601 bp, Human
agtatttcaaaaggcatgggtggaattaacaagacttaaggtttcaaagaaactagcaaatgtatgccctatggtgctcttgaagtgtttgctggttttagcatctttcttcatgtgctatagggccattatgataaacaagtagcatctttaccacaggaagttagataccaagtcatcagacactagaagtatagagacactaaactcatgtaaccctcacaactactttatgagataggtactattataaatcccattttaagccaggcgcggtggctcatgcctgtaatcccagcamtttgggaggctgaggcgggtgaatcatttgaggtcaggagttcaagactagcttggccaacatggcgaaactccgtctctactaaaaatacaaaaattacccgggcgtggtggtgtgctcctgtagttccagctacttgggaggccaaggcaggagaattgcttgaacctgggaggtggaggttgcagtgagccgaaatcgtgccactacactccagcctgggcaacagagcaagactccatctcaaaaaaaaaaaaaaaaatcccattttgcaaatgaagaaataaacacagtggtcaa

SEQ ID NO: 155852 - DNA, 601 bp, Human
atttcaactaaactaaaaatgtgcgggcaaagatacactctgttaagacactatggacatagggatatttgttcacaatgaaacttgatttccagaggggccagtgaaaatggtttggtaagagatttgtgttcagaagactatgggaaaaggaagtgcataactacaaatgaacaggtgtgtcaacaagtaattagaagggcttgcatctgtggtactccaaagaatgaagtatttcaaaaggcatgggtggaattaacaagacttaaggtttcaaagaaactagcaaatgtatgccctrtggtgctcttgaagtgtttgctggttttagcatctttcttcatgtgctatagggccattatgataaacaagtagcatctttaccacaggaagttagataccaagtcatcagacactagaagtatagagacactaaactcatgtaaccctcacaactactttatgagataggtactattataaatcccattttaagccaggcgcggtggctcatgcctgtaatcccagcactttgggaggctgaggcgggtgaatcatttgaggtcaggagttcaagactagcttggccaacatggcgaaa

SEQ ID NO: 155853 - DNA, 601 bp, Human
agattgacagttgcagagagaagtcaaggctgaagatgtatttggaattcatctataagtaagtggtaggtgatcatatggacatgcatgggactactcaagtaaagttgtaaagaaaataacatacaacaagctggatgcagtggctcatgcctgtaattctagcactttgggagtacaaggcaggagactcacttgaggccagttcgagactagcctgggcaacaaagcgagaccacgttttttaaaaaaacaaaaagcaaggatctggaggaatacctaattgaaatcatagtgaccrtcactgagatgggaaagcaaatagagcagagccctggatgatcactgacagagatgttgaagtcatcccaactgtcaggagacactggaatagaaggagactataaacaaagtgcccaaatctttaacaaatgtggagtttgtgaactgtagaatggaaatgaggctcagtggatggtaaaacaactaaataacatgaatttccaaggatgaagaagagtatagatttttaggagagagctaaaatacgctatatcgtgaccctgtgacataagaaacatttgtgagtgagcagcctaca

SEQ ID NO: 155854 - DNA, 601 bp, Human
tatgtacaagaaaactgagatgtgataaagcacaacatgttcagggaactgaaacctaagtatcctcttagagctattacagtaggtgagtacagatgactaagagtcttgtatactctatcaaagagcttgtctgcttgaccatattttcctgcatatgggaaaccactgacggatttaaggaagggaatggtaacatgttcaaattttcattttatgaggttcattctaatggcaataagaaaatggcatggagcaatcttgaggtaggaaatgagccatcaaggaatagaaggtagtragtcaagaagtagacaaatcagtcagtagcctatgttgatacgttgaaagcctgaatatgagcctataaaatgcctaaactaaggggctgcaataggaattataaggagagaattgctcccagagatatacagaaagcagaagtaaaaatatttatatatcaggtaggtatgaggaatgggggagcagcaagatgaatctaggatcactttcagattgacagttgcagagagaagtcaaggctgaagatgtatttggaattcatctataagtaagtggtaggtgatcatatggacatgca

SEQ ID NO: 155855 - DNA, 601 bp, Human
gttttcttaaaggctttgaactgggttcacagtatgtgacaaatatatgtaaacattaactacttttaaaactggaaactgttccctagcaaagaatcaacctttcaggcttgagaattcatttgatatgcaatgcttttaagattttatcaggatattacaaaatgaatttacataacaagttatatcacgcatactctcattctaaccaaatgtacttaaacattcatttggctatgaagagattatgaaatatgtaatgccaatatagagaataaaattcatcccgagacatggaaargagaaaaaaatcaaaattttctagagccaattatagccatgattaaattattatatttattccttacaacaatatattgaaataggtgtgatcacctttattttacatcggaaaagaataaagttcagcatggttacataagttgtccagttcacaaagctagtaaggacaagacaagaagatttgaacccaaagctctctgattgcaaatttctgactgcttatgctcttgctactactaactgtagaacaacattctagagggtaaagagaaaaactcacaaaaaaagagatacgtat

SEQ ID NO: 155856 - DNA, 601 bp, Human
agctaatttttgtacttttactagagatggggtttcaccatgctggccaggctggtctcaaactcctgacctcaggtgatccacccacctcggcctctcaaagtgctgggattacaggcatgagccaccgcacctggccttatccatctttttacacagcatcctgaacgttctagaaacaaaggttaatatttgaccagtgagaatatttgttctttaaagtctaaataagttgcatcaaaaaaatgcaaagccatcttctaattaaaaatttgtcatttttttccacaggctttaaacwtaagagcttaggctagaattttaatttaatgtttatagctttttttcttagctaggtctctccaaaggaaagactacagtcgtgtttttaaaagctgcctgagaaattatgtatcttaatatgtttttattttattggttactaatgctttaactgacatcactaaaaaaggggagaatatggaaacatttagaattcagagtttattaattgtaacagggatttatttttacatttatattaccactaaagaatatctacagcggcaataaaagaatgcattttaaactgattagctaa

SEQ ID NO: 155857 - DNA, 601 bp, Human
aagtaaaagttgacataaaaaataaaaattaaaaaaattaaaagccccacaaacacaaaagcataataaaaatattgaacatcaaatataattatcactccatttttaatcaaccaaaaattttaaaagttatccttcttgtaatgtaaacaaatctttctatttgcaactgattaaactttaagatttttaatgataaaatataggaattcttacttaataaaaagacagagaatataattcttagaattctgtgcagttgcaagatgttgctatggcccttttgacagattattctcawgtaataaattttacaaatgtaactccatagttttctaggatatcctcctttacataccactaatccccaaattaaggacctacttgaaaaagggtcttgactggtgatctacatgaaaatccaatgcttctttcctataaaataatcaaaatgacaatagttaagaattataaaattaaacacttattattttagcttacattaataaaattaagataaaatcctctcaatttatactaatttatattttaattaataatttttcaccaaatattctgtcaaagccactcttttaaaata

SEQ ID NO: 155858 - DNA, 601 bp, Human
tcagtggtgaactggataaaaaaaatgtggtacatatacaccatggaataccatgctgcaataaaaaagaatgaaatcatggtctctgcaacaacatgaatggagatggaggccattatcctaagcaaattaacgcagaacagaaaaccaaataccacatgttcttacttataagtgggaactaaataatggctactcatggacaataatatctattgatggcaacaacagacactggggactactagagtgggagaaagggaagggagcaagggttgaaaaactaactattgggtattaygctcagtacctgggtaatgggatcaattgtaccccaaacctcagcatcacacaatatacccaggtaacaaacctgcacatgtaccccctgaatctaaagtaaaagttgacataaaaaataaaaattaaaaaaattaaaagccccacaaacacaaaagcataataaaaatattgaacatcaaatataattatcactccatttttaatcaaccaaaaattttaaaagttatccttcttgtaatgtaaacaaatctttctatttgcaactgattaaactttaagatttttaatgataaaatat

SEQ ID NO: 155859 - DNA, 601 bp, Human
acaattggaggccataatcctaaacaaattaatccacaaacagaaaaccaaatgctgcatgttcgcacttacaagtaggagctaaacattaaacacacatagacacaaatttgggggtaatagacactgtggactactagaggagagaaggcaggtggtttgaaaaactacctattgggtactatactcactacctggatgatgggatccatactccaaacctcagcatcacacaatattcccacgtaacaaatctgcatgtgtaccccctgtatctaaaatagaagttgatttttttttaaaaaaaaagtcaaaaaacgacagatatgctggcaagtctgtagagaaagggaacacacttatacactgttgatggaaatgcaaattagtacctcaaccactgtagaaaatagtttggagttttttcaaaggacttaaaacagaactaccatttgaaccttaaatcccattactgctatatatccaaaagaaaacaaacctttctaccaaaaagatacatgcacttgcctgttcattgcagcactatacaaaatagcaaagacatggaatcaacccaggcgcccatcagtggtgaactgga

SEQ ID NO: 155860 - DNA, 601 bp, Human
cacaattggaggccataatcctaaacaaattaatccacaaacagaaaaccaaatgctgcatgttcgcacttacaagtaggagctaaacattaaacacacatagacacaaatttgggggtaatagacactgtggactactagaggagagaaggcaggtggtttgaaaaactacctattgggtactatactcactacctggatgatgggatccatactccaaacctcagcatcacacaatattcccacgtaacaaatctgcatgtgtaccccctgtatctaaaatagaagttgattttttttwaaaaaaaaagtcaaaaaacgacagatatgctggcaagtctgtagagaaagggaacacacttatacactgttgatggaaatgcaaattagtacctcaaccactgtagaaaatagtttggagttttttcaaaggacttaaaacagaactaccatttgaaccttaaatcccattactgctatatatccaaaagaaaacaaacctttctaccaaaaagatacatgcacttgcctgttcattgcagcactatacaaaatagcaaagacatggaatcaacccaggcgcccatcagtggtgaactgg

SEQ ID NO: 155861 - DNA, 601 bp, Human
taatatggacacaattggaggccataatcctaaacaaattaatccacaaacagaaaaccaaatgctgcatgttcgcacttacaagtaggagctaaacattaaacacacatagacacaaatttgggggtaatagacactgtggactactagaggagagaaggcaggtggtttgaaaaactacctattgggtactatactcactacctggatgatgggatccatactccaaacctcagcatcacacaatattcccacgtaacaaatctgcatgtgtaccccctgtatctaaaatagaagttgatttttttttaaaaaaaaagtcaaaaaacgacagatatgctggcaagtctgtagagaaagggaacacacttatacactgttgatggaaatgcaaattagtacctcaaccactgtagaaaatagtttggagttttttcaaaggacttaaaacagaactaccatttgaaccttaaatcccattactgctatatatccaaaagaaaacaaacctttctaccaaaaagatacatgcacttgcctgttcattgcagcactatacaaaatagcaaagacatggaatcaacccaggcgcccatcagtg

SEQ ID NO: 155862 - DNA, 601 bp, Human
aattctgccaaaaagacacatgccctcatacactcattgctgtgctattcacaatagcaaatacatggaaataactcaagtgcccatcagtggcagattggataaagaaaatgtggtatatatatataacacagaattctacacagccataaaaaaataaaattatgtccttggcaataatatggacacaattggaggccataatcctaaacaaattaatccacaaacagaaaaccaaatgctgcatgttcgcacttacaagtaggagctaaacattaaacacacatagacacaaatttgrgggtaatagacactgtggactactagaggagagaaggcaggtggtttgaaaaactacctattgggtactatactcactacctggatgatgggatccatactccaaacctcagcatcacacaatattcccacgtaacaaatctgcatgtgtaccccctgtatctaaaatagaagttgatttttttttaaaaaaaaagtcaaaaaacgacagatatgctggcaagtctgtagagaaagggaacacacttatacactgttgatggaaatgcaaattagtacctcaaccactgtagaaaatagt

SEQ ID NO: 155863 - DNA, 601 bp, Human
acgagtgggactaaagagcttctgcacagaaagcttctgcactagcaacagagtaaaaagacaatccacagaatgagagaaaatattcacaaactatgcattcaacaaaggactaatatgcagaatctgtaacgaccttaaataatcaaacaagcatgaaacaaccccactaaaaaaagagcaaaagacataaatacacacttctcaaaagaacatacaagcagccaataagcatacgaaaaaacgctcaatatcactaatcatcggagaaatgcaaatcaaaaccacaatgagataccayttcacaccagtcagaatggttattattaaaaagtcaaaaaataacatgctggcaagactatagaggaaagagaatgcttatacacggttggtgggaatattaattactccagccattgtggaaagcagtgtggatatttctcaaagaacttaaaacagagctaccatttaacctagcaattccattactgggtatatacccaaaagaaaagaaattctgccaaaaagacacatgccctcatacactcattgctgtgctattcacaatagcaaatacatggaaataactcaagtgcccatc

SEQ ID NO: 155864 - DNA, 601 bp, Human
aaccaaaacatcatggtactggtacaaaaacagacacatagatcactggaacataatagagaacccagaaataaagccacacatctacagccatctgaactttgacaaagtcaacaaaaataagcaatggagaaaggattctctattcaataaatggtgctgggatacctgtctagccataagcagaagaaagaaactggccccttaacattaaccatatacaaaactttactcaagatggattaaagatttaaaagtaagacctcaaactataagaatcctagaagaaaacctaggaaayaccattctggacattggcctggggaaagaatttatgactaagtcctcaaaagtaatggcaacgaaaacaaaaattgacgagtgggactaaagagcttctgcacagaaagcttctgcactagcaacagagtaaaaagacaatccacagaatgagagaaaatattcacaaactatgcattcaacaaaggactaatatgcagaatctgtaacgaccttaaataatcaaacaagcatgaaacaaccccactaaaaaaagagcaaaagacataaatacacacttctcaaaagaacatacaagcag

SEQ ID NO: 155865 - DNA, 601 bp, Human
aatcattagactaggagttgtaagttaatgctataaacatatacaaagtttataccaaaagataatttccaccaattttctagaaaagtgtatatagctattctaagaaggcttaggaatattttataacacttgatttgaaataatctatagcataataattttcttacatacaaatttttttaaaaacccactactcagtgcaggatatcaaataacatgtctactgtggccatttagtttggctgatgtaacattctttcttattagaagtgtaaacagtctttggcaacagtaatartaatatgagcatgcaaaatattcacttaaatttaattacatgtcaaatatttagaatacataaagtgtaacatatattatctgttctatgtcaaggaacaaaatatatatcaaactagttaaaatagaaaggttccatgaacattgctttatgtatacaagactaccaaaatagtttaaaagtacaacaggctacagtaaccaaaacatcatggtactggtacaaaaacagacacatagatcactggaacataatagagaacccagaaataaagccacacatctacagccatctgaactt

SEQ ID NO: 155866 - DNA, 601 bp, Human
ctagttaattcattcctttaataaaatttactgcatgcaaatcacacataaatcattagactaggagttgtaagttaatgctataaacatatacaaagtttataccaaaagataatttccaccaattttctagaaaagtgtatatagctattctaagaaggcttaggaatattttataacacttgatttgaaataatctatagcataataattttcttacatacaaatttttttaaaaacccactactcagtgcaggatatcaaataacatgtctactgtggccatttagtttggctgatrtaacattctttcttattagaagtgtaaacagtctttggcaacagtaataataatatgagcatgcaaaatattcacttaaatttaattacatgtcaaatatttagaatacataaagtgtaacatatattatctgttctatgtcaaggaacaaaatatatatcaaactagttaaaatagaaaggttccatgaacattgctttatgtatacaagactaccaaaatagtttaaaagtacaacaggctacagtaaccaaaacatcatggtactggtacaaaaacagacacatagatcactggaac

SEQ ID NO: 155867 - DNA, 601 bp, Human
catagatactgcttcatgaaaatttaattacttcacctagtcttttgttacatcattctcattaacaggcaactagttaattcattcctttaataaaatttactgcatgcaaatcacacataaatcattagactaggagttgtaagttaatgctataaacatatacaaagtttataccaaaagataatttccaccaattttctagaaaagtgtatatagctattctaagaaggcttaggaatattttataacacttgatttgaaataatctatagcataataattttcttacatacaaatytttttaaaaacccactactcagtgcaggatatcaaataacatgtctactgtggccatttagtttggctgatgtaacattctttcttattagaagtgtaaacagtctttggcaacagtaataataatatgagcatgcaaaatattcacttaaatttaattacatgtcaaatatttagaatacataaagtgtaacatatattatctgttctatgtcaaggaacaaaatatatatcaaactagttaaaatagaaaggttccatgaacattgctttatgtatacaagactaccaaaatagttta

SEQ ID NO: 155868 - DNA, 601 bp, Human
aaaacccccaagaccaaccactagatttaaaaaaacccaaatcaaaggagcaaaccatgtttattcactcaataagcatttaataattgcctataacatatcagcgtctgtgccacaaaaaagatcccccttcaagacacttacaatctaacgccctattaatacaaaattctcaaaacacacaattgaataagcctatgaatatggcatgtaacaatatagggaaggatgtgcctgatcatagatactgcttcatgaaaatttaattacttcacctagtcttttgttacatcattctcaytaacaggcaactagttaattcattcctttaataaaatttactgcatgcaaatcacacataaatcattagactaggagttgtaagttaatgctataaacatatacaaagtttataccaaaagataatttccaccaattttctagaaaagtgtatatagctattctaagaaggcttaggaatattttataacacttgatttgaaataatctatagcataataattttcttacatacaaatttttttaaaaacccactactcagtgcaggatatcaaataacatgtctactgtggccatttag

SEQ ID NO: 155869 - DNA, 601 bp, Human
gacaagtttaactatgaaataagtgacatcctccctctgactatattaagcagggacacagtactttttagagtaagcccatggttttctctcatccaaagtagagagaagagatcctcctggagaaaggagcatggtgtgacaggctcttttgtgcccactaacttatgactattttttacacacttccttccaccctgcatgttatatgtcagctcccctcagtacttcctttttaaaacactcccattcattttgaagaatatttctaaaaaacagcatgtacaaaaaagtattcttrtcttctatcctaagagttctataatacctcctcatacattttctgccagacctttgctgccaaaacaaacaaaacccccaagaccaaccactagatttaaaaaaacccaaatcaaaggagcaaaccatgtttattcactcaataagcatttaataattgcctataacatatcagcgtctgtgccacaaaaaagatcccccttcaagacacttacaatctaacgccctattaatacaaaattctcaaaacacacaattgaataagcctatgaatatggcatgtaacaatatagggaaggat

SEQ ID NO: 155870 - DNA, 601 bp, Human
agtaatgtcaaattactgttaccagaaaaatcactgttctgttgaattaagactatttcatgacttaaaatgcatactgttgacctatgcttttcccagtgctctaacaggtacagaggattttcctttttatttacatgtgtttaccactgcagtcaagtacaatttcacaatatatagggatggatgccttgtaacatatttttagtaagaatttatttatttttgtgtaaaactattagaattcaaagactgacaaagaactctcttaatcaataaacactgagctggtttggtgataaaaaaaaaatccccagcaggcttcaagaaatatccttttattagcgtaaaaactactctgggttatttctgtattaaattattaaagtgtacgcatcggttcttgactaaaaatccagcactgagtcacagtcccccaaggtataaaagacaatacttcattttattttctacttttatatgtgtacaggatgcaatgacaagtttaactatgaaataagtgacatcctccctctgactatattaagcagggacacagtactttttagagtaagcccatggttttctctcatccaaagta

SEQ ID NO: 155871 - DNA, 601 bp, Human
tctataccttctccttggtaatctcaaccagtctcccggctttaaataccatttatgtgctgataactctaagctgtcacactaatttttttcatcagtctaattggaaaactaacaaacaggttaagtttataaatgtccaaaacgttaactcctgattgtccattcattctgactctagccacagttttcctcatttcagtttacgtaaattctatccttctgataatcaggctaagaactttggagtaatacttggtatctttttctcatactctacattcaatctagcagaaaatcytgtttatttgaccttcaaccgttaatatatattttaaaatatatttgtatacttctttcattattaccacccaggtccaagccatcatctcactgggttattccaacagactcctgattaggctccctgttgctgtttttgccctctatagtcattcttttttttttcccccgagatggagtctcactctgtcacccaggctagagcacagtggcatgatctcagttcactgcaacctccacctccctggttcaagcaattctcccaccttagcctctggagtagctgggattacaggtg

SEQ ID NO: 155872 - DNA, 601 bp, Human
tttaacaatccattcttagtcctcttcttacttgccttatttgacaccactggtcattctctcattttagaatatttgattcacttggcctccaggacataattatctctcagtttttcctcttacctctctggtggctcctcttcaacctcctttgctgccttcttctccttaccttttatcaagatgtagcttcatctttggtcctctttacttctctatctataccttctccttggtaatctcaaccagtctcccggctttaaataccatttatgtgctgataactctaagctgtcayactaatttttttcatcagtctaattggaaaactaacaaacaggttaagtttataaatgtccaaaacgttaactcctgattgtccattcattctgactctagccacagttttcctcatttcagtttacgtaaattctatccttctgataatcaggctaagaactttggagtaatacttggtatctttttctcatactctacattcaatctagcagaaaatcttgtttatttgaccttcaaccgttaatatatattttaaaatatatttgtatacttctttcattattaccacccaggtcca

SEQ ID NO: 155873 - DNA, 601 bp, Human
attcaccttacaaagttcaccaatgatatccacattgcaaaatttaacaatccattcttagtcctcttcttacttgccttatttgacaccactggtcattctctcattttagaatatttgattcacttggcctccaggacataattatctctcagtttttcctcttacctctctggtggctcctcttcaacctcctttgctgccttcttctccttaccttttatcaagatgtagcttcatctttggtcctctttacttctctatctataccttctccttggtaatctcaaccagtctcccrgctttaaataccatttatgtgctgataactctaagctgtcacactaatttttttcatcagtctaattggaaaactaacaaacaggttaagtttataaatgtccaaaacgttaactcctgattgtccattcattctgactctagccacagttttcctcatttcagtttacgtaaattctatccttctgataatcaggctaagaactttggagtaatacttggtatctttttctcatactctacattcaatctagcagaaaatcttgtttatttgaccttcaaccgttaatatatattttaa

SEQ ID NO: 155874 - DNA, 601 bp, Human
aaattgctccaacaagtcttcctctttttcctacatcatcaattttttacccaatacctctcctcttaaaaaaaattgatactacttttcttgacagctaccacctcatctctttgcaggaaaactcctcaaaaaaactcctcaaaaaaaaagttgtctatattcactaactacaattcccgtcccacaattttcttttaagtctactccacacagggttttgcctccacctccccatcaacattcaccttacaaagttcaccaatgatatccacattgcaaaatttaacaatccattctyagtcctcttcttacttgccttatttgacaccactggtcattctctcattttagaatatttgattcacttggcctccaggacataattatctctcagtttttcctcttacctctctggtggctcctcttcaacctcctttgctgccttcttctccttaccttttatcaagatgtagcttcatctttggtcctctttacttctctatctataccttctccttggtaatctcaaccagtctcccggctttaaataccatttatgtgctgataactctaagctgtcacactaatttttttcatc

SEQ ID NO: 155875 - DNA, 601 bp, Human
ggtgaaataggcaggaaatatcagtaaacatggtagtgactttcagttcagcctcaattatttccttcattaattagatatgtttattatttttataatgctttaaaatatgattggaaatttaactatacaaaacaataccacatttacaataaatgtctactactaagatatggtcaaagactataattgctctcttgcatgtatctttaacttccttaacacttccgtcacatttgtttcacaaaaccacagccatggttaaaagccagctctccacctactccttaccttcagccakgcagttgaacaggctggagaaccacactcatagttcatggccatgaacactacatgggccattaattcagtatagcaatcacacaccacatttccctgatctattccttttccagatcaccatttcacatattcttctctcccttcagaccaaccaataccttatacctcatcctcactttcagctgttttgatcttgcttcctacttaagaatcagcatctgtgttcacatattctcccttcccatctgttgctatagacgagtacctgagaggcacacctgcctaatctctccacctg

SEQ ID NO: 155876 - DNA, 601 bp, Human
atgccctccctccaaggtgagcgaattttccctctattagttcctctgaaagctggttgttaaaaacagcctgacacctctcccggtggcttgcttcttctcttaccatgtgatctgtgcacacgcaggctcccttttaccttccacctcaggcagtggaagctgcctgagaccctcacgagatgcagatgcccaatcttgatgtcccagccatcaggactatgagccaaataaacctttttcctttataaatgacccagcctcaggtattccttcacagcaacacaaaatggactgagayagtagctaacttaacaaaagttgctccactacaagatatgctaaaatctaacaagtatatttatgctcaaatttattaaataatctagtagaaataaaaaagaaatggatggcataaggtggtaatagggtgaaataggcaggaaatatcagtaaacatggtagtgactttcagttcagcctcaattatttccttcattaattagatatgtttattatttttataatgctttaaaatatgattggaaatttaactatacaaaacaataccacatttacaataaatgtctactactaagat

SEQ ID NO: 155877 - DNA, 601 bp, Human
tactatgttctaggtactatactaagcactgaaataatttcatttaatcctcaaagacctctataatgcaggttcaatcattatcttattttacagactaggaaactgaaaattagagcaagaaaagcagtaaaccaagaaaagaagcctgcacaataccagcatctgaaaggacaagtgaaggaagaaaaaccaattagtaagacacaagtcatggtctccaaagacagtattttcaggaatgatgaaaataatgctaaattttaacaattgctcacaaatgagtagtcaaagatagctsaggaatgaaaatagtgagtataagtctatgttttggtaaaatctggaaagatggaatgaaaaattagacaataactaataggaattcaaggtaaagaagaggctgtttggggctgcataagtttggggctgtgatgtttttcaattttttaagacctgtggtctttgcttcttcacataagctcattttccagctacaatatttttccttaattcctagagccacctaacataatgtcaacaacactcactcttccccagacaagggtaaaaaaatatatatcctaaagggttcatacaa

SEQ ID NO: 155878 - DNA, 601 bp, Human
gcaagtaaaatattaataataaaagataacatccattcattaaatactatgttctaggtactatactaagcactgaaataatttcatttaatcctcaaagacctctataatgcaggttcaatcattatcttattttacagactaggaaactgaaaattagagcaagaaaagcagtaaaccaagaaaagaagcctgcacaataccagcatctgaaaggacaagtgaaggaagaaaaaccaattagtaagacacaagtcatggtctccaaagacagtattttcaggaatgatgaaaataatgytaaattttaacaattgctcacaaatgagtagtcaaagatagctgaggaatgaaaatagtgagtataagtctatgttttggtaaaatctggaaagatggaatgaaaaattagacaataactaataggaattcaaggtaaagaagaggctgtttggggctgcataagtttggggctgtgatgtttttcaattttttaagacctgtggtctttgcttcttcacataagctcattttccagctacaatatttttccttaattcctagagccacctaacataatgtcaacaacactcactcttcc

SEQ ID NO: 155879 - DNA, 601 bp, Human
aaaagcaacagagtaagaatcccacagtatacagaaggtgaggcaggatataaggctggaggaggggctgggagacagatcactggaacgccttggaaaccatgtcaaggagcttgaacttgattctgggaataatggagtactttaaaaatttttaatagtcatgagattgacggattaatatttttagacaacttgttctgaagcctatgtggaagatatatttgaggtagaaaagtatattccaggactcttgcagcagcccaggtcagaactagaagagtgatggtaggaatacagrgaaagggaataattcaagaaaatgttcagaaggaaaaacctacaagatcttttgctgattctattaaggggataaacagggcagaagaaagaatactggctcccaaatttctttcctagagatgtacagaatacaaaaggaatactttggtaaattataatcagtgcaggctgggcatgatggcttatgcctgtaatcccagcattttgggaggccaagaaggaggctcactggagaccaggagtttgagaccagactgggcaacatcacaagaccctgtctttagaaaaaataaaaaaa

SEQ ID NO: 155880 - DNA, 601 bp, Human
aaacgcttttacactgttggtgagagtgtaaattagttcaacctttgtggaagacagtgtggtaattcctcaaggatctagaaccagaaatagcatttgacccagcaatcccatttctggatatacacccaaaggattataaaccattctgttgtaaagacacatgcacacgtatgtttattgcagcactattcacaatagcaaagacttggaaccaacccaaatgcccatcagtgatagactggataaagaaaatggggcacatatacagcatagaatactatgcaaccataaaaatggrtgagttcatgtcctttgcatggacatggatgaagctggaaaccatcattctcagcaaactaacacaggaagagaaaaccaaacactgtatgttctcactcatatgtgggagttgaacaatgagaacacaaggaggggaacatcacacaccgtggcatgttgcggggtggggggctaggggaaggatagcattgggagaaatacctaatgtagatgatggggtgatgggtgcagcaaaccaccatggcacgtgtatacctacataataaacctgcacgttacgcacatgtatcccagaact

SEQ ID NO: 155881 - DNA, 601 bp, Human
taaatttaaaatgaaaagattatagaatgtgttaatgtgccacactgatgagcatttttttaaacacaaggatgatgaggaattattcaaatagtagtgtatacacctgagcatttccagtggtaagacactagaataaaaagtgttctattcctaagataccaactgcctttctatcatattgctgccattatttattattctttttaatcaataacaacagcaactaccccttttagtcctataccagatgctttgattgcatggtccgagagaacctttatggtacagatgaaaattgaaatacctacagggacctggcagatgatcaatgaaggaatgaagtagaagtggtgtgacaagagaatatgatagagtagcaaactagaaagggcatgctctttcgagagttcccattggtctgttcccttcacaacaaaattcaaaagaaatgtctttcttttccatttccatttttacttcctctcctacagtctcttttaaatccataaccaattaggttttcattccaccaaagctgctcattaaaatcccttactacctccatgttgctaagtccactggttaattattctcagcc

SEQ ID NO: 155882 - DNA, 601 bp, Human
ggtactcaaatccctgtgtgtactcaaatccatgcatgctcaagtcctgcagtcagccctgtggaacctgcttataggaaaagtcaaatctctgtagatgtgagtttcacctcttgcaaatactgcattttcaatccttctgttgaaaaaaatccacatataagtagactcgtgcagttcaaacctgtgttgtttatggatcaactgtatttatttttcattaaatttaaaatgaaaagattatagaatgtgttaatgtgccacactgatgagcatttttttaaacacaaggatgatgagkaattattcaaatagtagtgtatacacctgagcatttccagtggtaagacactagaataaaaagtgttctattcctaagataccaactgcctttctatcatattgctgccattatttattattctttttaatcaataacaacagcaactaccccttttagtcctataccagatgctttgattgcatggtccgagagaacctttatggtacagatgaaaattcaaatacctacagggacctggcagatgatcaatgaaggaatgaagtagaagtggtgtgacaagagaatatgatagagtag

SEQ ID NO: 155883 - DNA, 601 bp, Human
tacttatcttccatcaaatcataaatttgaaaaagagggaactaagttgtatagctctgtaggacccctagcacctaaaacaatgtctggctcaatgcaaatagcccttggtatacacaagggattggtactcaaatccctgtgtgtactcaaatccatgcatgctcaagtcctgcagtcagccctgtggaacctgcttataggaaaagtcaaatctctgtagatgtgagtttcacctcttgcaaatactgcattttcaatccttctgttgaaaaaaatccacatataagtagactcgtgmagttcaaacctgtgttgtttatggatcaactgtatttatttttcattaaatttaaaatgaaaagattatagaatgtgttaatgtgccacactgatgagcatttttttaaacacaaggatgatgaggaattattcaaatagtagtgtatacacctgagcatttccagtggtaagacactagaataaaaagtgttctattcctaagataccaactgcctttctatcatattgctgccattatttattattctttttaatcaataacaacagcaactaccccttttagtcctataccagatgc

SEQ ID NO: 155884 - DNA, 601 bp, Human
gtggacaaagatttaataaattttgaatattggaaataccaatataaagttcttattctccccaaagcattagttaattagacacaaatttaattttaaatttttcattaaaatatgtaaaataaaatttaaaactaggaaattttataggaacagagattaatatcaggaatctgagaactacagctacttaaaactaactataggcctagtataaaataaaatcaaatgaaccatgttttataaacagattcaggctgtgttattcactttgcatgtggttcactaaaatgacaacacaacaatttgaactagccacaaagatgttcacactaatcagttcttttaattatttagatgctttcctgtctctaagctttcactgctattatttctactatttcctataaaaccctctgactcaagctccaaagaatcttaccaatgtgtaaagagccacctcaaataccactttccactaggaggcatttcctgatgcctccttccggcaacctttgctcccccaaagttatggttatttgggtacttatcttccatcaaatcataaatttgaaaaagagggaactaagttgtatagctc

SEQ ID NO: 155885 - DNA, 601 bp, Human
atagtggacaaagatttaataaattttgaatattggaaataccaatataaagttcttattctccccaaagcattagttaattagacacaaatttaattttaaatttttcattaaaatatgtaaaataaaatttaaaactaggaaattttataggaacagagattaatatcaggaatctgagaactacagctacttaaaactaactataggcctagtataaaataaaatcaaatgaaccatgttttataaacagattcaggctgtgttattcactttgcatgtggttcactaaaatgacaacacaacaatttgaactagccacaaagatgttcacactaatcagttcttttaattatttagatgctttcctgtctctaagctttcactgctattatttctactatttcctataaaaccctctgactcaagctccaaagaatcttaccaatgtgtaaagagccacctcaaataccactttccactaggaggcatttcctgatgcctccttccggcaacctttgctcccccaaagttatggttatttgggtacttatcttccatcaaatcataaatttgaaaaagagggaactaagttgtatag

SEQ ID NO: 155886 - DNA, 601 bp, Human
atatagtggacaaagatttaataaattttgaatattggaaataccaatataaagttcttattctccccaaagcattagttaattagacacaaatttaattttaaatttttcattaaaatatgtaaaataaaatttaaaactaggaaattttataggaacagagattaatatcaggaatctgagaactacagctacttaaaactaactataggcctagtataaaataaaatcaaatgaaccatgttttataaacagattcaggctgtgttattcactttgcatgtggttcactaaaatgacaacacaacaatttgaactagccacaaagatgttcacactaatcagttcttttaattatttagatgctttcctgtctctaagctttcactgctattatttctactatttcctataaaaccctctgactcaagctccaaagaatcttaccaatgtgtaaagagccacctcaaataccactttccactaggaggcatttcctgatgcctccttccggcaacctttgctcccccaaagttatggttatttgggtacttatcttccatcaaatcataaatttgaaaaagagggaactaagttgtat

SEQ ID NO: 155887 - DNA, 601 bp, Human
aaaaaaaagtgctattgaagtaaattaagtgaatcacaatttgtgattagaaagagagaaggcagactaaaagtcaattagccaagatctgtaacagtatgactgagcctgagcatgatcagcaactcaaagaacacctcctaaaaatgcacaaagaaaagacaaatagagatttagacagattttcccttatattttgtcacctttactcaagtgccttcaaagaaaaaaaatggaaatactaaaagtatactttattttctatacataaagtacatcaagaaaataaacattgctctcytattaacaaaatgtactgaatatagtgtattcaacataccttcactgacagcatggggtttaacaatgcaacaggtacaattagtaaatttagcagtgtttgccggcccacaacctccacttgaaggaaaaaacaactccatttcctaaagacagagagaaatgattttgacaaatgtgatctcttatcttgaacttacaagatatttctgtgggggaggagaatcatgcaattacttttagagtttcatcatataaattttttgtttcagattttctaaaaatgagttttacaaagaca

SEQ ID NO: 155888 - DNA, 601 bp, Human
tggtgaaaccctgtctctactaaaaatacaaaaattagctgggcatggtggcatgtacctgtagtcccagctactcgggaggctgaggttgcagtaactcgagatcatgccactgcactccagcttggacaacagaactagactctgtctcaaaaaaaaaaaaaaaaagtgctattgaagtaaattaagtgaatcacaatttgtgattagaaagagagaaggcagactaaaagtcaattagccaagatctgtaacagtatgactgagcctgagcatgatcagcaactcaaagaacacctcytaaaaatgcacaaagaaaagacaaatagagatttagacagattttcccttatattttgtcacctttactcaagtgccttcaaagaaaaaaaatggaaatactaaaagtatactttattttctatacataaagtacatcaagaaaataaacattgctctcctattaacaaaatgtactgaatatagtgtattcaacataccttcactgacagcatggggtttaacaatgcaacaggtacaattagtaaatttagcagtgtttgccggcccacaacctccacttgaaggaaaaaacaactcc

SEQ ID NO: 155889 - DNA, 601 bp, Human
atatatgcaaacatgtatatacatacatatgtcaaagaactgtttcagatacaaagaactgaaggaaatttctccagccttctcagaaagggtatactagaggtatggcagacattgttttaatttgtacaacaggagtgctattggctgggcacagtggctcatgcctataatcccagcactttgggaggccgaggtgggtagatcatctgaggtcaggagtttgagaccagcctgaccaatatggtgaaaccctgtctctactaaaaatacaaaaattagctgggcatggtggcatgtrcctgtagtcccagctactcgggaggctgaggttgcagtaactcgagatcatgccactgcactccagcttggacaacagaactagactctgtctcaaaaaaaaaaaaaaaaagtgctattgaagtaaattaagtgaatcacaatttgtgattagaaagagagaaggcagactaaaagtcaattagccaagatctgtaacagtatgactgagcctgagcatgatcagcaactcaaagaacacctcctaaaaatgcacaaagaaaagacaaatagagatttagacagattttcccttatattt

SEQ ID NO: 155890 - DNA, 601 bp, Human
agagcaacaaatttacctacttgacatacttgctgtgaagattaaaaataatgtataaggaaccagtctgccacctggcacataatggtatattctccataagtgtttgttatccatgctgcatgttatttacttataatcatggtcctaaggatttacaatatactaaaatacttcctaaaaaattaaagaagtattaattatgcagcaagatctttaaggctcatatccttccaacaagtaattctatttctaggaaactagccagaggaaaagattagagatatcatcaaatatttaygtataaagatattcttcaaagttttaattttaatatcaaaacactgaaaacaacctaagtatccaaataccatactacatctatacaattgctgttaaatattaaagaatctattaaaatattaatgaggacttaacagcagccagaaatgctcacaaaaattatatttaaacaacagcctatagacctacatctcaaccattacattcatgtgtagcagtgtacacacatgcacatacaaatgcagaaaaaaatgatttggaggaaatgcatcaaaacattaacaatgactatcttcag

SEQ ID NO: 155891 - DNA, 601 bp, Human
ttgtggctattgctattagggcaatagagtatagagggaacagaatggagattaaaaacaaacaaacaaacaaacagggtttgcatcctcaatttccattccaaattaggagaaacaacttaatctcatggaaccttagcttgcctatctggaaaagagcaacaaatttacctacttgacatacttgctgtgaagattaaaaataatgtataaggaaccagtctgccacctggcacataatggtatattctccataagtgtttgttatccatgctgcatgttatttacttataatcatggkcctaaggatttacaatatactaaaatacttcctaaaaaattaaagaagtattaattatgcagcaagatctttaaggctcatatccttccaacaagtaattctatttctaggaaactagccagaggaaaagattagagatatcatcaaatatttacgtataaagatattcttcaaagttttaattttaatatcaaaacactgaaaacaacctaagtatccaaataccatactacatctatacaattgctgttaaatattaaagaatctattaaaatattaatgaggacttaacagcagcca

SEQ ID NO: 155892 - DNA, 601 bp, Human
tgtgccatgtgacttttttgtggctattgctattagggcaatagagtatagagggaacagaatggagattaaaaacaaacaaacaaacaaacagggtttgcatcctcaatttccattccaaattaggagaaacaacttaatctcatggaaccttagcttgcctatctggaaaagagcaacaaatttacctacttgacatacttgctgtgaagattaaaaataatgtataaggaaccagtctgccacctggcacataatggtatattctccataagtgtttgttatccatgctgcatgttakttacttataatcatggtcctaaggatttacaatatactaaaatacttcctaaaaaattaaagaagtattaattatgcagcaagatctttaaggctcatatccttccaacaagtaattctatttctaggaaactagccagaggaaaagattagagatatcatcaaatatttacgtataaagatattcttcaaagttttaattttaatatcaaaacactgaaaacaacctaagtatccaaataccatactacatctatacaattgctgttaaatattaaagaatctattaaaatattaatga

SEQ ID NO: 155893 - DNA, 601 bp, Human
tgagcttcatgtctgtgctcaaaaagttttggagtttggagtaatttgggtttcagatttttggattagggataccacacctgtgtagacactcacatacacatacacaatctctccagctaagaaaaatgagtgaaacataaaatcccaggtttttttccataaattttcaacaccagccatttcaaatattactatcacttcctatggaattgttactaatcatgtgccatgtgacttttttgtggctattgctattagggcaatagagtatagagggaacagaatggagattaaaaaaaaacaaacaaacaaacagggtttgcatcctcaatttccattccaaattaggagaaacaacttaatctcatggaaccttagcttgcctatctggaaaagagcaacaaatttacctacttgacatacttgctgtgaagattaaaaataatgtataaggaaccagtctgccacctggcacataatggtatattctccataagtgtttgttatccatgctgcatgttatttacttataatcatggtcctaaggatttacaatatactaaaatacttcctaaaaaattaaagaagtattaattat

SEQ ID NO: 155894 - DNA, 601 bp, Human
ttgctgtacagaagctctttagtttaattagatccaatctggcaatttttgtttttgttgtaattgcttttcacattttgttcacaaaattgttgcccatgcctatgtcctgaatgctattgactagattttctactagggtttttatagttttgggttttacatttaagtctttaattcatcttaagttaatttttgtatacggtataaggaaggggtcccgtgtcaattttctccatgtggctatcagttctcccagctatatgtgcaattattaaggtatacaactagtatttattckagtaccactttattttatttcactctccttgcaacatatttttccttgaaaaggattagatcaggtaaattgaataaaacattttagggtgtcaaggataagctttttaaaaagttgatgcctataaacaagaactttttcaaaatgtgagtgtactatgtgtgtttatgtatatatgtatatgtacacaaatatacacgggtgtatgtatgtgcatgtgtgtgtgtacaggttgaatattccttacagaaatgcttgtgacaagcagtgttttggatttcaattttttttttgattttg

SEQ ID NO: 155895 - DNA, 601 bp, Human
cttgtaaatttaagtcccttgtagattccagatattaaacctttgtgaaatggatagattgcaaaaattttctctcattctgtaggttgtctgttcactctgatgatagttcattttgctgtacagaagctctttagtttaattagatccaatctggcaatttttgtttttgttgtaattgcttttcacattttgttcacaaaattgttgcccatgcctatgtcctgaatgctattgactagattttctactagggtttttatagttttgggttttacatttaagtctttaattcatcttragttaatttttgtatacggtataaggaaggggtcccgtgtcaattttctccatgtggctatcagttctcccagctatatgtgcaattattaaggtatacaactagtatttattctagtaccactttattttatttcactctccttgcaacatatttttccttgaaaaggattagatcaggtaaattgaataaaacattttagggtgtcaaggataagctttttaaaaagttgatgcctataaacaagaactttttcaaaatgtgagtgtactatgtgtgtttatgtatatatgtatatgt

SEQ ID NO: 155896 - DNA, 601 bp, Human
acttcagctttttttcatgtgtttgttgggtgcatgaatgtcttcttttgagaagggtctgtccatgtcctttgaccactttttaatgaggttgttttttcttgtaaatttaagtcccttgtagattccagatattaaacctttgtgaaatggatagattgcaaaaattttctctcattctgtaggttgtctgttcactctgatgatagttcattttgctgtacagaagctctttagtttaattagatccaatctggcaatttttgtttttgttgtaattgcttttcacattttgttcacraaattgttgcccatgcctatgtcctgaatgctattgactagattttctactagggtttttatagttttgggttttacatttaagtctttaattcatcttaagttaatttttgtatacggtataaggaaggggtcccgtgtcaattttctccatgtggctatcagttctcccagctatatgtgcaattattaaggtatacaactagtatttattctagtaccactttattttatttcactctccttgcaacatatttttccttgaaaaggattagatcaggtaaattgaataaaacatttt

SEQ ID NO: 155897 - DNA, 601 bp, Human
gctcttctcgaggagcatctttgtggtgttctctgtatttcctgaatttgaatgttggtctgttttgctagtttggggaagttctcctggataatatcctgaagagtgttttccgacttggtcccattctccccgtcactttcaggtacaccaatcaaacgcagatttgtcttttcacataatcccatatttcttggaggctttgttcatttctttttattcttttttctctaatctggtcttctctttttatttcattaagttgatcttcagtcactgacatcctttcttctacttgatygatttgactattgatagttgtgtattcttcacaaagttcttgtgctatgcttttcagctccatcaggtcattcatgttcttctctgcattggttattctagttagcaatttgacttcagctttttttcatgtgtttgttgggtgcatgaatgtcttcttttgagaagggtctgtccatgtcctttgaccactttttaatgaggttgttttttcttgtaaatttaagtcccttgtagattccagatattaaacctttgtgaaatggatagattgcaaaaattttctctcattctgtaggtt

SEQ ID NO: 155898 - DNA, 601 bp, Human
ctctcgtaaggcaggtctggtggtgacaaattccctcagcatttgcttgtctgtaaaggattttatttctccttcacttatgaagcttagtttggctggatatgaaattctgggttgaaaattcttttctttaagaatgttgaatattggcccccactctcttctggcttgtagggtttctgcaaagatatctgctgttagtctgaatgggcttctctttgtgggtaacccaacctttctctctggctgcccttaacatttttttgttcatttcaaccttggtgaatctaatgattatgtrtcttggggttgctcttctcgaggagcatctttgtggtgttctctgtatttcctgaatttgaatgttggtctgttttgctagtttggggaagttctcctggataatatcctgaagagtgttttccgacttggtcccattctccccgtcactttcaggtacaccaatcaaacgcagatttgtcttttcacataatcccatatttcttggaggctttgttcatttctttttattcttttttctctaatctggtcttctctttttatttcattaagttgatcttcagtcactgacatcctttct

SEQ ID NO: 155899 - DNA, 470 bp, Human
aagttttagggtacatgcgcacaatgtgcaggttagttacatatgtatacatgtgccatgctggtgtgctgcacccattgactcgtcatttagcattaggtatatctcctaatgctatccctccccactccccctaccccacaacagtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtccctacaaaggayatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatt

SEQ ID NO: 155900 - DNA, 601 bp, Human
tgcacccatcaacctatcacatataattaggtatttctcctaatgtcatccctcccctagcctcccaccccctgacaggccccagtgtgtgatgttcccctccctgtgtccatgtgttttcattgttcaactcagacttatgagtgagaacatgcagtgtttagttttctgatcttgtgatagtttgctgagaatgacagtttccagcttcatccatgtccaatcaaaggaaatgaagtcatcactttttaaggctgcatagtattccatggcgtatatgcaccacactttcttttctatwtttttcttaatttttttttattattatactttaagttttagggtacatgcgcacaatgtgcaggttagttacatatgtatacatgtgccatgctggtgtgctgcacccattgactcgtcatttagcattaggtatatctcctaatgctatccctccccactccccctaccccacaacagtccccagagtgtgatgttccccttcctgtgtccatgtgttctcattgttcaattcccatctatgagtgagaacatgcggtgtttggttttttgtccttgcgatagtttactgagaatgatg

SEQ ID NO: 155901 - DNA, 601 bp, Human
taggtatacacgtgccctgctggttagctgcacccatcaacctatcacatataattaggtatttctcctaatgtcatccctcccctagcctcccaccccctgacaggccccagtgtgtgatgttcccctccctgtgtccatgtgttttcattgttcaactcagacttatgagtgagaacatgcagtgtttagttttctgatcttgtgatagtttgctgagaatgacagtttccagcttcatccatgtccaatcaaaggaaatgaagtcatcactttttaaggctgcatagtattccatggygtatatgcaccacactttcttttctatttttttcttaatttttttttattattatactttaagttttagggtacatgcgcacaatgtgcaggttagttacatatgtatacatgtgccatgctggtgtgctgcacccattgactcgtcatttagcattaggtatatctcctaatgctatccctccccactccccctaccccacaacagtccccagagtgtgatgttccccttcctgtgtccatgtgttctcattgttcaattcccatctatgagtgagaacatgcggtgtttggttttttg

SEQ ID NO: 155902 - DNA, 601 bp, Human
catgtgcagaatgtgcagttttgttacataggtatacacgtgccctgctggttagctgcacccatcaacctatcacatataattaggtatttctcctaatgtcatccctcccctagcctcccaccccctgacaggccccagtgtgtgatgttcccctccctgtgtccatgtgttttcattgttcaactcagacttatgagtgagaacatgcagtgtttagttttctgatcttgtgatagtttgctgagaatgacagtttccagcttcatccatgtccaatcaaaggaaatgaagtcatcaytttttaaggctgcatagtattccatggcgtatatgcaccacactttcttttctatttttttcttaatttttttttattattatactttaagttttagggtacatgcgcacaatgtgcaggttagttacatatgtatacatgtgccatgctggtgtgctgcacccattgactcgtcatttagcattaggtatatctcctaatgctatccctccccactccccctaccccacaacagtccccagagtgtgatgttccccttcctgtgtccatgtgttctcattgttcaattcccatctatga

SEQ ID NO: 155903 - DNA, 601 bp, Human
agaattattctcattttagaaataaggaaacaaggtagaaagagatgaagtaattaatccaatatcccatagctagtaagtggcagagccagaattcaaacctaaacagcctgatttcagagtaaaagtaatttattttatggatggaattaataactataacctataaacaatactgagaacataataaacacattgcataatttttaaagtaaaaagaacacaagaacattcaccttgtttttctttccttttaaaacctgagtcctaaaatgacaatatattttaatctgcatatctaaaaagaccacagatgcctcaaatataccttatttttcccacaatttatctcacagaccaagaactctttatgttctagctctcttagaaatgagaagtgaaaccactgcatccacatagattaactataggtctatgaactaaggccgcctacatacacatgactactacttgtgccaagaagtttcttgcccagaaagataaggcagtaaatcagtaaataacttcactgttggcttcaggaacttcccaaaaatccatttaccccaacaatagagtactcaaacagtcccctttcaca

SEQ ID NO: 155904 - DNA, 601 bp, Human
gttagcattataaaactattactttgttacaagacagtcattcaactttgcttaaaaattaaaagataatgatattagtggcagcagcagtagtagtagtaatagagtagtaatcataatactaacaatgtgtaacacttatacagcactaaactacgtgctgggaactgtctagagcaccttccatacactaatgcacttaatccttagttaccccatgaaaaatgtatagaattattctcattttagaaataaggaaacaaggtagaaagagatgaagtaattaatccaatatcccatrgctagtaagtggcagagccagaattcaaacctaaacagcctgatttcagagtaaaagtaatttattttatggatggaattaataactataacctataaacaatactgagaacataataaacacattgcataatttttaaagtaaaaagaacacaagaacattcaccttgtttttctttccttttaaaacctgagtcctaaaatgacaatatattttaatctgcatatctaaaaagaccacagatgcctcaaatataccttatttttcccacaatttatctcacagaccaagaactcttta

SEQ ID NO: 155905 - DNA, 601 bp, Human
aacatccagaatctatgaggaacttaaacaaatttacaggaaaaaaataaaaacaaccccataacacagtgggtgaaggacatgaacagacaattttcaaaagaagacacacatgcagccaacaaccatgaaaaaaagctcaatatcactgatcattagagaaatgcaaatcaaaaccacagtgagataccatctcacaccagtcagaatggctattactaaaaagtcaaaaaataacagatgctggttaggtggtggagaaaaaggaacacttatatacctgttgggggaagtgtaaatyagttcagctattgtggaagacagtgtggcgattcctcaaagacctaaagccataaataccatttgacacagcaatcccattactgggtacatacccagaggaatataaatcattctaccataaacacgcatgcaaatgttcactgaagcactattcacaatagtaaagacataaaagtaacctaaatgcccatcactggtagactggataaagaaaacatggtacatatacaccatggaatactctgcagccattaacaaaaaaaatgagatcatgtcctttataggaacacgaatggaa

SEQ ID NO: 155906 - DNA, 601 bp, Human
aacactgctcaaagaaatcagagataacacaaacaaatgtaagaacattccatgctcttagatgggaagaatcaatatcattaaaatggtcatactgcctaaagcaatttacagattcaatgctattcctttccatgtaccagtgacattcttcacaaactggaaaaaaactattttaatgttcatattgaaccaaaaaagagcctgaattgccaagggaaccctaagcaaaaagatcaaagctggaggaatcatattgtccaacttcacactgtagtacaaggctacagtaaccaaaaacaacatggtactggtataaaaacagacacacagaccaatggagcaggatagagagcccagatataaacccacacacctacaaccatctgatctttgacaaagctgacaaaaacaagcaatggggaaaggactccctattcaataaatgattctgggataacgggctagctatatacagaagactaaaactggaccccttccttacaccatatacaaaaatcaactcaagatggatgaaagacctaaatgtaaaacctaaaacctaaataaaacctaaaacctaaataaaaaccctaaagga

SEQ ID NO: 155907 - DNA, 601 bp, Human
aagatcatcaagattcagaagaatgttgaaacccaatccaaggaagctaagaatcacaataaaacaatacaggagatgaaagtcaaaatagctcatatagaaaataatacaaccaatctgatagagctgaaaaacacactacaagaatttcataatgcaaccacaaatattaacagcagaatagaacaagtggagaaaagaatctcagagattgaagactggctttctgaaataatacagtcagacaggaagaaaacagaacaaaaaggaatgaataaaacctctgagaaatatggaattrtgtaaaagaccaaatctatgactctctggcatacctgaaagaaatgggaagaaagaaaacaagttgaaaaacatatttcaggatatcatccatgagaatttcctcaacctagctagagagtccaacactcaaattcaggaaatgtggagaaccaccacaagatacttcaagatcacccccaagacacataatcatcaaattttccaagttcaaaatgaaagaaaaaatgttaaaagcagctagagagaaaggacaggtcacctaaaaagagaagcccatcagaataatagtgtacctatc

SEQ ID NO: 155908 - DNA, 601 bp, Human
tggtccagtgaaccataattcctggtattcatgtgcttgtagagtctcctcctatactgactctggacctggccatgtgactttccttagctgtgatgcaaacagagacatgatgagcacttttccattgaggattatcttggaatgttactcttagaagccagaaaccatccggtaaagaagctcaggctatactactgaatgatgagaggccacatggaaagagtcttttgagaatgagattcagtcttgtacactccagctccagtacagctcccagatgaatgaagccacatgaatractcaagcaaggcatagcacagaagaatcatcaattgataacccacagaattgtgaaaaataatacatcatttttccctttttctttttagcctctatttcttaatgatgagataaatcattgtttttaagaaactaagtttttggatatctgggggcagggctaagatggtagactggaagtagttcatgtgtgccactcccagggggagaaaacaaaagtgctagtgaacacgggttctgcaggctgatcatctgagaaaccatgatgagatacatcaaggcagcaggggaacacaga

SEQ ID NO: 155909 - DNA, 601 bp, Human
ggtccatgaataagaattttaaacagtctccccaagtggttctgttgcacactaaagtttgagaagcactatctagcatcttagtgtcacaatactactggttcaggttctagtctcacgtcccaaccacatgaaggacttaagatgccttataccacttgaggtagaatgatacattggtggtccagtgaaccataattcctggtattcatgtgcttgtagagtctcctcctatactgactctggacctggccatgtgactttccttagctgtgatgcaaacagagacatgatgagcacttttccattgaggattatcttggaatgttactcttagaagccagaaaccatccggtaaagaagctcaggctatactactgaatgatgagaggccacatggaaagagtcttttgagaatgagattcagtcttgtacactccagctccagtacagctcccagatgaatgaagccacatgaatgactcaagcaaggcatagcacagaagaatcatcaattgataacccacagaattgtgaaaaataatacatcatttttccctttttctttttagcctctatttcttaatgatgagataaatca

SEQ ID NO: 155910 - DNA, 601 bp, Human
gggtccatgaataagaattttaaacagtctccccaagtggttctgttgcacactaaagtttgagaagcactatctagcatcttagtgtcacaatactactggttcaggttctagtctcacgtcccaaccacatgaaggacttaagatgccttataccacttgaggtagaatgatacattggtggtccagtgaaccataattcctggtattcatgtgcttgtagagtctcctcctatactgactctggacctggccatgtgactttccttagctgtgatgcaaacagagacatgatgagcamttttccattgaggattatcttggaatgttactcttagaagccagaaaccatccggtaaagaagctcaggctatactactgaatgatgagaggccacatggaaagagtcttttgagaatgagattcagtcttgtacactccagctccagtacagctcccagatgaatgaagccacatgaatgactcaagcaaggcatagcacagaagaatcatcaattgataacccacagaattgtgaaaaataatacatcatttttccctttttctttttagcctctatttcttaatgatgagataaatc

SEQ ID NO: 155911 - DNA, 601 bp, Human
ataagaacagctgaaaatcaaaaggtgactcttccctaaccatctccttggttgctattgacctgccatagtgaacaaactaggaatcttcaatcatgtatcaacttttataaggcttgactctgatgatggcagattactaaaggaaatgcaagatggtccctgcccagaatttctcataagtggctcttgtactgggtgtttatcaggaaaacccagggattcttttaaaaatgcatattcttgggctctactccagatatactgaaaaaagattctaaaattagggtccatgaataakaattttaaacagtctccccaagtggttctgttgcacactaaagtttgagaagcactatctagcatcttagtgtcacaatactactggttcaggttctagtctcacgtcccaaccacatgaaggacttaagatgccttataccacttgaggtagaatgatacattggtggtccagtgaaccataattcctggtattcatgtgcttgtagagtctcctcctatactgactctggacctggccatgtgactttccttagctgtgatgcaaacagagacatgatgagcacttttccattgagga

SEQ ID NO: 155912 - DNA, 601 bp, Human
ttcttttataaatgtttactgaaacaaaacactgaaattaaatattattcaaaataaaaaactgaaaaggtataaagaaacttagataattaagcttataagtgatatttattgtttgtggtatttatagttctgaagttattaaagcttaaaactgtgctatgacttttgagaaaaccccatgttacatttttgccagtgctatttctttccatgaaactgggtttcattccaatctcactagagaaagatcaatctaagcactgtctagcaacagatcaagatttaccgttattttcaytaaacaactgctataaagaagtaaacgtgcattagagaagctacttgtgtaaagcagagtgtcccaactactcacattttccattactccaaaaaattctcaccaacctaaaatccagcacagggatctgagttataagaacagctgaaaatcaaaaggtgactcttccctaaccatctccttggttgctattgacctgccatagtgaacaaactaggaatcttcaatcatgtatcaacttttataaggcttgactctgatgatggcagattactaaaggaaatgcaagatggtccctgc

SEQ ID NO: 155913 - DNA, 601 bp, Human
tttgcactcctataccctaagtttatatgaatctttatgtattaggtgagtctcttgaagacagtatatatttggtttgtgatttttaaaatccattctgccaatctgtatcatttaagtggagaatttaagcaatttatatccaatgttaatattgagatgtgaggtactgttccagttatcctgttacttgttacctacatactctggtttcttttttttttttttctttttttttttattatactttaagttttagggtacatgtgcacattgtgcaggttagttacatatgtatacrtgtgccatgctggtgcactgcacccactaactcatcatctagcattaggtatatctcccaatgctatccctcccccctccccccaccccacaacagtccccagagtgtgatattccccttcctgtgtccatgtgatctcattgttcaattcccacctatgagtgagaatatgcagtgtttggttttttgttcttgcaacagtttactgagaatgatgttttccagtttcatccatgtccctacaaaggacatgaactcatcattttttatggctgcatagtattccatggtgtatatgtg

SEQ ID NO: 155914 - DNA, 601 bp, Human
tctgatataagactacctactcctgctcacttttggtttccatttggagtggaatatctttttgcactcctataccctaagtttatatgaatctttatgtattaggtgagtctcttgaagacagtatatatttggtttgtgatttttaaaatccattctgccaatctgtatcatttaagtggagaatttaagcaatttatatccaatgttaatattgagatgtgaggtactgttccagttatcctgttacttgttacctacatactctggtttcttttttttttttttctttttttttttattatactttaagttttagggtacatgtgcacattgtgcaggttagttacatatgtatacatgtgccatgctggtgcactgcacccactaactcatcatctagcattaggtatatctcccaatgctatccctcccccctccccccaccccacaacagtccccagagtgtgatattccccttcctgtgtccatgtgatctcattgttcaattcccacctatgagtgagaatatgcagtgtttggttttttgttcttgcaacagtttactgagaatgatgttttccagtttcatccatgtccc

SEQ ID NO: 155915 - DNA, 601 bp, Human
aatctgttttatctgatataagactacctactcctgctcacttttggtttccatttggagtggaatatctttttgcactcctataccctaagtttatatgaatctttatgtattaggtgagtctcttgaagacagtatatatttggtttgtgatttttaaaatccattctgccaatctgtatcatttaagtggagaatttaagcaatttatatccaatgttaatattgagatgtgaggtactgttccagttatcctgttacttgttacctacatactctggtttcttttttttttttttctttttttttttattatactttaagttttagggtacatgtgcacattgtgcaggttagttacatatgtatacatgtgccatgctggtgcactgcacccactaactcatcatctagcattaggtatatctcccaatgctatccctcccccctccccccaccccacaacagtccccagagtgtgatattccccttcctgtgtccatgtgatctcattgttcaattcccacctatgagtgagaatatgcagtgtttggttttttgttcttgcaacagtttactgagaatgatgttttccagtttc

SEQ ID NO: 155916 - DNA, 601 bp, Human
tttgtctttttttactgttgttgctttaaaatctgttttatctgatataagactacctactcctgctcacttttggtttccatttggagtggaatatctttttgcactcctataccctaagtttatatgaatctttatgtattaggtgagtctcttgaagacagtatatatttggtttgtgatttttaaaatccattctgccaatctgtatcatttaagtggagaatttaagcaatttatatccaatgttaatattgagatgtgaggtactgttccagttatcctgttacttgttacctasatactctggtttcttttttttttttttctttttttttttattatactttaagttttagggtacatgtgcacattgtgcaggttagttacatatgtatacatgtgccatgctggtgcactgcacccactaactcatcatctagcattaggtatatctcccaatgctatccctcccccctccccccaccccacaacagtccccagagtgtgatattccccttcctgtgtccatgtgatctcattgttcaattcccacctatgagtgagaatatgcagtgtttggttttttgttcttgcaaca

SEQ ID NO: 155917 - DNA, 601 bp, Human
ttgtggcctagcatatggtctattgtggagaatgttctgtgtgctgattaaaagaatgtacaatctgaagttattaggtagaatgttcggcaaatatttgtcaggtccatttgttctagagtgcactttaggtccattatttctttgttgactttctgtcttgatgatctgtctagtgttgtcggtggactgttgcagtctcatactattattatttcatgtctatctcatgtcttaggtctaatagtaattgttttatgaatctgggagctccagtgttaagtgtatataaatttaggawtataatatcttcttgttggattgatccttttatcatcatataatgaccttctttgtctttttttactgttgttgctttaaaatctgttttatctgatataagactacctactcctgctcacttttggtttccatttggagtggaatatctttttgcactcctataccctaagtttatatgaatctttatgtattaggtgagtctcttgaagacagtatatatttggtttgtgatttttaaaatccattctgccaatctgtatcatttaagtggagaatttaagcaatttatatccaatgt

SEQ ID NO: 155918 - DNA, 601 bp, Human
tgctctggttaggacttccagcactatgctgaatagaagtggtgaaagtggcatccttgtcttgttccagttctcaaggggaatactttcaacttttccccatttattatgatgttagctgtgggtctgtcatatatggctttcattagttttaggtaaagttccttttatatctgtttgttgagtttttttatacggggatgctggattttatgaaatgctttttctgcatctattcagatgatcatagagtttttctttttaattccttttatcagatgtatcccatttattgacttgyatattttaaaccatccctgcatccctggaatgaaacctacttggtcatggtgtattatctttttgatgtgctgcttgaattagctagtattttgttgaggatttttgcatctatgttcatcaggggtattggtctgtagttttctttttttcttatgtcttttcctggttgtggtatcagaatgatactggcttcatagaatgagttagggaggatccctctttcttaatcttttggaatagtttcagtaggattggtcccagttctctgaatgtctggtaggattcagttgtgaatcca

SEQ ID NO: 155919 - DNA, 601 bp, Human
tatttctgggttctctattctgttccactgctctatgtgcctacttttataccagcactatttttgtaactacagccttgtggcaaacatctgataatgtgatgcctctacgtctgttttcttgtttgtttgtttttttgcataggattgctttggctattcaggttctttttctggtttcatatgaattttagaattgttttttctaattctgtgaaaaatgatgttggtattttgataggaattgcactgaatcagtggattgctttgggtagtatggtcattttcatgatattgattmttccaatccatgagcatgggatgtgtttccatttgtttgtgtcatctatgatttctatcagcagtgttttgtagttctccttgtagagatcttttacctccttggttaaatatattcctaggtaatttatttttttccagctgttgtgaaaaggactgagttcttgatctgattctcagcatggtcattgttggtgtatagcactgctactgatttgtgtatattgattttgtgacctgagactacggaattcatttgtcaaatccaggagtcttttggaggagtatttagggttttcta

SEQ ID NO: 155920 - DNA, 601 bp, Human
tggctttatttctgggttctctattctgttccactgctctatgtgcctacttttataccagcactatttttgtaactacagccttgtggcaaacatctgataatgtgatgcctctacgtctgttttcttgtttgtttgtttttttgcataggattgctttggctattcaggttctttttctggtttcatatgaattttagaattgttttttctaattctgtgaaaaatgatgttggtattttgataggaattgcactgaatcagtggattgctttgggtagtatggtcattttcatgataytgattattccaatccatgagcatgggatgtgtttccatttgtttgtgtcatctatgatttctatcagcagtgttttgtagttctccttgtagagatcttttacctccttggttaaatatattcctaggtaatttatttttttccagctgttgtgaaaaggactgagttcttgatctgattctcagcatggtcattgttggtgtatagcactgctactgatttgtgtatattgattttgtgacctgagactacggaattcatttgtcaaatccaggagtcttttggaggagtatttagggt

SEQ ID NO: 155921 - DNA, 601 bp, Human
tttagcatttttcatatgttctttaccattcttatatcctcttttgagaaatgtctattcatgttatttgcccacattttgatgggatttttttttcttgttgatgtacttgagttcattgtagattctagatattagtcctttgctagatgtatagtttgcagatattttctcccactctgtgggttgtctatttattctgatagttatttcttttaatgtactgaagtttcttttatttaattaggtcctatttatttatttttattttagttgcatttgcttttggggtcctactcaygaattatttgcctaagccaatgtccagaatagtttttcctaggttatcttctataatttttatagtttcatgtcttagatttacatctttgaaccatcttgagatgatttttgtataaggtaagggataagcatccagtttcattcttctacatgtggttatccagttttcccagcattatttattaaataaggtgtcctttcctcagcctgtgtttctctatgctttgttgaagatcagttggttgtaagtatttggctttatttctgggttctctattctgttccactgctctatgtg

SEQ ID NO: 155922 - DNA, 601 bp, Human
agagtgagctgcttcctaatcttaagaggccagtctctatgtggttggagtaagcaaatgtcccattagaagccaaatccatgtttctaggagattttcatgaatgttattatgcaggggctattctcattatatgaaaatctcagtttttaaaatttttttatttcaatagtttttggggtacaagtggttttggtcacacggatgaattatatagtggtgaagtctgagattttagtgcacccatcatccaagtagtgtacattgtacccaataagtagttttttaatccctcaccccyctcaaccctccctcttctgagtcgccaaagtccatcatagaattctgtatgcctttgcatacccatatcttggttcccacttataagtgagaacatacggtttttggtttttccattcctgagtacttcacttagaataatggcttctagctccatccaagttactgcaaaacacattatttcattatttttatggctgagtagtattccatggtgtatatatatcacattttctttatccactcattcgttaatggacacttagattggttccatacgtttgcaactgtgaattgtgtt

SEQ ID NO: 155923 - DNA, 601 bp, Human
ataataaacaggggtggtgggaaataaaacgaaacgatttttaaaaatgaaaaaatgtcaacaaggaaatcttgcagtttattttggaaagaaactgaaagaaaagttttaatcgtgatgtagccaagagtacacgaactaataaaactggtgcctaaaatagacatgtttaatattaataaccataaccaatttaaatcaaattggaaggatatgatttcctttaaaatttaaatctagtgaaataaaattcaaagccattttaactaaaaaatagacgtgtatctttaaaacatgattrgtgtaaagacaaatcaaaaaactagagattatgagagtttaatgttcaatgctaacatataaaagaaatcacaagtgttactaaagtcaacagaaggaatttaatactaatcttggcaaacatgcataacaaataaccttaggcataaaaaccaggtggaaaagctttctgtctcctagagagcaatatgttactaggcaataccacttcactgataatcttcctgtaatttttaatggaagcactcagattggtttaagctacaaatgtctatggttttctgccttgcaataaggaaaa

SEQ ID NO: 155924 - DNA, 601 bp, Human
ggcagagcttacagtgagccaagattatgccactgtcctccagcctgggtgacagaacaagattctgtctcagaacaacaacaacaaaaataaaacaaataaacagaaaatcatagtatctatcatctataatatacctcacagcaatcttgcagccaatgagccccttacactgtagaaacacttgaaaaatatcgttaccatgaatgttaaacttactggatgtaacagcaagatacagatgacaacaaaaccctactcacgagcatgagagcccatgaaaaggacactttggtgagcraaacaacttacaaaactgaaatttaaagaagcgaccaggctgttgtacaagataattcactatcacctgtatgctttgcttcacaatccatataataaacaggggtggtgggaaataaaacgaaacgatttttaaaaatgaaaaaatgtcaacaaggaaatcttgcagtttattttggaaagaaactgaaagaaaagttttaatcgtgatgtagccaagagtacacgaactaataaaactggtgcctaaaatagacatgtttaatattaataaccataaccaatttaaatcaaattggaa

SEQ ID NO: 155925 - DNA, 601 bp, Human
gggtggatcacttgaggtcctgagttcaagcccagcctggccaacatggagaaaccctatctctactaaaaatacaaaaattagccagacgtagtgccacatgcctgtaatcccagctacctgggaggctgaggcacaagaatcgcttgaacccaggaggcagagcttacagtgagccaagattatgccactgtcctccagcctgggtgacagaacaagattctgtctcagaacaacaacaacaaaaataaaacaaataaacagaaaatcatagtatctatcatctataatatacctcacagcaatcttgcagccaatgagccccttacactgtagaaacacttgaaaaatatcgttaccatgaatgttaaacttactggatgtaacagcaagatacagatgacaacaaaaccctactcacgagcatgagagcccatgaaaaggacactttggtgagcaaaacaacttacaaaactgaaatttaaagaagcgaccaggctgttgtacaagataattcactatcacctgtatgctttgcttcacaatccatataataaacaggggtggtgggaaataaaacgaaacgatttttaaaaatgaa

SEQ ID NO: 155926 - DNA, 601 bp, Human
tatatcaaaaatatttcttgtgaaaataacttattctgatgttaaggtctttcctggcatcaatattttcccttgatatcacaatatctaccacctgggtgcggtggctcatgcctgtaatcctagcactttgggaggacaaggtgggtggatcacttgaggtcctgagttcaagcccagcctggccaacatggagaaaccctatctctactaaaaatacaaaaattagccagacgtagtgccacatgcctgtaatcccagctacctgggaggctgaggcacaagaatcgcttgaacccasgaggcagagcttacagtgagccaagattatgccactgtcctccagcctgggtgacagaacaagattctgtctcagaacaacaacaacaaaaataaaacaaataaacagaaaatcatagtatctatcatctataatatacctcacagcaatcttgcagccaatgagccccttacactgtagaaacacttgaaaaatatcgttaccatgaatgttaaacttactggatgtaacagcaagatacagatgacaacaaaaccctactcacgagcatgagagcccatgaaaaggacactttggtga

SEQ ID NO: 155927 - DNA, 601 bp, Human
caaaattctaacaaaattggttttcatagttaataatctaatagttttattttgccacatgtatctatatcaaaaatatttcttgtgaaaataacttattctgatgttaaggtctttcctggcatcaatattttcccttgatatcacaatatctaccacctgggtgcggtggctcatgcctgtaatcctagcactttgggaggacaaggtgggtggatcacttgaggtcctgagttcaagcccagcctggccaacatggagaaaccctatctctactaaaaatacaaaaattagccagacrtagtgccacatgcctgtaatcccagctacctgggaggctgaggcacaagaatcgcttgaacccaggaggcagagcttacagtgagccaagattatgccactgtcctccagcctgggtgacagaacaagattctgtctcagaacaacaacaacaaaaataaaacaaataaacagaaaatcatagtatctatcatctataatatacctcacagcaatcttgcagccaatgagccccttacactgtagaaacacttgaaaaatatcgttaccatgaatgttaaacttactggatgtaacagca

SEQ ID NO: 155928 - DNA, 601 bp, Human
ggggaagaggtgattagatagcaagaacaaagcccatgtgaatggcattagtgcccttataaaagaagctccagagagttctcttgcctctttcaccatgtaaaggcacagtgagaaggtgtcatctatgaagaaaaccatgggccctgacctgaaactgaacctgcaggacctgatcttggacttcccactatggagaactgtgggaaatacatgtttgttgtttaagacatccagtctatggtatttatattgtagcagctcaaatgaactaagataatgcctatgaggaaagtactaktataatcttcattttatagatgttgagtatctatattcaaggattaaacaatatgccttaataactagtaagtgatagaactgaatttcaaacccagttttgcttgccccagagcctaagattatattataataaaataaataatcaaaatatttagttggcatatgtatgtacctcaattaaataatttatgtatatgcaaaaatatacatatgtgtatatatgtgtatatacagctatgaaacatctgtttgatcttctgaatatatactataaaatctttaacagagatggttatag

SEQ ID NO: 155929 - DNA, 601 bp, Human
tttctacacactggcaataaatacttgaacactgaaactaaaactataatagcatttataatcactcaaaaagaaaataaaattgggtgtgaatctaaccaaaaatgtatagaacttgtgtatgaaaactacaaaatgctggatgaaagagctaaataaatgaagagcatacagtgttcagggaatacttcacacaataaagatgtcaattctccctaaattgacaaataagtttaacaaaattgttatcaaaataccagcaagttttttttgtagcaatagataagattattctaaaatyatatggtaagataaaggaactagaataactaaaacaatttcaaaaaagaaaaatgtgaggtaatcagtctactcaatttcatggttcattattaactgcaataaccgaaagatggtgtagtattgtcagtgatagagatcaatggaacagaacaaaaaaatcccaaaatagaaccacacaaatatgtccaactgattttttacaaaagtgcaaaagcaattcaaattagagagataacttttcaacaaactcagtaaagttaggaaataaagtctccaagaaaaaagagttacttcccag

SEQ ID NO: 155930 - DNA, 601 bp, Human
aaatatctgggattacaggcacataccactgtatctggctaaacataaaaattatttccaaatgttaaaattttagaaattttataatttccaataaattttaaattttataaatttagcaacatatacaaagaattatacaccatgaccaagagacgttaatttcagatatgcaagcctggtacattattcaaactatcaaccaatatattaacaggctaaggaagaaaaatcacatgaacacatcaatatatgttgatcacatatctatctatagatatatatctgcatatattgatayagaaaaaaacatttgaaaatatacagcactcataaatcaaaaaaactgtaagaaaaaaatagaaatagaaggcaacttccccatcttcataaacagcatctacagaaacctacaactaacataatagtgaaagactgaatgctttccatgcaagacagtaaacaaggcaagaatgtccattctcattgctctgattcaacatggtgctggaaaattcaagtcagtgcaaccagacaagaaaaggagataaaaagtatacagacaagaaaggcagaaatataactgtctctatttgtatat

SEQ ID NO: 155931 - DNA, 601 bp, Human
attttggtcacatagaccctttagctcttagatagtactgaagacctttatataggttatctctatcaatatttattataatataagttaaagtgtgcttattctcctttacttgacaagtggtagtttcttagcctttatataggttatctctatccatatttattatgatatgagttaaaacaaaattttaaaatatttaaatataacaaaaatcctttaaatgttaacataaataacattttgtgaggaaaattataattttttaaaaatgtgatctaagccaaaaggccaggaagarattatagtattttttttaattagtgagaagagagatattgttttacattttttaaaaatctctttaatgtctcatttaataaaaggcagctggactctcacatttacttcagctttcaatctgttgccatatgttgttttggttggagtatatttagttgaaaaatagtggaatattttaataatcttttacaataactgtgtatattttcctttacttgataagtggtagcttcttaaaagtttgttgcaatgtataatctaaaacctttatcaataaacttttttttaccctgttaca

SEQ ID NO: 155932 - DNA, 601 bp, Human
tgaggatgcagcatatccaatggctgaatgagtaaaataaactccctgcacaaaattagtgacatgggattgcataccaacagatagagttataaagacagaataagaggtacagagaggttagaactgaaatgatgccaagaggcatttggagacagtactttatataaagagctggagaagaatacatattcaaggcaaaaggaacattaagcaaaggtaaggagatgtaaaacaccatagttctggaataaaagtatcttcatcttactgaataatagagtggaaaggaaatgagacrgaagagaagggagcagaggtggcagaagccatgatagaaggacttatggaccatatacagaggtttggattttatcctgtaggccagaagttctcaaacattttggtcacatagaccctttagctcttagatagtactgaagacctttatataggttatctctatcaatatttattataatataagttaaagtgtgcttattctcctttacttgacaagtggtagtttcttagcctttatataggttatctctatccatatttattatgatatgagttaaaacaaaattttaaaatattt

SEQ ID NO: 155933 - DNA, 601 bp, Human
ttcaaaaaccattttttgactacaggaaggttactgagttcagtaagtatgtcttttatttttaatgtggttcatgagtacacagggaacattcaatgtaaagcattttataactatttttgaaaaaaatcctcacaaatattatggttcattgtaaactacctaccatctgcatagctgagatttcaaaacctgcatctcggatagccatcaggatctttcccaacagtcctgaaaatgaaggacaatgagtgaaaaaatacaaaattttaagacattttagtttcttagaaatgcaaattttttatagcaaagtactttttgtttatactctatatttaaaaaaacacatattttgcaagagaaactaaattaaatccctaatactgagcattaaatctaatcatttgatttcctttgtaagtgcttcaagaatatcaacaatggttctgaggtttatgcaaaaaacttttaagataatattttgcctttaaagcccctgaagtctaggtgatatagagaacataaaaatcaaacaattataaatggcattatttaatacaaagaaacgaaatgccaaagtaccagatacagaaggaat

SEQ ID NO: 155934 - DNA, 601 bp, Human
tagggaaaaaaaatctgaactgattctcttccttcattatttgtttagtgaagaatccagaagacagaaaactcatcacaatttctcactttgattctactttttgtttataagaacaaaatacagtttttggtccttatttattttgcaactaaagtttccagaattgtataaacttaccttataagcttaaattaggtgtatcattgaatattacttctctcagtaaaatattatatgggaaaaatcatttcaaaaaccattttttgactacaggaaggttactgagttcagtaagtaygtcttttatttttaatgtggttcatgagtacacagggaacattcaatgtaaagcattttataactatttttgaaaaaaatcctcacaaatattatggttcattgtaaactacctaccatctgcatagctgagatttcaaaacctgcatctcggatagccatcaggatctttcccaacagtcctgaaaatgaaggacaatgagtgaaaaaatacaaaattttaagacattttagtttcttagaaatgcaaattttttatagcaaagtactttttgtttatactctatatttaaaaaaacac

SEQ ID NO: 155935 - DNA, 601 bp, Human
atgactttgtaaactatttccctttttttttttttcttttttggcttattggcacaaaatagaactccagtttgtgtcctggtccttgattttgggtaatcttaagactttagaaagctgtttcttttcagaaaataaaatacaaataataccagtaagaaaattctcagcttcaaaatggctattttggtatttcactatcaaaaaagcacaaacttgctgggcttcaaacactgtaaaaaccaaattgtttatctgatttatataataatctgttgcccaatttctagtcaaatgtacygatgagtacagcacaaaggtatgacctctaccaaagtgggtgttgtttctcactgaaaggtttcctaggagtgtatgaacaacgcaattttgaacaagcgtgggctctgaaggtgcagcggtacaagtgccaacagagttgctagaatacactaactccaaagacagtcttgagagaaagtccaaaaaccagcaaaaggcactggttagggaaaaaaaatctgaactgattctcttccttcattatttgtttagtgaagaatccagaagacagaaaactcatcacaatttctcactttga

SEQ ID NO: 155936 - DNA, 601 bp, Human
cctagaaaacagctgacccaagattcagaaatagatctttctgactccacaagtccacgactgtgtttgctactacactaccatgccttacctataggctcaattaatcatttttaaaattatttttttcatcagtacaaactatacccaatcaccaatcactatgctaaactgtagatctagaattaggtcagtgtttaaaactaacatttctatatttttttaaataggcttacatgtcatcctacaatcttgttaatatatcaccaagctaatacttttagaaagttttggctgacawttactttataattctaggtaagattcttcaaatatcagttttctcattagtctttaagttttgctcaatgactttgtaaactatttccctttttttttttttcttttttggcttattggcacaaaatagaactccagtttgtgtcctggtccttgattttgggtaatcttaagactttagaaagctgtttcttttcagaaaataaaatacaaataataccagtaagaaaattctcagcttcaaaatggctattttggtatttcactatcaaaaaagcacaaacttgctgggcttcaaaca

SEQ ID NO: 155937 - DNA, 601 bp, Human
acaaaatactaatagaagatatcatttattaaatacttagaatttgagccagaaatgattattttatttaatctgctgagtaacccatttaggcagatactaatgctttcattgcctagatgagaaaactgagaataagaatgcttgacatttggccaaggccacatgcctagaaaacagctgacccaagattcagaaatagatctttctgactccacaagtccacgactgtgtttgctactacactaccatgccttacctataggctcaattaatcatttttaaaattatttttttcatyagtacaaactatacccaatcaccaatcactatgctaaactgtagatctagaattaggtcagtgtttaaaactaacatttctatatttttttaaataggcttacatgtcatcctacaatcttgttaatatatcaccaagctaatacttttagaaagttttggctgacaattactttataattctaggtaagattcttcaaatatcagttttctcattagtctttaagttttgctcaatgactttgtaaactatttccctttttttttttttcttttttggcttattggcacaaaatagaac

SEQ ID NO: 155938 - DNA, 601 bp, Human
gattagtggcacaagaaagaaatattactaaagaaaagtagttcagacttttagaggaaacagaaaacaataccattttcctcccaagcattcggaaaaatccctagttagtctggtttgtgttaaagcatttatacaagtcatgtggacttcctgctactcttcaaaaagaactgtaaaagtgtgcttacaaagtaagtctagagggacttattcttatcaaggctgaatttaaatttagttaggaataaaatttcgttaaattctaaggttctcaaaaactaagaccttattttttttaaaaagtagcctcagaattcccagttttattttccctccattttgcttgtttattgttgccaggattgaagacccactgagaaatttctgccaatatggacaatcatttaagctaggaggatttatttttatgggcaacattactaccatagggaggaaattctgttggatttcagtgttttatccaacattcacatatgttttgctaaatgcaacaaaatactaatagaagatatcatttattaaatacttagaatttgagccagaaatgattattttatttaatctgctgagtaaccca

SEQ ID NO: 155939 - DNA, 601 bp, Human
aaatgttttacatttacttttatacttacatgatattcggtcactactcctttataaacttcatagaattcctcaacattaacccgatccatattgaactatattaaaaaataaaacaaaacaaaaccataaaccaaccaacaaaagggaaataaataagccacacttagcacttaacacttgtaatctcttctttactctaaaacataaactttacatagattactctttgaagaaaaagtgttattaaacatcaactcatcaagaataataatggataacagcatcactctaggttctrtacgtgcatcatctcatttagccctcacaaccaccttactgcataggtagtattaatggctccaacttacagatgagactactaagactcagaggagtcatacaacttcctcaaactggcatcctatctcaagcagtctgaccccattgataatacttttacctactacactacacctctctctgaataaaacctcattcttgatacaaaagaagatttatatgcaatattaattatactattgatagattagtggcacaagaaagaaatattactaaagaaaagtagttcagactttta

SEQ ID NO: 155940 - DNA, 601 bp, Human
tagaagatttaagatctgaacctagcatctgactctacagagggggaagaaaaaagaagagaactgaatttaggaagctgcaggctggttgcaatgaattttgggagatatgaaaggtatacagtttgaagaatgtaatgtggaaataactgactggttaacatcaggttacctcaggttactttttgttgtatggatgaaagacagagaaaacttcattattataccaaacaaaattagcctgtttgggaaatttggctcgctctctcctgatttctcagaaggtcagataacaacctargtcgttgacacagaactttagtatgaatgactctgtattgattttcagtctggccatttgggacctagtacaggagcttagtccaaaacactgcatcctatacttttcacttaacagtacaaatgttttacatttacttttatacttacatgatattcggtcactactcctttataaacttcatagaattcctcaacattaacccgatccatattgaactatattaaaaaataaaacaaaacaaaaccataaaccaaccaacaaaagggaaataaataagccacacttagcacttaacac

SEQ ID NO: 155941 - DNA, 601 bp, Human
ttaattaagtcacaaattttttaaacaaaaaaacaacctttctgtttcctttacagccttttgactgctgtccttaggtagctatgtgtaggatcatttgatttcatgtctatcttctccagagcataagctccataaatgcaggcagtatgttttttgttcatcactgattatttggcttatagcagatactcaatatatataataagtgtggatcatagtaacagcatgagataggaattatcacctttttatgactgtacatgttgaagcagaaaatacaggtgtaaataatcaacayggaatctactaccaaagaattatatcagactaaataataataaaaacaacaataatagcaggtaatatttactgagtacttttaatatgtgagacagttttacataatttatttcatttaattcccacaacaatctcataaggtaggtaatagcattattcccattttataaatgggttaatcaaggtttaaagaaggtaaataaattgtcgatggtcatataactagaagatttaagatctgaacctagcatctgactctacagagggggaagaaaaaagaagagaactgaatttagga

SEQ ID NO: 155942 - DNA, 601 bp, Human
aaagaattgccagaaagtagaccaaacaactcagagacagcacaaggctgagaagagtttatgtttctaccagccagagtgaaaggcctttttatatgatatatggagcatcaaggagagtcctcagaagggtactgcaccatagcagttggcctaaattagccctagattgtaagatgctctatacccatcctacaaagattaaaagcaagactcaaaagtttcaaattgattccaagtgatttaactaggtgccagaccaaaattgagcactctttacaaatctaccatgtaacaatgyaaattttacaatatacagtatccagtaaaaaaattaccaggcaggcaaatatgtaggaaaatactaaccattaccagaagaaaactcaataaatagacccagcaattaaataaatgacataaaaaggatatccaaacagctattataagctccacattctcaaattatacaaggaaatataaacttggtgaggagaaaataaaaaatatttaaaagatccaaatacaacgtctagagatataatctaagacatctaaatttaaaaatacactgaatggggtgaacaggatacgacactgc

SEQ ID NO: 155943 - DNA, 601 bp, Human
ggaaacagattaggtgagctgtagaattgctctgtcttactgtctagaggcagtttccagaccagtagaccaggtagaggaaacacaacagagcccaacgttctctgagttgaaaagacaaagattgcacttcggggaggccaatgtagccttattttcaggaaagaatactggagagatgaggggagtatgcagaaaataagctacaggatctgcagaggagttcccatgagtctttggctactaatctgtcacatgtgtacagcaaactacttgaggctggggaaagaattgccagaamgtagaccaaacaactcagagacagcacaaggctgagaagagtttatgtttctaccagccagagtgaaaggcctttttatatgatatatggagcatcaaggagagtcctcagaagggtactgcaccatagcagttggcctaaattagccctagattgtaagatgctctatacccatcctacaaagattaaaagcaagactcaaaagtttcaaattgattccaagtgatttaactaggtgccagaccaaaattgagcactctttacaaatctaccatgtaacaatgtaaattttacaatata

SEQ ID NO: 155944 - DNA, 601 bp, Human
tcttccccacttatatcccacatatcaagcagttcccaaattctgtccatttttccttgaagaatattttttagatatgctctctcttctccattcctatcacattttaatataatgctttatcatccgacactttcattatttggaatgatcttctagtatatcttccttgcaaaggccttcttgaatacaatgttgttgaattcacattactaaatatatatatataaatttcaaaggttttatcctaaaaaaccttttaaaaatcataatgcattctagcaacaagaaataataggascagatttattctcccatattaaacatctagaaactagataaaatatacgaaacaatagttttcatacactgggtgatgggcagcacaggtctatgacccctgaaagtatggaaacagattaggtgagctgtagaattgctctgtcttactgtctagaggcagtttccagaccagtagaccaggtagaggaaacacaacagagcccaacgttctctgagttgaaaagacaaagattgcacttcggggaggccaatgtagccttattttcaggaaagaatactggagagatgaggggagtat

SEQ ID NO: 155945 - DNA, 601 bp, Human
aacttacaggatcagcaggtccacaaaattctcgaaatgtctttgtagcattattctgttgaatctccattgctacacaagggccagaatacatttctgtcaccatgtcctatgatatgtaatataaaagaatgaaaagaatttaacaatttttaactctcctcttttaattgtttcactgttccactaatgtccttaaagtcatctgtgacttcttccccacttatatcccacatatcaagcagttcccaaattctgtccatttttccttgaagaatattttttagatatgctctctctyctccattcctatcacattttaatataatgctttatcatccgacactttcattatttggaatgatcttctagtatatcttccttgcaaaggccttcttgaatacaatgttgttgaattcacattactaaatatatatatataaatttcaaaggttttatcctaaaaaaccttttaaaaatcataatgcattctagcaacaagaaataataggaccagatttattctcccatattaaacatctagaaactagataaaatatacgaaacaatagttttcatacactgggtgatgggcagcaca

SEQ ID NO: 155946 - DNA, 601 bp, Human
tatgaagtgccattttgaattaaaactttgtatattatattcatttttacattatttacttaaaggaacaaacgaaaaattttaaacctgttaaaatagtgaatagataacacaaactaggataatattttaaacaataacttacaggatcagcaggtccacaaaattctcgaaatgtctttgtagcattattctgttgaatctccattgctacacaagggccagaatacatttctgtcaccatgtcctatgatatgtaatataaaagaatgaaaagaatttaacaatttttaactctccycttttaattgtttcactgttccactaatgtccttaaagtcatctgtgacttcttccccacttatatcccacatatcaagcagttcccaaattctgtccatttttccttgaagaatattttttagatatgctctctcttctccattcctatcacattttaatataatgctttatcatccgacactttcattatttggaatgatcttctagtatatcttccttgcaaaggccttcttgaatacaatgttgttgaattcacattactaaatatatatatataaatttcaaaggttttatccta

SEQ ID NO: 155947 - DNA, 601 bp, Human
tttattgtcttacatctaagggtgttcaataaatggccgggcatagcggctcatgcctgtaatctcaacactttgggaggccgagacaggctgatcacctgaggtcaggagttcaagaccagcctggccaacaggataaaaccctgtctctactaaaaatacaaaagattagccaggcggggtggcacacacctgtagtcccagctactcagatggctgaggcaggagaatcactagagcccgggaggtggaggttgcagtgagccgagattgcaccgctgcactctacactgggcaacasagtgagactccatctaaaaaaaaaaaaaattaaaaataataaacaatgccctgaataaaattaaattgaattggctgctcatcttcaataaactacttataaataatagtaaaatacaggaaacagtacatttacattaaggttagtgtttaaatcattaatacttcccataatcctatcaagtttctaatatttgcatagagctttatcatagcgttctaatgctacttctacttgtcactcccctacacctatacacacatacatacatgcactgttaaatgtccaagaaaaagtagt

SEQ ID NO: 155948 - DNA, 601 bp, Human
atcctattacctcccaaaggccccacttccaaataccatcaacatatacacatggggattaagtttccaacacatgaacttttcgtggacacattcaaaccactgtgtcacacattcccaggctgagctaagtgctatatttctgggttcctagagtacccgcaaatatctaacaatgcaattgccatattgcatggaaattagccacttacagttgtttactcacaggctaagatctttgaggcttatattatatcaactttattacataatatatatatataacaaaaataaagatagaaaaaaatatataattatgtgtgtatacacacacacacacacacacacacacacacatatatacgtgtaattttatagcaatagggtctcactatattgccaaggcaggtctccaactcctggcctcaagcaatcttcctgccttatcctcccaaaatgctgggattacaggtgtgtgctaccatgcccagcctgggcttctatatattcacaaatactgacatgggctcaataaatatttattgaataaatgagagaacaaaagaatgaatcatcttatttctttccttttttgttttag

SEQ ID NO: 155949 - DNA, 601 bp, Human
aaattctgagaccaaagggaaagagccattttattgtcctcaaaacatagcttgattgtaactactatagtatttcttctgatttgaaaacccccatcaaaggcatacagtcctgcctgacatcctggatctccacttagaaacagaatgtaactcaggagtctgagacacaagataatcagttcttagaagtatatgcctcctcattcaaaagttcattaactttcaggttttaagataaaaagtatttttgttattataaaagtaatataagtactttaaagaaattttgcaaaatatrggaaaacagaactgaaacattatcatatttccacctcctaaagataaccactgttaacattttacacgttaaatcagttccaaattttaaaatccctgtggtgcaactttctataatgctatgaggaacttatagacaactaaaatgaaccaaaaaaacacagtagagtaatgccatccatacttaatgagacaagattcagggccctgaaagagtttcaagattgagctatcatgaggttacgaggtccttaaggaaatataacgtattctagtcatcttttttatgccccagcaatag

SEQ ID NO: 155950 - DNA, 601 bp, Human
tgatgaattctaccacatataaccaacctcccatatctgtcatcatctattccccatgaagatgctcttctcatctcacacaggcttcaatatcctgacccaggcgatgcctctcacctggatgccttggtcatgccaatcaggctctgacacaccaggccagatctcccttctgtatcaatgcccatctggcactgggctgcctccaagtgtgaatgctctcttcacctcactcaggttctgactccccatgccaggctgctccccaggatcacaggccctcctctctgtgcataagatygggcaccctatgccaggccattccttctacagggaaaccatgcttaccccacctgggctctaaaaccccatactaggttgtctttccaagtctgaaccttcctcatcttacgctaagctgtcttcaggtgtggatgctctcttcttctgagatttcctgtttaatagattttggatattcatatatgtatatatatgaatatatacatatatacacacatttatacatatatatttaacagatctgtaatattttacatatcatgtcatactacaatatgagtggtgaaaacaaggcaaa

SEQ ID NO: 155951 - DNA, 601 bp, Human
ggaaccccttcaagctggcttctgtgtcctattgatatgtcaccattactttggcataaaaagattttccaagatcatattgtattttgcttcccctagttctggaatttgccatttcacttctctgaggatcttcatttcgtagagtgaagaatggtatttagaagtcaagatctggaaactaggtatgttctttgctatggaatatgtgtatgggaatacatgcatatatatatatatagagagagagagagagagatgtatttttctgagtgtgtacacatacacacatttatatctwttatttctacatttaatctgtgtatattgaaagccatgccttcatatcatatctccaatttcaattcgaacacaaagttcattgcagttttctcattttctgtatttgtatatctctcctctgagagaaatctggctcctattgtctttaatttatctagttatttgatgaattctaccacatataaccaacctcccatatctgtcatcatctattccccatgaagatgctcttctcatctcacacaggcttcaatatcctgacccaggcgatgcctctcacctggatgccttggtcatg

SEQ ID NO: 155952 - DNA, 601 bp, Human
attataacgtgttgctatcatgatttacttagatgctcaaattggtttcgattcaactagtggaaccccttcaagctggcttctgtgtcctattgatatgtcaccattactttggcataaaaagattttccaagatcatattgtattttgcttcccctagttctggaatttgccatttcacttctctgaggatcttcatttcgtagagtgaagaatggtatttagaagtcaagatctggaaactaggtatgttctttgctatggaatatgtgtatgggaatacatgcatatatatatatakagagagagagagagagagatgtatttttctgagtgtgtacacatacacacatttatatcttttatttctacatttaatctgtgtatattgaaagccatgccttcatatcatatctccaatttcaattcgaacacaaagttcattgcagttttctcattttctgtatttgtatatctctcctctgagagaaatctggctcctattgtctttaatttatctagttatttgatgaattctaccacatataaccaacctcccatatctgtcatcatctattccccatgaagatgctcttctcat

SEQ ID NO: 155953 - DNA, 601 bp, Human
tacttatttttgagttgtaaaaacttgacattttaagttttattttgaaagaactgtaaatttatagaaaagttactaatagactacagataatttgtttttgctatgaatcgttcaaaaataagttgctaatctgatgctccactacctccaaatattttagtttatatttcttaccaacaactacagcctcctatataaccacaatacagtcttcatacttagaccctggtgaggtttcactaattatctcaataatgtcatttatggccaaagtatcctgacttggaatcacatgctscatttagatatcatgtctcttcagtgtttttcagtcctgaacagttcctcagtctttattcaactttgtgacctttatatttctaaagattagaggccatgggcatgtcatatttctgtataattgaattcagttataaatatttggcaggaatatcacagaaataatgttacattctttttatttcatcctatcttgtggtatatgatttaattttcctccaatctatgatattcacttttatcactacatttttttaatatttcttattgtctgccagcctatgttaacattattaac

SEQ ID NO: 155954 - DNA, 601 bp, Human
tgaccagacctgcttagagactttgttctgttaagacaatagaggaacccagggctgagacctcaggactatggcgaggagaggaaggagctaaacaatataatctatttctttcacattttcagtggagctggccttgacttcacagacaatgacattttatttatttacttatttttgagttgtaaaaacttgacattttaagttttattttgaaagaactgtaaatttatagaaaagttactaatagactacagataatttgtttttgctatgaatcgttcaaaaataagttgctaayctgatgctccactacctccaaatattttagtttatatttcttaccaacaactacagcctcctatataaccacaatacagtcttcatacttagaccctggtgaggtttcactaattatctcaataatgtcatttatggccaaagtatcctgacttggaatcacatgctgcatttagatatcatgtctcttcagtgtttttcagtcctgaacagttcctcagtctttattcaactttgtgacctttatatttctaaagattagaggccatgggcatgtcatatttctgtataattgaattca

SEQ ID NO: 155955 - DNA, 601 bp, Human
tttgtttgtttttaaatagagacagggtcttgctatattgaccaggctagtcttgaactcctgccctcaaacaatcctcccacctcaaccttccaaagtgctgggattacaagcatgagccactgtccctagctaaatgttttcttaaatatcactttcttagtgagcccttctctgatgactccaacttataatcaaatcctatctacacttccttaactcaggttgcttcctttcttcattttccatcatatgaaatactatgtattctattttttatttgtttattatctgtctccarctagaatgtaagcttggtgccctgtgaggagattttatctctctgtctctctcactttctcatttgttttgttcactggtgtatccttggtgcctagaatactgcctggcacacagtaggcactcaaacatttatgaatgcatgaatgattgaagggcaactatgaagtcctgtaagtcagcttttcttagcttcctggaaactaaaattccaaagttgaaattttcttttaaaataaaaataatgaaatctgtttaaaaagtaaaggaaaaggaaaaaaccccaaggaaatggtaatat

SEQ ID NO: 155956 - DNA, 601 bp, Human
ccagtagaatatataaatatatttatatatatttatatacacataaacttgaacacacatgtgcacacacccaaatttttttgagacagagtctcactctgtcagtcaggctggagtgcagtggtgcgatcatggctcactgcagccttaacctattacaggcatgtgccaccatgcctggcaacttttgtattttttgtagagatgaggttttaccttgttgcccagtctggtctgttgttgttgtttgtttgttttatttttgtttgtttgtttgtttttaaatagagacagggtcttkctatattgaccaggctagtcttgaactcctgccctcaaacaatcctcccacctcaaccttccaaagtgctgggattacaagcatgagccactgtccctagctaaatgttttcttaaatatcactttcttagtgagcccttctctgatgactccaacttataatcaaatcctatctacacttccttaactcaggttgcttcctttcttcattttccatcatatgaaatactatgtattctattttttatttgtttattatctgtctccaactagaatgtaagcttggtgccctgtgaggag

SEQ ID NO: 155957 - DNA, 601 bp, Human
tcagcatggctggctttttcaagagctttatatgtatatatgtttacatatatttatacatattcaagtctttatatgcatacaaatatatggaaatatatttgtatacctatatactgtgtgccaggtagtatatgtgccagtagaatatataaatatatttatatatatttatatacacataaacttgaacacacatgtgcacacacccaaatttttttgagacagagtctcactctgtcagtcaggctggagtgcagtggtgcgatcatggctcactgcagccttaacctattacagscatgtgccaccatgcctggcaacttttgtattttttgtagagatgaggttttaccttgttgcccagtctggtctgttgttgttgtttgtttgttttatttttgtttgtttgtttgtttttaaatagagacagggtcttgctatattgaccaggctagtcttgaactcctgccctcaaacaatcctcccacctcaaccttccaaagtgctgggattacaagcatgagccactgtccctagctaaatgttttcttaaatatcactttcttagtgagcccttctctgatgactccaacttata

SEQ ID NO: 155958 - DNA, 601 bp, Human
gacagtcctggccaaattgggaacggtgttggtcatccaactaatatacgacattgagatgagggttttctttctttttctcggttagacaaatgtttcttcattaaacacatgatcattttctccaggattattttgtaatcactgaatcacttaataggtattacaagttattgcatgcaaatcacttcaaagaaaataaattactaacacataactttttttatatatactcactgtacttggattactttcaattttcttatgttaaaatgcatttaaaccacttaatactttcctraaaatgtatttttaaattatttttacatttgctaaagttaacaaaatgcttataaaataaattaagttgattacctaagaaaaatgtttcttttactataaactagtaatagaaatgcttggcacatgttaatctgtggatatgcctgttatctctggttaggtataaatgccttctctaagcgttgttatgtactaaattgacaggcaggaatatgaattcaccttccattttctcatcaatagagtgagataaaatcataatagagtagagagaactctgttttattccatttctact

SEQ ID NO: 155959 - DNA, 601 bp, Human
tttaagaggtatacaattaaaaggtaaattatttagagtgattaaccatcccacttttcctgggattgggggatttctcaggatgctggtctttcagtgtgaaacctgtgacagtcctggccaaattgggaacggtgttggtcatccaactaatatacgacattgagatgagggttttctttctttttctcggttagacaaatgtttcttcattaaacacatgatcattttctccaggattattttgtaatcactgaatcacttaataggtattacaagttattgcatgcaaatcacttcraagaaaataaattactaacacataactttttttatatatactcactgtacttggattactttcaattttcttatgttaaaatgcatttaaaccacttaatactttcctgaaaatgtatttttaaattatttttacatttgctaaagttaacaaaatgcttataaaataaattaagttgattacctaagaaaaatgtttcttttactataaactagtaatagaaatgcttggcacatgttaatctgtggatatgcctgttatctctggttaggtataaatgccttctctaagcgttgttat

SEQ ID NO: 155960 - DNA, 601 bp, Human
ggatgtgggtggaagtagtttaactgtacttctaagcttttataacttaatataacatctatttaaaaattataagtgaatataaataaactttattacagttcaattttaagaggtatacaattaaaaggtaaattatttagagtgattaaccatcccacttttcctgggattgggggatttctcaggatgctggtctttcagtgtgaaacctgtgacagtcctggccaaattgggaacggtgttggtcatccaactaatatacgacattgagatgagggttttctttctttttctcggytagacaaatgtttcttcattaaacacatgatcattttctccaggattattttgtaatcactgaatcacttaataggtattacaagttattgcatgcaaatcacttcaaagaaaataaattactaacacataactttttttatatatactcactgtacttggattactttcaattttcttatgttaaaatgcatttaaaccacttaatactttcctgaaaatgtatttttaaattatttttacatttgctaaagttaacaaaatgcttataaaataaattaagttgattacctaagaaaaa

SEQ ID NO: 155961 - DNA, 601 bp, Human
ttgcccaggctagtctcgagctcctgagctcaagtgatccttacacctcagcatctaaagtagctgggactataggtatgtgtcactgtacccagcctacaatacattattgcaatttatttgtctgattctcccagtatactgagagcttcttaagggtctcaactcctctttgaatccccaataaataaacatgatatcaggttcatagcaagtgtttaataaatgcctgaatttatgaatagataatgacagttgaaataaataaatatttactctaaatctcctattctgaaatgcrttccaatataccttatatgatgaagaagctacagaaacttgatggaaggaaggctaaggagaccttccaagacagctttttcctcatttttttatcattttggtttgcctccttcatgaaagattttcacaaatcatgagtttgaacacggacttacatttcagttacgcatgttttccccaacctctatactttagctttcaacccatatgttgttttgagaagtgggcctgtacttaatacctctacctgtaaataattccaatgaaaggataacttataaagcaaatgaaaagttaa

SEQ ID NO: 155962 - DNA, 601 bp, Human
ttatcatatcttattataattattatgacttgagataggatctcactgtgttgcccaggctagtctcgagctcctgagctcaagtgatccttacacctcagcatctaaagtagctgggactataggtatgtgtcactgtacccagcctacaatacattattgcaatttatttgtctgattctcccagtatactgagagcttcttaagggtctcaactcctctttgaatccccaataaataaacatgatatcaggttcatagcaagtgtttaataaatgcctgaatttatgaatagataatsacagttgaaataaataaatatttactctaaatctcctattctgaaatgcgttccaatataccttatatgatgaagaagctacagaaacttgatggaaggaaggctaaggagaccttccaagacagctttttcctcatttttttatcattttggtttgcctccttcatgaaagattttcacaaatcatgagtttgaacacggacttacatttcagttacgcatgttttccccaacctctatactttagctttcaacccatatgttgttttgagaagtgggcctgtacttaatacctctacc

SEQ ID NO: 155963 - DNA, 601 bp, Human
agccccaccccactcaacacagactgggttgggttccttcagagtaaaatcagtcctccatatccatgagttaatgcatctgcaaagtcaaccaaccacggatcaaaaatatttggaaaaataaaaaaattgtacaaagttgcaaaaagcaaaacttgaatttgccatgtgctaagtactacattgaatccacacaaattaagtgatgtgtaggcattgtattaagtagtaatagtaatctggatgtgaataggttccacgcaaatactataccattttatataagggacttaactatgckcagattttggtgtctgagggggtactggaaccaagcccccaagataccagaggatggctgtatttcctgagcattctgtacttctcactaagataacctttatcatatcttattataattattatgacttgagataggatctcactgtgttgcccaggctagtctcgagctcctgagctcaagtgatccttacacctcagcatctaaagtagctgggactataggtatgtgtcactgtacccagcctacaatacattattgcaatttatttgtctgattctcccagtatactgagagctt

SEQ ID NO: 155964 - DNA, 601 bp, Human
gccttttctgaatagcctattccctaggcctcagccccaccccactcaacacagactgggttgggttccttcagagtaaaatcagtcctccatatccatgagttaatgcatctgcaaagtcaaccaaccacggatcaaaaatatttggaaaaataaaaaaattgtacaaagttgcaaaaagcaaaacttgaatttgccatgtgctaagtactacattgaatccacacaaattaagtgatgtgtaggcattgtattaagtagtaatagtaatctggatgtgaataggttccacgcaaatacyataccattttatataagggacttaactatgcgcagattttggtgtctgagggggtactggaaccaagcccccaagataccagaggatggctgtatttcctgagcattctgtacttctcactaagataacctttatcatatcttattataattattatgacttgagataggatctcactgtgttgcccaggctagtctcgagctcctgagctcaagtgatccttacacctcagcatctaaagtagctgggactataggtatgtgtcactgtacccagcctacaatacattattgcaattta

SEQ ID NO: 155965 - DNA, 601 bp, Human
ggtgaaacttcttgctgaagatccagactttccttagggaaacttgaaggcagatgggaggagctttaatttcctataagtaggagctcttcatttctctggaactttccttctttgccaagccaaatttaactccttctttaaattatagctccaggcatcatttcctcagggaagccttttctgaatagcctattccctaggcctcagccccaccccactcaacacagactgggttgggttccttcagagtaaaatcagtcctccatatccatgagttaatgcatctgcaaagtcaacmaaccacggatcaaaaatatttggaaaaataaaaaaattgtacaaagttgcaaaaagcaaaacttgaatttgccatgtgctaagtactacattgaatccacacaaattaagtgatgtgtaggcattgtattaagtagtaatagtaatctggatgtgaataggttccacgcaaatactataccattttatataagggacttaactatgcgcagattttggtgtctgagggggtactggaaccaagcccccaagataccagaggatggctgtatttcctgagcattctgtacttctcactaag

SEQ ID NO: 155966 - DNA, 601 bp, Human
gaccagcctgggcaacatggtggtacctcctctctacaaaatattttaaaacttagccagccatgtagcacatgcctatagtcccagctactcgggatgctgagatgggaggattgcttgagatggggagattcaggctgccactgcagtccagcctgggtgatagaccaaaaccctgtctcagaaaaacagaaaaacaaacaaacaaagcaaagcaaagaaaaaataatagtatttcctgttaaggcatttaaaaaatttttccaattttgaattttttttttttttttttttttttagkaatatagcccaatgccaatcaatgcagcctgccaaaagtcttcatctacagtagccctgggaaagaggaaaaatcctttgcagagaatacccattcccattagaagtaatctcagtgtttatcattaattccactggaagtaggaaaaaacacaaaaataagagactaagatttcagatgacgtgagataccacttttgaatgcaactccatccttaagataaatgccctggatcttaaatacaactttttctcctataagggtgaaacttcttgctgaagatccagactttccttaggg

SEQ ID NO: 155967 - DNA, 601 bp, Human
attgtgaaatatacatttgatctttgtctaaacacatttggtcttagtcctgggatacaactcctagaatctttggaatcttcaaagtgataagtacctttttgtatgctaatgagttgactgatggctgacaccacccaggtagcttcagaatgagagctgttcaccagaaagatcaatgtatgatcagaagggactttcagctctacttcctaacttttcgggagggaagagaagctgaaggttaaagccaatcatcagtggccaataatttaaccaaccatgactatgaaatgagacyttcataaaaatacaaaaggacagggttcagagagcttccagatagctgagcaaatgaaagtccctaaagggtggtgcacccagagacagcatggaaactccacaccccttcttatacatttcctttgcatctttatatcctttgtaatatcctttataataaagcagtaaacgtgtttcccttagttctgtgagttgctctagcaaattaatcaaactcaaagtgggggttgtggaaactccaatttatttatagcaagtcagtaaaagcacaagcaaaacaatctgggaattgcaatta

SEQ ID NO: 155968 - DNA, 601 bp, Human
gataaaaaagttctaacttctgggaatctaaagtagagcatacatactgtacctgaaatttgctaaaagagttgtgatattgtgaaatatacatttgatctttgtctaaacacatttggtcttagtcctgggatacaactcctagaatctttggaatcttcaaagtgataagtacctttttgtatgctaatgagttgactgatggctgacaccacccaggtagcttcagaatgagagctgttcaccagaaagatcaatgtatgatcagaagggactttcagctctacttcctaacttttcsggagggaagagaagctgaaggttaaagccaatcatcagtggccaataatttaaccaaccatgactatgaaatgagactttcataaaaatacaaaaggacagggttcagagagcttccagatagctgagcaaatgaaagtccctaaagggtggtgcacccagagacagcatggaaactccacaccccttcttatacatttcctttgcatctttatatcctttgtaatatcctttataataaagcagtaaacgtgtttcccttagttctgtgagttgctctagcaaattaatcaaactcaaa

SEQ ID NO: 155969 - DNA, 601 bp, Human
caagtcaaattcatagaaattgagagtagaatagtagttgccagggcttggcagatggaagaaatggagagatgatggtcaagggtataaactttcaggtataagataaaaaagttctaacttctgggaatctaaagtagagcatacatactgtacctgaaatttgctaaaagagttgtgatattgtgaaatatacatttgatctttgtctaaacacatttggtcttagtcctgggatacaactcctagaatctttggaatcttcaaagtgataagtacctttttgtatgctaatgagttkactgatggctgacaccacccaggtagcttcagaatgagagctgttcaccagaaagatcaatgtatgatcagaagggactttcagctctacttcctaacttttcgggagggaagagaagctgaaggttaaagccaatcatcagtggccaataatttaaccaaccatgactatgaaatgagactttcataaaaatacaaaaggacagggttcagagagcttccagatagctgagcaaatgaaagtccctaaagggtggtgcacccagagacagcatggaaactccacaccccttcttataca

SEQ ID NO: 155970 - DNA, 601 bp, Human
tgaaggatggtgaatgcggataatttcactgagcaatgaaagtagctctcagtggaaaggggagctggaggggaagggaagggcagatctctcccctgaagtcaggttgcctctctccctctctccttgaagtcaagctgcctccttctgacatccagccatcatctctgaagtcaactcacctcttctagatatccagctgcttctcccctctactggctgagtctggggtctttataggcacaggatggggggcagggtaagccataggtagttttgaaaaaggcaacattcaatttgwaaaaagacattattcagaaagaaccaatcaggaaagaccaggcaaatagggatagaagttctcactttgggccacgggtttcaggttttttggcttgaaggtgaggcttcaccagggactcacccctgtctgcctagagtttctctgcctcctacctctattattatttattttgttgtaaagagaagtgacaggtactaatgtcaaaatgaaacaaaaaaaaaaggagaggtgactcattttttcaaggttgctaaatactagcttagcatcttatttgagctttagaaagcaaggccc

SEQ ID NO: 155971 - DNA, 601 bp, Human
gatcttggaatttcaaaagtgaattatgagaaaggaaaaccttagtcctcttcaggctttgtagtttaggggacaaaccaagtataaagaatgagaaagtgctcttcaagataaaacgtaggaagacatgttagaagcaagtggtttggaaagggagcttatatcatggattaaaattagatgagtagacatccaagaaaaaagtctcaatattgatctccattgttagcccctttgaaaagactggtctttcctttcctaacctgctctctgagcctgctgaagaaaagaagggaacagycttgtttgaaacatgactatagaacccgtgtggctcttctgagtcccctgagttcctttattgatttcaaaaccatgaaggcttttgtttgaatttttgccatttcaaaaaatgataataggtccaagttattgttaaattctcataagaacatcaaacattttctgactagaagacactaaacatctggtataatttgcttcttaggataactttatttaaaaagagaggaaagagaaaagaaaaaggctttgtaactttctccaggaccatgtcaagaaacaaaggtattgataatgc

SEQ ID NO: 155972 - DNA, 601 bp, Human
acacaaacatacacacacatacagggtgtaagcttgttaagctaatttccagttaataggtgctccagattacccagtgctatacattcattctctttgtaatacatattgattggtggtaatgagcccacagatgtccacagcagtaagctttctagtatgtacaagcatatcttttgaagatctatacagttaattatactgatcttggaatttcaaaagtgaattatgagaaaggaaaaccttagtcctcttcaggctttgtagtttaggggacaaaccaagtataaagaatgagaamgtgctcttcaagataaaacgtaggaagacatgttagaagcaagtggtttggaaagggagcttatatcatggattaaaattagatgagtagacatccaagaaaaaagtctcaatattgatctccattgttagcccctttgaaaagactggtctttcctttcctaacctgctctctgagcctgctgaagaaaagaagggaacagccttgtttgaaacatgactatagaacccgtgtggctcttctgagtcccctgagttcctttattgatttcaaaaccatgaaggcttttgtttgaatttt

SEQ ID NO: 155973 - DNA, 601 bp, Human
tctttcctgtgtatcactccccattaattttttctcttttttgtctttcttaagtacagaattataaccaactaatctttaaacatgccaaatgctaaaggaaggaagagaacaagaactgaaaaattttcctggtctttagctggttgattgtccaaagagatttgggtcagtgtttagctctggccaaaagagacccatcctggtcagacagcagttgagctgtctcataaaaacaataatcttgggaaaaaatataaaaataaaataaataaataaatatatatatatatacacacamacatacacacacatacagggtgtaagcttgttaagctaatttccagttaataggtgctccagattacccagtgctatacattcattctctttgtaatacatattgattggtggtaatgagcccacagatgtccacagcagtaagctttctagtatgtacaagcatatcttttgaagatctatacagttaattatactgatcttggaatttcaaaagtgaattatgagaaaggaaaaccttagtcctcttcaggctttgtagtttaggggacaaaccaagtataaagaatgagaaagtgct

SEQ ID NO: 155974 - DNA, 601 bp, Human
gtgccttataaagaaaatatatatgtaatgcaggcatcattcaggcatgagttacagtcatgctggccatgagttcaatgttactagatcaacgatatttatttagtgtctttaaacagaaatacacacaaaacaaggttatatattgatcattaatatatttgttgtgaccacaggctcacaggaacctaactctgtatttctcctaggaacaatagttcagtattcaccaagtcagtgttcatggtaactttatagaacttaactactgtaaataatgagaatgaactgcacaggagtaaaaaaaaaaatctcacccatagtactacagcctcgagtacctcttccaccacatggttgccaatgctggattttatctatttttttaaattttgccaacctcactggtttaaaaagttgtattattcccctttaatatgcatttccctgatcaataaggctgaacatatatgaaataggcatctttcctgtgtatcactccccattaattttttctcttttttgtctttcttaagtacagaattataaccaactaatctttaaacatgccaaatgctaaaggaaggaagagaacaagaac

SEQ ID NO: 155975 - DNA, 601 bp, Human
aagagctgtcaagagtcctaagtataacagtgctgtgatgtgccttataaagaaaatatatatgtaatgcaggcatcattcaggcatgagttacagtcatgctggccatgagttcaatgttactagatcaacgatatttatttagtgtctttaaacagaaatacacacaaaacaaggttatatattgatcattaatatatttgttgtgaccacaggctcacaggaacctaactctgtatttctcctaggaacaatagttcagtattcaccaagtcagtgttcatggtaactttatagaacwtaactactgtaaataatgagaatgaactgcacaggagtaaaaaaaaaaatctcacccatagtactacagcctcgagtacctcttccaccacatggttgccaatgctggattttatctatttttttaaattttgccaacctcactggtttaaaaagttgtattattcccctttaatatgcatttccctgatcaataaggctgaacatatatgaaataggcatctttcctgtgtatcactccccattaattttttctcttttttgtctttcttaagtacagaattataaccaactaatcttt

SEQ ID NO: 155976 - DNA, 601 bp, Human
aggtgtcctttttgcagtgtacttggtgttacattttttgcatttttgtattttctgttggtgactttactatttaaaacagttcctgagcatagtgccgaagagctgtcaagagtcctaagtataacagtgctgtgatgtgccttataaagaaaatatatatgtaatgcaggcatcattcaggcatgagttacagtcatgctggccatgagttcaatgttactagatcaacgatatttatttagtgtctttaaacagaaatacacacaaaacaaggttatatattgatcattaatatatwtgttgtgaccacaggctcacaggaacctaactctgtatttctcctaggaacaatagttcagtattcaccaagtcagtgttcatggtaactttatagaacttaactactgtaaataatgagaatgaactgcacaggagtaaaaaaaaaaatctcacccatagtactacagcctcgagtacctcttccaccacatggttgccaatgctggattttatctatttttttaaattttgccaacctcactggtttaaaaagttgtattattcccctttaatatgcatttccctgatcaataaggct

SEQ ID NO: 155977 - DNA, 601 bp, Human
gctattaaatacttttaaaaaagtcatttaaattcattgttaaaaaacatagaaaatatagtcaatccccactgtttgtggattccatgtttgtgaatttacctactcactgaaatttatttgtaaccccaaaatcaatattaatagcacatgtatggccattggtagacatgtgcagagcagcaaaaatttgagtcactcaaatgagtactcatgagtactcccaaatgagggtgaacaaggtgacactctctgccttcttattttaactctcacacttcacactttaaaacaaatgtcyttttttttttttttttttttaagtcaaggtcttgctctgttgccctagctggagtgtagtggtactgtcatggcccactgcagcctttaagtcctgggctcaagtgattcttccatcttagcctcttgagtactgagtagctaggactacaggcacaggccatcatgcccagctaaggtttttttgtttttgttttcgttttaaatatttttagagacagggtctcactatgttacacaagttggtctcaaactcctggcttcaagtgatcctcccacctcatcctcccaagttgctggg

SEQ ID NO: 155978 - DNA, 601 bp, Human
aaatgaaaatatttattttaaaaattagttgctatttactttgctatttacttaataaatttgttttacttaataactttacttaataaattatttaataaattgctattaaatacttttaaaaaagtcatttaaattcattgttaaaaaacatagaaaatatagtcaatccccactgtttgtggattccatgtttgtgaatttacctactcactgaaatttatttgtaaccccaaaatcaatattaatagcacatgtatggccattggtagacatgtgcagagcagcaaaaatttgagtcactcaaatgagtactcatgagtactcccaaatgagggtgaacaaggtgacactctctgccttcttattttaactctcacacttcacactttaaaacaaatgtccttttttttttttttttttttaagtcaaggtcttgctctgttgccctagctggagtgtagtggtactgtcatggcccactgcagcctttaagtcctgggctcaagtgattcttccatcttagcctcttgagtactgagtagctaggactacaggcacaggccatcatgcccagctaaggtttttttgtttttgtttt

SEQ ID NO: 155979 - DNA, 601 bp, Human
tattttcaacaaatttggggattgagcattatttaacaccaaagcaaaagaaatccaagacacacagttattctgaaatctaagtattttctagtatgtaatttttactaattgtattaaacccctttcagccacctcctcttcaagagaaattcttttctttagccagaatattttattaaatgaaaatatttattttaaaaattagttgctatttactttgctatttacttaataaatttgttttacttaataactttacttaataaattatttaataaattgctattaaatacttttwaaaaagtcatttaaattcattgttaaaaaacatagaaaatatagtcaatccccactgtttgtggattccatgtttgtgaatttacctactcactgaaatttatttgtaaccccaaaatcaatattaatagcacatgtatggccattggtagacatgtgcagagcagcaaaaatttgagtcactcaaatgagtactcatgagtactcccaaatgagggtgaacaaggtgacactctctgccttcttattttaactctcacacttcacactttaaaacaaatgtcctttttttttttttttt

SEQ ID NO: 155980 - DNA, 601 bp, Human
ctgggttttgactttctatccataatacaagtaatcatgatataggaaatataaggtaaaaactgtcatctatcttgttgcttttggatcagcttacagctaaatcacctggaaaaaatattatgcaatctctacttttaaaacttaacagagaatacttttctatttaattttcaaaagtcattagatttgcacatgttttatgccctggtaatattgtgataggatcatgaacatgtaataaaacaatatgatataatggttaaaggcatgaagttgagagcaacaatgtgaagatttkaatcccagttatgatacttaatggcaggaacaaccagaaaagagaaaaatcttcatttaaaaaatttagttaaaaaatccacgcattacaagaaaaggatatataaaattccaaacctctgacttgtaaatttgaattacatcttctgctttttcaggaaaagattgccgttgattcaatactattatatttgaataaaattttaattttcatagaaaaatatgatacaatattgttttatacagtagtttaatgtcaactgctgtttgttactctcttactaggttgcaatgtttcttc

SEQ ID NO: 155981 - DNA, 601 bp, Human
agtaaacattatcgtggcaaaataattctgtatcagatgtgttggtgccccgtgggggttggaacattggtattcatctagaaactatgttctaagtttgttgtttagatagtccttctgtggtagtttcagatgctctagaacaaatcattcataatatttaaatacacacacacacacacactccatcagaataaaggagtacactgtaaatgcaatgtgccaaaacaagaacaatatgttactacaaaatgacagttactacaaatttgccagttacgtcataatcacaaataaaatrgggaaaaaagaaagcaggggatggggaggaggttctgtaatcagaggcaatataatacctctagagaatcacacactgaacaattatcagctaccctgccccagtcgttctctcccgtttctgcttcattcccctggcctcatcggggcttccttcccctttgtttgcaggccacattaaataagacttttaggtatattccaggtcacgggactatcatattcctaccatagtctattgaatccctcatatagatcataagctctttttttttttaatttttcttttgcaagctccagt

SEQ ID NO: 155982 - DNA, 601 bp, Human
ttggttcctaagtgaggtaatagtaaacattatcgtggcaaaataattctgtatcagatgtgttggtgccccgtgggggttggaacattggtattcatctagaaactatgttctaagtttgttgtttagatagtccttctgtggtagtttcagatgctctagaacaaatcattcataatatttaaatacacacacacacacacactccatcagaataaaggagtacactgtaaatgcaatgtgccaaaacaagaacaatatgttactacaaaatgacagttactacaaatttgccagttaygtcataatcacaaataaaatggggaaaaaagaaagcaggggatggggaggaggttctgtaatcagaggcaatataatacctctagagaatcacacactgaacaattatcagctaccctgccccagtcgttctctcccgtttctgcttcattcccctggcctcatcggggcttccttcccctttgtttgcaggccacattaaataagacttttaggtatattccaggtcacgggactatcatattcctaccatagtctattgaatccctcatatagatcataagctctttttttttttaat

SEQ ID NO: 155983 - DNA, 601 bp, Human
tatgcctgaatatatgaaagtattgttgatattattccaattattgcttgagactgaagcctccattccagaaatgtatgtgtcaacctagaacctagagagcatcccaatgcttggttcctaagtgaggtaatagtaaacattatcgtggcaaaataattctgtatcagatgtgttggtgccccgtgggggttggaacattggtattcatctagaaactatgttctaagtttgttgtttagatagtccttctgtggtagtttcagatgctctagaacaaatcattcataatatttaaatccacacacacacacacactccatcagaataaaggagtacactgtaaatgcaatgtgccaaaacaagaacaatatgttactacaaaatgacagttactacaaatttgccagttacgtcataatcacaaataaaatggggaaaaaagaaagcaggggatggggaggaggttctgtaatcagaggcaatataatacctctagagaatcacacactgaacaattatcagctaccctgccccagtcgttctctcccgtttctgcttcattcccctggcctcatcggggcttccttcccctttgttt

SEQ ID NO: 155984 - DNA, 601 bp, Human
ctgttattaatataatttcttgcacaattatcagattcttctaaaagacttggcatagttgtaatatatacaactatgtaatcatttgtttaataacaatattcctcactagactataaattccatgtggacagagccaatgtctatcatgctcagtcctcaatacccaacacccacagtgtatttaataattttagtcaaataaaactgagtaaatctcaatctaacaaaaatggaggtaaaagggcaaaaatcccttaaagtgaaatttatttctagtttacccaagtctgtataccayagggaatctctgagagttttattcctaagacttttctatattctccactacactagaagatatgcctgaatatatgaaagtattgttgatattattccaattattgcttgagactgaagcctccattccagaaatgtatgtgtcaacctagaacctagagagcatcccaatgcttggttcctaagtgaggtaatagtaaacattatcgtggcaaaataattctgtatcagatgtgttggtgccccgtgggggttggaacattggtattcatctagaaactatgttctaagtttgttgttt

SEQ ID NO: 155985 - DNA, 601 bp, Human
cagagaaacattgaaacaatgaataaaggctttggtgttttaattactgttactgtatatattccaaaataaaacaaacatttctatcaagaatttcttcatctatagtaaataaactatgtacttgcttgtgcccatgtccaaattaccaagttcttccagttctccttccaaaatatatttcaaaaccttccactgttaccatccaagcccaaggtcccattatttctagtccgatttcctttattttcctccaacaaattttccacatcatagccacagagctttttaaaaatacaayctagatgtcattaattctttatttaaattttccatggagcttcctgttgcactcagagtaaatataaactagttaatgtggccttcatactctggcctaagcaatctctttagttaccttgtaggctactttcctctttgcattgtaggctagagccaaattagacttccttgaattcctagaatatgctaggttctccccagatttagggcctctacaggcttcagaataaatgaaaatctttcaggaattcctctacttcagctaagctagagcctcctgttattaatataatttctt

SEQ ID NO: 155986 - DNA, 601 bp, Human
aaaacttgagtttttaaaaaatctacaaaattaaaattaacactgaaggagcagcataagacctcattattgccacaccactactttaagaacaaaaccagacatactcaagacctttttcatcaaagactagggggttccaaatttactaaaacctaatagatgccaaagttaaaatagtttaaattcaagattgcatgcatttttgctatttctacctcctgcttttgagagtaaaagctatttatatgtacgtgatatttaaatctctggaaaagctccagagaaacattgaaacaaygaataaaggctttggtgttttaattactgttactgtatatattccaaaataaaacaaacatttctatcaagaatttcttcatctatagtaaataaactatgtacttgcttgtgcccatgtccaaattaccaagttcttccagttctccttccaaaatatatttcaaaaccttccactgttaccatccaagcccaaggtcccattatttctagtccgatttcctttattttcctccaacaaattttccacatcatagccacagagctttttaaaaatacaacctagatgtcattaattctt

SEQ ID NO: 155987 - DNA, 601 bp, Human
tatagtagggtgaaatatagcattttttgtttttacaaaacttgagtttttaaaaaatctacaaaattaaaattaacactgaaggagcagcataagacctcattattgccacaccactactttaagaacaaaaccagacatactcaagacctttttcatcaaagactagggggttccaaatttactaaaacctaatagatgccaaagttaaaatagtttaaattcaagattgcatgcatttttgctatttctacctcctgcttttgagagtaaaagctatttatatgtacgtgatatttamatctctggaaaagctccagagaaacattgaaacaatgaataaaggctttggtgttttaattactgttactgtatatattccaaaataaaacaaacatttctatcaagaatttcttcatctatagtaaataaactatgtacttgcttgtgcccatgtccaaattaccaagttcttccagttctccttccaaaatatatttcaaaaccttccactgttaccatccaagcccaaggtcccattatttctagtccgatttcctttattttcctccaacaaattttccacatcatagccacagag

SEQ ID NO: 155988 - DNA, 601 bp, Human
tcacatttcaatatgagatttgggggagtcaagcaaaccaaactagagcacccctgaattctattcccaaaagccataggggtctgtagacatcaggataagaaccttgctctaggattagtctcagggtacacccaagggggaagaggatcaaaattaactacaccttcactatcacagaagcagaaggaaaaaaagagacaacaaagaaaaacaaaacaaaatgatttttttccaaattcctttaactaaaggcaatctttttcaccttataactagaaaatagtctgaaaaatgcaartatttatgagttttggtgtatcagtatgaataagctttaataacaggacaatgttactttctaacattgatgagaaattcaaaagcaggaaagcatagaagcctccaaatcagtgcaaagatctgatgcggtggggaagggagggtgctggagtgagtagtctggaaataaagaaaacaaaataatgaaggctagatttatggagtcctgtttatcttttttctcttccctaaaaagtaaaagctatgtttcaaagttctttatgttctcttcaaggtccctgaaagcagcttagcaaga

SEQ ID NO: 155989 - DNA, 601 bp, Human
tcaaggaaactaacacagtgagaactcagtcattaccctgaggatgccaccaagccattcatgagggatctgcccccaggacccaaatgcctcccactaggccctacctccaacgctgagaatcacatttcaatatgagatttgggggagtcaagcaaaccaaactagagcacccctgaattctattcccaaaagccataggggtctgtagacatcaggataagaaccttgctctaggattagtctcagggtacacccaagggggaagaggatcaaaattaactacaccttcactatcacrgaagcagaaggaaaaaaagagacaacaaagaaaaacaaaacaaaatgatttttttccaaattcctttaactaaaggcaatctttttcaccttataactagaaaatagtctgaaaaatgcaagtatttatgagttttggtgtatcagtatgaataagctttaataacaggacaatgttactttctaacattgatgagaaattcaaaagcaggaaagcatagaagcctccaaatcagtgcaaagatctgatgcggtggggaagggagggtgctggagtgagtagtctggaaataaagaaaac

SEQ ID NO: 155990 - DNA, 601 bp, Human
agaggaagaagggaacgatgccaggctctttttaacagacagttctcaaggaaactaacacagtgagaactcagtcattaccctgaggatgccaccaagccattcatgagggatctgcccccaggacccaaatgcctcccactaggccctacctccaacgctgagaatcacatttcaatatgagatttgggggagtcaagcaaaccaaactagagcacccctgaattctattcccaaaagccataggggtctgtagacatcaggataagaaccttgctctaggattagtctcagggtacayccaagggggaagaggatcaaaattaactacaccttcactatcacagaagcagaaggaaaaaaagagacaacaaagaaaaacaaaacaaaatgatttttttccaaattcctttaactaaaggcaatctttttcaccttataactagaaaatagtctgaaaaatgcaagtatttatgagttttggtgtatcagtatgaataagctttaataacaggacaatgttactttctaacattgatgagaaattcaaaagcaggaaagcatagaagcctccaaatcagtgcaaagatctgatgcggtg

SEQ ID NO: 155991 - DNA, 601 bp, Human
actactatattaacacatagctataacagtgattagttgtttatatttatggaattctaatattcagtcagatattagtgaaaataaacacgattctttttttctcatccaagttcacagaccccttgtcttagtccgtttgcattgctataaagaaacatctgaggataggtaatttataaggaaaagaggtttatttggctcatggttctgcaggctataccagaagcatggtaccagcatctgcttctgatgagggcctcaggctgtttctactcatggtggaaggtgaaggggaagyggcatgcagagatcacagggtaagggtggaagcaagaggaagaagggaacgatgccaggctctttttaacagacagttctcaaggaaactaacacagtgagaactcagtcattaccctgaggatgccaccaagccattcatgagggatctgcccccaggacccaaatgcctcccactaggccctacctccaacgctgagaatcacatttcaatatgagatttgggggagtcaagcaaaccaaactagagcacccctgaattctattcccaaaagccataggggtctgtagacatcaggat

SEQ ID NO: 155992 - DNA, 601 bp, Human
cagctttggcacttgctgttcctccagcctggattgctaggtgactgtcaccctcatctccttcaagtctgtatccaatgttaacttttaaatgcagccttctctgtccattctacttaaaaactataaatccctcccttttctggaaaaccctatttccctcccctgctttattttcccctacacacttaccatcatattatatattttacttatttattccgctcctgatctgtttccccccaactagaacgtcctctgtgaagatagattttattgtttgttcttttgccactgtatytctactgtatctagaatagtacttagtatgtagtaagtccccagaaaatatttgatgaattaactaattaattaattcaaatatctatatggaagttggagctgatgttgagagactgaaaaagaatggatggctacaagtcttacaaggaggaatacctcagaggcctggaacacggagggtagggaggattaatactaggacaaggaataaaaaggaagaagctgtcttgggttaatgcttggtcttcaactccagggattcttatttgacctttgtgtatcttcctttaggactagg

SEQ ID NO: 155993 - DNA, 601 bp, Human
tatactaagcatactccagctttggcacttgctgttcctccagcctggattgctaggtgactgtcaccctcatctccttcaagtctgtatccaatgttaacttttaaatgcagccttctctgtccattctacttaaaaactataaatccctcccttttctggaaaaccctatttccctcccctgctttattttcccctacacacttaccatcatattatatattttacttatttattccgctcctgatctgtttccccccaactagaacgtcctctgtgaagatagattttattgtttgtycttttgccactgtatttctactgtatctagaatagtacttagtatgtagtaagtccccagaaaatatttgatgaattaactaattaattaattcaaatatctatatggaagttggagctgatgttgagagactgaaaaagaatggatggctacaagtcttacaaggaggaatacctcagaggcctggaacacggagggtagggaggattaatactaggacaaggaataaaaaggaagaagctgtcttgggttaatgcttggtcttcaactccagggattcttatttgacctttgtgtatc

SEQ ID NO: 155994 - DNA, 601 bp, Human
tttcagcagctttccacgctctatgtgatcttctttcccatcctgtatctctttgacctcacctcacacattcactccactctggccacactgtcctcctgacttcttccaatatactaagcatactccagctttggcacttgctgttcctccagcctggattgctaggtgactgtcaccctcatctccttcaagtctgtatccaatgttaacttttaaatgcagccttctctgtccattctacttaaaaactataaatccctcccttttctggaaaaccctatttccctcccctgctttrttttcccctacacacttaccatcatattatatattttacttatttattccgctcctgatctgtttccccccaactagaacgtcctctgtgaagatagattttattgtttgttcttttgccactgtatttctactgtatctagaatagtacttagtatgtagtaagtccccagaaaatatttgatgaattaactaattaattaattcaaatatctatatggaagttggagctgatgttgagagactgaaaaagaatggatggctacaagtcttacaaggaggaatacctcagaggcctgga

SEQ ID NO: 155995 - DNA, 601 bp, Human
attcattattcattcttcctgcttctgctccggccccactttgtctattcaccacatggaagccagcattattgtgttaaaacatgttaggttatgttggtcctctgctcaaactctgcaatggtccccttcttactcagagtaaaagctaaagtattttcagcagctttccacgctctatgtgatcttctttcccatcctgtatctctttgacctcacctcacacattcactccactctggccacactgtcctcctgacttcttccaatatactaagcatactccagctttggcacttgytgttcctccagcctggattgctaggtgactgtcaccctcatctccttcaagtctgtatccaatgttaacttttaaatgcagccttctctgtccattctacttaaaaactataaatccctcccttttctggaaaaccctatttccctcccctgctttattttcccctacacacttaccatcatattatatattttacttatttattccgctcctgatctgtttccccccaactagaacgtcctctgtgaagatagattttattgtttgttcttttgccactgtatttctactgtatctaga

SEQ ID NO: 155996 - DNA, 601 bp, Human
tcacagcatgtatcctaggctctgagaaaagtaagaaaaatccatatttatggaatattctaagaagtttgcccatattagctgatataatcctcacaaccggcttattctttttccgttttattggtgaagaaacagattatattttacagatgaagaatctcaggcggcctggctctagagcccactgcaaagcaccacatgtcaagtactggcattcattattcattcttcctgcttctgctccggccccactttgtctattcaccacatggaagccagcattattgtgttaaaacaygttaggttatgttggtcctctgctcaaactctgcaatggtccccttcttactcagagtaaaagctaaagtattttcagcagctttccacgctctatgtgatcttctttcccatcctgtatctctttgacctcacctcacacattcactccactctggccacactgtcctcctgacttcttccaatatactaagcatactccagctttggcacttgctgttcctccagcctggattgctaggtgactgtcaccctcatctccttcaagtctgtatccaatgttaacttttaaatgcagcct

SEQ ID NO: 155997 - DNA, 601 bp, Human
tctcaatgcctatgtgacataatctctcattttaaaagtacagattcccatttcagattatagaaattctaagtattccacagggttcaccttctttcagatgtcgcactctctcggaaaccttacgcacttactccagagatgtaagcactttccttgaaaatcttattcacaacctgtatctctcttaaagcatttatcttactgtcagatttattttgccattgtctgtaaacttatcttttcttacaacagtttgcaagcaaaatctagtaatgccttgactaccactacatttcartaaataattattgactcaattttattcaattttgaactcttatcaaagctctcaaatttgctatctgtgttctttgggcaagcttagtatctttacagatggtgtaattccattggaagtttcttttctttcttgaaggtcataaaacaaggatggcccaacatctcatactgaaaacagttttccatctaattttttgatcaactataagattattctataagaccaaagcaggaagcctataaatatatatttactattgtcacactaataattagtctagcaaaatagtatgcttat

SEQ ID NO: 155998 - DNA, 601 bp, Human
ctcaaatgcctcagtactggctgcctctcctcctaaactttcactcaatccatactagatattgtcacataactcttactttgatcacatgacagtgctactttgtcagtaaccttcaatggtttttcatgtttattaagtaacaaaattcccagccttggactcattatgatgctaatatctctctagctttattgtctactattatactatatccaatgcttcaaactaaattactcagccttgcaatctcaatgcctatgtgacataatctctcattttaaaagtacagattcccatktcagattatagaaattctaagtattccacagggttcaccttctttcagatgtcgcactctctcggaaaccttacgcacttactccagagatgtaagcactttccttgaaaatcttattcacaacctgtatctctcttaaagcatttatcttactgtcagatttattttgccattgtctgtaaacttatcttttcttacaacagtttgcaagcaaaatctagtaatgccttgactaccactacatttcaataaataattattgactcaattttattcaattttgaactcttatcaaagctc

SEQ ID NO: 155999 - DNA, 601 bp, Human
cacttgagtctaggaggtagaggctgtagcaagctatgataatatcactgcactccagcctgggtgacagagcgagactgtctcaataaataaataaataaataaaacaaagattcagtaaattctgctacatagacagaaaggggcaagaccatgtaaagtgttgtctgaggagttttaactactcaggagacattggaagccacagaacagtgttaagcaggggcataatatgactagatttacattttaaaaagattactcaggcagcagtgtggttacagaattgcagtgaagtaaktctgaaggtatggagactaattaggaggttatggtataaaacagtcgggaagtgatgaaaatctcaattaaggtaggggaactggaaatggacagaaaggaatatttacgagatggtgagaaggtatcttgaaggacttgattgactataatgggttggggaaaggcaaaagcaaagacacacttcaaggtttctggcttagctgactgtggctggtaatgaatttatggagataagaaaagaagcacagaagcaagtttgcaaggaaggagaatgggatctgcttgcctgtaggattgt

SEQ ID NO: 156000 - DNA, 601 bp, Human
aagtttacataaattatctcacttattcttcacaataataattccatgaggtagatatcattattattacaattttacaaatgaagaaactaaagttttcaaaggataccacacttgccaagagcaaagctactgagtggtggaggtaggatttgaacttagatagataacagaacccagggtctttattattattattattattattattattattattattattatttttaaattgagatggagcctcactatgttgcccaagctggtctcaaactcctgggctcaagtgatcctccckcctcagcctcccaagtagctgagtctaaagtgtatttcaccatgcccaacagcacccagggtcttaaccactttgctatacttgttggttcctattgtctacaaaaataaaaatcatgtaccacatttcccagagctgcaactttcaaaactgcacattataactctaagccatataaaggtaaaaggaaaaggtataattcaccaaaagtactaaaagtttactcagccaaaattcagaattttagagttggaaggagaagcataaatcatttagtttgatgacaacttagtgcaaatg

SEQ ID NO: 156001 - DNA, 601 bp, Human
gtttaagagtgcagagtatcattaaatagtgataattataataacctctattacaagagtgacaataatgttagctaacacttattaagtattcactatgttctagaaagtttacataaattatctcacttattcttcacaataataattccatgaggtagatatcattattattacaattttacaaatgaagaaactaaagttttcaaaggataccacacttgccaagagcaaagctactgagtggtggaggtaggatttgaacttagatagataacagaacccagggtctttattattattattattattattattattattattattattatttttaaattgagatggagcctcactatgttgcccaagctggtctcaaactcctgggctcaagtgatcctcccgcctcagcctcccaagtagctgagtctaaagtgtatttcaccatgcccaacagcacccagggtcttaaccactttgctatacttgttggttcctattgtctacaaaaataaaaatcatgtaccacatttcccagagctgcaactttcaaaactgcacattataactctaagccatataaaggtaaaaggaaaag

SEQ ID NO: 156002 - DNA, 601 bp, Human
actgtttaagagtgcagagtatcattaaatagtgataattataataacctctattacaagagtgacaataatgttagctaacacttattaagtattcactatgttctagaaagtttacataaattatctcacttattcttcacaataataattccatgaggtagatatcattattattacaattttacaaatgaagaaactaaagttttcaaaggataccacacttgccaagagcaaagctactgagtggtggaggtaggatttgaacttagatagataacagaacccagggtctttattattattattattattattattattattattattattatttttaaattgagatggagcctcactatgttgcccaagctggtctcaaactcctgggctcaagtgatcctcccgcctcagcctcccaagtagctgagtctaaagtgtatttcaccatgcccaacagcacccagggtcttaaccactttgctatacttgttggttcctattgtctacaaaaataaaaatcatgtaccacatttcccagagctgcaactttcaaaactgcacattataactctaagccatataaaggtaaaaggaa

SEQ ID NO: 156003 - DNA, 601 bp, Human
catactgtttaagagtgcagagtatcattaaatagtgataattataataacctctattacaagagtgacaataatgttagctaacacttattaagtattcactatgttctagaaagtttacataaattatctcacttattcttcacaataataattccatgaggtagatatcattattattacaattttacaaatgaagaaactaaagttttcaaaggataccacacttgccaagagcaaagctactgagtggtggaggtaggatttgaacttagatagataacagaacccagggtctttwttattattattattattattattattattattattattatttttaaattgagatggagcctcactatgttgcccaagctggtctcaaactcctgggctcaagtgatcctcccgcctcagcctcccaagtagctgagtctaaagtgtatttcaccatgcccaacagcacccagggtcttaaccactttgctatacttgttggttcctattgtctacaaaaataaaaatcatgtaccacatttcccagagctgcaactttcaaaactgcacattataactctaagccatataaaggtaaaag

SEQ ID NO: 156004 - DNA, 601 bp, Human
actgaaaacatatattcccacaaaaacttgtacacagtgtttacagcagcatcagtcataatagccaaaagatagaaacaacccaaacgtctatcatttgatgaaagaataaacaaaatctggtatatccatacaatggattatgatttagccataaaaaggaataaagtactgaatgcatgatacaatgtggatgaaccttaaaaatattatgctacatgaaaaaggccagtcatgaaagaccacatattatatgatctcattcatatgaaatgtccagaacaggaaaatctatagagayagaaagtagattagtgattgcctagggctgagggtgaggtgggaagtaggcaaatgatagccaaaaggtatagggcttgtttttgaagtgatgaaaatattctaaaattgtggtgatggaaaccactgagctatatgtttttaaacaagtgaatcatattggtatgtgaattacacctcaataaagctgttaaaaatcacatgtatagaccttgctcaatttttacacaaagattttcttattttcctttttaaaaagacttctctgaaagaattaaattaccagacaggccacctaggt

SEQ ID NO: 156005 - DNA, 601 bp, Human
aaataaaaactatgcttttagattttatttagaaaaatttcaggtttatgaaatttatttatgaaatttctattcatattcatatttaagtgtgtaattctggatgattcatttctgatgtctagttagctctataatcatgactaaaaactgtgtattaattaaaaactactctgtgtgtgtgtgtgtattcttagatgtcaacattctctaggagaaaaataagacaaaacaagaaaatacctaaagatcaaatgtacacatggcacaaagatagacatatggattaatggaatagaaytgagagctcagaaataaatatatacatccactttcaactgattttcaacaaagttgccaaggccaaccaatgggggaaataataatcttttcaacaaataatgtttcaacagctggatagcaatgtgcaaaaaaatgaagttcaatccttacctcacaccatatacaaaaattcactcaaaatgaataaaaggcctaaaagcaagacctacaattttagaactcttagaagacaacataggagtaaaacctttatgatgctggctttgacaaaggattctcagatatgacaccaaaagta

SEQ ID NO: 156006 - DNA, 601 bp, Human
ggaaaaatataatacttgtcaaaataaaaactatgcttttagattttatttagaaaaatttcaggtttatgaaatttatttatgaaatttctattcatattcatatttaagtgtgtaattctggatgattcatttctgatgtctagttagctctataatcatgactaaaaactgtgtattaattaaaaactactctgtgtgtgtgtgtgtattcttagatgtcaacattctctaggagaaaaataagacaaaacaagaaaatacctaaagatcaaatgtacacatggcacaaagatagacatatggattaatggaatagaattgagagctcagaaataaatatatacatccactttcaactgattttcaacaaagttgccaaggccaaccaatgggggaaataataatcttttcaacaaataatgtttcaacagctggatagcaatgtgcaaaaaaatgaagttcaatccttacctcacaccatatacaaaaattcactcaaaatgaataaaaggcctaaaagcaagacctacaattttagaactcttagaagacaacataggagtaaaacctttatgatgctggctttgacaaaggattc

SEQ ID NO: 156007 - DNA, 601 bp, Human
ctttataaattgaaaaagatttttggaaaaatataatacttgtcaaaataaaaactatgcttttagattttatttagaaaaatttcaggtttatgaaatttatttatgaaatttctattcatattcatatttaagtgtgtaattctggatgattcatttctgatgtctagttagctctataatcatgactaaaaactgtgtattaattaaaaactactctgtgtgtgtgtgtgtattcttagatgtcaacattctctaggagaaaaataagacaaaacaagaaaatacctaaagatcaaaygtacacatggcacaaagatagacatatggattaatggaatagaattgagagctcagaaataaatatatacatccactttcaactgattttcaacaaagttgccaaggccaaccaatgggggaaataataatcttttcaacaaataatgtttcaacagctggatagcaatgtgcaaaaaaatgaagttcaatccttacctcacaccatatacaaaaattcactcaaaatgaataaaaggcctaaaagcaagacctacaattttagaactcttagaagacaacataggagtaaaacctttat

SEQ ID NO: 156008 - DNA, 601 bp, Human
agataaaatggagttacaataatataagtaaataagagtacctatatttcaccatattagccttaggaccaaaatgaaatgttctatatttaactgctttataaattgaaaaagatttttggaaaaatataatacttgtcaaaataaaaactatgcttttagattttatttagaaaaatttcaggtttatgaaatttatttatgaaatttctattcatattcatatttaagtgtgtaattctggatgattcatttctgatgtctagttagctctataatcatgactaaaaactgtgtattrattaaaaactactctgtgtgtgtgtgtgtattcttagatgtcaacattctctaggagaaaaataagacaaaacaagaaaatacctaaagatcaaatgtacacatggcacaaagatagacatatggattaatggaatagaattgagagctcagaaataaatatatacatccactttcaactgattttcaacaaagttgccaaggccaaccaatgggggaaataataatcttttcaacaaataatgtttcaacagctggatagcaatgtgcaaaaaaatgaagttcaatccttacctcacac

SEQ ID NO: 156009 - DNA, 601 bp, Human
attgagtgttaggctgttacaactataaatgtgggtgggaaaaggtaggctttgatctctttgagaatgagatattcaagcacaaatactactaagcacaaataactgaggtaactaagtaccaatttggatttctgcgaataaattgtggatgatatatggatggtgtttcattgttgttactgttatccaaaggcataagaaagctaaatttgctggaagaatcttatcttgaaatattcttacaactatattctattcttcatgctattcttaacttctctttggcctatcacagaayagtatttgtttaaagcgcaaccatttcttttgaccatgtagcagcagcactcattaatgccatgttcaaggttatcaatcttcagacaggcttccttctcaaagcactccccatctctcatattgcttccttattctcacagtacttattttactcatttgttgtctgtctttctattagaacaaaaactttgtgagaaaagggatttttttgtgccattactgcagtatccgcatgcttggcattgtctgacacataaaaagcacttgatacatggttgaataaataaaagcggtaagt

SEQ ID NO: 156010 - DNA, 601 bp, Human
tttactaacactcattctctcaaaaatatatactgagttcttactatgtaccagacacttttctgaatatatcagtgaaaaaccaaaaatcctttccttccaagagcttgcatgctagtgaaaggaaacaaaaaataagtgtgttcaatagtaaatggtatagtatgtttaaagctaatacttacttgttacagaagaaagtaaaaccaaatatagtaggataagtaattgagtgttaggctgttacaactataaatgtgggtgggaaaaggtaggctttgatctctttgagaatgagatwttcaagcacaaatactactaagcacaaataactgaggtaactaagtaccaatttggatttctgcgaataaattgtggatgatatatggatggtgtttcattgttgttactgttatccaaaggcataagaaagctaaatttgctggaagaatcttatcttgaaatattcttacaactatattctattcttcatgctattcttaacttctctttggcctatcacagaacagtatttgtttaaagcgcaaccatttcttttgaccatgtagcagcagcactcattaatgccatgttcaaggtt

SEQ ID NO: 156011 - DNA, 601 bp, Human
taggattgtttcactgggatataaataaaacgccttagtaactacatcctgagaacaccatggctcagtactattcatgccaacttaactgaactgaaacatggcactggtgtcagtggcttttacttattgatggatttgtaaggtggcaggctctttcatgtccaaaagcggtagtttcccagggtctcaagaagatttaaaaatattttccttccatcacaacacaaagcctactgactttaagtaatgctgctgagggttaacatttgaaactgacaagcagcacatgtgtattacrgagataaggcctggcacatgttgctgcagcctcctgagattttgaaatgctagcagctccagctggtggctatgctccattcctaatgtgcactttttagggaaacttgagcccctccttctgactgtgatagggacatgtctgattggaatagggttatttttaaagatattcagaacaacgaacatatttattctaagaataaaaagagagtggaaagaaataaaagaggtaaaatgttaagctgagatcttaaagaaaacagtatcacttgttaaaaaaaaagaaaaatagtgaatg

SEQ ID NO: 156012 - DNA, 601 bp, Human
attttgggagctgaggcaggaggatcacttaaggccaggagtttgagaccagcctgggcaatacagtgagaccccatctccacaaataataataataataaagatcatgcttgtacatacttactatatggagctaatggttattgttttgctacagtgtcactaaacaaaaatcaacatacaaaggtgaaagggtggcacatgtctgctgattacatttaagggcccccaaagtctctctttttgtccttgcaagtggtaggattgtttcactgggatataaataaaacgccttagtaaytacatcctgagaacaccatggctcagtactattcatgccaacttaactgaactgaaacatggcactggtgtcagtggcttttacttattgatggatttgtaaggtggcaggctctttcatgtccaaaagcggtagtttcccagggtctcaagaagatttaaaaatattttccttccatcacaacacaaagcctactgactttaagtaatgctgctgagggttaacatttgaaactgacaagcagcacatgtgtattacagagataaggcctggcacatgttgctgcagcctcctgagatt

SEQ ID NO: 156013 - DNA, 601 bp, Human
ctgaggggtcctggaaccaatctccctcaaataccgaggagtactttacttggaaaataagaaaaaagggagtatggtaatactcaaccctcctttgcataagtttactctgtaacagttctgtaaattttatatacctagagctcttggtatggttattgtgtggagaaaaactatttggtctgaacaacttagttatggtaacttgaaaacagtatgcatgatgtacaaatatacagccttctgtgaataaggccaggctgttttccccaaactgtgtgtatttcattttttaaacaartatattaaatttaggatttatttagaatgcaggaaaactcctttttgaagcactcctgaaaggaattcttttggaaaatatagaattattttataatatgaatagtcaattcctgaaatatatataccgtgagttaatattttcattatatttcaattaagtgcttttaaaaagatcatgcttggccaggtgcagtagttcatacctgtaatcccaacattttgggagctgaggcaggaggatcacttaaggccaggagtttgagaccagcctgggcaatacagtgagaccccatctcca

SEQ ID NO: 156014 - DNA, 601 bp, Human
gcagctggagacatcttaaaggaaagacagtatagctggccctctgtatccgcagattctgtatccgtgaacacaaacaatctgggatcaaaaaatattttgaaaaaaaattgcacctatacagaacatatacaaactttttttcttattattccctgaacaatatagtataacaaaatttacatagcatttacattgtattaggtataagtaaactagagatgataaaggaagatgtgcatagatcatatgcaattactacactattttatatcagggacttgagcatctcagattttgrtatctgaggggtcctggaaccaatctccctcaaataccgaggagtactttacttggaaaataagaaaaaagggagtatggtaatactcaaccctcctttgcataagtttactctgtaacagttctgtaaattttatatacctagagctcttggtatggttattgtgtggagaaaaactatttggtctgaacaacttagttatggtaacttgaaaacagtatgcatgatgtacaaatatacagccttctgtgaataaggccaggctgttttccccaaactgtgtgtatttcattttttaaa

SEQ ID NO: 156015 - DNA, 601 bp, Human
tggagataccaaaaaggtgtaaagagacttctctagttagttcctagactaggaagtaaatatacataaaagataaactatacaagaagcatatgacaactgccaggtgagaggtgtagacaattaacggcataggagtttgaaggaaggcaaaggtcactcaagattggggcagctggagacatcttaaaggaaagacagtatagctggccctctgtatccgcagattctgtatccgtgaacacaaacaatctgggatcaaaaaatattttgaaaaaaaattgcacctatacagaacatrtacaaactttttttcttattattccctgaacaatatagtataacaaaatttacatagcatttacattgtattaggtataagtaaactagagatgataaaggaagatgtgcatagatcatatgcaattactacactattttatatcagggacttgagcatctcagattttgatatctgaggggtcctggaaccaatctccctcaaataccgaggagtactttacttggaaaataagaaaaaagggagtatggtaatactcaaccctcctttgcataagtttactctgtaacagttctgtaa

SEQ ID NO: 156016 - DNA, 601 bp, Human
tcacaattttcaattcaacaagatccccaggtgttttctatgcacagtacatggatgtttgagaagcactgttttaagagcatttttcaagtattggagataccaaaaaggtgtaaagagacttctctagttagttcctagactaggaagtaaatatacataaaagataaactatacaagaagcatatgacaactgccaggtgagaggtgtagacaattaacggcataggagtttgaaggaaggcaaaggtcactcaagattggggcagctggagacatcttaaaggaaagacagtatagytggccctctgtatccgcagattctgtatccgtgaacacaaacaatctgggatcaaaaaatattttgaaaaaaaattgcacctatacagaacatatacaaactttttttcttattattccctgaacaatatagtataacaaaatttacatagcatttacattgtattaggtataagtaaactagagatgataaaggaagatgtgcatagatcatatgcaattactacactattttatatcagggacttgagcatctcagattttgatatctgaggggtcctggaaccaatctccctcaaat

SEQ ID NO: 156017 - DNA, 601 bp, Human
tatactgaggatatgcgtaattcttgaccctgaaatgtgatacctatagaatctaagagtttactgggaaaaccatctgctcctcaaagctaggtgtcccaaataagagaaaagttagaaaaagtttgtattatttacgtgactagaaatgtgttataaagacttttgcttttcagcctgaatctagtgaagacagaagtagaagttattcacgtataatctcatccagtctggtattaatgaaaatggataagctaaagtccattcctattgatcagatggagaaatcagaaaaaaagayatctaacatcttcaatcattcagcgtattttttcaatcaatatctcagttcagtcttagtgctatttgcatattacataaaaatgcagcacttaacaaatttaaatctcttatcctttttctgaaaaaaaaaatggcatcatcaataaacatttgctgaaggtttgacagacactggtcactcagaatgtggtctgtggtccagctgcatcacatcacatgggagtctgtcataaatgtagaatctcaggccccaccccagaccagctgaatcacaattttcaattcaacaagatcccca

SEQ ID NO: 156018 - DNA, 601 bp, Human
gttcattgcaatgcctactgtttatgaactcctcaggttaattcgtgttccaaatattaagtagctcttttgtatattaatgtacgtcaggagccaacaaaagttttgctattgagagaaaataattttcaaaagaaactatgaaataatataagtcaaagttctattaaactacttctgtcgttttagaaagggcaagatgaaacaaattataaatgaacatcttttatcctctgacctagcaattttacctctagaaattagttccaaggtaaaaacttgtacaaacatttatgtatamgtctggtctctgcaacatcctcttatataaaaattagaaaaaaatcaacagtaggggaatggttagttaatccatatgctggaacactatgcagctgttaacaaccatgttatggaaatatatttaatgatattagagaagaccacaatatattttttaatttaaaaaggatgttacaaagtagtaatgattatataatcttaattttatttttataatatatatataaaaagacaatggtttgaggtcaggtcaaaatgtttattttacagtgtttatttctgagaagtaggcaaacaa

SEQ ID NO: 156019 - DNA, 601 bp, Human
ggatttcatggcatgcattttattgtttagagcctcatttgctctctgtcttgatttcctcattcactttattttattatattgcataaattttataaatggccttacatttttactaaaaaaggaagtttaaaataaataaatgaacacaacaatgacaatgttgtaaacttttacaaaaatgtagagttaacttatacatattaacaggtattttaactattatagtgttaggtaactacagatactttttgttacatgcactcttaaaacaatgaatgtttaataatcacaaaatcaytattttcgcacaatttcaatttgctatttaaacttataaaatacttgtaaaaatttttgctttattcaataaactgtatcaatgcaagtcctactttaaaatcagtgctgtgggctcatgtaattcatttattttaaaaatataatcatttttctattgaattcagctttcgcaacaggataaagagcaagttttgaaacacaacaaattagcatactatcaagatttgttagccctggtactccttagactaatatagatagaaagagttaaccagtttttcttttcttatattatttc

SEQ ID NO: 156020 - DNA, 601 bp, Human
tgaaaactcttttctttaagaatgttgaatattggcccctactctcttctggcttgtagggtttctgcagagagatctgctgttagtttgacaggcttccctttgttggtaacccgacctttctctctggctgcccttaaggtatattttgtacgaagttcatcttggagagtacatcagaaaataacagcttcaaagacaaatgtctataagtattttattgatggtttttgttttgctttgtttgaatgtgtgggtgttttatttcatggcatagggcaagcaactgatcacacctgcttattttataaatttcaggctaaagctgtacaatcatgatctatactacagagctttggaaacttgattgttcaatcacgtctatgcaacaaattattgggaatgagttcaggtcctgcctgggtactccctcattaggggtatccatccattcaattgaatgtccatgctattctgaatctccacaaagagcacacctggcttggctaagaggtgaagcacactgctctgcacttgcatgtggacatacaataaccacattccagctatttttcagaaagtttaactctgaacctattgt

SEQ ID NO: 156021 - DNA, 601 bp, Human
ttagttgatgcagctttttcatagtgtcagtggtctttaaaatttggtatgtttttgcagtggctggtactggtttttcctttccatatttagtgctttcttcaggagctcttgtaaggtaggcctggtggtgacaaaatctctcagcatttgcttgtctgaaaaggattttatttctccttcgcttatgaagcttagtttggctggatatgaaatcctgggttgaaaactcttttctttaagaatgttgaatattggcccctactctcttctggcttgtagggtttctgcagagagatcygctgttagtttgacaggcttccctttgttggtaacccgacctttctctctggctgcccttaaggtatattttgtacgaagttcatcttggagagtacatcagaaaataacagcttcaaagacaaatgtctataagtattttattgatggtttttgttttgctttgtttgaatgtgtgggtgttttatttcatggcatagggcaagcaactgatcacacctgcttattttataaatttcaggctaaagctgtacaatcatgatctatactacagagctttggaaacttgattgttcaatca

SEQ ID NO: 156022 - DNA, 601 bp, Human
gcgatgtgggtgctgagaagaatgatttcgggtggagagttctgtagatgtctattgggtctgcttggtccagagttgagttcaagtcctgaatatccttgttaattttctgtctcgttgatctgtctaatattgagagtagagtgttaaagtctcccactattattgtgtgggagtctaagtctctttgtaggtctctaagaacttgctttatgaatcttggtgctcctgtattgggtgcatatatatttaggatagttagctcttcttgctgcactgatctctttatcattatgtaatrcccttctttgtcttttttgatctttgttggtttaaagtctgttttatcagagactaggattgcgaaccctgcttttttatttttttctttccatttgcttagtaaatattcctccatccctttattttgagactatgtgtgtctttgcatgtgagatgggtctcctgaatacagcacactgatgggtcttgactctttatccaatttgccagtctatgtcttttaattggggcatttagcccatttacatttaaggttaatattgttatgtgtgaatttgatcctgtcattagctagctg

SEQ ID NO: 156023 - DNA, 601 bp, Human
ttgagtgagtttcttaatcctgagttctaatttgatggcactgtggtctgagagactgttatgattttcgttcttctgcatttgctgaggagtgttttatgtataattatgtggtcaattttagaataagtgcgatgtgggtgctgagaagaatgatttcgggtggagagttctgtagatgtctattgggtctgcttggtccagagttgagttcaagtcctgaatatccttgttaattttctgtctcgttgatctgtctaatattgagagtagagtgttaaagtctcccactattattgtrtgggagtctaagtctctttgtaggtctctaagaacttgctttatgaatcttggtgctcctgtattgggtgcatatatatttaggatagttagctcttcttgctgcactgatctctttatcattatgtaatgcccttctttgtcttttttgatctttgttggtttaaagtctgttttatcagagactaggattgcgaaccctgcttttttatttttttctttccatttgcttagtaaatattcctccatccctttattttgagactatgtgtgtctttgcatgtgagatgggtctcctgaa

SEQ ID NO: 156024 - DNA, 601 bp, Human
atgtgggcatttagtgctatcaatttccctctaaacactgttttagctgtgttgaagagattttggtatgctgtgtctttgttctcattggtttcaaagaacttatttatcttatttatttctgccttaattttgttatttacccagtagtcattcaggagcaggttgttcagtttccatgtagttgtgcagttttgagtgagtttcttaatcctgagttctaatttgatggcactgtggtctgagagactgttatgattttcgttcttctgcatttgctgaggagtgttttatgtataaytatgtggtcaattttagaataagtgcgatgtgggtgctgagaagaatgatttcgggtggagagttctgtagatgtctattgggtctgcttggtccagagttgagttcaagtcctgaatatccttgttaattttctgtctcgttgatctgtctaatattgagagtagagtgttaaagtctcccactattattgtgtgggagtctaagtctctttgtaggtctctaagaacttgctttatgaatcttggtgctcctgtattgggtgcatatatatttaggatagttagctcttcttgctgca

SEQ ID NO: 156025 - DNA, 601 bp, Human
gcaccacggacaggattgcaggctctagacactattttgcaacttatttggacaggcttcataggaacacacaggctaaggatttgaatgctctattgctctgaggggtttgactatgtacaatatatttcatacttaagattcatttaaaaacctaaatttcagaacttgttattggtctattcagggattcaacttctttctggtttagtcttgggagggtgtatgtgtccaggaatttatccatttcctctagattttctagtttatttgagtagagatgtttacagtattctctgayggtagtttgtatttctgtgggattagtaggtgatatcccctttatcattttttattgtgtctatttgaatcttctttttttctttattagtctggctagcagtctattttgttaatctttccaaaaaccagctcctggattcactgattttttgaagggtttttcgtgtctctatctctttcagttctgctctgatcttagttatttcttgtcttctgctagcttttgtttgctcttgcttctctggtttttttaattgtgatgttagggtgtcaattttagatctttccagctttctga

SEQ ID NO: 156026 - DNA, 601 bp, Human
tgcaaaatgggtaaagatgaactctaggcaatacaggaagaccaaccagaatttacattggggaattgtaataaaattagagtatttctactgcaaaagggaagagatgtggctgcttctctaattgttgcttttaaatggtacttcattaggttgagaattgaaacctgagactcacacaaataacaaaatagcaccacggacaggattgcaggctctagacactattttgcaacttatttggacaggcttcataggaacacacaggctaaggatttgaatgctctattgctctgagggrtttgactatgtacaatatatttcatacttaagattcatttaaaaacctaaatttcagaacttgttattggtctattcagggattcaacttctttctggtttagtcttgggagggtgtatgtgtccaggaatttatccatttcctctagattttctagtttatttgagtagagatgtttacagtattctctgatggtagtttgtatttctgtgggattagtaggtgatatcccctttatcattttttattgtgtctatttgaatcttctttttttctttattagtctggctagcagtctat

SEQ ID NO: 156027 - DNA, 601 bp, Human
cattggactgaatcttctctaggcctttcaatcttctgagcattcaaaaactatacaccagtatttataaaatacacatatttttaaaaatatataagtagaaatgcaccaaacagattgaattgcaaaatgggtaaagatgaactctaggcaatacaggaagaccaaccagaatttacattggggaattgtaataaaattagagtatttctactgcaaaagggaagagatgtggctgcttctctaattgttgcttttaaatggtacttcattaggttgagaattgaaacctgagactcasacaaataacaaaatagcaccacggacaggattgcaggctctagacactattttgcaacttatttggacaggcttcataggaacacacaggctaaggatttgaatgctctattgctctgaggggtttgactatgtacaatatatttcatacttaagattcatttaaaaacctaaatttcagaacttgttattggtctattcagggattcaacttctttctggtttagtcttgggagggtgtatgtgtccaggaatttatccatttcctctagattttctagtttatttgagtagagatgtt

SEQ ID NO: 156028 - DNA, 601 bp, Human
ggaactctagggtacccatgcaacgtttcacaggatcctcttggttctgtgaacttctttccattctgaactaaagctactactttagttcagcaaaatgcaattgagagtcagcatgatacaatttcttcctgactcaaacacctctgatgggcctccactgtttgtaagtccaacaattaataagtccaaaataagacacgacaattcaaggaactttttcatcttgcttgagctactctttcagcctcatcattccttcatacacttctacatgatttatgctttagaaaatatttaraagtgaaaaaggcagatgaaatttgacccaggataaaaaagagaacatacatatttgtcataacagtaaacctctttacaaaacttccattgagtcctgtgtattttctctgtgatactcaaaatccctgtcaaacagaatggggtgaagcttattaatactttcacatcttgccattatgtgtttatgctgtgctttcccttagcttgtttttcctcttcttttctggtcaatgaaactctaagactctagaaaaattgtcacttccatgaagcatttctcaatccatagctagagtta

SEQ ID NO: 156029 - DNA, 601 bp, Human
atgtgctagtaactgtttaacagttttcaaaaaacaacaataaaaaacagatttgtattgtttgctcattttcatggtgtaaatattcctaccaaggcagagcatagaattggaaagtgatactaacaattagatcttgcaagctggtgcaagctgacttcaacacaacactctaaaagcactcacagtgtaacaagagctctactagagatatatgcaaagtgctataaggggagcacaaaagagggaactctagggtacccatgcaacgtttcacaggatcctcttggttctgtgaacytctttccattctgaactaaagctactactttagttcagcaaaatgcaattgagagtcagcatgatacaatttcttcctgactcaaacacctctgatgggcctccactgtttgtaagtccaacaattaataagtccaaaataagacacgacaattcaaggaactttttcatcttgcttgagctactctttcagcctcatcattccttcatacacttctacatgatttatgctttagaaaatatttagaagtgaaaaaggcagatgaaatttgacccaggataaaaaagagaacatacatat

SEQ ID NO: 156030 - DNA, 601 bp, Human
tataaaaatgcaattttctcttgtactattgaaatgaagcaatcttttaaaaaaataaataactttgaacttcaactagtctgtatagttaagtattttagaaagtcacaggaaaagtaatttcaaaactgtcatttgatagtaactggagtgaatgctgggcatctctaatcctggtcttttgacagtacctcaaacacaacatgtcccaaatcaaaacaattatcttcccctatgatccctccctctgcctctccctctcaactcagtttttcttcttcagtttctagtagtatcactrttaccaaatgttcaggctacataatatagggctatttccaaccatttcatccattcccaaaatcaattggtcattacctaatttgttgatctcatttgttaatctgtccctctacatattcaataaatatttattgatacctataatttgtgaggtactgggctagaaataaggaaataaaaataagatggtatttttattctaaatggtcacagtcttataagaagtcagacatgttaataaacagtcggtgatgtgctagtaactgtttaacagttttcaaaaaacaacaataaaaaa

SEQ ID NO: 156031 - DNA, 601 bp, Human
actttaactttatcctcccccaaaattcatttttctcttcctaatagaattgtaaactgtgactatgatcttgaaacacacttacattgtttttaaaaaaaaaaacaaaattccatttcctcagtcattctcttctaggctatctgatctctgcttttccctgcaaacgtagtgttcagaatgtattataaaaatgcaattttctcttgtactattgaaatgaagcaatcttttaaaaaaataaataactttgaacttcaactagtctgtatagttaagtattttagaaagtcacaggaaragtaatttcaaaactgtcatttgatagtaactggagtgaatgctgggcatctctaatcctggtcttttgacagtacctcaaacacaacatgtcccaaatcaaaacaattatcttcccctatgatccctccctctgcctctccctctcaactcagtttttcttcttcagtttctagtagtatcactattaccaaatgttcaggctacataatatagggctatttccaaccatttcatccattcccaaaatcaattggtcattacctaatttgttgatctcatttgttaatctgtccctcta

SEQ ID NO: 156032 - DNA, 601 bp, Human
aggcgcctgtagtcccagctacttgggaggctgaggcaggagaatggcgtgaacccgggaggtagaacttgcagtgagccgagatcacgccactgtgctccagcctaggcgacagagcgagactccatctcagaaaaaaagaaaaaaaaaagaaaagccctatgtgtacagattatactgtattatcctattaatgagaacatttactaaatcagaatatgccatttcttaggtaatgtaaagttattgccttctgaaagtatattgtttttacttccctaatactttattgtaaaaagatttttttttctcatggtcacattataatagcttttttgaaaagaaaaactttttattaggagttatattctaaaaggtaactttaactttatcctcccccaaaattcatttttctcttcctaatagaattgtaaactgtgactatgatcttgaaacacacttacattgtttttaaaaaaaaaaacaaaattccatttcctcagtcattctcttctaggctatctgatctctgcttttccctgcaaacgtagtgttcagaatgtattataaaaatgcaattttctcttgtactattgaaatg

SEQ ID NO: 156033 - DNA, 601 bp, Human
gtgaccttcctgcctcagcttccagagtagctcggactacaggtgcatgccaccacaactagctaatttaaaaaaaaaaaaaaaaaaaacaactctgtagagataaagtcttgctgtattaaccaggctagtcttgaagtcctggcctcagagatctcctgccttggcctcccaaagtgctgggattacaggcatgagctataatgtgcctggcccccacagggctcttatactcagcttgcacaaaactaacctcattgtcttcctcccaaaactccccctcttcctaaattccctctcktcataaatggcaccactcttacaccaagttacctaggccaacagcttgggagtcatcctaagactcctctctctcccttttgggccccccatctaatttgttaccaagtcacacagattctatttctttagcatagcattctttccttactttccaagtctactcctactatcacagttcaccttcacatcttgtttaggttttagtggtctgctaacaggctgcattacctctaccattaaaaatgtactgtttgtttacccttctgtcttaactccttaaaaacaaggactacaacct

SEQ ID NO: 156034 - DNA, 601 bp, Human
gggcagtcaatctaaccatatttctcatgctgccatcctaggctataatcctatctatctatctatctatctatctatctatctatctatctatcatctatctacctacctatctataatttatcatgtctgttgcccacttttcctccacagctggcattgccaatgttcgtcattatcctcaaggctccatcctcaattacatgttttctctcagcaattttgtttcctgcttcacagaaaaaaaaattaagactgatatcaagagattcagctccctcaaattcctacacacacacacacacacacacacacacacacatatatacacacacattatccttcccttccccctttccattcagtgccaaagaaagtgccatttcttcttcttttgataattaaccctcccatctctttgcaactctaggtcaggaaacttccttcattataattacctttcgcctgtgttttcaacctttctcttttcaagtttattttatgcatcctatcaaaatgctcatgtctctcccatcacttaacaaatagacaattttaattactgtcctacctcttcccctcctttttagaagtcttaata

SEQ ID NO: 156035 - DNA, 601 bp, Human
cataagcttgagggcagtcaatctaaccatatttctcatgctgccatcctaggctataatcctatctatctatctatctatctatctatctatctatctatctatcatctatctacctacctatctataatttatcatgtctgttgcccacttttcctccacagctggcattgccaatgttcgtcattatcctcaaggctccatcctcaattacatgttttctctcagcaattttgtttcctgcttcacagaaaaaaaaattaagactgatatcaagagattcagctccctcaaattcctacacacacacaaacacacacacacacacacacatatatacacacacattatccttcccttccccctttccattcagtgccaaagaaagtgccatttcttcttcttttgataattaaccctcccatctctttgcaactctaggtcaggaaacttccttcattataattacctttcgcctgtgttttcaacctttctcttttcaagtttattttatgcatcctatcaaaatgctcatgtctctcccatcacttaacaaatagacaattttaattactgtcctacctcttcccctcctttttag

SEQ ID NO: 156036 - DNA, 601 bp, Human
attaagggctgagccaagactaataatatctgcagtattaacctctctcatgctaatggaaaccttgaacataagcttgagggcagtcaatctaaccatatttctcatgctgccatcctaggctataatcctatctatctatctatctatctatctatctatctatctatctatcatctatctacctacctatctataatttatcatgtctgttgcccacttttcctccacagctggcattgccaatgttcgtcattatcctcaaggctccatcctcaattacatgttttctctcagcaaytttgtttcctgcttcacagaaaaaaaaattaagactgatatcaagagattcagctccctcaaattcctacacacacacaaacacacacacacacacacacatatatacacacacattatccttcccttccccctttccattcagtgccaaagaaagtgccatttcttcttcttttgataattaaccctcccatctctttgcaactctaggtcaggaaacttccttcattataattacctttcgcctgtgttttcaacctttctcttttcaagtttattttatgcatcctatcaaaatgct

SEQ ID NO: 156037 - DNA, 601 bp, Human
atcatattggacagtagagacctagagaatagtagctctctcccaggaccgaggtttaacttctgagcaacattctacattaagggctgagccaagactaataatatctgcagtattaacctctctcatgctaatggaaaccttgaacataagcttgagggcagtcaatctaaccatatttctcatgctgccatcctaggctataatcctatctatctatctatctatctatctatctatctatctatctatcatctatctacctacctatctataatttatcatgtctgttgcccacttwtcctccacagctggcattgccaatgttcgtcattatcctcaaggctccatcctcaattacatgttttctctcagcaattttgtttcctgcttcacagaaaaaaaaattaagactgatatcaagagattcagctccctcaaattcctacacacacacaaacacacacacacacacacacatatatacacacacattatccttcccttccccctttccattcagtgccaaagaaagtgccatttcttcttcttttgataattaaccctcccatctctttgcaactctaggtcaggaaacttc

SEQ ID NO: 156038 - DNA, 601 bp, Human
ctgggtgtgtattttgtgtataatacatctcagttagaaccagccatgtttcaggtgctggagagctatatgtggctaatggccatcatattggacagtagagacctagagaatagtagctctctcccaggaccgaggtttaacttctgagcaacattctacattaagggctgagccaagactaataatatctgcagtattaacctctctcatgctaatggaaaccttgaacataagcttgagggcagtcaatctaaccatatttctcatgctgccatcctaggctataatcctatctatctatctatctatctatctatctatctatctatctatcatctatctacctacctatctataatttatcatgtctgttgcccacttttcctccacagctggcattgccaatgttcgtcattatcctcaaggctccatcctcaattacatgttttctctcagcaattttgtttcctgcttcacagaaaaaaaaattaagactgatatcaagagattcagctccctcaaattcctacacacacacaaacacacacacacacacacacatatatacacacacattatccttcccttccccctttcc

SEQ ID NO: 156039 - DNA, 601 bp, Human
cctgggtgtgtattttgtgtataatacatctcagttagaaccagccatgtttcaggtgctggagagctatatgtggctaatggccatcatattggacagtagagacctagagaatagtagctctctcccaggaccgaggtttaacttctgagcaacattctacattaagggctgagccaagactaataatatctgcagtattaacctctctcatgctaatggaaaccttgaacataagcttgagggcagtcaatctaaccatatttctcatgctgccatcctaggctataatcctatctatctatctatctatctatctatctatctatctatctatcatctatctacctacctatctataatttatcatgtctgttgcccacttttcctccacagctggcattgccaatgttcgtcattatcctcaaggctccatcctcaattacatgttttctctcagcaattttgtttcctgcttcacagaaaaaaaaattaagactgatatcaagagattcagctccctcaaattcctacacacacacaaacacacacacacacacacacatatatacacacacattatccttcccttccccctttc

SEQ ID NO: 156040 - DNA, 601 bp, Human
gtcctgggtgtgtattttgtgtataatacatctcagttagaaccagccatgtttcaggtgctggagagctatatgtggctaatggccatcatattggacagtagagacctagagaatagtagctctctcccaggaccgaggtttaacttctgagcaacattctacattaagggctgagccaagactaataatatctgcagtattaacctctctcatgctaatggaaaccttgaacataagcttgagggcagtcaatctaaccatatttctcatgctgccatcctaggctataatcctatcaatctatctatctatctatctatctatctatctatctatcatctatctacctacctatctataatttatcatgtctgttgcccacttttcctccacagctggcattgccaatgttcgtcattatcctcaaggctccatcctcaattacatgttttctctcagcaattttgtttcctgcttcacagaaaaaaaaattaagactgatatcaagagattcagctccctcaaattcctacacacacacaaacacacacacacacacacacatatatacacacacattatccttcccttccccctt

SEQ ID NO: 156041 - DNA, 601 bp, Human
gcttttttacattcttaatttatgctaaattttcaagtcctgggtgtgtattttgtgtataatacatctcagttagaaccagccatgtttcaggtgctggagagctatatgtggctaatggccatcatattggacagtagagacctagagaatagtagctctctcccaggaccgaggtttaacttctgagcaacattctacattaagggctgagccaagactaataatatctgcagtattaacctctctcatgctaatggaaaccttgaacataagcttgagggcagtcaatctaaccatrtttctcatgctgccatcctaggctataatcctatctatctatctatctatctatctatctatctatctatctatcatctatctacctacctatctataatttatcatgtctgttgcccacttttcctccacagctggcattgccaatgttcgtcattatcctcaaggctccatcctcaattacatgttttctctcagcaattttgtttcctgcttcacagaaaaaaaaattaagactgatatcaagagattcagctccctcaaattcctacacacacacaaacacacacacacacacaca

SEQ ID NO: 156042 - DNA, 601 bp, Human
acagggacacatggaggggaggaggggagcaacacacactggggcctgtcagaggaccaggggtgggaggagggagaagatcaggaagaatagctagtggatgctggatttaatacctgggtggtgggatgatctgtgcagcaaaccaccacggaacacatttacccatgtaacatgaacatttacccctgaacttaaaataaaagttggaaaaaaaaaaaaggcatgtcagtcaaagaaagaaacaatgggtctaataaactgatcttagtacaggtatatccaatttataaaataacayagagattttataaaatttaggtttatttgtcctagagtagcaacattagtctcagcagttagtagaaagattttggtgcctttaaaggcctagcttcagcgttatctggctgaattaattaagataatgcccataaaatgtctaatggtgtctggccaaactggaggcatttagtagatataatcattgtcttcatagtattataaataaactcatagctaacaatgaggcacttatatagtacttgtgtttttaaaagcatgtactatttcacaggaatcccacaaatccccttgtcag

SEQ ID NO: 156043 - DNA, 601 bp, Human
aagtgagagctaaatgatgaaaacacagggacacatggaggggaggaggggagcaacacacactggggcctgtcagaggaccaggggtgggaggagggagaagatcaggaagaatagctagtggatgctggatttaatacctgggtggtgggatgatctgtgcagcaaaccaccacggaacacatttacccatgtaacatgaacatttacccctgaacttaaaataaaagttggaaaaaaaaaaaaggcatgtcagtcaaagaaagaaacaatgggtctaataaactgatcttagtacagktatatccaatttataaaataacacagagattttataaaatttaggtttatttgtcctagagtagcaacattagtctcagcagttagtagaaagattttggtgcctttaaaggcctagcttcagcgttatctggctgaattaattaagataatgcccataaaatgtctaatggtgtctggccaaactggaggcatttagtagatataatcattgtcttcatagtattataaataaactcatagctaacaatgaggcacttatatagtacttgtgtttttaaaagcatgtactatttcacag

SEQ ID NO: 156044 - DNA, 601 bp, Human
cccgcatgttctcatttataagtgagagctaaatgatgaaaacacagggacacatggaggggaggaggggagcaacacacactggggcctgtcagaggaccaggggtgggaggagggagaagatcaggaagaatagctagtggatgctggatttaatacctgggtggtgggatgatctgtgcagcaaaccaccacggaacacatttacccatgtaacatgaacatttacccctgaacttaaaataaaagttggaaaaaaaaaaaaggcatgtcagtcaaagaaagaaacaatgggtctaayaaactgatcttagtacaggtatatccaatttataaaataacacagagattttataaaatttaggtttatttgtcctagagtagcaacattagtctcagcagttagtagaaagattttggtgcctttaaaggcctagcttcagcgttatctggctgaattaattaagataatgcccataaaatgtctaatggtgtctggccaaactggaggcatttagtagatataatcattgtcttcatagtattataaataaactcatagctaacaatgaggcacttatatagtacttgtgtttttaaa

SEQ ID NO: 156045 - DNA, 601 bp, Human
acctagaggcagaaataccgtttgacccagcaatcccattactgggtatatactcaaaggaatataaactgttctattataaagacatatgcacctgtatgttcattgcaacactattcacaatagcaaagacatagaatcaacctaaatgcccatcaattatagactggataaagaaaatgtacatatacaccatggaatactatgcagccataaaaaggaacaagatcatgtccattgcagaaacatggatggagctggaggccattatccttagcaaactaacgcaggaatagaaaaycaaatacccgcatgttctcatttataagtgagagctaaatgatgaaaacacagggacacatggaggggaggaggggagcaacacacactggggcctgtcagaggaccaggggtgggaggagggagaagatcaggaagaatagctagtggatgctggatttaatacctgggtggtgggatgatctgtgcagcaaaccaccacggaacacatttacccatgtaacatgaacatttacccctgaacttaaaataaaagttggaaaaaaaaaaaaggcatgtcagtcaaagaaagaaacaatgg

SEQ ID NO: 156046 - DNA, 601 bp, Human
cgaggtcactagtctaattccaggaaaatctaagtacaaggaaaaaaatattctctggactacaggataactatgttagcagtgatatacatatatggataaacattaaaagaggagctagtatagctcaagtcctagtaaccctaaaacagctgtgaaacaatgttacaatcattgtcctcctttcacaggcaatgagggtaataaaacttaatatcaaatgccagtgaggggaccactataactaaaacagcaaatattttcatttctatccattactagtattcttctgcaacaagtyttgtaatactaaacagcacatgctaagtgctctcttgactcctccggcacttcaaaaatatcttaccaaaactgacccatcaaacagcttttcccagtagtatgcaactttgtactaatacagttatgcagttttatattcctgggagataagcaatgtcagatgaattcaaactaaaatgagataatgaaagatggggaaggaattggaagtagaaaaggaagccagggagagacccagaggctactttctgctaagtctaaggatccttctagaacctatgcataggctttagaaaga

SEQ ID NO: 156047 - DNA, 601 bp, Human
attagcctaggcttatgcagggtcagaatcatcaaaatcactgtcttccacctccatatcttgtcccactggaaggtctttagggacaataacacacatagagctgtcatctcctctgataaaatgccttgttctggaatacctcctgaaggacctgcctcaggctcttttacagttaactttttttctaataagtagaaaaagtatactctaaaacaacgataaaaagtatagtaaatatgtaaaccagtaacatagtcatttattatcattatcaagtattatgtactatacataattktatgtagtatactttaatacaagtggcagcacagtaggtttatttatgccaacatcaccacaaacacgtgagtaatgcattgtgtgactatctcacaacagcaatttttcagctccattataatcttatgggatcagcatcctatatgcagtcaggtgttgatggaaatattgttatgcagtgcatgactgtaatgagtagcatatggtggtttatcacgaggtcactagtctaattccaggaaaatctaagtacaaggaaaaaaatattctctggactacaggataactatgttagcag

SEQ ID NO: 156048 - DNA, 601 bp, Human
tattgtaaagaatgtcactgtttattgaataggtctatcagattgataaaatatgtctggacaaagaataacttacttccataataaagccactcagtttcagttctccacaacacagaagagatatgtaagaattgaaaatgcccttctatttaagaaacaaattaaactagaaaaagatttatgaaatttactaattacagaaaaagatcaactgtagaatatattcagatacagtcatgcattgcttaacaacagagatatagtctaagaaatgcatcattaggtgatttcctcattstgtgaacatcatagagtgtacttacacaaacctagatgatatagcctactacacatctaggctatataatttgctactaggctataaacttgtatagcatgttgctatactgaatattgtaggcaactataacacaatgataaatatttgtgtatctacacatatctaaacagaaaaggtacagtaaaaatatggtaaaaaatgatgtagacctatagagggcacttaccatgaatggagcttgtaggactagcagttgctctaggtgagtccgtgagtgagtggtgagtgagtgtgagg

SEQ ID NO: 156049 - DNA, 601 bp, Human
aaaaatactaaaagtgagagtgaaataataacagcacttcccccctccatttcctgatggattgtccctaattttttctaacagatttacattcctcttgctgcttaaactctggtgaagaccatactaccacgcatagttcccctcccttcaaggagcagaagcaattatgagatcataaaagcaacacaaagtaccaacatataatttcatctaataccataaataattcttaaaaagttattgcagtatttataaataacaggttatgctgagaaaatcagactcattaaagagcgayacttatttgtacttggagggtcagcagtctttcaaattccacaaaattccaggcatattcatcctcccctaaaaccttgcatgctgagtcccatcaagtcaaattcttggctatgttacagctcatcataagtactaaaaattctgctcaggtaatcctgctgtgggaggaagaattctgacttatagaatgacttctaaatctaagatatcaaaaaaatgcaccaaatatagaatagtgattggcaaaatactgaaaataaagaagggaatatttatttaattattctatggctgtgtt

SEQ ID NO: 156050 - DNA, 601 bp, Human
ttaagagttgtaatcgtcatagttttagaataaaggtataagtttagattagatcataagctaattatgacctattattatccattaataaacctcagaaaacatgaagtatttttactgatataaaatgttttatttaggtaaatgataacaatgaaacttaaagatataaaacaataggtattttcttcatatctgctcttaaaatctaggctttcatgttagatcctctttaaaaaaggtattgataaattaattttagttttgattagtataaaatatcacatatgcttataaagtraaaaatattgaaatactaaaaaatacaaaaatattaaaaaatactaaaagtgagagtgaaataataacagcacttcccccctccatttcctgatggattgtccctaattttttctaacagatttacattcctcttgctgcttaaactctggtgaagaccatactaccacgcatagttcccctcccttcaaggagcagaagcaattatgagatcataaaagcaacacaaagtaccaacatataatttcatctaataccataaataattcttaaaaagttattgcagtatttataaataaca

SEQ ID NO: 156051 - DNA, 601 bp, Human
ggccttcttgacttgcaatttatatagttgttttgtgagcctattttagtaagatcccattagatttcaatccctgaacacaatataaaacttcccttatattctgtatcttactaatgaacacacagtaaatgtttggtaaatatttgttgactgatataaaatgacagtacttctattcagagtgtcaggatggagtagcaaataagggtgggggctgtggaaaaaggctctctggatttgaattttgcctctgccacttaacagttgtgtgaccacaccacattatttaacctctctrtgcctgctttaatgttcttatttgtaagacaaggataaaatagaatctgtcttaaggagattaagacaattcttaaagagacagaaaggtatgttttgacaaatatcaaagataatctaaccaaatattatattatctttaaataaatatataacatctcttaagagttgtaatcgtcatagttttagaataaaggtataagtttagattagatcataagctaattatgacctattattatccattaataaacctcagaaaacatgaagtatttttactgatataaaatgttttatttag

SEQ ID NO: 156052 - DNA, 601 bp, Human
aaaacaaacccacaaaaacaaaaacatacgtgtgtgtgtgtgtgtgtgtgttgtgtatgtgtgtactcttccttgttttccagcatcactggagatttactctttaaaacaacacacagtgaaacagtatctcctgtaaattcctgtaaggacttggtaagcaaggggatgatgggcacatatggtcttctgccatcttcatgacacttcatcttactgacattctctatttctccaacacaacaaaccatctttagttcatttttcatgctgctataattttgtacctaaatgccaataygatcatgttatttacttgctcaaaaaatctttgaaggctcataattgcctatggccaaatgtctaaactccccagtgtggcattcaaggtcctccccattcttgcctaaatctacctcactcacacctgccttgaaagcttacacatcccagtgaaaacactgtttcctctataaaagcaaattaagccttcccaatcagagtaatccttgcttcttcaatgttcctacagtagtttacacttccaatataggccttcttgacttgcaatttatatagttgttttgtgagcctattttag

SEQ ID NO: 156053 - DNA, 601 bp, Human
tttgaagtttatggcctgtaacaaaactaaaaaaaaacaaaaaaaaaacaaacccacaaaaacaaaaacatacgtgtgtgtgtgtgtgtgtgtgttgtgtatgtgtgtactcttccttgttttccagcatcactggagatttactctttaaaacaacacacagtgaaacagtatctcctgtaaattcctgtaaggacttggtaagcaaggggatgatgggcacatatggtcttctgccatcttcatgacacttcatcttactgacattctctatttctccaacacaacaaaccatctttarttcatttttcatgctgctataattttgtacctaaatgccaatacgatcatgttatttacttgctcaaaaaatctttgaaggctcataattgcctatggccaaatgtctaaactccccagtgtggcattcaaggtcctccccattcttgcctaaatctacctcactcacacctgccttgaaagcttacacatcccagtgaaaacactgtttcctctataaaagcaaattaagccttcccaatcagagtaatccttgcttcttcaatgttcctacagtagtttacacttccaatataggcct

SEQ ID NO: 156054 - DNA, 601 bp, Human
aatcccagcactttgggaggccgaggcgggtggatcacctgaggtcaggagttagagaccagcctgatcaacatggtgaaaccctgtttctactaaaaatacaaaaattagcagggcatggtggcacgcacctgtagtctcagctacttggggggctgaggcagaagaatggcttgaacccggcggtgcggaggttgcagtgagccgagatcacgccactgcactccagcctgggtgaaagagcgagattccatctcaaaaacaacaacaacaacaaaaatggttggtaattcctggctgtttttttttttttctttttttttatgagttctctatttgcttgtcatagatgccagggacatgctgctagatgaggtattctggttgccttcctttcagaagggggtgctaccatttttcctgagtgttattagctgccttcccattgctctgcctctttagctcaagccccacattcagtgccttaggctgtggctaaaagtatcaactgccttctgctcaatgtaagcaagcaaatgtgaaggcgctgatttactctgctgctcttcatgcagccctccaactaaccaccctgcttaag

SEQ ID NO: 156055 - DNA, 601 bp, Human
tcggcactttgggaggagtttgagagcagccttggcaacacagagagaccccgttgctacaaaaaatacaaaaattagccaggtgtagtggtgcacgcctgtagtcccagctacttgggaggctgtgtgggaggatggcttgagcctgtgaggtcgaggctgcagtgagccaaaatgacaccactgcactccagcctgggttgtcagacagagtaggaccctgtctcaaaaaaagaaaattttatttaacttgcactacattcattaaaagattactttcatataagtgtctgctacatgmacagcacttgaaatctgaagaggttcatgtgtgttggcctagcgcggtggatcatgcctgtaatcccagcactttgggaggccgaggcgggtggatcacctgaggtcaggagttagagaccagcctgatcaacatggtgaaaccctgtttctactaaaaatacaaaaattagcagggcatggtggcacgcacctgtagtctcagctacttggggggctgaggcagaagaatggcttgaacccggcggtgcggaggttgcagtgagccgagatcacgccactgcactccagcctgggtgaa

SEQ ID NO: 156056 - DNA, 601 bp, Human
agactgtgcattgcactccagcctggacgacagatcagactccatctcagaaaacaagcagaagccttactctgcttatatagtgggaagctgtcattttgtgacataagatgtaatttatgaaattgtgaaaagtgagtactaacgttctttttcttatttccggtcagggaaaaaaacacttttaaattactcagttccagtaaactgttttattagaacctattctctatcaaattttgtttgatggccaggctcatacctataatcggcactttgggaggagtttgagagcagcctyggcaacacagagagaccccgttgctacaaaaaatacaaaaattagccaggtgtagtggtgcacgcctgtagtcccagctacttgggaggctgtgtgggaggatggcttgagcctgtgaggtcgaggctgcagtgagccaaaatgacaccactgcactccagcctgggttgtcagacagagtaggaccctgtctcaaaaaaagaaaattttatttaacttgcactacattcattaaaagattactttcatataagtgtctgctacatgcacagcacttgaaatctgaagaggttcatgtgt

SEQ ID NO: 156057 - DNA, 601 bp, Human
aattagctgggcatggtggtgcgtgcctgtaataccagatatttaggaggctcaggcaggagaatcacctgaacctgggagatggaggttgcagtgagccgagactgtgcattgcactccagcctggacgacagatcagactccatctcagaaaacaagcagaagccttactctgcttatatagtgggaagctgtcattttgtgacataagatgtaatttatgaaattgtgaaaagtgagtactaacgttctttttcttatttccggtcagggaaaaaaacacttttaaattactcagttycagtaaactgttttattagaacctattctctatcaaattttgtttgatggccaggctcatacctataatcggcactttgggaggagtttgagagcagccttggcaacacagagagaccccgttgctacaaaaaatacaaaaattagccaggtgtagtggtgcacgcctgtagtcccagctacttgggaggctgtgtgggaggatggcttgagcctgtgaggtcgaggctgcagtgagccaaaatgacaccactgcactccagcctgggttgtcagacagagtaggaccctgtctcaaaaa

SEQ ID NO: 156058 - DNA, 601 bp, Human
cctgtctcaacatggtgaaaccctgtctctacaaaaattagctgggcatggtggtgcgtgcctgtaataccagatatttaggaggctcaggcaggagaatcacctgaacctgggagatggaggttgcagtgagccgagactgtgcattgcactccagcctggacgacagatcagactccatctcagaaaacaagcagaagccttactctgcttatatagtgggaagctgtcattttgtgacataagatgtaatttatgaaattgtgaaaagtgagtactaacgttctttttcttatttccrgtcagggaaaaaaacacttttaaattactcagttccagtaaactgttttattagaacctattctctatcaaattttgtttgatggccaggctcatacctataatcggcactttgggaggagtttgagagcagccttggcaacacagagagaccccgttgctacaaaaaatacaaaaattagccaggtgtagtggtgcacgcctgtagtcccagctacttgggaggctgtgtgggaggatggcttgagcctgtgaggtcgaggctgcagtgagccaaaatgacaccactgcactccagcct

SEQ ID NO: 156059 - DNA, 601 bp, Human
aaatcagaaagaatcatgacaggtgtagcttagggtgcaaagattctgagcagcactcacatttgtggttccatcacttaaggatgttttaaagacatgcatttatttaattacttaagttttatttgccagggttccatcaaatgtcagctataaatgtattatgtttaggaaaaacattttgataaagtagaaaataaggatgtctttatattttatttcatatttattactttcattctgttctccgtaatttttctagcaagtaagtatccaatattaaaaacctactcagctgcgygtggtggcccacacctgtaatcccaacactttcagaggtagaggtgagtgaatcatttgtggtcaggagttcgagaccagcctggctaacatggtgaagccctgtctcaacatggtgaaaccctgtctctacaaaaattagctgggcatggtggtgcgtgcctgtaataccagatatttaggaggctcaggcaggagaatcacctgaacctgggagatggaggttgcagtgagccgagactgtgcattgcactccagcctggacgacagatcagactccatctcagaaaacaagcagaag

SEQ ID NO: 156060 - DNA, 601 bp, Human
aaaatttaaattgagaaagacaggaagagaggacctaggggataaagaggtaattgacaatgaaaaggtggatcaatgaatttgagctcctagtggtatgggataattattgagatctgtatgttagaagaagagagctggaaagttaaaagatactcgagactgagattactgtgggtgggaggagagggggctatagtgattgataatgatcagttttaaggcataaccatggataaggttagtctgagggcaagaatgttagaagaaagaagaacaacagattgagaggccaaggtcrtaagtgggtcacctctatgaaagtggaaatcagaaagaatcatgacaggtgtagcttagggtgcaaagattctgagcagcactcacatttgtggttccatcacttaaggatgttttaaagacatgcatttatttaattacttaagttttatttgccagggttccatcaaatgtcagctataaatgtattatgtttaggaaaaacattttgataaagtagaaaataaggatgtctttatattttatttcatatttattactttcattctgttctccgtaatttttctagcaagtaagtatc

SEQ ID NO: 156061 - DNA, 601 bp, Human
atgtaacctagaacttgaagtataacaataaaacaaaaagttttcttacacatcagaactcctgagataatttatgagcttgaaatataaataggatgtttaccttctttatcttacctctaataggccatcctctggcagatcagtacagtgaacagcattctggatcttagttttaccaaagattgctctgagagttccagggcgtaaatgccgggcaatttcctattaaacatacattcacatatagattaatgttagtcatatggtataaataagaaaaacactagctatatgaaaygctaacttatttatgaaatacatgttatatatagacagtgcttataagggtttttctgtggcccaatgtaaagtctgctttcatctacatcggggaaaaataataattgcatttctttttatcaatagattatgggaatcacacaaaatgtgaagctagttcattactgtgaaagacttgtattttataaagacagtagagatcttaacaactttgatttaaaatgaaccaatttgatgctattgatttcaaaagcttttaaaaaaatgttagctgtatcaacttaatggtagttcatct

SEQ ID NO: 156062 - DNA, 601 bp, Human
cagtgagccgagattgtgccactgcactacagcctgggcgacagagtgagactccctctcaataaataaataaaaagttcatttggaggaatacattttagggactaaccaagaacacttttgtaaagtataaataacctacaataataaaaacagtattttgctggtacagatcaatggaataaaataggaagttcagaaacaggcaaggatgtatataagtattcaataaatgagaaagaacaatgaaaggatggatggatttagccatttaaataaaataaattgtttattattaatcatattgtgatagctggctaaatccatacctcacactatatgtctaataaattccaggtggattgaacatttcaatgtatgaaaatgaaaacaaaatatttggggaaggcttttctatgtacaacttccaggacataatttttttttaaaagactaatagatttgatcacataaaacataatactcattaaaataaatgtgtattaaggatatcaaccatttttcttcatttaatcacttaaatttattatttctttttaaatttcatttagcttattttgacacaaaaattttaaaatct

SEQ ID NO: 156063 - DNA, 601 bp, Human
tcccacttgcattttgtaggggtggagtaaagacctcggtaaaaagtcatttaaagttcattcggaggttggccaggcgtggtggctcatgcctgtaatcccagaacttttcgaggctgaggtgggtggatcacctgaggtcaggagacagcctggccaacatggtgaaacttcatctctactagaaatacaaaaaattagctgggcatggtggcatgcacctgtaatcccagctatgcaggaggctgaggctggagaaatgcttgaactcaggaggcggaggttgcagtgagccgagatygtgccactgcactacagcctgggcgacagagtgagactccctctcaataaataaataaaaagttcatttggaggaatacattttagggactaaccaagaacacttttgtaaagtataaataacctacaataataaaaacagtattttgctggtacagatcaatggaataaaataggaagttcagaaacaggcaaggatgtatataagtattcaataaatgagaaagaacaatgaaaggatggatggatttagccatttaaataaaataaattgtttattattaataatattgtgatagct

SEQ ID NO: 156064 - DNA, 601 bp, Human
taagaagtagaattctgggacaaaagttatagaaatattccaaggctttcaatatgttttgcccatagttgtcaccagctatatgagggtatctactttactgtagcattgccagcagtgggcattattacttcaaaagttctttgccattaatagaaaactagtatttgattactcagctgaacattttaccatcaatgctatctttaacacacaaatttaagatcattgtagttacaaccagcagagtataagagaacattaacagtgacagaacattctagaatgtctcatattatawataccataatttattcctataatcacaaaattgactgggtcacaattagcaatattcaaagaaaacaaatttctgtattcatgctaagatctttgacctctcaaacttactatgagttctaggagaacagtagaaatgaattgtttgatcctatcacaatccagcaagtaaaacatgttctataattgtttgctataaaaataaataaataaataaataaataaataaaataatggataatgacaaaatataaactgaagccatactttctgagctctatacccatgacacatagctcag

SEQ ID NO: 156065 - DNA, 601 bp, Human
actgtgctgtaatagtaataataataataactactatcatttgttgagcaattactatttgctaggcacaatgatatttgatagggcaggtactgttatcttcgttttacagagtgaggaaacctacgcatagtgagatgagtaacttgcccaggagtacagagctattttgacttggctacaccactatagtataggaaggcaaagtgctatgaaaacacacatacggactgatgcagactatgggtgccatggaaggtttcttagaggaggtaaggtgggatgtatctgtaaacatgcrtattatttccattgttaatgatcacaaatactccttccatgaacatctgtgcagataactttccattttgtagtcctgctgccactctcttcctttgcttagatcctaagaagtagaattctgggacaaaagttatagaaatattccaaggctttcaatatgttttgcccatagttgtcaccagctatatgagggtatctactttactgtagcattgccagcagtgggcattattacttcaaaagttctttgccattaatagaaaactagtatttgattactcagctgaacattttacca

SEQ ID NO: 156066 - DNA, 601 bp, Human
atacaatttatttaactaaactcttccttcctttctttcaaaaatcacttattgaagagcttttatatgccaggcaagaaaaaatctcttccctactatgtgtactcacagtctcacatgagcaaacagacactgtgctgtaatagtaataataataataactactatcatttgttgagcaattactatttgctaggcacaatgatatttgatagggcaggtactgttatcttcgttttacagagtgaggaaacctacgcatagtgagatgagtaacttgcccaggagtacagagctattytgacttggctacaccactatagtataggaaggcaaagtgctatgaaaacacacatacggactgatgcagactatgggtgccatggaaggtttcttagaggaggtaaggtgggatgtatctgtaaacatgcatattatttccattgttaatgatcacaaatactccttccatgaacatctgtgcagataactttccattttgtagtcctgctgccactctcttcctttgcttagatcctaagaagtagaattctgggacaaaagttatagaaatattccaaggctttcaatatgttttgcc

SEQ ID NO: 156067 - DNA, 601 bp, Human
gcgtggtggcatgcacctgtagtcccagctactcgggaggctgaggcaggagaatagcttgaacccgggaagcagaggttgcagtgagtcgagactgcaccactgcactccagcctgggcaacagagcgagactctgtctcaaaaaaaaaaaaaaaaattagaatctctgggggtgagtctggacgtcagtatttagaaaactggctaggtgattctgatgtgcaaccaaggctaggaaacactgttatagagtcttctctataaagtgtgacatactttttcaccgagtgcaaaaaatayaatttatttaactaaactcttccttcctttctttcaaaaatcacttattgaagagcttttatatgccaggcaagaaaaaatctcttccctactatgtgtactcacagtctcacatgagcaaacagacactgtgctgtaatagtaataataataataactactatcatttgttgagcaattactatttgctaggcacaatgatatttgatagggcaggtactgttatcttcgttttacagagtgaggaaacctacgcatagtgagatgagtaacttgcccaggagtacagagctattttga

SEQ ID NO: 156068 - DNA, 601 bp, Human
aggagtagttctatcctttgtcccagtgctactttaagacctcctccccttatatatgaactcctgactttttgaggcttatgccatctggctagatcttttctccttgttgctgtcacacctttggttcacaaacttccctagtttgtgaaagacttcagaatttgagtcaccattttcttctccaccctacctcctaaccatgatcctaggtgatttcaatgccactcaacatgaaagcttctctcagttcctagacttacatatctctagtgactgatactgatctccactccacackggctacctccttccatggccacaccctgaatcatatcatccattaccatggaaagctccacttctgaagtgtacagtgacacagctctttccctgttattcctggggtctctgtaggtaccttagaaaagcattcggtcccttggcccatctactttatccctttcttcaagcacctcctgccatcacatctttccttgtttataacttcaactatagttgctaacatcctcaattatctttcctcatcgtaccctcctgtaaaaacctcacccctgggccaaactgttcaccagagaat

SEQ ID NO: 156069 - DNA, 601 bp, Human
taaactcccttgaaacttgaatctcttcataggcctcttagccttaaatgaaacttggatatcccctaagggcatcaattccttggagtccgcaggataagaatctctggccaggagggtaggagtagttctatcctttgtcccagtgctactttaagacctcctccccttatatatgaactcctgactttttgaggcttatgccatctggctagatcttttctccttgttgctgtcacacctttggttcacaaacttccctagtttgtgaaagacttcagaatttgagtcaccattttcytctccaccctacctcctaaccatgatcctaggtgatttcaatgccactcaacatgaaagcttctctcagttcctagacttacatatctctagtgactgatactgatctccactccacactggctacctccttccatggccacaccctgaatcatatcatccattaccatggaaagctccacttctgaagtgtacagtgacacagctctttccctgttattcctggggtctctgtaggtaccttagaaaagcattcggtcccttggcccatctactttatccctttcttcaagcacctcct

SEQ ID NO: 156070 - DNA, 601 bp, Human
caaggcaaaaagcacatactaaagatgatgacggtaccaaggaggaggagactgggtgactgatggtattacggagttgccataccagtcccacatgcctaccttcagatctcaaattatggggcggaaaaataaaagttctcatttttaaagatgattttagggtctctatttactagtgaccagaaaattaattattaatttgtcacaccccaacccaccaacatggaggccattatattcacctcttttctccgatcctgctattctcacatggctctgagattcttcttcccttccycaatctctaactattcctattgctttctgcagaacttcagtgccattgtaaactcccttgaaacttgaatctcttcataggcctcttagccttaaatgaaacttggatatcccctaagggcatcaattccttggagtccgcaggataagaatctctggccaggagggtaggagtagttctatcctttgtcccagtgctactttaagacctcctccccttatatatgaactcctgactttttgaggcttatgccatctggctagatcttttctccttgttgctgtcacacctttggttcac

SEQ ID NO: 156071 - DNA, 601 bp, Human
tcgataggttgtctgtttactatgttgataggttcttttacaagttttaaaaaagtctggtgtgcccctactcactgggacagtggtttctaaatgctagtttaactatcagccatatcagaatatcagaatcacctgcaacataaaatacagtagtgcccccttataagtggggaatatgttccagttcccccagtggatgcctgaaactgtggatagtaccgaactctatctatactacgtttttccatatgtatgagagataaagtttaatttataaattaggcacagtaagagattmacaataaaatagcataattataacaatatactgtaatatttcctcatactactcagaatggcatacaatttaaaactttttattttttaatttttgcaaccctgctctttaaggtaccatacaatttaaaacttataaattgtttatttctggaattttccattttatatttttgggccatggttgaccatgggtaactgaagctgtggaaagtgaaaccatgaataacggggctctactctatagatataaggagctcataccagacctccttaaccagaatcttctataatagggctc

SEQ ID NO: 156072 - DNA, 601 bp, Human
atgttttccatatcaagtttgaataaaattatcaatcaaagactccataagcatgtgtaacttagcccagttgctcccaaccaccagatggtgagggtctaggatgacatttcactgctttctggcaaaatgggaaaaatgagggcaacaaagcagtgatgaagcaagggttggcaggagtagtccaccctggggaaggggcagtattttctcactgacgttgtttggaactgcctgtttatggtgataacaaaaagcagacaaactattagtggattctattattgttttaaaatgatcyacagaagatgcaatgctgttttgcctgtgcctgaagtggactgcttcgaccatcatgcctttggcatgcaatagcaataaagtgagcttcaggtaaagctgaatttattcagttgaagagacagtccattattctgtgataaaatgctgttggtgattaaatgtccttttaaaacaaaacgatgatgatgggaaacaaatttttctaatgtcttcatttgttaaattttaaaaactttatcattgtgtctatccctgaagtgggttttattactgtttagttttttttttttttttgaaa

SEQ ID NO: 156073 - DNA, 601 bp, Human
aaatatttgtgcccatgtataagtgttaaagaatactctatttctccaaataattataaaggattttttctttatttttaaaatatgtttttaaaatttgtataatttaaaaaaatttttttttaagatagagacagggtcttgctgtgttgtccaggctggtcttgaactccttggctcaagcaatccttctgcctcagcctcccaaagtgctgggattaccacagcacctgtcccaattttctttaacatagataaaatcaccactcgcaggactcaactagtttacattcctctttgrcctatgaaatgtgatatatgttttccatatcaagtttgaataaaattatcaatcaaagactccataagcatgtgtaacttagcccagttgctcccaaccaccagatggtgagggtctaggatgacatttcactgctttctggcaaaatgggaaaaatgagggcaacaaagcagtgatgaagcaagggttggcaggagtagtccaccctggggaaggggcagtattttctcactgacgttgtttggaactgcctgtttatggtgataacaaaaagcagacaaactattagtggattctatt

SEQ ID NO: 156074 - DNA, 601 bp, Human
acctgcagtcccagctactcaggaggctgaggcagaagagtcgcttgaacccgggaagtggaggttgcagtgagctgagatcaagccagtgcactccagtctgggcgacagagcaagactctgtctaaaaaaaaaaaaaaaatcagaattttctacctttgtccattagtcctagttaaataaatatttttaaaaatatttgtgcccatgtataagtgttaaagaatactctatttctccaaataattataaaggattttttctttatttttaaaatatgtttttaaaatttgtataattwaaaaaaatttttttttaagatagagacagggtcttgctgtgttgtccaggctggtcttgaactccttggctcaagcaatccttctgcctcagcctcccaaagtgctgggattaccacagcacctgtcccaattttctttaacatagataaaatcaccactcgcaggactcaactagtttacattcctctttgacctatgaaatgtgatatatgttttccatatcaagtttgaataaaattatcaatcaaagactccataagcatgtgtaacttagcccagttgctcccaaccaccagatg

SEQ ID NO: 156075 - DNA, 601 bp, Human
gaatgaatgaaatttaaataaaataacatgtggtagttaacttaaaattaagccatggattaaggagataaaattaatttttaattcctcatgttacattgaagaactcaatattataaaaaaatctctggctttttattttgaatttgaaaatcagaggccaagcacggtggctcacacctgtaatcccagcactttgggaggccaaggtgagcagatcaggagttcgagaccagcctggccaatatggtaaaacaccgtctctactaaaaacacgaaaattagatgggcatggtggcgkgcacctgcagtcccagctactcaggaggctgaggcagaagagtcgcttgaacccgggaagtggaggttgcagtgagctgagatcaagccagtgcactccagtctgggcgacagagcaagactctgtctaaaaaaaaaaaaaaaatcagaattttctacctttgtccattagtcctagttaaataaatatttttaaaaatatttgtgcccatgtataagtgttaaagaatactctatttctccaaataattataaaggattttttctttatttttaaaatatgtttttaaaatttgtataa

SEQ ID NO: 156076 - DNA, 601 bp, Human
ttagacaaacttgggttcaaatttcagctctctgccactcattggtggggtgatcctggccaagtcatttcacctatgggagcctcactctcttagcatataaaatggagataatagaaactattcaacagagtttttaggtaatgcaggtaaacaatgtggcatagtacctggtatatattgcttagtaaattaaagttattatttttatcactgttaccataatgttcattattgccatcagaaagctttccaaagtctccacaatctagctctaatttacatttccaaatttatctcycatactctaccaaaggaaccctccacttcaaccagaggaactcaatgtctcctaaaaccagcctgccatgttctttttctgtgtgtataaaaatctgccttattcttcaaataccatttcattaaattcatgaaatttatttcatgaaattttcctgacccccttcagccacactcatactgctctccattgaactctcatacttactgttcctaacacttcatcatacactatctggtaacattcttttatgctggtgtttaattttatattacaatttaattttacattttttttatc

SEQ ID NO: 156077 - DNA, 601 bp, Human
agcaaacatcagtaatccatcatggtgattttttttttctatttggttgtagttttatcaataaatcaaaaactggcacgtgaattgaaacacttttgtcatcgttgacctagtttgctgtatagaaacactggttttggacttagacaaacttgggttcaaatttcagctctctgccactcattggtggggtgatcctggccaagtcatttcacctatgggagcctcactctcttagcatataaaatggagataatagaaactattcaacagagtttttaggtaatgcaggtaaacaatktggcatagtacctggtatatattgcttagtaaattaaagttattatttttatcactgttaccataatgttcattattgccatcagaaagctttccaaagtctccacaatctagctctaatttacatttccaaatttatctcccatactctaccaaaggaaccctccacttcaaccagaggaactcaatgtctcctaaaaccagcctgccatgttctttttctgtgtgtataaaaatctgccttattcttcaaataccatttcattaaattcatgaaatttatttcatgaaattttcctga

SEQ ID NO: 156078 - DNA, 601 bp, Human
ttacagcaaacatcagtaatccatcatggtgattttttttttctatttggttgtagttttatcaataaatcaaaaactggcacgtgaattgaaacacttttgtcatcgttgacctagtttgctgtatagaaacactggttttggacttagacaaacttgggttcaaatttcagctctctgccactcattggtggggtgatcctggccaagtcatttcacctatgggagcctcactctcttagcatataaaatggagataatagaaactattcaacagagtttttaggtaatgcaggtaaacaatgtggcatagtacctggtatatattgcttagtaaattaaagttattatttttatcactgttaccataatgttcattattgccatcagaaagctttccaaagtctccacaatctagctctaatttacatttccaaatttatctcccatactctaccaaaggaaccctccacttcaaccagaggaactcaatgtctcctaaaaccagcctgccatgttctttttctgtgtgtataaaaatctgccttattcttcaaataccatttcattaaattcatgaaatttatttcatgaaattttc

SEQ ID NO: 156079 - DNA, 601 bp, Human
tttagactaccaggtccttaagacttgttactggatgatcagagtatacgcgtccattactcctattatctactcaccttaaactctgctgcttggttaaagttttggaacctttatcgagtcacttccctgttcaaaaacctttgatggcttccagttttctagagcctaagtagccactgtgtgtcatacataccaagaaactcccatccagcatttacagcaaacatcagtaatccatcatggtgattttttttttctatttggttgtagttttatcaataaatcaaaaactggcacktgaattgaaacacttttgtcatcgttgacctagtttgctgtatagaaacactggttttggacttagacaaacttgggttcaaatttcagctctctgccactcattggtggggtgatcctggccaagtcatttcacctatgggagcctcactctcttagcatataaaatggagataatagaaactattcaacagagtttttaggtaatgcaggtaaacaatgtggcatagtacctggtatatattgcttagtaaattaaagttattatttttatcactgttaccataatgttcattattgc

SEQ ID NO: 156080 - DNA, 601 bp, Human
aaagaggagcaagttcagataggtacagaggctagcacctgggtactgacctttgaatttcttgcaaggcaatataatttgctcttcaaacataaaaggctacactaaaagaataaaagccttttccccgctatgttcctataaaactttatttatggacattgaaatttgcatatcacatacttttcatgtgtcacaaaatattattctacttttgatgtttttcaaccatttaaacatgtgaaagccattcttagctcatgggccgcacaaaaacaggcagcaagggatgggcccttaractaacattggttgactgctggattggagcattagagcttgggtatgagtcccaccccagggcttccaggagagggggcccggctgatgccatctccaccctcattgctctaggtgggaaggcagagctggtgctgtatgaggtgtggctgtagatcctgggccagcccttcaccaaggccttggaagataaaaccagtcctgagtcccgggtgcttcaggggcagctgatgaaatgagtgaagtggcaggatggagtgggagatcagggaagaggcctcgaggggatggaggatgactg

SEQ ID NO: 156081 - DNA, 601 bp, Human
tgttggtggttggtaatgtgaacacaataccagctgtcttaggtgagtagacacaaaagtcacaggttaaaaagggcactttgtctcccttacttgatatgtggatcaaagccatgtacccatacatgtattgtccttggcatcttttctcagttttctctttcacaagatgcccatacacacaatatattctataccaatgctcttctggaagttctttcaacttcaagattactagaaataagagcactagtgagcatatctatttgttagttttaagtaatatttaacttgcagggcrcagtggctgacgcctgtaatcctactttgggaggccgaggtgggtggatgacctgaggtcaggagtttgagaccagcctggctaacatggtgaaatcctgtctctaccaaaaacacaaacaatagccgggtgtggtggtgcatacctgtagtcccagctactcgggaggccaaggcaggagatttgcttgaacctgggaggcggaggttgcagtgagccaagatcctgccactgcactccagcctgggtgacagagtaagactccatctcaaaaataataaaaaaataaaataaataata

SEQ ID NO: 156082 - DNA, 601 bp, Human
gccaagattttgccacgttggccagactggtctcaaactcctgacctcaagtgattgacctgccttggcctccccaagtgctaggattacaggtgtgaaccactgcgcccggactcatttctttaaaagctttccataacctgcaaaaccttctcaatacatgtgctcttgaaaacattgagcctaatattttcctgttagactagtcttctgtttcctcttaaaacaggaaagcccataactgtctaaaggacaaagaacagtagtaggtttaacaattttcaccctaaagccaaagtgrgagtagctgtaatattttatgaatgaaaaacaggatgaattctattagggcaaccatgttttagactcctttctaagtcacctcctagaatttttaatcagtcacctaagagttacttattaactcaaaaactgcttagtcactgactgaaaaatgaggcagggagcagaccaaagtcaagagttcagggtcaaactgcagagagcaaagcacaatgagtgaattggtttcatctttctcctcagtcttccagagccaggaaaatgaagggactggacagtgttggtggttggtaatgtg

SEQ ID NO: 156083 - DNA, 601 bp, Human
ttccaggggcacgtgaccttctctcatccccctcaagaactcaaaggcctcttgctgctgacaatacagcagcttgatagttaagaattttttaaggaataaataactttatatttttaatctaaaactgagttggacaagtttgtgaataaaaatatcagttaataaggataaaacctaagtaaatatctaatcattctaattacttttgagggaggccaaatattctgactctatttcctattatatcttccctcatgcttagtttttctagtctcactccccatcctatcatgaactstaaagaaataatacttgttacatttaagatcacacagaaaggcagtgaggttagagagtataaattctggacccagattgcctgggttcaagtctgtgctctgttatgttctagctgtgtggccctggggaagttgcttaactcttctatgtttcagttactcatctgtaaatgaagtcgtcaattaatgcatataaaacacttagaccaatgcttggcatatggccaggactccctacaagctagttaatattcctaccatatacataaaaataaaaaatcaataagcaatgataagaa

SEQ ID NO: 156084 - DNA, 601 bp, Human
cctcatatgacacattattattagaatgggagatgagaattatgtacttggtcattcaacaaatactgactatgcccctctcatgggtaagcacagtgaaatcacagtgagatcagaataatcctttggaattccaggggcacgtgaccttctctcatccccctcaagaactcaaaggcctcttgctgctgacaatacagcagcttgatagttaagaattttttaaggaataaataactttatatttttaatctaaaactgagttggacaagtttgtgaataaaaatatcagttaataagkataaaacctaagtaaatatctaatcattctaattacttttgagggaggccaaatattctgactctatttcctattatatcttccctcatgcttagtttttctagtctcactccccatcctatcatgaactctaaagaaataatacttgttacatttaagatcacacagaaaggcagtgaggttagagagtataaattctggacccagattgcctgggttcaagtctgtgctctgttatgttctagctgtgtggccctggggaagttgcttaactcttctatgtttcagttactcatctgt

SEQ ID NO: 156085 - DNA, 601 bp, Human
gaaacaaataattatttaacaatacaccaagtatgttaacagaagtatgtataaggacaatggggacaaagaggagaaagtacttgtgattttgttcctcatatgacacattattattagaatgggagatgagaattatgtacttggtcattcaacaaatactgactatgcccctctcatgggtaagcacagtgaaatcacagtgagatcagaataatcctttggaattccaggggcacgtgaccttctctcatccccctcaagaactcaaaggcctcttgctgctgacaatacagcagcytgatagttaagaattttttaaggaataaataactttatatttttaatctaaaactgagttggacaagtttgtgaataaaaatatcagttaataaggataaaacctaagtaaatatctaatcattctaattacttttgagggaggccaaatattctgactctatttcctattatatcttccctcatgcttagtttttctagtctcactccccatcctatcatgaactctaaagaaataatacttgttacatttaagatcacacagaaaggcagtgaggttagagagtataaattctggacc

SEQ ID NO: 156086 - DNA, 601 bp, Human
aatatcatctttgaatatatttcaaaagcctcaaatgattaaacccaatgaccttttaataaatgtaaaataaatacacaaggatatcagctctaggtctgccttactccttcccttccttccacagccatttgtcaataatcaactaagttactgataaacagaggctaggttcttgggatacaaaggtaagacatggcccctgccctcaaggagttcacactaaggggtgaactacacagaaacaaataattatttaacaatacaccaagtatgttaacagaagtatgtataaggacartggggacaaagaggagaaagtacttgtgattttgttcctcatatgacacattattattagaatgggagatgagaattatgtacttggtcattcaacaaatactgactatgcccctctcatgggtaagcacagtgaaatcacagtgagatcagaataatcctttggaattccaggggcacgtgaccttctctcatccccctcaagaactcaaaggcctcttgctgctgacaatacagcagcttgatagttaagaattttttaaggaataaataactttatatttttaatctaaaactgagt

SEQ ID NO: 156087 - DNA, 601 bp, Human
tacctaagggacagactataacatacatactctttaaatcccagtgacctcttcccaggggttaaatcagaggagtcatatcaaatccaagaaatatcatctttgaatatatttcaaaagcctcaaatgattaaacccaatgaccttttaataaatgtaaaataaatacacaaggatatcagctctaggtctgccttactccttcccttccttccacagccatttgtcaataatcaactaagttactgataaacagaggctaggttcttgggatacaaaggtaagacatggcccctgcccycaaggagttcacactaaggggtgaactacacagaaacaaataattatttaacaatacaccaagtatgttaacagaagtatgtataaggacaatggggacaaagaggagaaagtacttgtgattttgttcctcatatgacacattattattagaatgggagatgagaattatgtacttggtcattcaacaaatactgactatgcccctctcatgggtaagcacagtgaaatcacagtgagatcagaataatcctttggaattccaggggcacgtgaccttctctcatccccctcaagaact

SEQ ID NO: 156088 - DNA, 601 bp, Human
ggaaatttaaatgctacagtgatttggggtgattcacacaggcattctgtataaattaagcaaaaatgaatgtatttatcaataattacagataaactcaccaaaagtacagccaaagccctttggagtatgacataatttagcaataaaatcaggtggtgtacctaagggacagactataacatacatactctttaaatcccagtgacctcttcccaggggttaaatcagaggagtcatatcaaatccaagaaatatcatctttgaatatatttcaaaagcctcaaatgattaaacccartgaccttttaataaatgtaaaataaatacacaaggatatcagctctaggtctgccttactccttcccttccttccacagccatttgtcaataatcaactaagttactgataaacagaggctaggttcttgggatacaaaggtaagacatggcccctgccctcaaggagttcacactaaggggtgaactacacagaaacaaataattatttaacaatacaccaagtatgttaacagaagtatgtataaggacaatggggacaaagaggagaaagtacttgtgattttgttcctcatatgac

SEQ ID NO: 156089 - DNA, 601 bp, Human
agtccatagctataccatgagatggaaatttaaatgctacagtgatttggggtgattcacacaggcattctgtataaattaagcaaaaatgaatgtatttatcaataattacagataaactcaccaaaagtacagccaaagccctttggagtatgacataatttagcaataaaatcaggtggtgtacctaagggacagactataacatacatactctttaaatcccagtgacctcttcccaggggttaaatcagaggagtcatatcaaatccaagaaatatcatctttgaatatatttcaraagcctcaaatgattaaacccaatgaccttttaataaatgtaaaataaatacacaaggatatcagctctaggtctgccttactccttcccttccttccacagccatttgtcaataatcaactaagttactgataaacagaggctaggttcttgggatacaaaggtaagacatggcccctgccctcaaggagttcacactaaggggtgaactacacagaaacaaataattatttaacaatacaccaagtatgttaacagaagtatgtataaggacaatggggacaaagaggagaaagtact

SEQ ID NO: 156090 - DNA, 601 bp, Human
ggcagacttcctagtccatagctataccatgagatggaaatttaaatgctacagtgatttggggtgattcacacaggcattctgtataaattaagcaaaaatgaatgtatttatcaataattacagataaactcaccaaaagtacagccaaagccctttggagtatgacataatttagcaataaaatcaggtggtgtacctaagggacagactataacatacatactctttaaatcccagtgacctcttcccaggggttaaatcagaggagtcatatcaaatccaagaaatatcatctttraatatatttcaaaagcctcaaatgattaaacccaatgaccttttaataaatgtaaaataaatacacaaggatatcagctctaggtctgccttactccttcccttccttccacagccatttgtcaataatcaactaagttactgataaacagaggctaggttcttgggatacaaaggtaagacatggcccctgccctcaaggagttcacactaaggggtgaactacacagaaacaaataattatttaacaatacaccaagtatgttaacagaagtatgtataaggacaatggggacaaaga

SEQ ID NO: 156091 - DNA, 601 bp, Human
actcttgctcagaccatagtggtaatgacagaatgggagatatcactcactgatagagtagactattctgtaagatgacaaggtcagtaaaagcagtaaataagggtgtgcttacaacaaagatggaattcacaatgtatgttgacccgaatttaaaaacaagaaatagaattatggaggaaaatcgaattgttataacccctagaaacaaaaacagcatccagcacaattgtgagtgcacagtgcataccacaagagatgtgagctaaatgtggtataatatgagagtatagtgggcctsaagaagaaagtaaaaagtggagagatacagcatttcatattatttttattgattcagagggtacatgtgtaggtctgttacatagatatattgtgtgatggtgaggtttgggcttctagcatacctgtaaccataatagtgaagattgtactcaataggcaatttttcaatcttcatcctcttctcactctccccgcttttagagtccccagtgtctattatttccctatgtatgtccatgtgtaaccattgtttggctcccacttacaagtgagaacacagcatttaatattatcggag

SEQ ID NO: 156092 - DNA, 601 bp, Human
aaggccattacaagagaatatattatacaacatacacactatttcttcagcctggaatactattctatgttttgttttttttaacatatcctccaatacttggagcagatttcatatctaacaggaggctcatctgattcttgtgctgaaacccaataaggatcaacctcctagcatttacttcctgataggggctttcatgaaacccaggaaggatcaatctcctagcatttactttctgatgtcaatttcgataacaatttttcctggagaatgttaaattctttgagaatgaggagtrtgtcttatttagccgtagtgcctagaacagtgaatggcacaaacaggccttcaataaatgtatgttaacctgagaaggaccaaaattatcaatgtgagaagaagccaggcactgtggcgtgcacctgccatcccaattactggaagctgaagcaggaggattgcttcagcaatttgtttattatacaacaaagttatttttaccccagtaaaatgactaaaaattgcattagcctaaggtatcaatgtcagtatcagtttctgttacagaaaatcatcatgtaaacactagaacaatgaa

SEQ ID NO: 156093 - DNA, 601 bp, Human
atttcccccccagaatgaatacatccacaacattttgcaaacaatttcagccagtcagtccatggactaaccctatgaataaatttcaaactcctaaatttggcataaaataattatatgacttgagccttagctacctttccatgctcatctgcaattctctaatgtctttttaagctatgctatatcaaattccatgtagtttccctacatggaattagggattgctcctgtgagtagctactacactgtagcctgggcaacatagtgagactccatctcaggaaacaaagacaaaaayaaaaaaccaaggtaaagagctaagagaatggatacataatatccctcaaatgagaagacaaactggaatactagcaaataaaattgaatacttgcaatgtgtaattatccacaaaggccattacaagagaatatattatacaacatacacactatttcttcagcctggaatactattctatgttttgttttttttaacatatcctccaatacttggagcagatttcatatctaacaggaggctcatctgattcttgtgctgaaacccaataaggatcaacctcctagcatttacttcctg

SEQ ID NO: 156094 - DNA, 601 bp, Human
ttccattcattgcactgacagctctgtacatcacatttcttgtaatatgaaacatggatatggttatgccttacttcactctaattagtgaacagtatgggcatttacttaaacttttcactgcaaatattctcaacaatttttttttattgtggacaactttgagatctaataagctacggaccatttcccccccagaatgaatacatccacaacattttgcaaacaatttcagccagtcagtccatggactaaccctatgaataaatttcaaactcctaaatttggcataaaataattrtatgacttgagccttagctacctttccatgctcatctgcaattctctaatgtctttttaagctatgctatatcaaattccatgtagtttccctacatggaattagggattgctcctgtgagtagctactacactgtagcctgggcaacatagtgagactccatctcaggaaacaaagacaaaaacaaaaaaccaaggtaaagagctaagagaatggatacataatatccctcaaatgagaagacaaactggaatactagcaaataaaattgaatacttgcaatgtgtaattatccacaaa

SEQ ID NO: 156095 - DNA, 601 bp, Human
ctaaaacacaccaaccaattccccgcataagggctttagcaagtgctattttctcggcctggagtcaactaccttcttcctcagctgacactcatttcaggcctcagttcaaatgccatttgctaaaggaaacctttcttaatcccctatctacaccaggttccccgattacaactcatcctgtctttcactacacagcaataatcagaatttatacttgtccatttccttttgtgattatctgattaatgtctgccttcctcattagactatgagccctgaatggaatgtgtgtctgaayaggagctcttgttcattactgtctcctcagtgcttaccaatttctggtgtataggaaaagttcagtgaaatgttcaatgaatgaatttacggtttagttttggctacagaagtcttcctggcaacttccattcattgcactgacagctctgtacatcacatttcttgtaatatgaaacatggatatggttatgccttacttcactctaattagtgaacagtatgggcatttacttaaacttttcactgcaaatattctcaacaatttttttttattgtggacaactttgagatctaataa

SEQ ID NO: 156096 - DNA, 601 bp, Human
taaaaactataaacctgattatgtcaatgcccattcccctcaagggttgcctcctgatgttttgaggataaagatccatattcttaaaatagcccacaaagccctgcatggcccaatctctatttctccagtgtcacctcaggcttttttttttttttttttgcattttatatttcttctttccttttctaaaacacaccaaccaattccccgcataagggctttagcaagtgctattttctcggcctggagtcaactaccttcttcctcagctgacactcatttcaggcctcagttcaartgccatttgctaaaggaaacctttcttaatcccctatctacaccaggttccccgattacaactcatcctgtctttcactacacagcaataatcagaatttatacttgtccatttccttttgtgattatctgattaatgtctgccttcctcattagactatgagccctgaatggaatgtgtgtctgaataggagctcttgttcattactgtctcctcagtgcttaccaatttctggtgtataggaaaagttcagtgaaatgttcaatgaatgaatttacggtttagttttggctacagaag

SEQ ID NO: 156097 - DNA, 601 bp, Human
tcagtccattttccacatggtaactggagagacctcttaaaaactataaacctgattatgtcaatgcccattcccctcaagggttgcctcctgatgttttgaggataaagatccatattcttaaaatagcccacaaagccctgcatggcccaatctctatttctccagtgtcacctcaggcttttttttttttttttttgcattttatatttcttctttccttttctaaaacacaccaaccaattccccgcataagggctttagcaagtgctattttctcggcctggagtcaactaccttyttcctcagctgacactcatttcaggcctcagttcaaatgccatttgctaaaggaaacctttcttaatcccctatctacaccaggttccccgattacaactcatcctgtctttcactacacagcaataatcagaatttatacttgtccatttccttttgtgattatctgattaatgtctgccttcctcattagactatgagccctgaatggaatgtgtgtctgaataggagctcttgttcattactgtctcctcagtgcttaccaatttctggtgtataggaaaagttcagtgaaatgttc

SEQ ID NO: 156098 - DNA, 601 bp, Human
ttttatgaatttataacaacccataaattaaagtacatggtatcaatgtattttcagttgttatactattatttaacaaatctatcccaacctgacccccttcagtccattttccacatggtaactggagagacctcttaaaaactataaacctgattatgtcaatgcccattcccctcaagggttgcctcctgatgttttgaggataaagatccatattcttaaaatagcccacaaagccctgcatggcccaatctctatttctccagtgtcacctcaggctttttttttttttttttttcattttatatttcttctttccttttctaaaacacaccaaccaattccccgcataagggctttagcaagtgctattttctcggcctggagtcaactaccttcttcctcagctgacactcatttcaggcctcagttcaaatgccatttgctaaaggaaacctttcttaatcccctatctacaccaggttccccgattacaactcatcctgtctttcactacacagcaataatcagaatttatacttgtccatttccttttgtgattatctgattaatgtctgccttcctcattagactatga

SEQ ID NO: 156099 - DNA, 601 bp, Human
catggagaaactaatgcctagacacattttatgaatttataacaacccataaattaaagtacatggtatcaatgtattttcagttgttatactattatttaacaaatctatcccaacctgacccccttcagtccattttccacatggtaactggagagacctcttaaaaactataaacctgattatgtcaatgcccattcccctcaagggttgcctcctgatgttttgaggataaagatccatattcttaaaatagcccacaaagccctgcatggcccaatctctatttctccagtgtcayctcaggcttttttttttttttttttgcattttatatttcttctttccttttctaaaacacaccaaccaattccccgcataagggctttagcaagtgctattttctcggcctggagtcaactaccttcttcctcagctgacactcatttcaggcctcagttcaaatgccatttgctaaaggaaacctttcttaatcccctatctacaccaggttccccgattacaactcatcctgtctttcactacacagcaataatcagaatttatacttgtccatttccttttgtgattatctgattaa

SEQ ID NO: 156100 - DNA, 601 bp, Human
aaggattggagctgctgcctccaggtctcagaggatcaattattcagctcatttgtaggggagtccaagctttgagaattacaagttcagcctcatcattttccacatggagaaactaatgcctagacacattttatgaatttataacaacccataaattaaagtacatggtatcaatgtattttcagttgttatactattatttaacaaatctatcccaacctgacccccttcagtccattttccacatggtaactggagagacctcttaaaaactataaacctgattatgtcaatgccsattcccctcaagggttgcctcctgatgttttgaggataaagatccatattcttaaaatagcccacaaagccctgcatggcccaatctctatttctccagtgtcacctcaggcttttttttttttttttttgcattttatatttcttctttccttttctaaaacacaccaaccaattccccgcataagggctttagcaagtgctattttctcggcctggagtcaactaccttcttcctcagctgacactcatttcaggcctcagttcaaatgccatttgctaaaggaaacctttcttaatc

SEQ ID NO: 156101 - DNA, 601 bp, Human
ggttaaggattggagctgctgcctccaggtctcagaggatcaattattcagctcatttgtaggggagtccaagctttgagaattacaagttcagcctcatcattttccacatggagaaactaatgcctagacacattttatgaatttataacaacccataaattaaagtacatggtatcaatgtattttcagttgttatactattatttaacaaatctatcccaacctgacccccttcagtccattttccacatggtaactggagagacctcttaaaaactataaacctgattatgtcaaygcccattcccctcaagggttgcctcctgatgttttgaggataaagatccatattcttaaaatagcccacaaagccctgcatggcccaatctctatttctccagtgtcacctcaggcttttttttttttttttttgcattttatatttcttctttccttttctaaaacacaccaaccaattccccgcataagggctttagcaagtgctattttctcggcctggagtcaactaccttcttcctcagctgacactcatttcaggcctcagttcaaatgccatttgctaaaggaaacctttctt

SEQ ID NO: 156102 - DNA, 601 bp, Human
gattcgggaaaaggatcttggagtatgtcctcgtcattccctgaatacttgggccaagactgctgtctacgaggccatcaatgctgatatgctgagtgtcctcataaaggatgttgtcaattaaacccaaggaattacagtactctttacaagaaaaacaaaccacagaatattttatttcttgggaagttcctattgctatacttcatacacatttcagttagaaaagctccaagacaaaaataatagagttagaaaatagaaataaaaattttttagaagatggaatgccttttttttwataaggacagatgagaaaagtgaaaaagctcttagattggataaaagctgagagaatacataatcagaattcatgagataatgaagtgaatagctgggatggactttgtcacttaaaattggaaagaaattgtgaaagcatatgctgaggtaatttaagatttaagagaaaattacttcatatattgcttcatttaatttttactgtgaaatgtcattatttctactcttcaagtagataaaatgagtctgagaaaggtaatttttcctaagtcatgaagttggtaggaggagaagctgg

SEQ ID NO: 156103 - DNA, 601 bp, Human
gtcttgggtaggtcctagacgtccacattttcaaagagcttcacagacacttctgatgtccactggggttgaaagccactgccctagtattgtttataaggactaaataagatcctttatacatagtgctcaataaacattaaccctaatctcatcttttcctttctctgtgcctcagaggaatgacaaactgaaattagaaatgcagatcttgttgacaaatgatttacaataaagtttctggatgaagaaaaaaaaagaaaactactgtcctagatagttagtcaaagtaggtgcctcmgaaatcagagcccaaaccaagcccatctgatatcattatatgtgatctggggaaagaataaaacccctcacttaatttggcatttactagtatccacagtaccttggaggcacttaacatggataatgtgccaaggagacaggtaggcctcaaaagatgaagtggggaatatgggcagaaaagcagagtaaacttcaacaggattaccttgggtattgataaggaaataaagcaggcttacaagatgagttttataaacaataaacagtgattcgggaaaaggatcttggagtatgtcct

SEQ ID NO: 156104 - DNA, 601 bp, Human
cattaggtcttgggtaggtcctagacgtccacattttcaaagagcttcacagacacttctgatgtccactggggttgaaagccactgccctagtattgtttataaggactaaataagatcctttatacatagtgctcaataaacattaaccctaatctcatcttttcctttctctgtgcctcagaggaatgacaaactgaaattagaaatgcagatcttgttgacaaatgatttacaataaagtttctggatgaagaaaaaaaaagaaaactactgtcctagatagttagtcaaagtaggygcctccgaaatcagagcccaaaccaagcccatctgatatcattatatgtgatctggggaaagaataaaacccctcacttaatttggcatttactagtatccacagtaccttggaggcacttaacatggataatgtgccaaggagacaggtaggcctcaaaagatgaagtggggaatatgggcagaaaagcagagtaaacttcaacaggattaccttgggtattgataaggaaataaagcaggcttacaagatgagttttataaacaataaacagtgattcgggaaaaggatcttggagta

SEQ ID NO: 156105 - DNA, 601 bp, Human
gattattgtgtgtaatccttacaaccacctttatgacattggtattattagtcccattttcagttcatgagactcaagttttttgagctaataatttgcctaaagacatatcactttgttaaatgtctctggttcagcctgtgctggttcagagctcacactagggatgtagcctggctgttggaatttgactcctagccctgccatctcctggccaggtaaccttgagcaagttacttaacttctttgttcctcagattccacatctataatgtaacaatacctactatgtaggtttgtwgtgaagtttaaatgaggaattatatggaagacatttaaaatagtgtccagcataaatattgcataataaatatcactattattggtttccaaatattctcctaatgttatggcccatcctgctgtatgtcactgaacccaagtatctctgaataactccatcaagtgctgacagccagaactgtcaattccagcttatcagatgatagcatacataattattcaagtcatgaacagcagaggcagactaagaaaactttgaaaactaagatagtaaacagacgtgagaaccaaatgcaat

SEQ ID NO: 156106 - DNA, 601 bp, Human
tatactgcagaaaatgaaacataatagatggagaagtccatgcctaccataaacctttgaaacctttgcctagagcaggcctttcttttctttcatttgcaaatttctcctgagccacctactatgtacccagcactgacaatgaaatgttggggtggggtagaggtagggggtcacaggggagtgtccaaacacactaggtcctcatgaaatttttacttttgtacttctaaacgtcttacatggtctaaactattctcatcgataccacttccttcccctccttcttctgccattcatktaacatattcaacatatccaacggataatgatacttgactacctataagattaagttgaaggctcgttctgtctttatcaccattaaatttaaataagaacaatagcttacatttatttactactttatagtgcatagtctaatttcacatataaatctcatttccttcccaatagctttgtgaagcttgttattctttcattagtgtatcagacactttagaggtggaatgcaggcatctattttccaatggtttttaatgttgattgagtatcagaaatgcctatggagttatatttt

SEQ ID NO: 156107 - DNA, 601 bp, Human
agcaagagaatagtataatagtataatacaactcaggttatactgcagaaaatgaaacataatagatggagaagtccatgcctaccataaacctttgaaacctttgcctagagcaggcctttcttttctttcatttgcaaatttctcctgagccacctactatgtacccagcactgacaatgaaatgttggggtggggtagaggtagggggtcacaggggagtgtccaaacacactaggtcctcatgaaatttttacttttgtacttctaaacgtcttacatggtctaaactattctcatygataccacttccttcccctccttcttctgccattcatgtaacatattcaacatatccaacggataatgatacttgactacctataagattaagttgaaggctcgttctgtctttatcaccattaaatttaaataagaacaatagcttacatttatttactactttatagtgcatagtctaatttcacatataaatctcatttccttcccaatagctttgtgaagcttgttattctttcattagtgtatcagacactttagaggtggaatgcaggcatctattttccaatggtttttaatg

SEQ ID NO: 156108 - DNA, 601 bp, Human
acaagtcctgtcaaatacttaattccttacacaatataaagggattgagtttttcaaagataggctgactacttggaatgaaaagcatttaaatactgaagagagaaaaaggattctcttttcaacccttcatattctcggaaggaaaactgaaataccgagttagtatgtcctcaaccctggttaatttcccttgcaaacaaagagggacaggccttggtgtcagaagctttgccataagatgttacctagctaggatttttaaactggttttcattgtattttattaccttcaattaasaatagtttaaaacaagtagttttccatttatagcagtaaaataaatttgttcaagtatagcactgaatggatttaaagaaaaatagtaaaatttcaggtggtaaatatgataaaaagcatggaagtgataaatggttggctaaaatttaggactctgcttgacagtatagcattttaggccaggcacagtggctcatgcctgtatcctaacactttaagagtctgaggttggaggatcacttgagcccaggagttcaagatcagcctagacaacataaggagatccccccgtctctacaa

SEQ ID NO: 156109 - DNA, 601 bp, Human
tgtcttgcagaaacatcagctcattttgtaaggtgtatgtgatatttaaatttgtgatgcttgtgaataagggaatggggctttaggtctgaggaaaggggagcattcattcaaactggagggtattttgcatttttaaggctgctataaggtcacgaccttggtgagacttgacctgttttcgtatgtattgtgtactttctgttctaagccattgtgtgtgtctgtaactttctccaagattctctccaaatcttgcttctcttaatttctccagattgtgccaacctatttcccactmctgatctttagtgttatatcaccactaggagactggggaatgtggtttgtgttcttagactcaacagatacctaccatatgccaagcattcttctaacagctagtgagagatctatcagtgaacaaaacagacaaaactccatcttttttcctctgctgctcatattctagtgttaaccatttgcatatttctcagactcttcaatacatttattatttctttttaatcagtttattctgaccctcagtagatgacatatttcatgggtgtagggacagtgccatctatctcccttgggg

SEQ ID NO: 156110 - DNA, 601 bp, Human
tggtcttttccacttaacagagtccaagaggttggtcaggacttcagacactggcataccccttcccaaagacactaaaagttaatcaatcaatcagaggcagagaatcgatgaagctccagtttgaagttccatttaaaaaaatcatcttgcagtgctactgctacttcactcagtttagaaaacatgaagtgttggttcctgctattgcttcactagacatatgtgttaaaaaaaaaagttgttagcacttcagtttttaaaaaatgaggttaggtttgtggttcagtaaattaaggtycataccttgctttttggttcagggattggcctaagtccttatttagctgtatttaaaaattagccttagtgtgaaagaagataaaaatcagctttccaaaaaacattttccagctataattattaaagatttagtatcacttaactaacatgggaaatgcccacactaaaatcagggcattgtatttctgaaacggaaacctttcgcaaagcctgtgcaggcagaggagctcacacacatccttgacgtggcactgtgtcttcaggggtgctgccctcttacagagagacagacctggag

SEQ ID NO: 156111 - DNA, 601 bp, Human
tatccaagatcttgaagaagtattgaacctgaaacggagaaacacataatttcttagttcagacaaattttggtcttttccacttaacagagtccaagaggttggtcaggacttcagacactggcataccccttcccaaagacactaaaagttaatcaatcaatcagaggcagagaatcgatgaagctccagtttgaagttccatttaaaaaaatcatcttgcagtgctactgctacttcactcagtttagaaaacatgaagtgttggttcctgctattgcttcactagacatatgtgttaaaaaaaaaagttgttagcacttcagtttttaaaaaatgaggttaggtttgtggttcagtaaattaaggttcataccttgctttttggttcagggattggcctaagtccttatttagctgtatttaaaaattagccttagtgtgaaagaagataaaaatcagctttccaaaaaacattttccagctataattattaaagatttagtatcacttaactaacatgggaaatgcccacactaaaatcagggcattgtatttctgaaacggaaacctttcgcaaagcctgtgcaggcagaggagc

SEQ ID NO: 156112 - DNA, 601 bp, Human
ttccacaccactaattatccaagatcttgaagaagtattgaacctgaaacggagaaacacataatttcttagttcagacaaattttggtcttttccacttaacagagtccaagaggttggtcaggacttcagacactggcataccccttcccaaagacactaaaagttaatcaatcaatcagaggcagagaatcgatgaagctccagtttgaagttccatttaaaaaaatcatcttgcagtgctactgctacttcactcagtttagaaaacatgaagtgttggttcctgctattgcttcastagacatatgtgttaaaaaaaaaagttgttagcacttcagtttttaaaaaatgaggttaggtttgtggttcagtaaattaaggttcataccttgctttttggttcagggattggcctaagtccttatttagctgtatttaaaaattagccttagtgtgaaagaagataaaaatcagctttccaaaaaacattttccagctataattattaaagatttagtatcacttaactaacatgggaaatgcccacactaaaatcagggcattgtatttctgaaacggaaacctttcgcaaagcctg

SEQ ID NO: 156113 - DNA, 601 bp, Human
aggttaaaacaacggacaataaaagaatgaacacattcctcgtgtgtgattcactcttgtctaaatgtcccaacctgtgacttctttactttccacaccactaattatccaagatcttgaagaagtattgaacctgaaacggagaaacacataatttcttagttcagacaaattttggtcttttccacttaacagagtccaagaggttggtcaggacttcagacactggcataccccttcccaaagacactaaaagttaatcaatcaatcagaggcagagaatcgatgaagctccagtttsaagttccatttaaaaaaatcatcttgcagtgctactgctacttcactcagtttagaaaacatgaagtgttggttcctgctattgcttcactagacatatgtgttaaaaaaaaaagttgttagcacttcagtttttaaaaaatgaggttaggtttgtggttcagtaaattaaggttcataccttgctttttggttcagggattggcctaagtccttatttagctgtatttaaaaattagccttagtgtgaaagaagataaaaatcagctttccaaaaaacattttccagctataattatta

SEQ ID NO: 156114 - DNA, 601 bp, Human; identical to SEQ ID NO: 22817

SEQ ID NO: 156115 - DNA, 601 bp, Human
acagagccacagaggagtctgtctcccacagacactccccatcccaggtttttgtcctgtcatgtagtctgctcagcagcagccctgctccacccagagcatgcagtggtgaggtttggggtgggatttgcccaggctttggttactgatattccttgagagtctagcagcccccaggaggagggatatgcagagatgttcccagccccagtgcagtgcagggactggcccttaccattccatgccagccctgttgatctcctcccaccagcactccgtgggttccccgaggctctgtggygtgggcatgcaggcgtagttccattgtctgtcagaaccttccttcttgctgaagatgctcctcacggccactatcacctgcccctggggacactggtagctgaagccttgccggttcaaattcacccacccatcatcgctgtagtcatgatactgctggtatgggtatccataatcgccatactggccccaggccatggtgactaggggcagaagtacccagagaagactgaggtccatgctgcctgggattttggcaaacaatgtcactctaagattgctggtctgaccgttttatata

SEQ ID NO: 156116 - DNA, 601 bp, Human
tatttttcttgttcccaaactactgtgggccagtacttttgtaaaatggtaaaaataaatttctaaaaaagaaaaatgccattccgatggcacagaaagttttaatttctataaagtttattactttcagtttctgtacatatcttttggtagtctggtaagcaagcttctcgccgacctacaccagcccctggcccaaactgagagtaggtagaacagcttctggaaggaacagagccacagaggagtctgtctcccacagacactccccatcccaggtttttgtcctgtcatgtagtcygctcagcagcagccctgctccacccagagcatgcagtggtgaggtttggggtgggatttgcccaggctttggttactgatattccttgagagtctagcagcccccaggaggagggatatgcagagatgttcccagccccagtgcagtgcagggactggcccttaccattccatgccagccctgttgatctcctcccaccagcactccgtgggttccccgaggctctgtggtgtgggcatgcaggcgtagttccattgtctgtcagaaccttccttcttgctgaagatgctcctcacggcc

SEQ ID NO: 156117 - DNA, 601 bp, Human
ctttaaattcaggcagagagaaggacctcagtactcataattgagagagcacatttaatcaaggcagtagacagctatttaattccactttcttttgcctaaatgtccttgtcccctcttttccattcacttgctctaaatcaatagttctcaaaccctccgtgctgagagatcaattgtttatttttcttgttcccaaactactgtgggccagtacttttgtaaaatggtaaaaataaatttctaaaaaagaaaaatgccattccgatggcacagaaagttttaatttctataaagtttmttactttcagtttctgtacatatcttttggtagtctggtaagcaagcttctcgccgacctacaccagcccctggcccaaactgagagtaggtagaacagcttctggaaggaacagagccacagaggagtctgtctcccacagacactccccatcccaggtttttgtcctgtcatgtagtctgctcagcagcagccctgctccacccagagcatgcagtggtgaggtttggggtgggatttgcccaggctttggttactgatattccttgagagtctagcagcccccaggaggagggatat

SEQ ID NO: 156118 - DNA, 601 bp, Human
tcctgaccaagcacctgggctgagacccagctgagacaatcacaccccacaaaaaagtacaagctcgaaaaaattccatgccactgcttagggcagaatgcagtcaggggaagacagcacctctctccaaaaccctttagtaaactattttccagcaataaaacccactttaaattcaggcagagagaaggacctcagtactcataattgagagagcacatttaatcaaggcagtagacagctatttaattccactttcttttgcctaaatgtccttgtcccctcttttccattcacttgytctaaatcaatagttctcaaaccctccgtgctgagagatcaattgtttatttttcttgttcccaaactactgtgggccagtacttttgtaaaatggtaaaaataaatttctaaaaaagaaaaatgccattccgatggcacagaaagttttaatttctataaagtttattactttcagtttctgtacatatcttttggtagtctggtaagcaagcttctcgccgacctacaccagcccctggcccaaactgagagtaggtagaacagcttctggaaggaacagagccacagaggagtctgt

SEQ ID NO: 156119 - DNA, 601 bp, Human
ctttctagccgaggaaatactggatctctagactgcagtttgtctacctataaatggcatatacccttgttttgagcattacacgagatgatccacataaagcacttagcatggagcctgctcagggtaagcactcaataaatggtagctgttgtcattacttaaaggcccgctctctttcctggctcccccacccatcggtgtttcttcctcttggatttcccatcatcacctctctactggttgtgtcccccagggttctatgctttttcttttttctattttctttttttttttttttgaggcagagtcttgctctgccacccaggagggaatacagtggtgcgagcatggctcactgcagcctcgactccctgggctcaagtgatcctcctaccttagcctcctgagtagctgggaccacaggctgcatgcaactacaccgggctaatttcttttttttctgtagagatagggtctggctgtgttccctaggctggtctcgaactcttgatctcaagtgatcctccctccccagcctcccaaagtgtttgggattacaggcgtgagccaccacacctggccagattttgtgcttgac

SEQ ID NO: 156120 - DNA, 601 bp, Human
tggcactggctctgctgacagagtcagctgtcgggtgggagcccactctgggtggaggcagcagcctctcaggagcccgtcactgtggcaaagtacaaactctttgaagcaaagactctgtggatccaaaccccagctttctagccgaggaaatactggatctctagactgcagtttgtctacctataaatggcatatacccttgttttgagcattacacgagatgatccacataaagcacttagcatggagcctgctcagggtaagcactcaataaatggtagctgttgtcattacttaraggcccgctctctttcctggctcccccacccatcggtgtttcttcctcttggatttcccatcatcacctctctactggttgtgtcccccagggttctatgctttttcttttttctattttctttttttttttttttgaggcagagtcttgctctgccacccaggagggaatacagtggtgcgagcatggctcactgcagcctcgactccctgggctcaagtgatcctcctaccttagcctcctgagtagctgggaccacaggctgcatgcaactacaccgggctaatttcttttttttct

SEQ ID NO: 156121 - DNA, 601 bp, Human
agtcctggtaaccaagtagggatcatccctctggggctgggcttctgctgtggtcttgcaggtccccaccctctccaggaggaagaactgccctgaatctggtcctgtggcactggctctgctgacagagtcagctgtcgggtgggagcccactctgggtggaggcagcagcctctcaggagcccgtcactgtggcaaagtacaaactctttgaagcaaagactctgtggatccaaaccccagctttctagccgaggaaatactggatctctagactgcagtttgtctacctataaatggsatatacccttgttttgagcattacacgagatgatccacataaagcacttagcatggagcctgctcagggtaagcactcaataaatggtagctgttgtcattacttaaaggcccgctctctttcctggctcccccacccatcggtgtttcttcctcttggatttcccatcatcacctctctactggttgtgtcccccagggttctatgctttttcttttttctattttctttttttttttttttgaggcagagtcttgctctgccacccaggagggaatacagtggtgcgagcatggctca

SEQ ID NO: 156122 - DNA, 601 bp, Human
tggcccacaaaggctgtccaagcagcctccacagccccggcaccctcacctgctgctgcctgtgtgagtcctctccccaccccttctacagtccggctgagcccctccacagtcctggtaaccaagtagggatcatccctctggggctgggcttctgctgtggtcttgcaggtccccaccctctccaggaggaagaactgccctgaatctggtcctgtggcactggctctgctgacagagtcagctgtcgggtgggagcccactctgggtggaggcagcagcctctcaggagcccgtcacygtggcaaagtacaaactctttgaagcaaagactctgtggatccaaaccccagctttctagccgaggaaatactggatctctagactgcagtttgtctacctataaatggcatatacccttgttttgagcattacacgagatgatccacataaagcacttagcatggagcctgctcagggtaagcactcaataaatggtagctgttgtcattacttaaaggcccgctctctttcctggctcccccacccatcggtgtttcttcctcttggatttcccatcatcacctctctactggttgtg

SEQ ID NO: 156123 - DNA, 601 bp, Human
gagcctggtctctgaatcagcatctgtcagaaggggttttgaataactaaatctgctcaccagaggccatgggggtggatgagaatggcccacaaaggctgtccaagcagcctccacagccccggcaccctcacctgctgctgcctgtgtgagtcctctccccaccccttctacagtccggctgagcccctccacagtcctggtaaccaagtagggatcatccctctggggctgggcttctgctgtggtcttgcaggtccccaccctctccaggaggaagaactgccctgaatctggtccwgtggcactggctctgctgacagagtcagctgtcgggtgggagcccactctgggtggaggcagcagcctctcaggagcccgtcactgtggcaaagtacaaactctttgaagcaaagactctgtggatccaaaccccagctttctagccgaggaaatactggatctctagactgcagtttgtctacctataaatggcatatacccttgttttgagcattacacgagatgatccacataaagcacttagcatggagcctgctcagggtaagcactcaataaatggtagctgttgtcattactt

SEQ ID NO: 156124 - DNA, 601 bp, Human
cagtgccctacagcctgtgctgacccaagttagagcagattccctgagaacaacctaggcatgccctgggatggtgaaataccactcatggggacccaggtaaggcctcctggtagttgttagtgccagagaccatcatccaaacttcagaagccggcacttgaagaggtgattttcaacagagaaactgtgatcaatggcagcaccacagaccactcagctatgatggcaacaccttttaaagatggcactttgattagaaagattttctttttagcagatcctatgtgctattgtcaarcctatattcgagactcctcccctcttttaaaataaacctgaaagctaatttggttatacaaggcagcccaactgcacaaaaccatcaacaactgttccctgagaacagactaagcctgtagccaacgtcagatgtaatagctccccagcccataagcaatttctttccttacagatttttcactgagactggaggctgaactcaaaggcataatcatttttaaaagtgcttccagggtaattcgtgtcagtcctggggcagctggatcttattgtaaagaagttgttttgcatgtttgtg

SEQ ID NO: 156125 - DNA, 601 bp, Human
gactgccctgaactacactgaggcttggtcttgcttagattagggaaatagtccgaccatggaaaacggagttcccacccaacctctccaccttcaaatgcacctcgatgctgccatagccctgttgcatagattctttctcctcttctccagtctgtggcttgtcattgaattcataaactcagctctaacacaaactgccactccaaaacttctccttgagattctttgaagcccggggtaaaaagtagataccaataaatggaacacttttcctctgaactcagactccgtggaaagytggcttgcccaacatcagccacatcaatttcagattcactaaacttttactacctgcccatgatgtgctaggcatttgttttagacttcaatttgctttagagttttcttatactttatcctacaagtatcacagtaacacaagtagcagcttgtgaggtgggagtcacaccttcctttttcttcctttgcttttctttcctttccattcctttcctttcctttcctttcctttcctttcctttcctttcctttctctttcccttcctttcttccttccttctttccttccttccttcaa

SEQ ID NO: 156126 - DNA, 601 bp, Human
taacctgacagcaatgtttttattcagtttttaattgcttcagtctcatggcctttattcctattctgtgaggtaaggaggttgctctagattgtgcccaagaccccctccagtgctggaattccacgattctgttgtactatatttgtgctgcatccttatatttatttttttaaattttattttgaagtaatttcagatttacagaatgcttgtaaagacagcacacaaaattcatgtatactcttcacccaggttcctctaatgttaattttcataactctagagtgtctaggaatgytaagaaatgctaagaaattaaccttggtataacaccaaactgatttcatcagttcttccacaaatgtcaaaccaggataggttactgtgcagcatttagcccttatggcttttgaaataaagagtttactttcaatttttgaaattgatcgagaccttaagattattgagagaatgaaaacctgataaaaacttcattctgcggcggcaaagtgtgtcagccatcctctgtgcatgttttagcgatccttaagaaatcttgaaagaccatcctgcatgttggtaaatgcaataaatcaaa

SEQ ID NO: 156127 - DNA, 601 bp, Human
aaagttggcaagaatcctagatctgtcataaccctattctcccacactcagccttcttgccctcagaagtcatccttaggtggatttgatatcttttttaggtcagcactcactatggctttatccaggaacaaaaataacatcagcatttcatatcacccacagcactgtggaatcaggctggctggctcaggtcctccgtctgccatctgctagccatgcaagggcaacctcctcatgtgtgaaacacctggattccaatactgttgtgaagatcaaacaatattagcttttgaataamtcatgggcatagactgtatgttattcatctccatcttcctggggcctgggaaagtttgtgctaataagcatttggtagtgaatgaataaacaaatgaacatataaatgaggaatactctataaatcataaatcaccacgtagatcagggttagggccatagaacctatacttatgtaaagttatggatttctctcctaattccaaacagaattgctccatgacccatctctccccttctactgatatttatatctacttttgtaaaaagaggatgacagttcctaacctgacagcaatgt

SEQ ID NO: 156128 - DNA, 601 bp, Human
atttttgcagagctcaagttcccccagacaattgattcctagcacttaggagagtgacctagatggaaagttggcaagaatcctagatctgtcataaccctattctcccacactcagccttcttgccctcagaagtcatccttaggtggatttgatatcttttttaggtcagcactcactatggctttatccaggaacaaaaataacatcagcatttcatatcacccacagcactgtggaatcaggctggctggctcaggtcctccgtctgccatctgctagccatgcaagggcaacctcytcatgtgtgaaacacctggattccaatactgttgtgaagatcaaacaatattagcttttgaataactcatgggcatagactgtatgttattcatctccatcttcctggggcctgggaaagtttgtgctaataagcatttggtagtgaatgaataaacaaatgaacatataaatgaggaatactctataaatcataaatcaccacgtagatcagggttagggccatagaacctatacttatgtaaagttatggatttctctcctaattccaaacagaattgctccatgacccatctctccc

SEQ ID NO: 156129 - DNA, 601 bp, Human
tgtgttttagttgtgaaagctgagtatttcggagttgagacgacttgagtaaaggtagtagtggggtcagtggggctgcattttgagaattgttctgactctaaacttcattaacttttcaatacttcaagatccctcaaagaaacacacacacacacacacacacacacacgatatcttaactctgcagaaatctcttattgattgagaagattgtgtcctgcaggttcccagacagaagcaaatcccctcctgggaggagggagcttttgccatccttacaagagcagccaacaaccayttttgcagagctcaagttcccccagacaattgattcctagcacttaggagagtgacctagatggaaagttggcaagaatcctagatctgtcataaccctattctcccacactcagccttcttgccctcagaagtcatccttaggtggatttgatatcttttttaggtcagcactcactatggctttatccaggaacaaaaataacatcagcatttcatatcacccacagcactgtggaatcaggctggctggctcaggtcctccgtctgccatctgctagccatgcaagggcaacctcct

SEQ ID NO: 156130 - DNA, 601 bp, Human
gagcttctcaccacgatcaccattttacgtataaggaaacttaggtttagagaaggtaagtaattcccctaaggacacaagttaatgtacatatattatcttatttaattctcacaacaacagttctagggaggtgtgttttagttgtgaaagctgagtatttcggagttgagacgacttgagtaaaggtagtagtggggtcagtggggctgcattttgagaattgttctgactctaaacttcattaacttttcaatacttcaagatccctcaaagaaacacacacacacacacacacactcacacgatatcttaactctgcagaaatctcttattgattgagaagattgtgtcctgcaggttcccagacagaagcaaatcccctcctgggaggagggagcttttgccatccttacaagagcagccaacaaccatttttgcagagctcaagttcccccagacaattgattcctagcacttaggagagtgacctagatggaaagttggcaagaatcctagatctgtcataaccctattctcccacactcagccttcttgccctcagaagtcatccttaggtggatttgatatcttttttagg

SEQ ID NO: 156131 - DNA, 601 bp, Human
ggacttgcaatgtgcaggcattgtgcttagcactatgcgtgcattaattattttaattatcaaaacaatcctataaaatgggttcaaataatgagcttctcaccacgatcaccattttacgtataaggaaacttaggtttagagaaggtaagtaattcccctaaggacacaagttaatgtacatatattatcttatttaattctcacaacaacagttctagggaggtgtgttttagttgtgaaagctgagtatttcggagttgagacgacttgagtaaaggtagtagtggggtcagtgggrctgcattttgagaattgttctgactctaaacttcattaacttttcaatacttcaagatccctcaaagaaacacacacacacacacacacacacacacgatatcttaactctgcagaaatctcttattgattgagaagattgtgtcctgcaggttcccagacagaagcaaatcccctcctgggaggagggagcttttgccatccttacaagagcagccaacaaccatttttgcagagctcaagttcccccagacaattgattcctagcacttaggagagtgacctagatggaaagttggca

SEQ ID NO: 156132 - DNA, 601 bp, Human
tcatgataaagtaataataaataacctttatcaaggacttgcaatgtgcaggcattgtgcttagcactatgcgtgcattaattattttaattatcaaaacaatcctataaaatgggttcaaataatgagcttctcaccacgatcaccattttacgtataaggaaacttaggtttagagaaggtaagtaattcccctaaggacacaagttaatgtacatatattatcttatttaattctcacaacaacagttctagggaggtgtgttttagttgtgaaagctgagtatttcggagttgagaygacttgagtaaaggtagtagtggggtcagtggggctgcattttgagaattgttctgactctaaacttcattaacttttcaatacttcaagatccctcaaagaaacacacacacacacacacacacacacacgatatcttaactctgcagaaatctcttattgattgagaagattgtgtcctgcaggttcccagacagaagcaaatcccctcctgggaggagggagcttttgccatccttacaagagcagccaacaaccatttttgcagagctcaagttcccccagacaattgattcctag

SEQ ID NO: 156133 - DNA, 601 bp, Human
tagcaatttggttttcaactccagctttgtaatttaccaactgtgtgatacttgtctccatgagtctcagtttacacagagtagtcatgataaagtaataataaataacctttatcaaggacttgcaatgtgcaggcattgtgcttagcactatgcgtgcattaattattttaattatcaaaacaatcctataaaatgggttcaaataatgagcttctcaccacgatcaccattttacgtataaggaaacttaggtttagagaaggtaagtaattcccctaaggacacaagttaatgtacrtatattatcttatttaattctcacaacaacagttctagggaggtgtgttttagttgtgaaagctgagtatttcggagttgagacgacttgagtaaaggtagtagtggggtcagtggggctgcattttgagaattgttctgactctaaacttcattaacttttcaatacttcaagatccctcaaagaaacacacacacacacacacacacacacacgatatcttaactctgcagaaatctcttattgattgagaagattgtgtcctgcaggttcccagacagaagcaaatcccctcctggg

SEQ ID NO: 156134 - DNA, 601 bp, Human
aattatatgttccaaaagcaaaatgatatatttcagaggctctgtaatctagcaatttggttttcaactccagctttgtaatttaccaactgtgtgatacttgtctccatgagtctcagtttacacagagtagtcatgataaagtaataataaataacctttatcaaggacttgcaatgtgcaggcattgtgcttagcactatgcgtgcattaattattttaattatcaaaacaatcctataaaatgggttcaaataatgagcttctcaccacgatcaccattttacgtataaggaaactyaggtttagagaaggtaagtaattcccctaaggacacaagttaatgtacatatattatcttatttaattctcacaacaacagttctagggaggtgtgttttagttgtgaaagctgagtatttcggagttgagacgacttgagtaaaggtagtagtggggtcagtggggctgcattttgagaattgttctgactctaaacttcattaacttttcaatacttcaagatccctcaaagaaacacacacacacacacacacacacacacgatatcttaactctgcagaaatctcttattgattga

SEQ ID NO: 156135 - DNA, 601 bp, Human
gcgagaatgcctccaaaaatacaaattcctcagttttttttggaaaaatacaggcaggagaggcttcccctaaggcctctgagaagatctagattatcttgtgagatgcatttatgtcctgagagcaattccaggtcacacaggaattgcatgagctacattagcatcacagtaaatttgacgtgagtttatgaatatcaattataatatttttaaacaagagatctaatgctatctccgtgtctattaaaatgtaataaatattcaagacacttataatgtacacataatatttatagaytgtgattaaattatatgttccaaaagcaaaatgatatatttcagaggctctgtaatctagcaatttggttttcaactccagctttgtaatttaccaactgtgtgatacttgtctccatgagtctcagtttacacagagtagtcatgataaagtaataataaataacctttatcaaggacttgcaatgtgcaggcattgtgcttagcactatgcgtgcattaattattttaattatcaaaacaatcctataaaatgggttcaaataatgagcttctcaccacgatcaccattttacgtata

SEQ ID NO: 156136 - DNA, 601 bp, Human
tcatggggctacaatgcaaagtttttgaacactgcaccgtttactgctcatcctcctgccaccatggtggggatatgaacagtctctttaaatagtgttaagttgcacacattctgctctcttcctgcctgcatctgggtaagaattctgctgtcttctccatgtccaggttttaagtctgctagtctgtctacaaggttttaacagtgaagcagaaatgacctgcagaacagcatctctggatagaaagacctagcacaggacagagcgagaatgcctccaaaaatacaaattcctcagktttttttggaaaaatacaggcaggagaggcttcccctaaggcctctgagaagatctagattatcttgtgagatgcatttatgtcctgagagcaattccaggtcacacaggaattgcatgagctacattagcatcacagtaaatttgacgtgagtttatgaatatcaattataatatttttaaacaagagatctaatgctatctccgtgtctattaaaatgtaataaatattcaagacacttataatgtacacataatatttatagattgtgattaaattatatgttccaaaagcaaaatg

SEQ ID NO: 156137 - DNA, 601 bp, Human
aggtgtgtgagtgtctggttttgttggtgaacccctctatacaattttagaagttggacttgctaagaagtttggactttaggtggtgtggtgtggggttgagtcaagtgatgaacaaggtaaaaggaagcagcaccatcttggtcaagaactctcaaaatttcattaaatagataatagatgggctggttgtgctggtcttttttttcccagcttcacagacacacaggtgtttcaagggctgttagccagtttccaaccccactgcagagatggactatgagaagttttgcccatgatytagacaagtggctcactccatgtggcacagcatccttaacactcccaaatttctttcccgccccaaaggtggatgaggtcttaaatagtaccaaaagagtttctttcttttagagtaaagctttgatttttgttaattctattttccccagaataattctttgagttgctatcaggcatttataaaaaggcccacagaattttagaatgttcattaagtcttttgacaaatattcactagaacttactctatacctgatgctgcacttggtctggaatctcttcagaagactggtactga

SEQ ID NO: 156138 - DNA, 601 bp, Human
gagtaactggaagagccaggacccaactcagattcatctgaggtcaaagctcatgttcatgagctctcaagaaatataataaatctcttcgagatggtcccacagctctgattggtatgctggacaggacttcttcttgttgtctgcattctttaccaagtccaaagctattggacaggcagaattacagagcatttgcaaggtgtgtgagtgtctggttttgttggtgaacccctctatacaattttagaagttggacttgctaagaagtttggactttaggtggtgtggtgtggggttsagtcaagtgatgaacaaggtaaaaggaagcagcaccatcttggtcaagaactctcaaaatttcattaaatagataatagatgggctggttgtgctggtcttttttttcccagcttcacagacacacaggtgtttcaagggctgttagccagtttccaaccccactgcagagatggactatgagaagttttgcccatgatctagacaagtggctcactccatgtggcacagcatccttaacactcccaaatttctttcccgccccaaaggtggatgaggtcttaaatagtaccaaaagagt

SEQ ID NO: 156139 - DNA, 601 bp, Human
tgcaggggaaagagcccttgttgaggaatcagcagacatgagttctagtcctagccctgacctttacatgctttgtggagcctcacctaaggcactgtgtggagtcagtgataatgcctacaaaactctcggccaagagagtaactggaagagccaggacccaactcagattcatctgaggtcaaagctcatgttcatgagctctcaagaaatataataaatctcttcgagatggtcccacagctctgattggtatgctggacaggacttcttcttgttgtctgcattctttaccaagtcyaaagctattggacaggcagaattacagagcatttgcaaggtgtgtgagtgtctggttttgttggtgaacccctctatacaattttagaagttggacttgctaagaagtttggactttaggtggtgtggtgtggggttgagtcaagtgatgaacaaggtaaaaggaagcagcaccatcttggtcaagaactctcaaaatttcattaaatagataatagatgggctggttgtgctggtcttttttttcccagcttcacagacacacaggtgtttcaagggctgttagccagtttccaacccc

SEQ ID NO: 156140 - DNA, 601 bp, Human
ccattcctctcattttcacttttaacaaagctccttatttaacaagactcacctaaacactggccatagctgcaggattacaaacacagagctaggtgagaagagaggcaacttctaaatggaacaggactgggggaactgtcagggattgcattgctaaagttactcaaactcaatttcaaaagagatgggtagcggtcaaatgactaatgctctgactcacttcacagcacctggttgttgctcctgaatggcctggagaacagggcagtggctcaatgctctattccgcttggagggmaactacttggagggagtttcaggccccttcatggatgtgagtgaggagttcctaacagtcaccaatacgatggctaatatcctggtgaattgtataacatgaccgcagctctaaggaaataagactatttccttagagcaggagggcactggtaccttacttacaagactctccttcccatctgagaagacatactttttttttttcttaccacctctttgaaggctgaggttcaatttcagtttcagaaactggagtattgttagccctgctccatctgaaactggaagctttctagaa

SEQ ID NO: 156141 - DNA, 601 bp, Human
ttctatcctaattcttagtaaagtaggtgagaggtaatttcaatatgaagctctaagaatcataagcaaaactcatatgtgtccaaaaagagaaggttgccataagctagtgctctctgtgacctgttctcctaccatcactaaaatgctgccttcctctaaaacaaagccctttcagaactgagctgggctgtggtttccacggagttgttgttccattgttttggcttgtcttctgtactcagacccctataggggacagagctcccatgggggtaagttcccctaagtaaaaataaaygtaggaagataagccgaactgtttcatggagtaccagttctgaaggcaatccaagttccacaaattccccgccagctgttggccaggctgctggccccagtgcctgtacgggaagtgtgtgtcactttctcacacaccacctcagataactctgccctgtgaagattatttggaccctacagactcagagcctaagaacatatagtgaaagttagataaccaaacataaccctcctcctccggctttggtttgattgccttcacattttggtagagtcagcctgttcaggagtttggtat

SEQ ID NO: 156142 - DNA, 601 bp, Human
aggttaaggtgtaaattgagacctatggctctttgatgatctagctttttttttttggtatgtgcaactgtgtagtttattatacatgtatctaggttttacaattttcttttattttactttaagttccgggatacaagtacagaatgtacaggtttattacataggtatatgtgtgccattgtggtttgctgcacctatcaacctgtcatctaggttttaaggcccgcatgcattagctatttgtcctaatgctctccctctcctcacactctacccccgactggtcccagtgtgtgtygttcccctccctgtgtcaatgtgttctcattgttcaacttccacttatgagtgagagcattcactgtttggttttctgttcctgtgttagtttgctgaggatgatggcttctagcttcatccatgtccctgcaaaggacatgatctcattcatttttatggctacatagtattccatggtgtatatgtaccacatttgctttatccagtctatcacggatgggcatttgggttggttccatgtctttgttattgcaaatagtgctgcagtaaacatacctgtgcatgtgtctttacagta

SEQ ID NO: 156143 - DNA, 601 bp, Human
tggaaggcaatggttttagtagggcgcagagcatctaaacccaatataagttcctttaaattgagacatctagtccaatttcctcaaaacttaagtatgtccatctctatagtaatagcttccagcttgcgcagaggaccagtatggaagctgctcttcatttttatttttttattttactttaagttctagggtacatgtgcacaatgtgcagtttgttacatatgtatacatgcgccaggttggtgtgctgcacctgttaactaacattaggagatatacctaatggaagctgctcttcttaccaggcctctgggagctgaattgcaggaggctgtctgggcacaggtggcatatgacaggcacagcaatgcagaggcctgtgagattgttcatgtccctaaaacagcattacaggagtgaacatgcaaacactccctatcttgtattaacatctgaacaaagaggctaagaattaaagattagctttgactgggtgctttggggtgggagagataagaatgttctaatcaactgatgttaactagagctatacaggaatttaaaaaaagcactctctggcttatgacttgcacacaga

SEQ ID NO: 156144 - DNA, 601 bp, Human
ttttcctgccatcatgtgaaggacatgtttgcttctccttctgccatggttgtaagtttcctgaggcctccccagccctgtggaactgtgagtcaattaaactgtttcctttgttaagttacccagtctcgggtatgtctttattagcagtgtgagaatggactaatacaacagtcatcagtggcatctgcaggggattgattccaggacccccatggataccaaaattttcagaaactcaagtccttgatctaaaatggtgtagcatttgcacataacctatgaatatcctcctgtttaytttaaatcacctctagattacgtataatacctaagataatgcaaatgctatgtgagtagttattatactatatggttttgtatttgtatcattttttattgttgtattgttatttttatttttattgtttttttctgaatatttttgattcaaagttggttgaattcttggatagggaaccccagatatggagtgccaattgtacatgtctacattttaaatatggcacaataattatggaaaccattccagcagatgaaagggatgatagattttgctcaagttcagagaggctgctgt

SEQ ID NO: 156145 - DNA, 601 bp, Human
aacatgaaaatggactaatacatcagcactatatatttagcaagataatagaatactgtataacatcatgatggccaatatagtgagctctttgagggatcactggtgcatggaatcaaatatgcttttatgatctggttcagaggtgggtttggaggagaaactcaacatttgcggatttggtgtgttgaggttggcttacgttttatatattcagctaaaaagatgtccctttctgacagtcaaatcattgagaagtttgttaaataaagccagtctgttcatgatcaatcctcttgcrtaatgcttttccaagtaagctataaggaatgaacatatttcagattaatttagtttgtctttattaggagctacatcagaccccctttgaattagttttgtaaagacagaaaaaataaaccccaaatggagttatgtgtaaaggaaaacagccacagagaacaatccccaggcttcttcccacaagagctggggattggccaagcgggacctctggtagtcacccaagtgcccttctctgcacagaaaatctgaacccaggggctctgaggtgtgtgaaataaaaacaaatgtccatgtc

SEQ ID NO: 156146 - DNA, 601 bp, Human
gctgtgtctcacccaaatctcattttgaattctcagatgttgtgagagggatccagtgggaggtaattgaacctttgggcaggtctttcctgtgttgttctcatactagtgaataagtcacatgagagctgatggttttaaaaatgagagtttccctgcacaagctctctttctgcctgctgccatccacataagatgtggcttgctcctccttgccttccaccatgattgtgaggcttcctcagccatggaactgtgagttctccattaaacctctttcttttgtaaattgcccagtctygggtatgtctttatcagcaacatgaaaatggactaatacatcagcactatatatttagcaagataatagaatactgtataacatcatgatggccaatatagtgagctctttgagggatcactggtgcatggaatcaaatatgcttttatgatctggttcagaggtgggtttggaggagaaactcaacatttgcggatttggtgtgttgaggttggcttacgttttatatattcagctaaaaagatgtccctttctgacagtcaaatcattgagaagtttgttaaataaagccagtctgtt

SEQ ID NO: 156147 - DNA, 601 bp, Human
cagtttggctgtgtctcacccaaatctcattttgaattctcagatgttgtgagagggatccagtgggaggtaattgaacctttgggcaggtctttcctgtgttgttctcatactagtgaataagtcacatgagagctgatggttttaaaaatgagagtttccctgcacaagctctctttctgcctgctgccatccacataagatgtggcttgctcctccttgccttccaccatgattgtgaggcttcctcagccatggaactgtgagttctccattaaacctctttcttttgtaaattgcycagtcttgggtatgtctttatcagcaacatgaaaatggactaatacatcagcactatatatttagcaagataatagaatactgtataacatcatgatggccaatatagtgagctctttgagggatcactggtgcatggaatcaaatatgcttttatgatctggttcagaggtgggtttggaggagaaactcaacatttgcggatttggtgtgttgaggttggcttacgttttatatattcagctaaaaagatgtccctttctgacagtcaaatcattgagaagtttgttaaataaagcca

SEQ ID NO: 156148 - DNA, 601 bp, Human
ccttggcccactttgtggggacaccagaaaagcacacaccacagactccctaccataaaaactggaaaaaaaccccagcatttacatatgaacagatcagaacgggtacctgaggaagccatacttcagctttttaaaaaataagaataaaattagaatgtcttccaaatgatcttttatagcccagcttatgctcaaacaacattttagagaagcttctgttggtcattcaatattgaattctgtttttcttctatttctctaccactcaattagcaccttactttaaatatcccattcwaatgtcctgtgacatgtcagctgatacagtttggctgtgtctcacccaaatctcattttgaattctcagatgttgtgagagggatccagtgggaggtaattgaacctttgggcaggtctttcctgtgttgttctcatactagtgaataagtcacatgagagctgatggttttaaaaatgagagtttccctgcacaagctctctttctgcctgctgccatccacataagatgtggcttgctcctccttgccttccaccatgattgtgaggcttcctcagccatggaactgtgagttctcca

SEQ ID NO: 156149 - DNA, 601 bp, Human
caggaaacatcatatccccaaccttggcccactttgtggggacaccagaaaagcacacaccacagactccctaccataaaaactggaaaaaaaccccagcatttacatatgaacagatcagaacgggtacctgaggaagccatacttcagctttttaaaaaataagaataaaattagaatgtcttccaaatgatcttttatagcccagcttatgctcaaacaacattttagagaagcttctgttggtcattcaatattgaattctgtttttcttctatttctctaccactcaattagcacmttactttaaatatcccattctaatgtcctgtgacatgtcagctgatacagtttggctgtgtctcacccaaatctcattttgaattctcagatgttgtgagagggatccagtgggaggtaattgaacctttgggcaggtctttcctgtgttgttctcatactagtgaataagtcacatgagagctgatggttttaaaaatgagagtttccctgcacaagctctctttctgcctgctgccatccacataagatgtggcttgctcctccttgccttccaccatgattgtgaggcttcctcagc

SEQ ID NO: 156150 - DNA, 601 bp, Human
ttttaagattgatataggatttttctcatctaagattcttgaagctctaaaattattaacagatccaactggactcaatgaatgtttgctatgatacaatatcatagactgagctgctgctgatagatgtctcggctccgttgccacaagaacagacatattgcagagctgagtccaggtatacgctctcacatccattttagaaagggaaatagagatacaatctagttatatacagtggccaattttattcattgtcagaggttgggttgagaacttattaggtttttaatagttaaartaaagattttcaatctattccttgacataaagtgactcagcgtaaggttttgtgaaaacccacctctacgagaccttattcggagctagacacttttcttctatgaaagtcaaacttcatagcactgagatgtgtttgttacagctgtttcacttggggaaattagggcaactggattagtcggtgtcacctggaagctcctctttcaggactttccctccaattgatgtgcacatgaacagatacagcttcatctcatggtcaggaaacatcatatccccaaccttggcccactttgtg

SEQ ID NO: 156151 - DNA, 601 bp, Human
ttttctaaaacttttgaagcatctctggatacaatgtgtaaaaattaattaccaagttgtgtgttttttcttttttttgctaaggcagaatctacatacagcaacactgcattaagctaaatccaattgccaaaagtatttggaaattatgaagctagatttttattttttaagtttttactgaccactctgatctgtcttcagatacttggataaatatcacggaataaagtgggaaagaaaagcttacctttaaaaacatcaagaagttttaagcttcaaagaaggaaaatgttatttmatgctttctttaattaggattctctgttgcttcatttttggtagtgaccagacataagccccctgtctaactggacagtttgtccgagaagcctctccatgaggtactgatgtccagtgaatttctagaatgtcctagagaaggtgaggtgcatgaccattggtactttttcttcttggtcccagacaggttttgttttgtgtgacttttggttgttgttattttgtcttgtttttgttataacaccatgggattgagtttagactgtcctagagaaacctgggtaaaggaggataggga

SEQ ID NO: 156152 - DNA, 601 bp, Human
tgagaattctaacaaggactgtattaaagttaacccaaggaaagagaggtttgttgagaacatcaataatgcaaattagaataagaggttgcatgggggtgggagggggtgtgtgttttccttacttcagggaacaaaaaatattttctaaaacttttgaagcatctctggatacaatgtgtaaaaattaattaccaagttgtgtgttttttcttttttttgctaaggcagaatctacatacagcaacactgcattaagctaaatccaattgccaaaagtatttggaaattatgaagctaratttttattttttaagtttttactgaccactctgatctgtcttcagatacttggataaatatcacggaataaagtgggaaagaaaagcttacctttaaaaacatcaagaagttttaagcttcaaagaaggaaaatgttatttaatgctttctttaattaggattctctgttgcttcatttttggtagtgaccagacataagccccctgtctaactggacagtttgtccgagaagcctctccatgaggtactgatgtccagtgaatttctagaatgtcctagagaaggtgaggtgcatgac

SEQ ID NO: 156153 - DNA, 601 bp, Human
acataaaatagaaaagaaaatataaaagcatgcatcacatgcagtaaggacgagtctatgtatgtaaacattttgtttcaaatatatatgtgtgtttgtttataagatgtacatattgcgatagtttaatgtttcttattgtgagttatagtcaacaaagtgttcaaaaattatttaattaaaatgtaagctccccaaaggtagagtttttgccttgtccaccattgttcatccagcacctaaaacacatacataataaatattagctgaataaatatatggcctggggaaagtcaatgartctgttttctgatctgtagaagaataaagtctaccttataggtttgtcattggaactaataaaaatgagtgatgagtgtgctatactagtacatggtaggtgttgaatcactaagaactattttgtttcttcttcctcttcctcctttcctttccttctcttccaatattgagtaaatcctgagccttcatatgagtaggtccatggtagtccatcctggaataaagtctagaatcccccagttctcataagggctttgccactggaaccttcaggaccaaaacagtccttttaccatga

SEQ ID NO: 156154 - DNA, 601 bp, Human
atgttggtgtccccttaaaatttatatattggaacctaatactcaatgtgatagtattaggaggaggagcctttaggggggtgattaagccatgagggctctgctctcatgaatgggattagtgcccatataaaataagttgaagggagctggcttgccctttccaccatgcgtgaggacacagtaataaagcaacatctctgaagcagcgagcaacccctcaccagacactgaacctgctggcaccttgatcttggactttccagcttccagaactgtgaaaataaatttctattgttcrtaagttacccagtctaaggtaatgtggtatagcagcccagactaagacagtaggttctgtgtgtttcttatctccaatcccttttctttctcttctctcttctttcctaaaacccaaagtggggatgatatagaggcacggggtggaagggggtccattttgacaatgggcactcctctaagcatatttgccttctcctcttggtgtttcatgaggaaaagtgctctttgaaattgagtgaggggaaaagcttagaccatcaagggataccgagtttaggactctctgctcttgagcagg

SEQ ID NO: 156155 - DNA, 601 bp, Human
gtggtttgcctatgggtaaacataaaggtttttgctgatcagcctgcaacatatattgtgcctttccagagctacttaatgtcttttttttttttaaaaaaaaaaaagaaattctaggtcatattaaataagttcactttatttaagatgtaattctgtttgaaaacacagacacacaccaaagatgtgtcacactcaaattcatcatagcatactatctaatgagttaatgtaagtgttatttggtttgcaaaatatttattggtaacttttcaggaattcatttctgtgtaaagtgatyatcggctgactaaaagtaggccaaaccaatcattaacacctgaatttacccacacatttctctatattaatagggagtacaattcttgttttcttcttaccgttttgatgtatttgagataggattaaggagttgattgtgagagaaaggtgatgaaaaaagtgttagtgctgtttttatctttaggccatttaaattctcttctttcattaatttttgcaggtttactgagggattgttaactcctttcatttctaaatatggttggtagatgctatggtctgaatgttggtgtcccct

SEQ ID NO: 156156 - DNA, 601 bp, Human
cctttcattttctttatttttcttaagcatatttgttatcatgtcatccagctatttattctcattggtggaatgagtttcattctaagtagtatatactcgtttccctttctaatttgctgcttctagaaaattggtaactaagctagtttaaagtgtatctaaagtaaaaataagtaatgtgtgcaaactgagtggtttgcctatgggtaaacataaaggtttttgctgatcagcctgcaacatatattgtgcctttccagagctacttaatgtcttttttttttttaaaaaaaaaaaagaaattctaggtcatattaaataagttcactttatttaagatgtaattctgtttgaaaacacagacacacaccaaagatgtgtcacactcaaattcatcatagcatactatctaatgagttaatgtaagtgttatttggtttgcaaaatatttattggtaacttttcaggaattcatttctgtgtaaagtgattatcggctgactaaaagtaggccaaaccaatcattaacacctgaatttacccacacatttctctatattaatagggagtacaattcttgttttcttcttaccgtttt

SEQ ID NO: 156157 - DNA, 601 bp, Human
gagttcttgagcctttcattttctttatttttcttaagcatatttgttatcatgtcatccagctatttattctcattggtggaatgagtttcattctaagtagtatatactcgtttccctttctaatttgctgcttctagaaaattggtaactaagctagtttaaagtgtatctaaagtaaaaataagtaatgtgtgcaaactgagtggtttgcctatgggtaaacataaaggtttttgctgatcagcctgcaacatatattgtgcctttccagagctacttaatgtcttttttttttttwaaaaaaaaaaagaaattctaggtcatattaaataagttcactttatttaagatgtaattctgtttgaaaacacagacacacaccaaagatgtgtcacactcaaattcatcatagcatactatctaatgagttaatgtaagtgttatttggtttgcaaaatatttattggtaacttttcaggaattcatttctgtgtaaagtgattatcggctgactaaaagtaggccaaaccaatcattaacacctgaatttacccacacatttctctatattaatagggagtacaattcttgttttctt

SEQ ID NO: 156158 - DNA, 601 bp, Human
ctcagatatatttatttcatactaatcttggatggcactcttcctttactgtattaattcctgctttcttaaacagggaacatagaactaattttcttgttgagctgaagtcatcatttggagcattgagcacccctgttatttcgttttgcactttggggagcatggccctgctaaatgacaacccatgttctttgagttcttgagcctttcattttctttatttttcttaagcatatttgttatcatgtcatccagctatttattctcattggtggaatgagtttcattctaagtagtrtatactcgtttccctttctaatttgctgcttctagaaaattggtaactaagctagtttaaagtgtatctaaagtaaaaataagtaatgtgtgcaaactgagtggtttgcctatgggtaaacataaaggtttttgctgatcagcctgcaacatatattgtgcctttccagagctacttaatgtcttttttttttttaaaaaaaaaaaagaaattctaggtcatattaaataagttcactttatttaagatgtaattctgtttgaaaacacagacacacaccaaagatgtgtcacactcaaa

SEQ ID NO: 156159 - DNA, 601 bp, Human
ttatgatcaggcattcaaactactcttttagaaggctattaattgatgctgagcaaaacttagacttggtcttatgaagaccaaatgattccaccaggttcagtctctgatttcacaccaggacagtgggggcaaatttgctccccaagggaatacttggcaatgtctgcaacttcttttggttagggtggggtgctaatggcatctagtgggtagactaaacatctagaatgcaaaggacagaccctgaaacaaagaaatatctggccctagatgtcaatagcgcatagatggaacaacrgcattctaagaggaaaccactatgatttgcatgtggagggaaagctcttgcacaaggagtcctgccctgacaatagttctccaagctggggacctcagcatctttcagcagaggagaagaaacccaagttgtggatcattaagctacttatttttgatgacagtagcaaagttgcatgagtatatttattttattttattttggggggaggatactcattttaaattaatgcaatgacataatatttcagtttttcatgattctgggtaatccacataaccgaaaaatttactaaaaagt

SEQ ID NO: 156160 - DNA, 601 bp, Human
gtaattactgcagccaggtcttatttatctgtgtagcaacaaacacagataaacaagatcttatgatcaggcattcaaactactcttttagaaggctattaattgatgctgagcaaaacttagacttggtcttatgaagaccaaatgattccaccaggttcagtctctgatttcacaccaggacagtgggggcaaatttgctccccaagggaatacttggcaatgtctgcaacttcttttggttagggtggggtgctaatggcatctagtgggtagactaaacatctagaatgcaaaggasagaccctgaaacaaagaaatatctggccctagatgtcaatagcgcatagatggaacaacagcattctaagaggaaaccactatgatttgcatgtggagggaaagctcttgcacaaggagtcctgccctgacaatagttctccaagctggggacctcagcatctttcagcagaggagaagaaacccaagttgtggatcattaagctacttatttttgatgacagtagcaaagttgcatgagtatatttattttattttattttggggggaggatactcattttaaattaatgcaatgacat

SEQ ID NO: 156161 - DNA, 601 bp, Human
acagtgataatgataattgtagcctctaatatatctggcattgcaccagatgctttacgtgttttctcttttaatcctcacaacgattcattgtttaggtgaaaaaccaggctcagagaaataattaacttgctttaaggtaatacaagtaataggtgacaatttcagattcgcagtttattgtactcaaatcttggtctttctcttaaaccacacagtctgcctaactaggtaatcttaagcccagaagaacacgtggctgccatgccctttgcacagtcctgataaagggcaaaaacgmagagtttttccatatttaattatgcaaatcattccaaagcttggtggggtcctttacaaactcagaattatctatctcccttttcaatctgcaagccctcttttcaacaatttatcctaaacactatgactaacaaggcctccatccagcttctaaactgaaaagtggggctgattgctcttagtcctaggaagcagggctcactctgctcaaacagcttaaggcaggctttctaattctgagtctgttgctccgggtcgtttgtttagaacaattgggtatagagtccctcaacacaaa

SEQ ID NO: 156162 - DNA, 601 bp, Human
atgcactgggctctgtgctatacatgtgtttcccttcagaaaacactgctacagaggaatgaaaaagtcccttaaattaaaaaagaaaatggctgccattctggcatcacaagaattgttatgaattgcctatgtgtttaagtggttggggatgggaagagtgtacatagcattactaaattttgaaaaatgtggtgtggatacatttcaaggaatgttctttgctcagggtgaatttatgttctttattcatccatttaagagaaatgttttgagtgcctacattgcatgacactcctgkggtctaatactgttgaacagtgataatgataattgtagcctctaatatatctggcattgcaccagatgctttacgtgttttctcttttaatcctcacaacgattcattgtttaggtgaaaaaccaggctcagagaaataattaacttgctttaaggtaatacaagtaataggtgacaatttcagattcgcagtttattgtactcaaatcttggtctttctcttaaaccacacagtctgcctaactaggtaatcttaagcccagaagaacacgtggctgccatgccctttgcacagtcctg

SEQ ID NO: 156163 - DNA, 601 bp, Human
tagcattttgggaggctgaggcaggtggattgcttgaggctaggagtttgagaccagtctggccaatatgtggaaaccctgactccacaaaaaaatacaaaaaattagctgggtgtggtggtgcatgcctgtagtcccagctacttgggaggctgaggtgggaggattgctggagtccgggaggttgaagctgcagtgaaccgagatggtgccactgcactccagcctgggtgacagagtgaaaccctgtctcaaaaaaaagaaaaaaatcttgttttaaaaagtccgtccattttcccamtgactctttctgagcacttaacatatgctgagtgctcaccatgcactgggctctgtgctatacatgtgtttcccttcagaaaacactgctacagaggaatgaaaaagtcccttaaattaaaaaagaaaatggctgccattctggcatcacaagaattgttatgaattgcctatgtgtttaagtggttggggatgggaagagtgtacatagcattactaaattttgaaaaatgtggtgtggatacatttcaaggaatgttctttgctcagggtgaatttatgttctttattcatccattta

SEQ ID NO: 156164 - DNA, 601 bp, Human
agaaagtacctcaaggacctgtgggttaacagcttggaataaaagcatttatttaacatcatctccatttcattgtaaagaatcttgttttaggctgggcttggtagctcacacctgcaatcctagcattttgggaggctgaggcaggtggattgcttgaggctaggagtttgagaccagtctggccaatatgtggaaaccctgactccacaaaaaaatacaaaaaattagctgggtgtggtggtgcatgcctgtagtcccagctacttgggaggctgaggtgggaggattgctggagtcygggaggttgaagctgcagtgaaccgagatggtgccactgcactccagcctgggtgacagagtgaaaccctgtctcaaaaaaaagaaaaaaatcttgttttaaaaagtccgtccattttcccactgactctttctgagcacttaacatatgctgagtgctcaccatgcactgggctctgtgctatacatgtgtttcccttcagaaaacactgctacagaggaatgaaaaagtcccttaaattaaaaaagaaaatggctgccattctggcatcacaagaattgttatgaattgcctatgtgt

SEQ ID NO: 156165 - DNA, 601 bp, Human
agaacatttggaggatctgggaactgaagggacacttaacctcactttgctcttagaagacatctttatgcagtttcccaagaaccgacaaatctgtgagttcaggtcacccttgaaggtgactaattaggtcactggctgtgtggaggcctctgttcatcactggtggtcagctcacccctgctgcctccagaaagtacctcaaggacctgtgggttaacagcttggaataaaagcatttatttaacatcatctccatttcattgtaaagaatcttgttttaggctgggcttggtagctmacacctgcaatcctagcattttgggaggctgaggcaggtggattgcttgaggctaggagtttgagaccagtctggccaatatgtggaaaccctgactccacaaaaaaatacaaaaaattagctgggtgtggtggtgcatgcctgtagtcccagctacttgggaggctgaggtgggaggattgctggagtccgggaggttgaagctgcagtgaaccgagatggtgccactgcactccagcctgggtgacagagtgaaaccctgtctcaaaaaaaagaaaaaaatcttgttttaaaaagtcc

SEQ ID NO: 156166 - DNA, 601 bp, Human
aggaaagagagcagcagaaacttctataggagatccaactgatgttaacatatgtggacaccctcctgtcccctggcccctttcctttcacccagatttggtatgtggcaaatctaaacatttgcaaattcacagtcgtattcagtcatccggcacattatgaacttccactggcgatccctgtgggagggagagtcagaaaatgaatgtcagtgagaaaggacatggcaggaagaatcgctgctggggaaacagcagcagagaacatttggaggatctgggaactgaagggacacttaayctcactttgctcttagaagacatctttatgcagtttcccaagaaccgacaaatctgtgagttcaggtcacccttgaaggtgactaattaggtcactggctgtgtggaggcctctgttcatcactggtggtcagctcacccctgctgcctccagaaagtacctcaaggacctgtgggttaacagcttggaataaaagcatttatttaacatcatctccatttcattgtaaagaatcttgttttaggctgggcttggtagctcacacctgcaatcctagcattttgggaggctgaggcaggt

SEQ ID NO: 156167 - DNA, 601 bp, Human
tatgctaagtgaaagcagccaatcacaaaaggctacatattacaagattccatttaaatgaaatgttcagaataggtaaatctaacttttatcacaggcaaagctatgacaggaaatagatgagtggttgcctagtgcttgggggcagaggtgggggtgaggcgagtgagtactgctaatggtacagagttacttttggggataaagaaactgttctgaaatggactctggtgatggttgcactactctgaacatactaaaactgttaaattatatacttgaaatgggtgacttgtgaggyatggaaattatatcttaataaagctgttttacatattttacatatttaaaaatgcaggtggagggatgagccctctaaagagaagcaggagtttgaggaggttctaaatattgtgtggtgggtactgaggcatataaatttgtcagacctcatcaaaatgtatgatgtaatcttcaagaaagttgattttaaagaaacaccaccagcaccaggtggagaaggcaggaagaagttacacaaggggtaggccaagagtggtggctcatgtctataatcccagcactgcgggaggccgagccg

SEQ ID NO: 156168 - DNA, 601 bp, Human
gaagaacatttgggtctcactctgtggcccaggctggagtatagtggcacaatcatagctcactgcacattcaaactcctggcctcaagtgatcctcctgccttagccttgaaataagcttggattacagatgagccaccacacccagccagaccattattcataatagccaaaatgtgaaaacaacccaaatctccatcaactgacaaatggataaatagaatggtggttgatccatacaatggagtatttactcagcaataaaaagaagtcctgatacatgctacaaggatgaacctcraaaacattatgctaagtgaaagcagccaatcacaaaaggctacatattacaagattccatttaaatgaaatgttcagaataggtaaatctaacttttatcacaggcaaagctatgacaggaaatagatgagtggttgcctagtgcttgggggcagaggtgggggtgaggcgagtgagtactgctaatggtacagagttacttttggggataaagaaactgttctgaaatggactctggtgatggttgcactactctgaacatactaaaactgttaaattatatacttgaaatgggtgact

SEQ ID NO: 156169 - DNA, 601 bp, Human
caacaagagagaaattctgtctcaaaaataaaaaaaaaatttttttaagaatatgaaatagtgtagccactttggaaaacaatttggtagctcctcaaaatgttaaacatagttacccttgcaactgaccagcaattcctaagaaaaatgaaagcatacctcgacattaaaaactttacaagggctaggcggggtggctcacacctataatcccaacactttgggaggcccaggagggaggatcacttgagcccaggagttcgagaccagtctcagcaacatagcatgacccagtctctayaaaaaaatttttttttaattagctggatgtgttgatgcgggcctgtagtcccaactattctggaggctgaggtgggaggatcatttgagcccaggaggttgaagctgcagtgaactgtgattgtgcctctgcactccagcctgggtcactgagtgagagaccctgtctcaaaaaaattaaaaaaaaaaagtccagaagaacatttgggtctcactctgtggcccaggctggagtatagtggcacaatcatagctcactgcacattcaaactcctggcctcaagtgatcctcctgccttag

SEQ ID NO: 156170 - DNA, 601 bp, Human
cggtggctcatgcctgtaatcccagcactttgggaggccgaggtgggcggatcacttgaggtcaggagttcgaaaccaacctggccaacatggtgaaaccccatctctactgaaaatacaaaaaattagccgggcgtggtggtggacgcctgtaatcccatctactcaggaggctgagacacaagaatcacttgaacctgggaggcggaggttgcagtgagctgagatcatgccattgcattccagcctaggcaacagagtgagactccatctcaaaaaaaaaaaaaaaaaaaaaaaaaaagatgggcaacgacacatattgttgaggctacaaagaaagtgaaccctcatcactgctaacaggaatgtaaaataggctggtcccagtgcagtggtgtttacacctattgatcaaaaccagttccttttccactcccactgcttcacttggctagtcttaaaaatatatatatatgagaaattaaaaattaaaaaattaaaattaaatttaaaaaaatgtaaaggaggccaggcacagtggctcacgcctgtaaattccagcactttgggaggccgaggggggtggatcacctgaggcagg

SEQ ID NO: 156171 - DNA, 601 bp, Human
ttaagtgccaggcacggtggctcacgcctgtaatcccgacactttgggaggccaaggcgggtggatcacctgaggtgaggaggtcgagaccagcctgaccaatatggtgaaacactgtttctactaaaattacacaaattagccgggcatggtggcatgcacctgtaatcccagctactcaggaggctgaggcaggagaatcgcttgaacctgggaggcggaggttgcagtgaggtgagatcgcaccactgcactccagcctgggcaacagagcgagattccatctccaaaaaaaaaaaaagaaaagaaaagaaagaaagatagaaagaaaattaagcttcaatcacccaacagcacatagcggagttggaagtctgcctctttccacacactatggcaacacagattcctggtctaattctgtgttcttgggacactgcagaggaagactgacacccaaagtgaataaagttccaagaagcagaaaacggacacttttgatcatgcagcatgactgaggcagatcaggcaacagcacccacagtcagcccgagagcctcaaggattttggctggagtcccttgaagggaagagaggtagg

SEQ ID NO: 156172 - DNA, 601 bp, Human
accggtgaccagcagttgcccccacccatgttttgctctgctggcaatgttgacccttatagtgttgtaaattataattgggtgccagtttaaaatcaggagttatcacataaaaatccagatgtcttgcttctctttaaaaagttagaagatcggccaggtgcggtggctcaagcctgtaatcccagcactttgggaggccaaggagggtaaatcacaaagtcaggagatcgagaccatcctggctaacacggtgaaaccccatctctactaaaaatacaaaaaaaaaattagccgggcrtggtggtgggcgcccgtagtcccagctacttgggaggctgaggcaggagaatggcgtgaacccgggaggcggagcttgcagtgagccgagatcgcgccactgcactccagcctgggtgacagagcaagactccgtctcaaaaaataaaaataaaaataaaaagttagaagatctaggcatgactgtagctgagtggaggccatccccttttgccagggcttgccttctcaaggtcatacacgtcctcacctctcttttaattcccagacattgctattctacacctgccctgctttaccc

SEQ ID NO: 156173 - DNA, 601 bp, Human
tggcgatgcatgtctgtagttccagctacctgggagtctgaggtgggaggattgcttgagcccgggcggtcgaggctgcagtgagccatgatcacaccattgcactccagtctgggtgacagagcaaggccctgtctcaaaaaaaaaaaaaaagaaaagaaaagaaaagaaaaaggaaacaaaaaaaccaacaaggggacaaggggatgtgataatgcctggatactagggggtggtagaggacatctgccctcagtagtgaaaatgacccctgactttacatatccaaaggtcatgcagktggcagaagagtaaagataaaggaatctgtgtgttgacataaggaagaacacaaaggcctggcagatcctgagtgttgaccagccatggaaggaactgtcctggacaacagagagtcttcttcagtaccagctgccaaggaggtggggaaagtgctcagacacctccaggaagcacttaggggttggaccacacagcctttggggatcaggctagccctataatttagtgatctttatgatcactgtcatttctctacaggtttttttttttttttttttttgagacagggtctcactct

SEQ ID NO: 156174 - DNA, 601 bp, Human
tagaggcaaaggcaaaggcagtgagtggtactctaatggctataacaagaattcattaaaatggcccggcgtggtagttcatgcctgtaatcccaccactgtgggaggctgagacaggcagatcgcttaagcctacaagtttgagaccagcctgggcaacatggtaaaaccccatctctaaataaaaaaaagaaatttagaaagaacactaaaacttagaggaagctttcccgataaatgatagtctgataaaataatagctaatacttattgagcacttaactatgctccaggcactgtcataagtcagttaataaagtatcccgttccctaggtgatgaagctgaggcacagaatgagaaccaggcactgccctccagtcccctctagaagtccacttggaggacttgtccttaacggtaaactgccaacttggagttgtgacaagttaaggagaaaagctagtgataggagacaaagggctgcttcgctttactcaatgctcagtgagtcatgaggtggctgcccccaggcctccaagttgtcacttggcagcactgccaagggcaaactcagggtgcacctggagcaggcagacaga

SEQ ID NO: 156175 - DNA, 601 bp, Human; identical to SEQ ID NO: 28091

SEQ ID NO: 156176 - DNA, 601 bp, Human; identical to SEQ ID NO: 28092

SEQ ID NO: 156177 - DNA, 601 bp, Human; identical to SEQ ID NO: 28093

SEQ ID NO: 156178 - DNA, 601 bp, Human; identical to SEQ ID NO: 28094

SEQ ID NO: 156179 - DNA, 601 bp, Human; identical to SEQ ID NO: 28095

SEQ ID NO: 156180 - DNA, 601 bp, Human; identical to SEQ ID NO: 28096

SEQ ID NO: 156181 - DNA, 601 bp, Human; identical to SEQ ID NO: 28097

SEQ ID NO: 156182 - DNA, 601 bp, Human; identical to SEQ ID NO: 28098

SEQ ID NO: 156183 - DNA, 601 bp, Human; identical to SEQ ID NO: 28099

SEQ ID NO: 156184 - DNA, 601 bp, Human; identical to SEQ ID NO: 28100

SEQ ID NO: 156185 - DNA, 601 bp, Human; identical to SEQ ID NO: 28101

SEQ ID NO: 156186 - DNA, 601 bp, Human; identical to SEQ ID NO: 28102

SEQ ID NO: 156187 - DNA, 601 bp, Human; identical to SEQ ID NO: 28103

SEQ ID NO: 156188 - DNA, 601 bp, Human; identical to SEQ ID NO: 28104

SEQ ID NO: 156189 - DNA, 601 bp, Human
ctccgaaagtgctggtattacaagtgtgagctaccacttcgagactcacttttcaccaacattttcagcagttgtgtcagacagcaagtcaatgtgccattatttacttaaatattcatccattatagggcatctgatacctaacaaccatggaccttaagattttttcctatgtagcctcagttcttagatgcaattactatggagacgggtacgatcacatgccagtgggagtattaaccgcacaacatttatgagggatcattaaagcgttaaatgcatatacttttggacctagcartcccagtactaggaatttatgcaaacagtgaggtgccaacaaggttattcaccacagcatgatgcacaataactaaaggttagaacgtatttcaatgagggaatggtgaaataaacgacaaaacccccataagggacgtccacagatcagcataaagacggaggccccggtgttggaacgcacgtaaactcccagacatgccgcaaaggaaacacggcaaggtgagaaagagtgggcgaggtgtcgacaacgaacacgcaagaagtgcttgtccttgcccaaaatacctcgaaaagaaga

SEQ ID NO: 156190 - DNA, 601 bp, Human
ccgtctcatcctcccaaagtgctgggattacaggcgtgagctaccgcgcccggccaactcttcaggatctattaaacttttttctttttttttcccacaggtagataagagtcttgctctgtcacccaggctggagtgcagtggctcaatcatagctcactgcagccttgaactcctggactcaagggatcctcttgccttagtctcaggagtaactgggacaacaggcttgcgccaccatgcccggctaatttttaaatttttggtagagatgggggtctcgttatgttgcccaggctgstcttgaactcctggcctcgagcgatccccgtctcagcctccgaaagtgctggtattacaagtgtgagctaccacttcgagactcacttttcaccaacattttcagcagttgtgtcagacagcaagtcaatgtgccattatttacttaaatattcatccattatagggcatctgatacctaacaaccatggaccttaagattttttcctatgtagcctcagttcttagatgcaattactatggagacgggtacgatcacatgccagtgggagtattaaccgcacaacatttatgagggatc

SEQ ID NO: 156191 - DNA, 601 bp, Human
tcctgagtagctaggattacaggcgcccgccaccacgcccggctaatttttgtaatttcagtagaaatggggtttcaccatgttggcccagctggtctcgaactcctgacctcgttatccacccgtctcatcctcccaaagtgctgggattacaggcgtgagctaccgcgcccggccaactcttcaggatctattaaacttttttctttttttttcccacaggtagataagagtcttgctctgtcacccaggctggagtgcagtggctcaatcatagctcactgcagccttgaactcctgractcaagggatcctcttgccttagtctcaggagtaactgggacaacaggcttgcgccaccatgcccggctaatttttaaatttttggtagagatgggggtctcgttatgttgcccaggctgctcttgaactcctggcctcgagcgatccccgtctcagcctccgaaagtgctggtattacaagtgtgagctaccacttcgagactcacttttcaccaacattttcagcagttgtgtcagacagcaagtcaatgtgccattatttacttaaatattcatccattatagggcatctgatacc

SEQ ID NO: 156192 - DNA, 601 bp, Human
ttttgctctttcgcccgggctggagtgcaatggtgccatctcggctcactgcaacctctgccttccgggttcaagtgattctcctgcctccgcctcctgagtagctaggattacaggcgcccgccaccacgcccggctaatttttgtaatttcagtagaaatggggtttcaccatgttggcccagctggtctcgaactcctgacctcgttatccacccgtctcatcctcccaaagtgctgggattacaggcgtgagctaccgcgcccggccaactcttcaggatctattaaacttttttctttttttttcccacaggtagataagagtcttgctctgtcacccaggctggagtgcagtggctcaatcatagctcactgcagccttgaactcctggactcaagggatcctcttgccttagtctcaggagtaactgggacaacaggcttgcgccaccatgcccggctaatttttaaatttttggtagagatgggggtctcgttatgttgcccaggctgctcttgaactcctggcctcgagcgatccccgtctcagcctccgaaagtgctggtattacaagtgtgagctaccacttcgagactc

SEQ ID NO: 156193 - DNA, 601 bp, Human
actgactcttcgggatctttgtttttttttgagacggagtttttgctctttcgcccgggctggagtgcaatggtgccatctcggctcactgcaacctctgccttccgggttcaagtgattctcctgcctccgcctcctgagtagctaggattacaggcgcccgccaccacgcccggctaatttttgtaatttcagtagaaatggggtttcaccatgttggcccagctggtctcgaactcctgacctcgttatccacccgtctcatcctcccaaagtgctgggattacaggcgtgagctacygcgcccggccaactcttcaggatctattaaacttttttctttttttttcccacaggtagataagagtcttgctctgtcacccaggctggagtgcagtggctcaatcatagctcactgcagccttgaactcctggactcaagggatcctcttgccttagtctcaggagtaactgggacaacaggcttgcgccaccatgcccggctaatttttaaatttttggtagagatgggggtctcgttatgttgcccaggctgctcttgaactcctggcctcgagcgatccccgtctcagcctccgaa

SEQ ID NO: 156194 - DNA, 601 bp, Human
tgcagggaaagcttccccttgtcactgctgcctccacttccaacaacacttgaagcacccacagaaaaagatatggaccttcttccacctttaatactgacagaaaaaaacacagcagcaaaggaaacagatagcaaccaatctcaggatagcaagaacgagcatggctctgccctctgcaccaccgccaccctcgagaatgagcatgtgtgtctccccaggcctctcaaaataatcacctttcttagacgactattggggtacaacaaaaagcagtcataaatcagaaatcaagacttayttgggagcaaaaaattcaggttaatgggaactgtgctcatttcataattcagtacactcagtaggcactcaactctgactgactgcaaacctccaaaggggtctcctaatgaaaactggttaaggagtcaagaagcaaagagggaaaaccctggttctaaaaccatctcaccacctattaagcgccccacttcacacagcatttcagacatctattcacttaaggtcgttccccaaacagctactgtgctcctactaaacacgaactgttaagagaagcacaaaaggaatgaaagttatt

SEQ ID NO: 156195 - DNA, 601 bp, Human
gtttttaaagtattctctagagctatccattcatgtgtttatagattatttctagattaaattcatgatgtgagagatttgcttcaaaataatctggggatttggaagaaggtggtgaggacgcaggaagaactggctgtgtgctggtgatgaggacaggacggttcgttacattgctctctttgtgtgtgctcaaaaaaattccataatacacttcttaaaagagagaagaaaaaaagagatcatcacaccagattggcaaaacaatgtcaacttctgcccaaaatacacagctctgcargtatgcaggagaacaagcagtggcctttaaacacccagaggacattttccttgggaacaaagccctaactagttggctcaaaaaaagtcccaaggaagaagcataagcgataggttttggccgtccccagaaacaggcacccgagcatcccctgtgagaaacaggcacccgagcctccctgggagaaacaggcacccgagcctccgtgggagaaaaagaatgtgtgcgactcacagagggctcacctctctcaagcccatcgatgttctgcgtgtagagccgcagaagcagccccttgtc

SEQ ID NO: 156196 - DNA, 601 bp, Human
ctcccgacctcaggtgatctacctgcctcggcctcccaaaatgctgggattacaggtgtgatcccacacctgtaatccggcacccggccggagttgtttttaaagtattctctagagctatccattcatgtgtttatagattatttctagattaaattcatgatgtgagagatttgcttcaaaataatctggggatttggaagaaggtggtgaggacgcaggaagaactggctgtgtgctggtgatgaggacaggacggttcgttacattgctctctttgtgtgtgctcaaaaaaattccrtaatacacttcttaaaagagagaagaaaaaaagagatcatcacaccagattggcaaaacaatgtcaacttctgcccaaaatacacagctctgcaggtatgcaggagaacaagcagtggcctttaaacacccagaggacattttccttgggaacaaagccctaactagttggctcaaaaaaagtcccaaggaagaagcataagcgataggttttggccgtccccagaaacaggcacccgagcatcccctgtgagaaacaggcacccgagcctccctgggagaaacaggcacccgagcctcc

SEQ ID NO: 156197 - DNA, 601 bp, Human
actcccgacctcaggtgatctacctgcctcggcctcccaaaatgctgggattacaggtgtgatcccacacctgtaatccggcacccggccggagttgtttttaaagtattctctagagctatccattcatgtgtttatagattatttctagattaaattcatgatgtgagagatttgcttcaaaataatctggggatttggaagaaggtggtgaggacgcaggaagaactggctgtgtgctggtgatgaggacaggacggttcgttacattgctctctttgtgtgtgctcaaaaaaattcyataatacacttcttaaaagagagaagaaaaaaagagatcatcacaccagattggcaaaacaatgtcaacttctgcccaaaatacacagctctgcaggtatgcaggagaacaagcagtggcctttaaacacccagaggacattttccttgggaacaaagccctaactagttggctcaaaaaaagtcccaaggaagaagcataagcgataggttttggccgtccccagaaacaggcacccgagcatcccctgtgagaaacaggcacccgagcctccctgggagaaacaggcacccgagcctc

SEQ ID NO: 156198 - DNA, 601 bp, Human
tagtagagacggggttttgccacgttggccaggctggtctcgaactcccgacctcaggtgatctacctgcctcggcctcccaaaatgctgggattacaggtgtgatcccacacctgtaatccggcacccggccggagttgtttttaaagtattctctagagctatccattcatgtgtttatagattatttctagattaaattcatgatgtgagagatttgcttcaaaataatctggggatttggaagaaggtggtgaggacgcaggaagaactggctgtgtgctggtgatgaggacaggayggttcgttacattgctctctttgtgtgtgctcaaaaaaattccataatacacttcttaaaagagagaagaaaaaaagagatcatcacaccagattggcaaaacaatgtcaacttctgcccaaaatacacagctctgcaggtatgcaggagaacaagcagtggcctttaaacacccagaggacattttccttgggaacaaagccctaactagttggctcaaaaaaagtcccaaggaagaagcataagcgataggttttggccgtccccagaaacaggcacccgagcatcccctgtgagaaa

SEQ ID NO: 156199 - DNA, 601 bp, Human
ttatttttttgagacagaatctccctctgtcgcccaggctggagtgaagtggcacgatctcggctcactgcaacctccgcctgctgggttcaagagattctcctgtctcagcctcccgagtacctgggattacaggcacacaccaccacgcctggctaattttttgtatttttagtagagacggggttttgccacgttggccaggctggtctcgaactcccgacctcaggtgatctacctgcctcggcctcccaaaatgctgggattacaggtgtgatcccacacctgtaatccggcaccyggccggagttgtttttaaagtattctctagagctatccattcatgtgtttatagattatttctagattaaattcatgatgtgagagatttgcttcaaaataatctggggatttggaagaaggtggtgaggacgcaggaagaactggctgtgtgctggtgatgaggacaggacggttcgttacattgctctctttgtgtgtgctcaaaaaaattccataatacacttcttaaaagagagaagaaaaaaagagatcatcacaccagattggcaaaacaatgtcaacttctgcccaaaataca

SEQ ID NO: 156200 - DNA, 601 bp, Human
ctatcagagttgtttttattttttaattatttttatttttatttatttttttgagacagaatctccctctgtcgcccaggctggagtgaagtggcacgatctcggctcactgcaacctccgcctgctgggttcaagagattctcctgtctcagcctcccgagtacctgggattacaggcacacaccaccacgcctggctaattttttgtatttttagtagagacggggttttgccacgttggccaggctggtctcgaactcccgacctcaggtgatctacctgcctcggcctcccaaaatrctgggattacaggtgtgatcccacacctgtaatccggcacccggccggagttgtttttaaagtattctctagagctatccattcatgtgtttatagattatttctagattaaattcatgatgtgagagatttgcttcaaaataatctggggatttggaagaaggtggtgaggacgcaggaagaactggctgtgtgctggtgatgaggacaggacggttcgttacattgctctctttgtgtgtgctcaaaaaaattccataatacacttcttaaaagagagaagaaaaaaagagatcatca

SEQ ID NO: 156201 - DNA, 601 bp, Human
ccaccttcccacaaggcctgccctgctgcacctctgggagaagagcccaccaacatggggcatccactgctgcctctgtggttccaagtcaggggatccttctggcaaggaaacacattcctggagccaaggtgccacctctttttaactgacaacacatcagcagtctctccgggagccaggagactgctcctggctcccggagagctgactgtcccagcacctgtctgcatcactgcacgtaaggaaaaggccccaccaagtgcttccgttaggtgcacggccagaagttggcacaacstgtgaatcgctggtttgggcaccatatggatacggtcaagaaatcaccacagactaagtgtgaccatattaaggaattactagtgattcttcagtgtgaatcactatcagagttgtttttattttttaattatttttatttttatttatttttttgagacagaatctccctctgtcgcccaggctggagtgaagtggcacgatctcggctcactgcaacctccgcctgctgggttcaagagattctcctgtctcagcctcccgagtacctgggattacaggcacacaccaccacgcctgg

SEQ ID NO: 156202 - DNA, 601 bp, Human
ggaacatatcttctattctacagataccaagttaaaatgaggatataaatatcataaattccaaaagaattgcttggtagaaacagacaaaaagtgacttcttatgaaagttgtgttagtattaactggttctgaaaggctgcggtggcacagccagggtcccagctgcaggaggcttcccaagtccctgtcgctgccctaactcagcagtgctgaatctcacagccaggagctcccaccttcccacaaggcctgccctgctgcacctctgggagaagagcccaccaacatggggcatccrctgctgcctctgtggttccaagtcaggggatccttctggcaaggaaacacattcctggagccaaggtgccacctctttttaactgacaacacatcagcagtctctccgggagccaggagactgctcctggctcccggagagctgactgtcccagcacctgtctgcatcactgcacgtaaggaaaaggccccaccaagtgcttccgttaggtgcacggccagaagttggcacaacctgtgaatcgctggtttgggcaccatatggatacggtcaagaaatcaccacagactaagtgtgacc

SEQ ID NO: 156203 - DNA, 601 bp, Human
gccagctactcggggaggctgagacaggagaatcgcttgaacccgggaggtggaagttgcagtgagctgaggtcgtgccaccgcactccagtttgggtaagagagcgagattctgtctcaaaaaaaaaaaaaaaaaattacacctaataccaggctgggtgcagtggctcatgcctgtaatcccagtgctttggaaggccaaggcaggaggatcacttgaggccaggagtttgagaccagcctcagcaacatagtgagacttgtcttaaaaaatttttttaattagccaggcatggtagtrcatgcccgtagtcccagctattccagaggctgaggcaaaaggatcacttcggcccaagagttcaggctatagtgagctatgatcatgccactgcactctagcctgggcaacagagccaagaccctgtctcaaaaatttatatctaatatccaggaacatatcttctattctacagataccaagttaaaatgaggatataaatatcataaattccaaaagaattgcttggtagaaacagacaaaaagtgacttcttatgaaagttgtgttagtattaactggttctgaaaggctgcggtgg

SEQ ID NO: 156204 - DNA, 601 bp, Human
gtggtggcaggcacctgtagtgccagctactcggggaggctgagacaggagaatcgcttgaacccgggaggtggaagttgcagtgagctgaggtcgtgccaccgcactccagtttgggtaagagagcgagattctgtctcaaaaaaaaaaaaaaaaaattacacctaataccaggctgggtgcagtggctcatgcctgtaatcccagtgctttggaaggccaaggcaggaggatcacttgaggccaggagtttgagaccagcctcagcaacatagtgagacttgtcttaaaaaattttttwaattagccaggcatggtagtgcatgcccgtagtcccagctattccagaggctgaggcaaaaggatcacttcggcccaagagttcaggctatagtgagctatgatcatgccactgcactctagcctgggcaacagagccaagaccctgtctcaaaaatttatatctaatatccaggaacatatcttctattctacagataccaagttaaaatgaggatataaatatcataaattccaaaagaattgcttggtagaaacagacaaaaagtgacttcttatgaaagttgtgttagtattaact

SEQ ID NO: 156205 - DNA, 601 bp, Human
tgtcaaaactcagtacgaaaaaccatttgataaaagctcaaataaaattatatccagccgggcacagtggcccacgcctgtaatcccagcactttgggaggccgaggtgggcagatcatttgaggctaggagttcaagaccggcctggccatcatggtgaaaccgtacctctactaaaaatacaaaaattagccagatgtggtggcaggcacctgtagtgccagctactcggggaggctgagacaggagaatcgcttgaacccgggaggtggaagttgcagtgagctgaggtcgtgccacygcactccagtttgggtaagagagcgagattctgtctcaaaaaaaaaaaaaaaaaattacacctaataccaggctgggtgcagtggctcatgcctgtaatcccagtgctttggaaggccaaggcaggaggatcacttgaggccaggagtttgagaccagcctcagcaacatagtgagacttgtcttaaaaaatttttttaattagccaggcatggtagtgcatgcccgtagtcccagctattccagaggctgaggcaaaaggatcacttcggcccaagagttcaggctatagtgagctatg

SEQ ID NO: 156206 - DNA, 601 bp, Human
cctccgagatgagcacgcaaggccaagagcacaacttctgggcttggcaggactcctggaaggaggcacagccccttggggttgtgatgtcctcaagcctggttttcatgcccgtatcacctacatgcgccatcaaccagaataaggcaggggagcaaaggggcgcctagctggagccaaatcacggttaaaacaaagcctgtcaaaactcagtacgaaaaaccatttgataaaagctcaaataaaattatatccagccgggcacagtggcccacgcctgtaatcccagcactttgggagrccgaggtgggcagatcatttgaggctaggagttcaagaccggcctggccatcatggtgaaaccgtacctctactaaaaatacaaaaattagccagatgtggtggcaggcacctgtagtgccagctactcggggaggctgagacaggagaatcgcttgaacccgggaggtggaagttgcagtgagctgaggtcgtgccaccgcactccagtttgggtaagagagcgagattctgtctcaaaaaaaaaaaaaaaaaattacacctaataccaggctgggtgcagtggctcatgcctgtaatc

SEQ ID NO: 156207 - DNA, 601 bp, Human
acaaggactctcaaacgaatacttgcatatgctccacagcagaactatacacaagagcagaaaggtgggacaacccaaacacccatccatgtacaaacaaaccaactgtggtgcatacatcagtggaacatttagccataaaacaggatgaaatactaacacaagctacaaggcgaaggagcgagaaacattttcaggaaataagctcggcacaaaaggccatctgattgccgggcgtggtggctcacgcctgtaatcccagctacttaggaggctgaggcagaagaattccttgaacccrggagacggaggttgcagtgagccgagatcgcccactgcactccagcctgggcgacagagtgagactcaatctcaaaaaaaaaaaaaaaaaaaagtgggcagctggaattggctgaagggagattcattttccctacatatttctatattgtcttaaatttttttacaagcatgtattgattttctaatttacaaataaaatgtttcacactattattgttcaactgtcctttcgagacaatgcttataaaataccacttttccagatcaccccaacagcaaactgcagaaggacaaccaa

SEQ ID NO: 156208 - DNA, 601 bp, Human
tgaacccgggaggcagaggttgtattgagccgaaatcgcgccattgcactccagcctgggtgacagtgtaagactgtgtctcaaaaaataaataaataaatatagctaaacgtggagttacccagcaatacttgtaggtatcatactcaaaagaataaaaaacaaggactctcaaacgaatacttgcatatgctccacagcagaactatacacaagagcagaaaggtgggacaacccaaacacccatccatgtacaaacaaaccaactgtggtgcatacatcagtggaacatttagccatraaacaggatgaaatactaacacaagctacaaggcgaaggagcgagaaacattttcaggaaataagctcggcacaaaaggccatctgattgccgggcgtggtggctcacgcctgtaatcccagctacttaggaggctgaggcagaagaattccttgaacccgggagacggaggttgcagtgagccgagatcgcccactgcactccagcctgggcgacagagtgagactcaatctcaaaaaaaaaaaaaaaaaaaagtgggcagctggaattggctgaagggagattcattttccctacata

SEQ ID NO: 156209 - DNA, 601 bp, Human
gtgcctgtagtcccagctactcaggaagctgaggcaggagaatcgcttgaacccaggaggcggatggtacagtgagccgagattgcgccactgcactccagcctggtgataagagctagactccgtctcaaaacaaacaaacaaaaaagttaaacatgggcagggcatggtggctcacgcctgtaatcttagcactttgggaggccgaggcgggtgaaccacctgaggtcaggaatgcaagagcagcctggccaacatggtgaaaccccatctctactagaaatacaaaaaacattagctrggcatggtggcaggcacctgtaatcccagcttctcaggaggctgaggcaggagaatcgcttgaacccgggaggcagaggttgtattgagccgaaatcgcgccattgcactccagcctgggtgacagtgtaagactgtgtctcaaaaaataaataaataaatatagctaaacgtggagttacccagcaatacttgtaggtatcatactcaaaagaataaaaaacaaggactctcaaacgaatacttgcatatgctccacagcagaactatacacaagagcagaaaggtgggacaacccaaa

SEQ ID NO: 156210 - DNA, 601 bp, Human
aaaaagttaaaacgggccgggcgcagtggctctcgcctgtaatcccacactttgggagaaagaggcaggcggatcacgaggtcaagagatcgagacatcctggccaacatggtgaaaccccgtctctactaaaatacaaaaattagccgggcgtggtggtgtgtgcctgtagtcccagctactcaggaagctgaggcaggagaatcgcttgaacccaggaggcggatggtacagtgagccgagattgcgccactgcactccagcctggtgataagagctagactccgtctcaaaacaaacmaacaaaaaagttaaacatgggcagggcatggtggctcacgcctgtaatcttagcactttgggaggccgaggcgggtgaaccacctgaggtcaggaatgcaagagcagcctggccaacatggtgaaaccccatctctactagaaatacaaaaaacattagctgggcatggtggcaggcacctgtaatcccagcttctcaggaggctgaggcaggagaatcgcttgaacccgggaggcagaggttgtattgagccgaaatcgcgccattgcactccagcctgggtgacagtgtaagactgtg

SEQ ID NO: 156211 - DNA, 601 bp, Human
aaaagaaaatgaagctggatccctaccttacagcgcacacaaaaattaactcaaaatggatcaaagaactaaatgtaaaagctttaaactataaaactcttataagaaaacaggagtaaaacaataccatttctcagatatgattccaaaagagtgagaaaataaatagacaaactagatttcatcaaaatcaaaacttctatgcatcaaaagacatcaacaaagtaaaaaagacaacctacagaatgacagaaaatatttgcaaatcatgtctctgataaggatctagcttccagaatayataaaggactctcttaacaataaaaaagacaacacaattaaacaatgcgcaaaggacttcaatctccaaagatatacaaatggccaaaaagcacatggaaagatgtttgatatcatgaatcattaggaaaatgccaatcagtgctacagtgggttacacctcccacccactgggatagctgtaattaaaaaatggaaagtaagtgttgggatgtggaaaagatgaaacccttgcccactgttggtggaatgtaaaatggtccagcttctgcagataacagtatattcgttcctcaaaaag

SEQ ID NO: 156212 - DNA, 601 bp, Human
tggtgctggaacaattacatatccacataaaagaaaatgaagctggatccctaccttacagcgcacacaaaaattaactcaaaatggatcaaagaactaaatgtaaaagctttaaactataaaactcttataagaaaacaggagtaaaacaataccatttctcagatatgattccaaaagagtgagaaaataaatagacaaactagatttcatcaaaatcaaaacttctatgcatcaaaagacatcaacaaagtaaaaaagacaacctacagaatgacagaaaatatttgcaaatcatgtstctgataaggatctagcttccagaatatataaaggactctcttaacaataaaaaagacaacacaattaaacaatgcgcaaaggacttcaatctccaaagatatacaaatggccaaaaagcacatggaaagatgtttgatatcatgaatcattaggaaaatgccaatcagtgctacagtgggttacacctcccacccactgggatagctgtaattaaaaaatggaaagtaagtgttgggatgtggaaaagatgaaacccttgcccactgttggtggaatgtaaaatggtccagcttctgca

SEQ ID NO: 156213 - DNA, 601 bp, Human
ttaatttctattcacatccacagaacccagcaaagggcctggcactgaggagactaaactatttgttgaataaattggtcattcaatgaatgagttgaccaaaacaataatacgtatatatcaagtttctactatgtgctggactcacacttcctaatttcaaaacttactacaaagctacagtaaccaaaacattatagtgcaggcacaaggatatacagataacaatggaatagaattgagactctagaaataacccatacacctatggccaactgattttcaacaacaatgccaagamcacagtttttttaaacaaatggtgctggaacaattacatatccacataaaagaaaatgaagctggatccctaccttacagcgcacacaaaaattaactcaaaatggatcaaagaactaaatgtaaaagctttaaactataaaactcttataagaaaacaggagtaaaacaataccatttctcagatatgattccaaaagagtgagaaaataaatagacaaactagatttcatcaaaatcaaaacttctatgcatcaaaagacatcaacaaagtaaaaaagacaacctacagaatgacaga

SEQ ID NO: 156214 - DNA, 601 bp, Human
aatcccttcacatcattttcctgcctaaaaatcctccaatgcctcccatgatcgtcaggatacagttcaaaccctaacagagcaagcaggcctcccacactccaggtctctgctgccagaaacagactcttacatccagacggcctcatctcaaaggtgcttcccagcctactctgttcctacagctgagtcagtgtagtgtccagtacatatttatagtaaaattcgtatggcacccagttgtaactgttggatgactccaccttattttaatttctattcacatccacagaacccagcaaagggcctggcactgaggagactaaactatttgttgaataaattggtcattcaatgaatgagttgaccaaaacaataatacgtatatatcaagtttctactatgtgctggactcacacttcctaatttcaaaacttactacaaagctacagtaaccaaaacattatagtgcaggcacaaggatatacagataacaatggaatagaattgagactctagaaataacccatacacctatggccaactgattttcaacaacaatgccaagaccacagtttttttaaacaaatggtgctggaac

SEQ ID NO: 156215 - DNA, 601 bp, Human
cctcccaggttcaagcaattcttctgcctcagcctcctgagtagctgggattacaggtgcaccaccacacctggctaatttttgtatttttagtagagatgggatttcaccattttggcaggctgctctcaagcttcccacctcaggtgacccgcctgtctaggcctcccaaagtgctggaattacaggcgtgagccactgtgcccagtcccaaataatctcttttaaatgcaaatcccttcacatcattttcctgcctaaaaatcctccaatgcctcccatgatcgtcaggatacagttyaaaccctaacagagcaagcaggcctcccacactccaggtctctgctgccagaaacagactcttacatccagacggcctcatctcaaaggtgcttcccagcctactctgttcctacagctgagtcagtgtagtgtccagtacatatttatagtaaaattcgtatggcacccagttgtaactgttggatgactccaccttattttaatttctattcacatccacagaacccagcaaagggcctggcactgaggagactaaactatttgttgaataaattggtcattcaatgaatgagttgac

SEQ ID NO: 156216 - DNA, 601 bp, Human
gctgagatcataccactgcactccagcctgggcaacagagcaagactctatctcaaaaaaacaaaaaatccaaacaacaacaacaaaaataaaacaggcagagaacagatagcaacagtttcagaaatttatatgaaaagccaaaagattcagaccagccaacacagtactgaaggagaagaacaaaggtggggaattaacatcaacctgttgcccaaattatctattttattctcttatttatttatttattttgttttgagatggagtctcactctgtcacccaggctggagtgcagtrgtgcgatctcagctcacagcaacctcccctcccaggttcaagcaattcttctgcctcagcctcctgagtagctgggattacaggtgcaccaccacacctggctaatttttgtatttttagtagagatgggatttcaccattttggcaggctgctctcaagcttcccacctcaggtgacccgcctgtctaggcctcccaaagtgctggaattacaggcgtgagccactgtgcccagtcccaaataatctcttttaaatgcaaatcccttcacatcattttcctgcctaaaaatcctccaat

SEQ ID NO: 156217 - DNA, 601 bp, Human
ggtggcgcatgcctgcaatcccagctactcaggaggatgaggcaagagaatcgcttgaacctgagagggggaggttgcaatgagctgagatcataccactgcactccagcctgggcaacagagcaagactctatctcaaaaaaacaaaaaatccaaacaacaacaacaaaaataaaacaggcagagaacagatagcaacagtttcagaaatttatatgaaaagccaaaagattcagaccagccaacacagtactgaaggagaagaacaaaggtggggaattaacatcaacctgttgcccarattatctattttattctcttatttatttatttattttgttttgagatggagtctcactctgtcacccaggctggagtgcagtggtgcgatctcagctcacagcaacctcccctcccaggttcaagcaattcttctgcctcagcctcctgagtagctgggattacaggtgcaccaccacacctggctaatttttgtatttttagtagagatgggatttcaccattttggcaggctgctctcaagcttcccacctcaggtgacccgcctgtctaggcctcccaaagtgctggaattacaggc

SEQ ID NO: 156218 - DNA, 601 bp, Human
gagccaccgcgcccagcctagaattttattttatttttcttaaggaaggcctacaattattattattatttttttttttttgagatggagtttcgctcttgtttcccaggctggagtgcaatggcctaatctcagctcaccgcaacctccgcctccctggttcaagcaattcgcctgcctcagcctcccgagtatctgagattataggcatgcaccatcacgcccggctaattttgtatttttagtagatatggggtttctccatgttggtcaggctggtctcaaactcctgacctcaggygatccacccacccggcctcccaaagtactgggattacgggcgtgagccaccatgaccaactggcctacaaattttaagcagaagaaataaaagaaaattcatatggaaaaccacagtggagaaaccgcaaaactccaaagacaaaagtcttaaaaaacaggcagagaggccagacacggtggctcatgcctgtcatcccagcactttgggaggccgaggcgggtggatcatgaggtcaggagttcgacaccagcctcaccaacatagtgaaaccccatctctactaaaaatacaaaaatt

SEQ ID NO: 156219 - DNA, 601 bp, Human
ccacaaatggctcatctttgtatttttagtagagacggggtttcaccatgttggccaggctggtctcaaactcctaactcaggtgatccacccgcctcagcttcccaaagtactgggattacaggcaggagccaccgcgcccagcctagaattttattttatttttcttaaggaaggcctacaattattattattatttttttttttttgagatggagtttcgctcttgtttcccaggctggagtgcaatggcctaatctcagctcaccgcaacctccgcctccctggttcaagcaattckcctgcctcagcctcccgagtatctgagattataggcatgcaccatcacgcccggctaattttgtatttttagtagatatggggtttctccatgttggtcaggctggtctcaaactcctgacctcaggcgatccacccacccggcctcccaaagtactgggattacgggcgtgagccaccatgaccaactggcctacaaattttaagcagaagaaataaaagaaaattcatatggaaaaccacagtggagaaaccgcaaaactccaaagacaaaagtcttaaaaaacaggcagagaggcca

SEQ ID NO: 156220 - DNA, 601 bp, Human
gagtgcagtggcatgatctcggttcactacaacttctgcctcctgggttccagcaattctcctgcctcagcctcccgagtagctgggattacagatgggtgccaccacaaatggctcatctttgtatttttagtagagacggggtttcaccatgttggccaggctggtctcaaactcctaactcaggtgatccacccgcctcagcttcccaaagtactgggattacaggcaggagccaccgcgcccagcctagaattttattttatttttcttaaggaaggcctacaattattattattatttttttttttttgagatggagtttcgctcttgtttcccaggctggagtgcaatggcctaatctcagctcaccgcaacctccgcctccctggttcaagcaattcgcctgcctcagcctcccgagtatctgagattataggcatgcaccatcacgcccggctaattttgtatttttagtagatatggggtttctccatgttggtcaggctggtctcaaactcctgacctcaggcgatccacccacccggcctcccaaagtactgggattacgggcgtgagccaccatgaccaactggcctac

SEQ ID NO: 156221 - DNA, 601 bp, Human
ggagtgcagtggcatgatctcggttcactacaacttctgcctcctgggttccagcaattctcctgcctcagcctcccgagtagctgggattacagatgggtgccaccacaaatggctcatctttgtatttttagtagagacggggtttcaccatgttggccaggctggtctcaaactcctaactcaggtgatccacccgcctcagcttcccaaagtactgggattacaggcaggagccaccgcgcccagcctagaattttattttatttttcttaaggaaggcctacaattattattattwtttttttttttttgagatggagtttcgctcttgtttcccaggctggagtgcaatggcctaatctcagctcaccgcaacctccgcctccctggttcaagcaattcgcctgcctcagcctcccgagtatctgagattataggcatgcaccatcacgcccggctaattttgtatttttagtagatatggggtttctccatgttggtcaggctggtctcaaactcctgacctcaggcgatccacccacccggcctcccaaagtactgggattacgggcgtgagccaccatgaccaactggccta

SEQ ID NO: 156222 - DNA, 601 bp, Human
gctggagtgcagtggcatgatctcggttcactacaacttctgcctcctgggttccagcaattctcctgcctcagcctcccgagtagctgggattacagatgggtgccaccacaaatggctcatctttgtatttttagtagagacggggtttcaccatgttggccaggctggtctcaaactcctaactcaggtgatccacccgcctcagcttcccaaagtactgggattacaggcaggagccaccgcgcccagcctagaattttattttatttttcttaaggaaggcctacaattattattwttatttttttttttttgagatggagtttcgctcttgtttcccaggctggagtgcaatggcctaatctcagctcaccgcaacctccgcctccctggttcaagcaattcgcctgcctcagcctcccgagtatctgagattataggcatgcaccatcacgcccggctaattttgtatttttagtagatatggggtttctccatgttggtcaggctggtctcaaactcctgacctcaggcgatccacccacccggcctcccaaagtactgggattacgggcgtgagccaccatgaccaactggc

SEQ ID NO: 156223 - DNA, 601 bp, Human
caggctggagtgcagtggcatgatctcggttcactacaacttctgcctcctgggttccagcaattctcctgcctcagcctcccgagtagctgggattacagatgggtgccaccacaaatggctcatctttgtatttttagtagagacggggtttcaccatgttggccaggctggtctcaaactcctaactcaggtgatccacccgcctcagcttcccaaagtactgggattacaggcaggagccaccgcgcccagcctagaattttattttatttttcttaaggaaggcctacaattattwttattatttttttttttttgagatggagtttcgctcttgtttcccaggctggagtgcaatggcctaatctcagctcaccgcaacctccgcctccctggttcaagcaattcgcctgcctcagcctcccgagtatctgagattataggcatgcaccatcacgcccggctaattttgtatttttagtagatatggggtttctccatgttggtcaggctggtctcaaactcctgacctcaggcgatccacccacccggcctcccaaagtactgggattacgggcgtgagccaccatgaccaact

SEQ ID NO: 156224 - DNA, 601 bp, Human
cccaggctggagtgcagtggcatgatctcggttcactacaacttctgcctcctgggttccagcaattctcctgcctcagcctcccgagtagctgggattacagatgggtgccaccacaaatggctcatctttgtatttttagtagagacggggtttcaccatgttggccaggctggtctcaaactcctaactcaggtgatccacccgcctcagcttcccaaagtactgggattacaggcaggagccaccgcgcccagcctagaattttattttatttttcttaaggaaggcctacaattattattattatttttttttttttgagatggagtttcgctcttgtttcccaggctggagtgcaatggcctaatctcagctcaccgcaacctccgcctccctggttcaagcaattcgcctgcctcagcctcccgagtatctgagattataggcatgcaccatcacgcccggctaattttgtatttttagtagatatggggtttctccatgttggtcaggctggtctcaaactcctgacctcaggcgatccacccacccggcctcccaaagtactgggattacgggcgtgagccaccatgaccaa

SEQ ID NO: 156225 - DNA, 601 bp, Human
gaagataaaccagtaatccacattagcagtgtagagtctttgaaaagggctggtttctgtttagcccttagtgaagaagcctaatggtggctggggagggaggggtacagtgaggcgcgtctgacctcctctcctgctacggccaggaactcaagcttccaaggtttctctggggttcccttgaccaaggggagggctccattcagttggttgcagggcttagaattttattttatattttatttttttgagatggcatctcgctctgtcacccaggctggagtgcagtggcatgatctcrgttcactacaacttctgcctcctgggttccagcaattctcctgcctcagcctcccgagtagctgggattacagatgggtgccaccacaaatggctcatctttgtatttttagtagagacggggtttcaccatgttggccaggctggtctcaaactcctaactcaggtgatccacccgcctcagcttcccaaagtactgggattacaggcaggagccaccgcgcccagcctagaattttattttatttttcttaaggaaggcctacaattattattattatttttttttttttgagatgga

SEQ ID NO: 156226 - DNA, 601 bp, Human
ggaagataaaccagtaatccacattagcagtgtagagtctttgaaaagggctggtttctgtttagcccttagtgaagaagcctaatggtggctggggagggaggggtacagtgaggcgcgtctgacctcctctcctgctacggccaggaactcaagcttccaaggtttctctggggttcccttgaccaaggggagggctccattcagttggttgcagggcttagaattttattttatattttatttttttgagatggcatctcgctctgtcacccaggctggagtgcagtggcatgatctyggttcactacaacttctgcctcctgggttccagcaattctcctgcctcagcctcccgagtagctgggattacagatgggtgccaccacaaatggctcatctttgtatttttagtagagacggggtttcaccatgttggccaggctggtctcaaactcctaactcaggtgatccacccgcctcagcttcccaaagtactgggattacaggcaggagccaccgcgcccagcctagaattttattttatttttcttaaggaaggcctacaattattattattatttttttttttttgagatgg

SEQ ID NO: 156227 - DNA, 601 bp, Human
gagggctactgagccagcctgagggtgcccacaggaaaaacatgagtcacggcacatctgtgcttgtttctgtcccaagaggttctcaggaggtttagtaattacatgtggtccttcaaagagggagggtggctgtgaggtgagtggttacgtacttgtgagacttcagtaagtgcccagtaaatgtacattttacctaagatagaaggaaacagaggaagagaactaagcagacctctcagggaagggtgaaggaaccattaatctcatcttgtctttaatctgtatctgggaagataarccagtaatccacattagcagtgtagagtctttgaaaagggctggtttctgtttagcccttagtgaagaagcctaatggtggctggggagggaggggtacagtgaggcgcgtctgacctcctctcctgctacggccaggaactcaagcttccaaggtttctctggggttcccttgaccaaggggagggctccattcagttggttgcagggcttagaattttattttatattttatttttttgagatggcatctcgctctgtcacccaggctggagtgcagtggcatgatctcggttcacta

SEQ ID NO: 156228 - DNA, 601 bp, Human
gatagtgggctaggggcaactcatatccgaagagataacggcagagtatgatccagcaaccatgaaagacgccaacccgcagattcaggatctcaagcaagtgagggctactgagccagcctgagggtgcccacaggaaaaacatgagtcacggcacatctgtgcttgtttctgtcccaagaggttctcaggaggtttagtaattacatgtggtccttcaaagagggagggtggctgtgaggtgagtggttacgtacttgtgagacttcagtaagtgcccagtaaatgtacattttacctaagatagaaggaaacagaggaagagaactaagcagacctctcagggaagggtgaaggaaccattaatctcatcttgtctttaatctgtatctgggaagataaaccagtaatccacattagcagtgtagagtctttgaaaagggctggtttctgtttagcccttagtgaagaagcctaatggtggctggggagggaggggtacagtgaggcgcgtctgacctcctctcctgctacggccaggaactcaagcttccaaggtttctctggggttcccttgaccaaggggagggctccattcagt

SEQ ID NO: 156229 - DNA, 601 bp, Human
gcagcaattacaggacagaagagtgatcaggaacagcaggagagagaaggtctaatgtatgttcaatcagaggtccctaaagagaggggccagatagtgggctaggggcaactcatatccgaagagataacggcagagtatgatccagcaaccatgaaagacgccaacccgcagattcaggatctcaagcaagtgagggctactgagccagcctgagggtgcccacaggaaaaacatgagtcacggcacatctgtgcttgtttctgtcccaagaggttctcaggaggtttagtaattacaygtggtccttcaaagagggagggtggctgtgaggtgagtggttacgtacttgtgagacttcagtaagtgcccagtaaatgtacattttacctaagatagaaggaaacagaggaagagaactaagcagacctctcagggaagggtgaaggaaccattaatctcatcttgtctttaatctgtatctgggaagataaaccagtaatccacattagcagtgtagagtctttgaaaagggctggtttctgtttagcccttagtgaagaagcctaatggtggctggggagggaggggtacagtgagg

SEQ ID NO: 156230 - DNA, 601 bp, Human
aaagtacaggaaccaaaattaaaactcaatgtctgttttgagttgctgtttgggaaaaaagaaagaaagaaacactcaatggaaggaccttataacagaatacaatattagtaaactggaaaaaagaccagaagaaattacccagaatgcagcacaagaagcagcaattacaggacagaagagtgatcaggaacagcaggagagagaaggtctaatgtatgttcaatcagaggtccctaaagagaggggccagatagtgggctaggggcaactcatatccgaagagataacggcagagtaygatccagcaaccatgaaagacgccaacccgcagattcaggatctcaagcaagtgagggctactgagccagcctgagggtgcccacaggaaaaacatgagtcacggcacatctgtgcttgtttctgtcccaagaggttctcaggaggtttagtaattacatgtggtccttcaaagagggagggtggctgtgaggtgagtggttacgtacttgtgagacttcagtaagtgcccagtaaatgtacattttacctaagatagaaggaaacagaggaagagaactaagcagacctctcagggaag

SEQ ID NO: 156231 - DNA, 601 bp, Human
atggaaaagggagagagttacagaggaagacacctgactttctaaggtaaacctttacagctaacggggcttgttttaagcaggctcagcccagcaaaaagcaacagatacaaaagacaaaagaaagagacccacgaaagatttcagatattcttggatacacagtaaaactgtattatatttaaattaaaaagaaaaaactgttatcttggaggcatggggtatagcaaaaaaaaaaattaaggaagcaaaaaaaaaagatgaacttgaaatatctatcaaaggccaggcgcagtggctyagctctgtaatcccaggactttgggaggccgaggtgggcagatcacgaggtcaggagatcgagactgtcttggccaacatggtgaaaccctgtctctactaaaacacaaaaaattagccaggcgtggtgatgcgtgcctgtaatcccagctacttgggaggctgaggcaggggaatcacttgaacctgggaggcggaggttgctgtgagctgagattgcaccactgcactccagcctgggcaacaaagcgagactctgtctcaaaaaacaaaacaaaacaaaacaaaacaaaaaactatc

SEQ ID NO: 156232 - DNA, 601 bp, Human
acacaacttccctttgcgtcaagattaatataaataaatgccttggagcagatggaaaagggagagagttacagaggaagacacctgactttctaaggtaaacctttacagctaacggggcttgttttaagcaggctcagcccagcaaaaagcaacagatacaaaagacaaaagaaagagacccacgaaagatttcagatattcttggatacacagtaaaactgtattatatttaaattaaaaagaaaaaactgttatcttggaggcatggggtatagcaaaaaaaaaaattaaggaagcaaaaaaaaaagatgaacttgaaatatctatcaaaggccaggcgcagtggctcagctctgtaatcccaggactttgggaggccgaggtgggcagatcacgaggtcaggagatcgagactgtcttggccaacatggtgaaaccctgtctctactaaaacacaaaaaattagccaggcgtggtgatgcgtgcctgtaatcccagctacttgggaggctgaggcaggggaatcacttgaacctgggaggcggaggttgctgtgagctgagattgcaccactgcactccagcctgggcaacaaagc

SEQ ID NO: 156233 - DNA, 601 bp, Human
atcatgccattgcctcagccctgggaggcattcaggtcagcttcactcactggctggcattattaggagtaacaacatctgccaaacactgcttccttactggccaaggtgaagtggacacaacttccctttgcgtcaagattaatataaataaatgccttggagcagatggaaaagggagagagttacagaggaagacacctgactttctaaggtaaacctttacagctaacggggcttgttttaagcaggctcagcccagcaaaaagcaacagatacaaaagacaaaagaaagagaccmacgaaagatttcagatattcttggatacacagtaaaactgtattatatttaaattaaaaagaaaaaactgttatcttggaggcatggggtatagcaaaaaaaaaaattaaggaagcaaaaaaaaaagatgaacttgaaatatctatcaaaggccaggcgcagtggctcagctctgtaatcccaggactttgggaggccgaggtgggcagatcacgaggtcaggagatcgagactgtcttggccaacatggtgaaaccctgtctctactaaaacacaaaaaattagccaggcgtggtgatg

SEQ ID NO: 156234 - DNA, 601 bp, Human
tccctgggatggcagccagagacatccaggcgctaaggaaacacctggtagaccacaccagtcctcaaacagtagtctgcaggcatttggcctacaccgaacactattcagtcagaaaggtgaaactgtctctggtttgagcttcggtgatcatgccattgcctcagccctgggaggcattcaggtcagcttcactcactggctggcattattaggagtaacaacatctgccaaacactgcttccttactggccaaggtgaagtggacacaacttccctttgcgtcaagattaatataaayaaatgccttggagcagatggaaaagggagagagttacagaggaagacacctgactttctaaggtaaacctttacagctaacggggcttgttttaagcaggctcagcccagcaaaaagcaacagatacaaaagacaaaagaaagagacccacgaaagatttcagatattcttggatacacagtaaaactgtattatatttaaattaaaaagaaaaaactgttatcttggaggcatggggtatagcaaaaaaaaaaattaaggaagcaaaaaaaaaagatgaacttgaaatatctatcaaag

SEQ ID NO: 156235 - DNA, 601 bp, Human
tagcgtatctaacaccatgctctatccctgggatggcagccagagacatccaggcgctaaggaaacacctggtagaccacaccagtcctcaaacagtagtctgcaggcatttggcctacaccgaacactattcagtcagaaaggtgaaactgtctctggtttgagcttcggtgatcatgccattgcctcagccctgggaggcattcaggtcagcttcactcactggctggcattattaggagtaacaacatctgccaaacactgcttccttactggccaaggtgaagtggacacaacttcmctttgcgtcaagattaatataaataaatgccttggagcagatggaaaagggagagagttacagaggaagacacctgactttctaaggtaaacctttacagctaacggggcttgttttaagcaggctcagcccagcaaaaagcaacagatacaaaagacaaaagaaagagacccacgaaagatttcagatattcttggatacacagtaaaactgtattatatttaaattaaaaagaaaaaactgttatcttggaggcatggggtatagcaaaaaaaaaaattaaggaagcaaaaaaaaaag

SEQ ID NO: 156236 - DNA, 601 bp, Human
cagcttcaggaattaccagttttcatagctaattgtttcacagccctccggaatctgggaggaggtattggagcctttaaaagcaaatcttggacatcatatgtttcacccataattacttcggcaggcatctagcgtatctaacaccatgctctatccctgggatggcagccagagacatccaggcgctaaggaaacacctggtagaccacaccagtcctcaaacagtagtctgcaggcatttggcctacaccgaacactattcagtcagaaaggtgaaactgtctctggtttgagcttyggtgatcatgccattgcctcagccctgggaggcattcaggtcagcttcactcactggctggcattattaggagtaacaacatctgccaaacactgcttccttactggccaaggtgaagtggacacaacttccctttgcgtcaagattaatataaataaatgccttggagcagatggaaaagggagagagttacagaggaagacacctgactttctaaggtaaacctttacagctaacggggcttgttttaagcaggctcagcccagcaaaaagcaacagatacaaaagacaaaagaaaga

SEQ ID NO: 156237 - DNA, 601 bp, Human
ctgtaaaaggaaaaggcaacaagttcttattaaagtctcaaacattctcccccaaaaaaggtgagagagggatcatgaacccccatgtacccagcttcaggaattaccagttttcatagctaattgtttcacagccctccggaatctgggaggaggtattggagcctttaaaagcaaatcttggacatcatatgtttcacccataattacttcggcaggcatctagcgtatctaacaccatgctctatccctgggatggcagccagagacatccaggcgctaaggaaacacctggtagacyacaccagtcctcaaacagtagtctgcaggcatttggcctacaccgaacactattcagtcagaaaggtgaaactgtctctggtttgagcttcggtgatcatgccattgcctcagccctgggaggcattcaggtcagcttcactcactggctggcattattaggagtaacaacatctgccaaacactgcttccttactggccaaggtgaagtggacacaacttccctttgcgtcaagattaatataaataaatgccttggagcagatggaaaagggagagagttacagaggaagacacctga

SEQ ID NO: 156238 - DNA, 601 bp, Human
aaggatgagcagcagatctgccatggggaaatcaaccacatgcagcaagaacctctggggcagcggctccccaaagaacacaatgtcgggcttcacaacgccggtgcagaccgggcagcggggaaccctgtctgccatcacgtcagcctggaaaacagagaaaacaggcctgaggaagatgcctgcaacaccctgtaaaaggaaaaggcaacaagttcttattaaagtctcaaacattctcccccaaaaaaggtgagagagggatcatgaacccccatgtacccagcttcaggaattaccrgttttcatagctaattgtttcacagccctccggaatctgggaggaggtattggagcctttaaaagcaaatcttggacatcatatgtttcacccataattacttcggcaggcatctagcgtatctaacaccatgctctatccctgggatggcagccagagacatccaggcgctaaggaaacacctggtagaccacaccagtcctcaaacagtagtctgcaggcatttggcctacaccgaacactattcagtcagaaaggtgaaactgtctctggtttgagcttcggtgatcatgccattgc

SEQ ID NO: 156239 - DNA, 601 bp, Human
gcagtgtcccctgccagaccctcctcacctcggtaaactcttagatccaactccacctgcctgacttgacactgcagctggttcccaacccttctagcctttctatcctacttgttatctttctcataacatcaatcatctcctaacaaactatataacttcttacactgacatctgaccgtgtatgtccaaagcactggagcagggcccagcacacaatgaatgcctgaacaaacacatgctctgggcccctgtggctgccctgggcccctctgagcacaggtctttctggcccttctgycctcggtgcctacatccagtcacgcacacactgacttcatggtctcatttcttgctctcatcacagcttttaggaatttcctgagctgcagacgcagacgcagaacagctgcttgaacacatccagggcatgtttcccgacacctcagacacgcacagaaccgagctgggcatcctccctcccaaatcacgcctcaccagcaagtgccctgaccttacagaccaagccagacgcctccttctcacgtccccaaaacatcacagactgcgagtccagtccccctcctcgccatccctcagg

SEQ ID NO: 156240 - DNA, 601 bp, Human
agcctctagagaggcctagctcggtgccatcaggcttcttcatacagctctcaaagcttcttttaagaggaacaaggtaaaaaatggatacattaataaatggcattaaaactggctcattatctgggaggaaaatactccattcctacctcccactgaaaaaaaattcaaatggattaaaggtttcaatgtaaacaaaacagttcttgaagaaaactaaggatttacaagtaaggatagggaagaacgttttaggcgcaaaaactgaagtcagataaggcaaaggaaaatgacagatctractatgtaaatactattatctcggtatctacataaaactactatgtagaaaatttaaaatttttaaaaacctctcatcatcataaactgcaaaaatatttacaacatatgacaatagtttatattgctaattgataaactcatttataaacatataatttatgaactaatttataatgctaatttataatgaaatttatattaacagctgggcatggtggttcacacctataatcccagcactttgggaggccgaggcgggcagatcagctgaggtcaggagttcaagaccagcctggcc

SEQ ID NO: 156241 - DNA, 601 bp, Human
ggcagtcagagcctgcgatatagggaaaacccaccaccaatctcatttcttcagctgagctcctgccgcttggcctccgtgacggttttctcccctccgcctctctctctctctcccacttcttgctgtttccacacatccttgcttttccccacctccgttccaaggctcatcagggatccaaccttcctgcctcctctttgtgagcacgttctgttctccctgtcctccccacctcgctgtctcccagcatgacacagagggacaacagcacagactcgtccatctcctctggctagcyctgcttgctgtgacagccaccaccagcatcgggcacccagacgagctggtgcccccgagcaggagttactgttacgtctctccatggtcttccccgcccagcctctagagaggcctagctcggtgccatcaggcttcttcatacagctctcaaagcttcttttaagaggaacaaggtaaaaaatggatacattaataaatggcattaaaactggctcattatctgggaggaaaatactccattcctacctcccactgaaaaaaaattcaaatggattaaaggtttcaatgtaaacaaaac

SEQ ID NO: 156242 - DNA, 601 bp, Human
cttagaaagcatcaaggctctttggctttcctcagcggattataattgatcaatggctctcataccaattacttccgaaaagcatcactcatgtagccttcatcccacatagatgcagagaactttagcttctcaaagttctttaacccgtatcatcttagaatcacataccaggccttagagggacactgttggctgctttattttagggagtgaaggtaacgcctatagtctgttaagaatacagactcatcagccctgagtgtctggaccgtgtccctgcttggcctgttagcatctrtttcctcatctctaaatggaggtattgaaagtaacacccagtcaggtccaggtagtgcctggtgcaggattcacagcatcatcagctattactgttactgtgttaaccaacggggctccatatcaggtggaccataccctagagcagtgagaagggcagccccttggatggtcctcctcagcagtctgtaccttcccagtttcccgctgcacaaggtcccgcatctcttctgtccagcccagaagctccactaggctttccacgccgtgaaccacgtcccccagctgggccacgtccctg

SEQ ID NO: 156243 - DNA, 601 bp, Human
acctgcctgtaatcatgacactggactttaaatgcttaatgctaccacctcccattgaaaacccttaatatcaaggctacacatgctacatgattcttatgggaaactgcattttctgtaacttcacttgtttataggcggtttgaaatctcttagaaagcatcaaggctctttggctttcctcagcggattataattgatcaatggctctcataccaattacttccgaaaagcatcactcatgtagccttcatcccacatagatgcagagaactttagcttctcaaagttctttaacccrtatcatcttagaatcacataccaggccttagagggacactgttggctgctttattttagggagtgaaggtaacgcctatagtctgttaagaatacagactcatcagccctgagtgtctggaccgtgtccctgcttggcctgttagcatctgtttcctcatctctaaatggaggtattgaaagtaacacccagtcaggtccaggtagtgcctggtgcaggattcacagcatcatcagctattactgttactgtgttaaccaacggggctccatatcaggtggaccataccctagagcagtg

SEQ ID NO: 156244 - DNA, 601 bp, Human
tgaattgtaatcatccccatgtgtcaagggtggggccaagtggaagtaactgaatcatgggggcgggtctttcccacactcttcttctgatagtgaataagtctcacaagatctgatagttttataaagggcagttcccccgcacacgtcctcttgcctgccaccttgtaagacagtactttgctcctgctttgccttccactatgattgtgaggcccccacagccatatggaactgtgagtccattaaacctctttcctttataaattacccagtctcaggtatgcctttatgagcagcmagagaacagactaatacactggtgaaatcccctttggacagtgttacacctgcctgtaatcatgacactggactttaaatgcttaatgctaccacctcccattgaaaacccttaatatcaaggctacacatgctacatgattcttatgggaaactgcattttctgtaacttcacttgtttataggcggtttgaaatctcttagaaagcatcaaggctctttggctttcctcagcggattataattgatcaatggctctcataccaattacttccgaaaagcatcactcatgtagccttca

SEQ ID NO: 156245 - DNA, 601 bp, Human
atctgccttggaaggcaagaggagcatcaactgtgatatattgtagttgatatggtttggctgtgtccccacccaaatctcaccttgaattgtaatcatccccatgtgtcaagggtggggccaagtggaagtaactgaatcatgggggcgggtctttcccacactcttcttctgatagtgaataagtctcacaagatctgatagttttataaagggcagttcccccgcacacgtcctcttgcctgccaccttgtaagacagtactttgctcctgctttgccttccactatgattgtgaggtccccacagccatatggaactgtgagtccattaaacctctttcctttataaattacccagtctcaggtatgcctttatgagcagccagagaacagactaatacactggtgaaatcccctttggacagtgttacacctgcctgtaatcatgacactggactttaaatgcttaatgctaccacctcccattgaaaacccttaatatcaaggctacacatgctacatgattcttatgggaaactgcattttctgtaacttcacttgtttataggcggtttgaaatctcttagaaagcatcaagg

SEQ ID NO: 156246 - DNA, 601 bp, Human
aatgtaacaatgtgcaagatattttttgttgttgttttttgcacttttgacataccctatccccaaacacaccccaaaccaggacactgtggaattaatacagtttggaaattgggtatagtttagtgactcagtgttagttaagatgctggcaacagatgttggcaaaggctatggaatgagtcccaagaatgacaaaccttacattactccaaaggtttgaaatccaggatttctctggttaatatggttaatagttccactgctggttttaattgtcttagagtggaaggaggtgtcrtattttcaggccctagtaatctcttccttcagaattcttctgaataaaaagcttagcaacaaaatcactagagttagagtgctatgccttcttgatttaatactaaaacatggaacaaatgaaaccactctggcctttttccaacctctacagatccctcattcttatacttctagtccgtcttttcttcctcataacaccccaattccctttttgctctttcttttcctcctcaaatcatatctctgcattgtctcgctatgtggccacccttgatctccagtgacctccaaagggcaa

SEQ ID NO: 156247 - DNA, 601 bp, Human
aaataaataaataaataaataaataaataaatcctaaatgcttttttctatcagaaaaatagaagcaattatattaccatttttcaaaacatacgagggaaataacacttattcttaatcctaatgatattttttcttaaatcttaacaattatcctgagcacgtaacaaaattttcaaagcaaggtataagtatcctgtcttttagggtgtggagagaaaaaatggttggggataaaactgagatattgcaaaatcaagtaagatgttgcaatttaaatagttgggatttgttactcttycagttttttttctttttttttttttggaaaagtattatatactagtatctatctgttacaatgaaataaataataattaataaaaattaacacatgccaggcactgtgctcaggagtttacacatttcatttaatcatcctaacactttgaggcagatgatattattgtccttattttgtagatcacaagaaagagacaaaaataatttgcttaagcgcatgaatgcagaaccaggacttgaatctgggctatctgatccctagcccctgcattaactaaaagttagaagttccagtctc

SEQ ID NO: 156248 - DNA, 601 bp, Human
tatttcacttcaagaatgtggtgaatcctaccaagaaatgtttaacacctccataaattgtggtttgtttcttattttctatggttgcattcaatttcatagtctcatgctataatttgattttttataccacaggtattaattttcatcattcatttagggtagattccccacaaatatccttaattagaaaaaaataaaactgggctgggtatagtggcttatgcccataatcttagcactttggaaggctgaggcgggaggatcccttgagcctaggagttccagaccagggcaacayagcaaaatccagtctgtatgaaaaatacaaaaaagtcagcccagcatggtgatgcacacctgtggtcccagctacttgggaggctgaggtgggaggatcacctgagcctaggtgagcctgcgatgagtcgagatcacgccaccacactccagcagcctgggccaaaggagtgataccctgtctcaaaaaataaataaataaataaataaataaataaataaataaatcctaaatgcttttttctatcagaaaaatagaagcaattatattaccatttttcaaaacatacgagggaaataa

SEQ ID NO: 156249 - DNA, 601 bp, Human
ataatttcttacaagataaaactttcaagttgtctatatctgtgattgtttcaacatttcaccaaatctagatactgcaaaatcatagactttcacaatttttctccattttggtagagaataaaaatttatccaaataaaattagaagtcaaaatacatcaaagtcaagatttttctgaagcacaattgtcaaaatagataattaaaccatatctgctttcatcttttgatttgttcaactccttcttcgcttttgtagggagaaatttgagcttcttcctttgcaagccttattttacrtaattgtaacttgctaaaagcttcaaaagctgaattttcatgctacattcattcagtaatcgattaaaaatttccaactggtcttgaacataatgcaatctaaatttgggttgctttacaaagtggtttttcaaaggctcaggcattcccaaaatccaattgatgacatgcaacacagacaggaatatacatatagtcattctgaaatgtttccttgcatggtagtgttcaatatcagcttctgtcagaaaagttttgtagatcagttacttataaaatctgtgtgtgtgtgtgtgtgtg

SEQ ID NO: 156250 - DNA, 601 bp, Human
taaatgaagaatcttctcattttttagattaaaatatgtaaatatttcaggccaatatcgtcataggtgctgtctttctaccttcattcaaagcacttttgctcaataatttcttacaagataaaactttcaagttgtctatatctgtgattgtttcaacatttcaccaaatctagatactgcaaaatcatagactttcacaatttttctccattttggtagagaataaaaatttatccaaataaaattagaagtcaaaatacatcaaagtcaagatttttctgaagcacaattgtcaaartagataattaaaccatatctgctttcatcttttgatttgttcaactccttcttcgcttttgtagggagaaatttgagcttcttcctttgcaagccttattttacataattgtaacttgctaaaagcttcaaaagctgaattttcatgctacattcattcagtaatcgattaaaaatttccaactggtcttgaacataatgcaatctaaatttgggttgctttacaaagtggtttttcaaaggctcaggcattcccaaaatccaattgatgacatgcaacacagacaggaatatacatata

SEQ ID NO: 156251 - DNA, 601 bp, Human
caagcaactttaaaaaaatattggccaggcacagtggctaacgcctatcatcccagcactttgggaggctgaggcacgtgcatcatttgaggtcaggagaatttgagaccagcctggtgtcatgtgaccagacatggtgaaaccctgtctctactaaaaatacaaaaaaatttgccaggtatggtggtgggtgcctgtagtcccagctactcgggaggctgagacaggagaattgcttgaacccaggaggcggaggttgcagcgagccaagatcatgccactgaactccagcctgggcaasagagtgacactctgtctcaacaacaacaaaaaattgattatctgaacatttttaatggtacagacaattattctttatatgtattcacataccttaattggttatttagatattattgtctctagcattgggatgtggacatttttcaggaacatgtgttttttttcgttttttatttaaacagttatttttttataaaactgcaatctttttcaaaacttcattttatggttaatatatttgaaattatggacaactttaattgatgcttcactatatgtttttaactgagaacacatt

SEQ ID NO: 156252 - DNA, 601 bp, Human
ttaaaatatgtgtttattggacgggcgtggtggctcacgcccgtaatcccagtactttgggtggctgaggcaggcggatcacgaggtcaggagatcgagatcatcacggctaacatggtgaaaccccatctctactaaaactataaaaatttagctgggagtggtgttgcgtgcctgtaatcccagctactcaggaggctgaggcttggagaattgcttgaacccgggaggcagagattgcagtgagctgagatcatgccactgcactccagcctgggtgacagagcgagactcggtctcaaaaaaaaaaaaaatgtgtttattgacctgaatttggtcttattatattggtggacctataagataattctatccaaaatttattttcaaaataaaaatttcctgaaatatcttaaagtgatagtgatacaaagttatgaacattcaagcaactttaaaaaaatattggccaggcacagtggctaacgcctatcatcccagcactttgggaggctgaggcacgtgcatcatttgaggtcaggagaatttgagaccagcctggtgtcatgtgaccagacatggtgaaaccctgtctctacta

SEQ ID NO: 156253 - DNA, 601 bp, Human
atacctgtagacattgagctcctggatattggtagtatacacgagctgcgcctaagatatataagtgacaagagaagagcaaagaataaatttttgttatcagaatgttgaggcttaatgatacccacagttaatagatgtttgtagcttttaaaggggactgacaagtggcatatctatgagctcttctttcacaagccagaggaattaccagccatcccacaaagaaaagccaaattctaaacagagtagttggcatgtgaacaaacactagcagcccctccttgcctaaaaaccaccsaaatagagaagttgatcctccttagataagaaccataaatcaaataaaatgggtcagagctaagcccctttaactaaacaggatggtgcctaggaggagactataatgttattaaacttgacatatgaaaagaaataacatgtgaatctaaaagatggttggctggcaattcatttattaattgaacaaatatgtattgagggcctgtcatgtgccagggctgaggatgtagcagtcaaaaagcaaaaaaatcaaataaaaactgtaagccctgaagcttacattctggtgctgtgaaac

SEQ ID NO: 156254 - DNA, 601 bp, Human
ggaagtacatcaaaggccagtcaggaaaacacaaaccacatgagtacacagagtttagaccagaaacctgattacacaggtgaggggagagctaagaagcaaaacagaagacactgaataacccagaagtcactactacccctaagccaaagggaaaaagaaaagaggagaagttaccagagctaggggcccaagtcaacaggcagaaggtgaaaccacagcagacctgttgtgctccagctgaagtcataaagaagataaagctgctgacagagatcctgtggaaatagagcgacttggcgggggaaatgccctggatttcactgctttttaccctgcagtctttccacagtgcctcccattggttgaagacagtgaggaccaactgatcctggagcctggaaaacccaaggggtcagctcccctggaatacagagcaagagaaggaggaaatcatgggaaataggccagagaggcccatactatgaggaagagggtgtcaataagttagtattggtacaccatcagttaataatcacagtgccagatatacaggctgttggttgggctagttttcatgttatatgttcatgcattcact

SEQ ID NO: 156255 - DNA, 601 bp, Human
aggaagtacatcaaaggccagtcaggaaaacacaaaccacatgagtacacagagtttagaccagaaacctgattacacaggtgaggggagagctaagaagcaaaacagaagacactgaataacccagaagtcactactacccctaagccaaagggaaaaagaaaagaggagaagttaccagagctaggggcccaagtcaacaggcagaaggtgaaaccacagcagacctgttgtgctccagctgaagtcataaagaagataaagctgctgacagagatcctgtggaaatagagcgacttgkggggggaaatgccctggatttcactgctttttaccctgcagtctttccacagtgcctcccattggttgaagacagtgaggaccaactgatcctggagcctggaaaacccaaggggtcagctcccctggaatacagagcaagagaaggaggaaatcatgggaaataggccagagaggcccatactatgaggaagagggtgtcaataagttagtattggtacaccatcagttaataatcacagtgccagatatacaggctgttggttgggctagttttcatgttatatgttcatgcattcac

SEQ ID NO: 156256 - DNA, 601 bp, Human
ttgcacccatgtttgatcatttacataagagttaaattttaagaagggaaatcaccgggccaaaaggtataaaaaggtaactgactgtggaatcatgtttgtaatcaacattaatcaacagagcttagctaacaacccaccaaaccaaaaccctctgtctcacgactactcaagccttttctctctctctctctgcacaaagatgcaaagtcataaataaaagtaaatgttctgtctttcacttaatatattttcaaaaatgaaaacatacatttactacttatctttatgtagttaccarccagaaaaaaagtagaagaaaagttgatacttttctctcttaagaagaaaagactatcttttggatacgacatatctcatgtccacttatttttgatcacttaacaacaaggaaaatataagaggaaaatggatatctcttaagataaaagatttatcttttaggtacaacatggccctctactagatgcaagattttttgttttaatctgagagcaaaaccggtcaagtatgcaagtaattgattcaatccattgtggatgtttcccagaaggtacactggagctttttctcacagctc

SEQ ID NO: 156257 - DNA, 601 bp, Human
gccaaaataatgtttaaaggctatatattttcaaatagataatgtattatataatttatcaaactaataatttattgctggacacctagattgttttctaactttcattattataatcaatactgccaaacaaatatttgcacccatgtttgatcatttacataagagttaaattttaagaagggaaatcaccgggccaaaaggtataaaaaggtaactgactgtggaatcatgtttgtaatcaacattaatcaacagagcttagctaacaacccaccaaaccaaaaccctctgtctcacractactcaagccttttctctctctctctctgcacaaagatgcaaagtcataaataaaagtaaatgttctgtctttcacttaatatattttcaaaaatgaaaacatacatttactacttatctttatgtagttaccaaccagaaaaaaagtagaagaaaagttgatacttttctctcttaagaagaaaagactatcttttggatacgacatatctcatgtccacttatttttgatcacttaacaacaaggaaaatataagaggaaaatggatatctcttaagataaaagatttatctttta

SEQ ID NO: 156258 - DNA, 601 bp, Human
ggggcttagagaagttaaaaacttttttgtacataatacagttggcaagtaacaaagagcttgggcctgcaaactgcaaagtttgtgctgtgtgtcctgaattatctgccaaaataatgtttaaaggctatatattttcaaatagataatgtattatataatttatcaaactaataatttattgctggacacctagattgttttctaactttcattattataatcaatactgccaaacaaatatttgcacccatgtttgatcatttacataagagttaaattttaagaagggaaatcaccrggccaaaaggtataaaaaggtaactgactgtggaatcatgtttgtaatcaacattaatcaacagagcttagctaacaacccaccaaaccaaaaccctctgtctcacgactactcaagccttttctctctctctctctgcacaaagatgcaaagtcataaataaaagtaaatgttctgtctttcacttaatatattttcaaaaatgaaaacatacatttactacttatctttatgtagttaccaaccagaaaaaaagtagaagaaaagttgatacttttctctcttaagaagaaaagacta

SEQ ID NO: 156259 - DNA, 601 bp, Human
tagcacttcaggaggctgaggtaggaggactgcttgagcccaggagttcaagaccagcctgggaaacatagggagactccatctctatgaaaattttaaaaattagctgggtgtggtggcacatgcctgtggtcccagctacttgggaggctgagatgagaaaataacttgagcccaggaggtcaaggctgcagtgagccaagataacaccactgttctccatcctgggcaatagagacagaccctatctcaaatttaaaaaagaaaaaaatttacttccatttatataaatttataagcmcatgtacataagtatgaatatgcacacacataagtctgtaaggagaagaacctgacagcagttacctgtggagctggtaatgagttggtgagaggaaagactctaagaggagtggtctcaattttcaccctatgtatacatttccaaattcttcgactttttacgcacatgagtttatgaaatagttttgtatcttaagttatatttttaaaacaaaacaaaacacaggtcatctatactaggaaaatagctaacacacatggccaacagatgaagtggtggaggtgtcagatgagacat

SEQ ID NO: 156260 - DNA, 601 bp, Human
acctgagctaaagattcttttaaaaagcaggtttcagaaaaagaaactcaaatgtttattactatataaaaataccctcaacctcattaatctttaaatttgcaatttaaagcaatgagatactaatatttacctattagttgaaattttaacagagggataatatgcagtgttggcaaaatatgaattttatatatatacacatacacatttatatataccataggtggttatataaatttataaacacttttgcaaggcagtatctatcaacatttcagacacatataccacttgattsagcaattttgctactaagaatctatcctacagaaaaattggacatatatatataaatatatgtgcaaggacatttattagggtacattttctatgagcaaattggaaataaaccaatggagctaaagtaaaataaataatggttcatccatgctatagaataacatgcaactgctaagcagacatagatttaagtgaactaaaaaagacttccaacaaacattgttagtgtaaaaaagaaaagcccagaacaatacgaaaattatacttccagcctggtgcagtcactcatgcctgtaat

SEQ ID NO: 156261 - DNA, 601 bp, Human
tagaatacattatcaaacacatttaaaagtaaaataagagaattatatatttgaaaaaaaggcagcacatcctcagtctttcttttaaaatagatggtataataatttcccaggaaaatgtaagataaatgactgaacaaccattggaatgaataaaaaagatcagggtggtgattagatacaagaatgaaatgaaacagtctctttcttattgatcatcaataagcagtttgaaaatccaatgcgaaaaaaagaacctgttcacaattctaacaaaagttgtaaaatatcaaataatatrtttaacaagaaatgtgtaagaattctatgaagaaaaaccattggcagacataaaggaagatccacatatccaattaaacaatgagcaaaggacctgaatagatatttttccaaagaagaaataaaaatggccaaaaggtatatgaaaaggtattcaacaccattaatcatcagggaaatgcaaatcaaactattatgagataccactcacaaacagatggctattctcaaaaagtcaaaagatggcaaatgttggccagggtatggagaaaaaagaacctttatacactgttggtgggaa

SEQ ID NO: 156262 - DNA, 601 bp, Human
ctagacctaggttccacctaaggccatctgtggtctgtgctttatggattgataataaaaggatgcccacttccgggactgatcactgtgatgaaagcctgtaaatgttcacaaccactgcactgccacagggggtggcagaaacaacatatagcacattgatgacagagaagttgtaactgtagccttagtgtggaagggacccctggaagaggaaaaggccaaatgacagtttttattcctctagtttgaacactttattccacgccccatgcagtcaggtctcaaagctttttatcayagcttcggtgaaggacgatgcagaacaggagtttgcagctgtgacttggagctgagttcagctgaaaattgtaatcaatcaatttagactgggaatgtgtgaacaaagggagcagtgagaaaggtcatctcagtaaaggcagtacagaaaaatggtcaagaactcaaactcaggagacagtctcctggtttcagatcttacctctacctcttattatgccttggatatgtccattaatgtctctgagtcctcagtttcctcatctttacaaagggagcaatcattcttcttgaagggctg

SEQ ID NO: 156263 - DNA, 601 bp, Human
aataccacaacccagatttgaacctggaagtctgactctaaaatccagactctagtgtagtcagtttgctacatggcttacttgtgagcagtattctatgattgtcaacatatgcacacttaatactgatctaacctgtaattatgacataattatatattgaaaaaacaggggaggggaaatatgttaggagtgagtggggtaataataacatttctaaacctcatcttccctcttagacagtcaatacataatggttaaaactggaaaaataaaacaatctataacaatataaagttaytatttaaaacacataagcaggccaggcgcagtagttcatgcctgtaatgccagcactttgggaggccaaggcgggcggatcacgaggtcaggagttcaagaccagcctggccaatatggtgaaacattgtccctactaaaaatacaaaaattaaccgggtgtggtggcaagtgcctgtagtcccagctacttgggaggctgaggcaggagaatcgcttgaacccaggaggtggaggttgcagtgggcggagatcgcaccagagatcgcaccactgcactccagcctgggcaacacagtga

SEQ ID NO: 156264 - DNA, 601 bp, Human
taagccaatttcaaaaaggattcaaatgttaactttagaaaaaaatgaatttataccaaaaggacactgtgataataatattaacactactatacctccatgtgcttggcactattctaaataccacgcttgtattgtctctaaatcctcataacaaccctataaggtaggcaatttcattaggactattttactgatgaggaaagtaaggtacagagatgttaaatgacttgaacaaataccacaacccagatttgaacctggaagtctgactctaaaatccagactctagtgtagtcagtttgctacatggcttacttgtgagcagtattctatgattgtcaacatatgcacacttaatactgatctaacctgtaattatgacataattatatattgaaaaaacaggggaggggaaatatgttaggagtgagtggggtaataataacatttctaaacctcatcttccctcttagacagtcaatacataatggttaaaactggaaaaataaaacaatctataacaatataaagttattatttaaaacacataagcaggccaggcgcagtagttcatgcctgtaatgccagcactttggga

SEQ ID NO: 156265 - DNA, 601 bp, Human
caaaacaaacataaaaaggagaaattaaaaaaaacaagacaattcagaaaacacatgaaacaaacatacaaagggggaagaatgggtcatgtagaaaggatcaaggataaaaaaaatttaataaaaacttgccaatcatggaagctagaagacagtgaagcaatgtcttcagaattatgaaggaaaatagtttccacttagaattctatgcccaggcaacttaagggcaatgacagaataaaaatattttcagatattcaagttctcaaaaattctttctcagaaagctactaggggatgwtccccaccaaaataaaggtggtaacatgtataaaacatagacatgggacccaggaaacagagcatccaaagaggaaactaataaaaggaatttccaagagtaattactagatataattctaagttaatgaaccagaatgactgctactcagcaggaagaaatcatttcatgttgaatcaggaggaggaaagtctcctggagggatatctccagaaaaaaaaaaaagaaaagaaagaaactgacttgttgccagatgtagttggccattttgaaaagaatttcacagttctgttgcataac

SEQ ID NO: 156266 - DNA, 601 bp, Human
attagtgagatgcagttagtggtatcagagttacccctggaaaaagtccatagatgagtctggctgaaagagcctatggcagctgaatagaaacatgcagctaaaaattataactccactggctgtcagagaaaagagtaagttatccatggtccttctatgaaaatatgagaggaagagattatctggaacgatgttaataatttctaagggttcactaggagggaacaatgaaagccccttgaaaaaagaatctttacaaaacaaatcctcaaagaaacatgacaaggagagaatagcyagtcaagacacgtaaagggcaatcaagagttcactgctggacctgtcttaatcccgaaaagaattcagggaaaaaagtcagagctaaacactggctgagcctggagagcataaagccaatttaacaacaatcctagacaagttagaccttcctgccttctattctcatctccatcctccctagtgtttcaaccctagagcaggcaggtgtcaaggctggcaataagggtgagggtggtagataacaaagcgaggtcaggagagaggaaaggccatacccctgtcctcgcctcctgcagct

SEQ ID NO: 156267 - DNA, 601 bp, Human
taaacaaatgtaaggcaccaagatgtaatatatatcaaattccaaattgaactgcaaaacatccctccaaacaggtagtcaaagattacttgtacaattctggaattcctcactcttgttcaggagaaaacaggtaaagaaaaaggaaaactgagagaaggattcctttgaagaaaactgtgctatgagtgccccatcaccaccaagaaagatgaggtatagttcttgataacctcaggttaaaagagggacttcactgggacgactcagagagttggatatgtgtgccttggcattagtragatgcagttagtggtatcagagttacccctggaaaaagtccatagatgagtctggctgaaagagcctatggcagctgaatagaaacatgcagctaaaaattataactccactggctgtcagagaaaagagtaagttatccatggtccttctatgaaaatatgagaggaagagattatctggaacgatgttaataatttctaagggttcactaggagggaacaatgaaagccccttgaaaaaagaatctttacaaaacaaatcctcaaagaaacatgacaaggagagaatagctagtcaa

SEQ ID NO: 156268 - DNA, 601 bp, Human
tggagcttctgatcaataaatgtcactttttgtcatgtggctctatgtataaatatgttttaagtgttgtttcctgtttatataaagccataaatgaccccatcagccctgtctgtttagaaggggcctgagtcaagaaaatgagaactagctaccttaatggtgctttctggtcatcctatggattgggtatttttttgtgtgtgtatctaacttatgtctctacctgaaatgtgcctatgtcctgttgttctgctttcaggcaacttctccatcataatgatccataggcagtattcamttgttgactgttgtactcaactaattctcagacttttatggctaccagtacaatataaatttattgtgacacaatttaagatgatttggattaagtgtcaatgaaaaatgctgcttaggtaaaataccatctagaaatgaaatacctaatgatttgtgaaaaagcattgagcaagctccagtgaacaagcaaattactacagagcactttgctagtggattctgtcagcaccactgtatctgggtctattgtcaaataaagcatatcgtgttggtaccacaaaagtaaagagatccaaca

SEQ ID NO: 156269 - DNA, 601 bp, Human
catacatgaataaatgtagaaaaacattggtaggaaaagttttctgtattgctttaggttaatagggtaataagttaaaaacaaacgtttctgcaaggtctttttattgtctttacacttacaacaaaattaactaattaatccttaagcacttattcaagtgatatatttgctctgttttgaaactcacttccctgagatacccaaatggcttagtcctttgcttacctcaggggtctgcttaagagaacaagtgactcaaccactgtgtctcaaatactacctaatcactctctctctygccatgcagagtaggtcgtagttagttggctagtttgattactgtttgtctcctccaccagaatacattaatcatgagggcaagaactttcctttttgtcactatatccctagtactttgaataatgcttgacacatatatagtagttgctcaataaatatctattgaatgagctgacataagaaaaatattacaatagcaaaattgagatcatctgctcccgagtatattgcaatttagagtctcacttcagcattgactagaatatgcataaatagattaacttttacgtaagaatcc

SEQ ID NO: 156270 - DNA, 601 bp, Human
gtaactaacctgcacattgtgcacatgtaccctaaaacttaaagtataataataataaaaatagaaaagaaaaaaaataataatatgttggacactataagtcaggaaactcaaaagaaaacaatgaagttgtaatttttgctaattagtagttgaatttctaattttagctaagtagtaaaaacagtgttaaataaatatactcaatactggaagatatatggaatgatccatatattcatatattcctggtaataatattaactgtattattcttttggagagtcacttgataatctayatcaaggttttttttaaaaaagatgtagacatctaagtcctaggaattaattaatacaaataattcagaagaagaaaacattatgtttaatgatatttattatagtactactaaacaccagaagtaatctaaatatgatactattgttaatacatttagttgtttccaatgtttggaactataataatgcttcagtgaaaatctttaggcatatagcattttattttttgtttatttacataaatccctaatggaataattgataatgttaaaattattataaaactattatgaaattat

SEQ ID NO: 156271 - DNA, 601 bp, Human
gagttcgagacaagccctgggcaatgtagtgagacccactctctacaaaaaattttaaaaaattagccagacctggtggtacacatctgtagtgccagctactcagaaggctgatgtgggagaatcgcttgagtccaggagttcaaggctgtagcaagctatgatagcacctctgaactctagcctgggagacagcatgagatcctgtctctataaaatttaaaaaccttaaaaagtagatctgaagctctgtccactgaaaaacctagaagaaatgacatcccagaaataatgaacactsctaatttttaaatatcctcaatgaagcagtctttttggagaaatggatgattccaagtatgtggcagagttgacaagttaggcctgatatatcttgctgtgccaaggaaataggaagattactgggatcatatcagaaagatacagtaaccaaattgaaggggctacctctgacctcagataaaaaaatttgagcattaaaaaatactaattcaatagatcaaattataccaagtatatataactccatgagttcataatgattttttaaaaataaaaatttattagtctccactggata

SEQ ID NO: 156272 - DNA, 601 bp, Human
tctgaaattgaggcagtaattaatagcctaccgaccaaaaaaaagtccgggaccaggtggattcacagcagaattctaccagaggtacaaaaaggagctgataccattgcctctgaaattattccaaacaatagaaaaagggggaatcctccctaactcatttttatgaggccagcatcatgctaataccaaaacacggcagagacacaacaaaaaaagaaaacttcaggccaatatccctgatgaacatcaatgtgaaaatcctcgataaaatattggcaaactgaatccagcagcatawcaaaaagcttatccgccacgatcaagtcagcttcatacctgggacgcaaggctggttcaacatacacaaatcaataaacataatccatctcataaacagaaacaatgacaaaaaccatgattatctcaatagatacagaaaaggcctttgataaaatttaacaccccttcatgataaaatctcttaataaactaggtattgatggaatgtatctcaaaataataagagctatctatgacaaacccacagccaatatcatattgaatgggcaaaacctggaagcattccctttgaaaactg

SEQ ID NO: 156273 - DNA, 601 bp, Human
tggcccacctgtgtcatgctcgaattcttgccaggcctcagctgcctccctgtggcgcagggcttgggatctgcagcccgccatgcccgagacccccacagtgggctcccatgcagcccaagcctccccgacaggtgctgccccctgctccgaggcgcccagtcccatcgaccgcccaagggctgaggagtgtgggcgcacggcacgagactggagggcagctccgcccgcagccctggcatgggatccactaggcgaagccagctgggctcctgagtcaggtggggacttggataacttytatgtctagctagaggattgtaaatgcaccaatcagcactctgtgtctggctcagggattgtaaatgcacccatcagcactctgtgtctagctaaaggtttgtaaatgcaccaatcagtgctctgtgtctagctaatctagtggggacttggagaacttttgtgtctagctagaggattgtaaatgcaccaatcagcactctgtgtctagctcagggattgtaaatgcaccagtcagcaccctgtcaagacagaccaaacagctctctgtaaaatggaccaatcagctctctgtaaaatg

SEQ ID NO: 156274 - DNA, 601 bp, Human
tgctcgtgggccagcgggagtttcgggtagcacgggatcagcaggccccgcactcagagtggccggccagcaccgccagccccaggcagtgagaggattagcaactgagacagcagctgcggagggtgcactgggtcccctagcactgctggcccacctgtgtcatgctcgaattcttgccaggcctcagctgcctccctgtggcgcagggcttgggatctgcagcccgccatgcccgagacccccacagtgggctcccatgcagcccaagcctccccgacaggtgctgccccctgctccraggcgcccagtcccatcgaccgcccaagggctgaggagtgtgggcgcacggcacgagactggagggcagctccgcccgcagccctggcatgggatccactaggcgaagccagctgggctcctgagtcaggtggggacttggataacttctatgtctagctagaggattgtaaatgcaccaatcagcactctgtgtctggctcagggattgtaaatgcacccatcagcactctgtgtctagctaaaggtttgtaaatgcaccaatcagtgctctgtgtctagctaatctagtggggacttg

SEQ ID NO: 156275 - DNA, 601 bp, Human
acagagaacaccacaaagatactcctcaagaagagcaaccccaagacacataatcatcagattcaccaaggttgaaattgaggtgacaatgtgcttgcaacccttgctcgctcttggcacgtccttggcctcggcatccactctggccacgcttgaggagcccttcagcctgccgctgcactgtgggagccccactctgggctggctgaggctggagccagctccctctgcctgcggggaggtgtggacggagaggcacgggcaggaactggggctgcatgcggtgctcgtgggccagcgsgagtttcgggtagcacgggatcagcaggccccgcactcagagtggccggccagcaccgccagccccaggcagtgagaggattagcaactgagacagcagctgcggagggtgcactgggtcccctagcactgctggcccacctgtgtcatgctcgaattcttgccaggcctcagctgcctccctgtggcgcagggcttgggatctgcagcccgccatgcccgagacccccacagtgggctcccatgcagcccaagcctccccgacaggtgctgccccctgctccgaggcgcccagtcccat

SEQ ID NO: 156276 - DNA, 601 bp, Human
taattaaaaagtgaaaaaattggccgggcacggtggcttgcacctgtaatcccagcactttgggaggccgaggcgggtggatcacgaggtcaggagatcgagaccatcctggctaacacggtgaaaccccgtctctactaaaaatacaaaaaattagccaggtgtggtggcgagcgcctgtagtcccagctacttgggaggctgaggcaggagaatggcgtaaacccgggaggcagagcttgcagtgagccgagatcgcaccactgcactccagcctgggagatagtgagactctgtctcaaaaaaaaaaaaaaaagtaaaaaaattaaaatggaaaaacatgaatccctaaaaaattgaatcaaattgaagaaaattaactgtatatcaaactgatgacatgagcaataaaataaataatttggagattgctggcaggatgaccgaataggaacagctcaggtctgcagcttccagtgagatcgatgcagaaggcaggtgatttctgcatttccaactgaggtaaccggttcatctcattgagactgatcggacagtgggtgcagcccattgagggcaagccgaaaaagggtggggtgtt

SEQ ID NO: 156277 - DNA, 601 bp, Human
acttagggtttttttaatgtgtgcatttgcatttcatatcttgtcattaatgatgtattcctctttaatctggaaacagaaaaactgtcataaataaagcccaaattccaaaagcaagttaaatattaataaatttagctacataaaaatatatctgaatgacttacacatgtcaaaaaatcaccataaacaaagacaaataacaatctgaagaaaatatttgctaattatattccactcctgagtatatgtatggtttcaactattgttgtacataattaaaaagtgaaaaaattggccrggcacggtggcttgcacctgtaatcccagcactttgggaggccgaggcgggtggatcacgaggtcaggagatcgagaccatcctggctaacacggtgaaaccccgtctctactaaaaatacaaaaaattagccaggtgtggtggcgagcgcctgtagtcccagctacttgggaggctgaggcaggagaatggcgtaaacccgggaggcagagcttgcagtgagccgagatcgcaccactgcactccagcctgggagatagtgagactctgtctcaaaaaaaaaaaaaaaagtaaaaaaat

SEQ ID NO: 156278 - DNA, 601 bp, Human
gctcttcctctcagagaggagaacccttgactttccctaagtccgaaagaaaagtgattatacagaccccacaaacaaagcactctgggtgccagacagtgtccatggctgaaaggtagttttccaacactgggcgattgcagccaccacacttgggtgagaacatggctaagaaatcctttcggcaatatggcttcttgtccttctcatgaaagcctggagagataaaatcaggaattcactgttgcaggttgagccctgaaagctacactggagactgagaggaggccctttcaatctctgtcctcatattcaaaataggatgattactgttacctaattcaaagggtagttgtaagaaataaatgagataatgcagaggaagtgttttggcattgtgtctggttcatagtaaacatttaataagtgttaggggctattgctcctcagtgcctttgtactaagtattcccttggcttggatagttctgtcccagagcctgatatagttgtcctcttcatgtgatgcaagaatcactcaaatatcatcttatcagagaggcatctcttcagtccctccttgtcacatcatcttctttcac

SEQ ID NO: 156279 - DNA, 601 bp, Human
agatccctgaaggcatagaatgcatgtttatgacataaatattaattggtacctatttatgtgtcaggtactgttgtagacactggggattcagttatgagctagataaccattgttgctgctttcattcttccgttcctgttgacccagagtagtgcttctgacaggactcaaatagattaccttttcttatctacacattatattgcatttctgttttgagatgttggacagaattgggccaactttaatagaaactgggtgccaagaattccaggtttcaatattgaggttaggaatttttttttttttttttttttttgagacagagtcttgctccattgcccaggctggagtgcaatggtgcaatctcagctcactgcaacctccacctcccaggttcaagtgattctcctgccttagcctcccaagtagctgagattacaggtgcccacaaccacggccagctaatttttttttttttttggtatttttagtagagacgggattttgccatgttggccagccttacaggtgcctgccaccacacccagcaaatttttttttttttgtattttttagtagagatggggtttcacca

SEQ ID NO: 156280 - DNA, 601 bp, Human
tccaggtttcaatattgaggttaggaatctttttttttttttttttttttgagacagagtcttgctccattgcccaggctggagtgcaatggtgcaatctcagctcactgcaacctccacctcccaggttcaagtgattctcctgccttagcctcccaagtagctgagattacaggtgcccacaaccacggccagctaatttttttttttttttggtatttttagtagagacgggattttgccatgttggccagccttacaggtgcctgccaccacacccagcaaatttttttttttttgwattttttagtagagatggggtttcaccatgttggccagcctggtcttgaactcttggcttcccaaagtgctgggattacaggcgcgagccactgcacatggcaggaatcatttaatagattggaaactgtccatgttgcctcctatgtgacctcatcgtctgctcaaaactggtttctaaaattagccaggtatggtggtgtgcgcctgtggtcccagctacccgtaaggctgaggtgggaggatcgaatgagcctgggaggcggaggttgcactgagccgagattgtgccactgcactt

SEQ ID NO: 156281 - DNA, 601 bp, Human
cgaggcgggcggataatctgaggccgggagttcgagaccagccttaccaacatggagaaacgctgtctctactaaaaatacaaaattagccgggcatggtggcacatgcctgtaatcccagctactcggggaggctgaggcaggagacttgcttgaacccgggaggcagaggtttcagtgagctgagatcatgccattgtactccatccagcctgggcaacaagagcgaaattccgtctcaaaaaaaaaaaaaaaaatacaaaaattagctgggggtggtggcatgtgcctgtaatcccasctacttgggaggctgaggcaggagaatccaggaggcagaggttgcagtgagccaagatcatgccactgcactctagcctgggtgacaaaagtgaaactcagtctcaaaaaaaaaaaaaagaaaagattttatattttgtagtctccctagttttgcttccaagaaggcaattaaaattcagttctttctgtattttcattacttctgaatctgagtcaactgtcagatggatgcttttgccttaatttgactttttattacttccaaatcatagccttagagacaagcactttctggatt

SEQ ID NO: 156282 - DNA, 601 bp, Human
actttttattacttccaaatcatagccttagagacaagcactttctggatttcagtctggtccaatagacagtttaatggaataaaaaaaatgagagactaaattacttattaaattaagtgtctgtatcaactgttcccctggggcagtgttcagtttgatttaaaatgactttttacttccctgagggggaggcagtagagagggaggacatttccattaatgacttcctattccacagaacaaagctctgtaaagaaaatcagctgatcagcttcctctgttcatattttggctcagrcagagacttgccctatatttgtctttgtctcaatatgggggtaagagaggggaggttttacaaaattgcagaacttagagcttttctgccctggttcttgcctgtgatggtaatctttttgttgagggaagtgaagaacctaagggtccttaagtctgcttttattttttcttctagcaagtactggctgtgagtgtgggacaggattttgtgttttctgtgacagtctgcagtttttggcctctgaacttgatagttgacttgccagaagatctaatgggggagtgaggagtgaaagag

SEQ ID NO: 156283 - DNA, 601 bp, Human
ccaatagacagtttaatggaataaaaaaaatgagagactaaattacttattaaattaagtgtctgtatcaactgttcccctggggcagtgttcagtttgatttaaaatgactttttacttccctgagggggaggcagtagagagggaggacatttccattaatgacttcctattccacagaacaaagctctgtaaagaaaatcagctgatcagcttcctctgttcatattttggctcaggcagagacttgccctatatttgtctttgtctcaatatgggggtaagagaggggaggttttayaaaattgcagaacttagagcttttctgccctggttcttgcctgtgatggtaatctttttgttgagggaagtgaagaacctaagggtccttaagtctgcttttattttttcttctagcaagtactggctgtgagtgtgggacaggattttgtgttttctgtgacagtctgcagtttttggcctctgaacttgatagttgacttgccagaagatctaatgggggagtgaggagtgaaagagtaggatgttatagggtctgtggcattctagggaatatccctgcctactactgctacccagt

SEQ ID NO: 156284 - DNA, 601 bp, Human
ggaggttttacaaaattgcagaacttagagcttttctgccctggttcttgcctgtgatggtaatctttttgttgagggaagtgaagaacctaagggtccttaagtctgcttttattttttcttctagcaagtactggctgtgagtgtgggacaggattttgtgttttctgtgacagtctgcagtttttggcctctgaacttgatagttgacttgccagaagatctaatgggggagtgaggagtgaaagagtaggatgttatagggtctgtggcattctagggaatatccctgcctactacygctacccagtaggactcactctctataaaacattgtccttatttaagcaaaacaactctttgtggaatctgcttgactcctaatctcctagttagaagcaatttgagggttgaggtggaggcatcttctcatcttgatttttttttttttttctgggcttccatcttttctctgaactgactcctaatttaggcagttttacattcagactgtgggtgtatgtgtgtatgtgtgtgttaaggcgccatgtatgtgggaagtgtggaaaatgaagactgcttttgccccatgggctcattt

SEQ ID NO: 156285 - DNA, 601 bp, Human
aggattttgtgttttctgtgacagtctgcagtttttggcctctgaacttgatagttgacttgccagaagatctaatgggggagtgaggagtgaaagagtaggatgttatagggtctgtggcattctagggaatatccctgcctactactgctacccagtaggactcactctctataaaacattgtccttatttaagcaaaacaactctttgtggaatctgcttgactcctaatctcctagttagaagcaatttgagggttgaggtggaggcatcttctcatcttgatttttttttttttttctgggcttccatcttttctctgaactgactcctaatttaggcagttttacattcagactgtgggtgtatgtgtgtatgtgtgtgttaaggcgccatgtatgtgggaagtgtggaaaatgaagactgcttttgccccatgggctcatttagtgacttataatataatattaatatgttaatatccctaagacacaagagagtcaaaattagtgttttgttaaatgtggggctgggggcatggtagctcatgtctgtaaccctagcactttgggaggccaaggcaggtgaattgcttgagct

SEQ ID NO: 156286 - DNA, 601 bp, Human
gcgcagtggctcacgcctgtaatcccagcattctgggaggacaaggcgggcagatcacgagatcaggagatcaagaccatcctggctaactcgatgaaaccccatctctactaaaaatacaaaaacaaaattagccaggcgtggtggcgtgtgcctctagtcccagctacttgggaggctgaggcaagagaatggcatgaacctgggaggtggagcttgcagtgagctgagatcatgccactgcactccagcctgggcgacagagtgagagtccgtctcaaaaaaaaaaaaaaaaaaaaaactgtttagaaagtcttgcagttaaatgtttatgaactttgtatgaccacagaacttttttttttttggcccatacaatggctttcaacattctgagagcaagtgtttggaagaatacaccttgagaaacattaatctagatgtgtggtcctgaggaaaagttgtatctattcattctggaagcttttgtataccgtatggggcctgtggcattctagagaacattcctcctaccatcaccacacaatagaacctgattttctgtcattggaataagtggataataggttccatactgtgg

SEQ ID NO: 156287 - DNA, 601 bp, Human
tgaggaaaagttgtatctattcattctggaagcttttgtataccgtatggggcctgtggcattctagagaacattcctcctaccatcaccacacaatagaacctgattttctgtcattggaataagtggataataggttccatactgtgggttttgagaagggtaaaggtggggcataagggtagaagcgcttttctctagaatcatgctgagaggagatatctattcctttaggtagaattactttctgagacaggaactgttaatgtcctatttactgaaattccttttttttttttttgctttgtccacagatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagtt

SEQ ID NO: 156288 - DNA, 601 bp, Human
cgagacagggagggacagggcagaggaggagaggaaggcgatgcgacggacaggcgcacccgctcaggctgactctcgggggcgaggtcgagccaggggcggctgccctgggggcgaggcgacgctgtctcaacctccacctcgcggcggaacccgaggacaggagcctcaggtaccgcgaggcttgcggagagtggccgggccgggcaggccctggctaggccgaggccaggccagggccaggggtggggggtgctggccaggcgtggggtagagcctttcatccgggcctgccaagagcggggagctgtgggggagtggtggggaggcgggtgctctttgggctccctggaaacccaaatttggagctttgcggggtggatttgggatccaggtttcggcctgtgtaggacgtttattttcctgctggtatcttgggaaataacgagcatggaatgctagagtgagctaaacctatccttgctgaggatttcctctttttctagatgaaagaaacaatcatgaaccaggaaaaactcgccaaactgcaggcacaagtgcgcattggtgggaaagtaagttttaatagttcgggtttgtg

SEQ ID NO: 156289 - DNA, 601 bp, Human
acagggagggacagggcagaggaggagaggaaggcgatgcgacggacaggcgcacccgctcaggctgactctcgggggcgaggtcgagccaggggcggctgccctgggggcgaggcgacgctgtctcaacctccacctcgcggcggaacccgaggacaggagcctcaggtaccgcgaggcttgcggagagtggccgggccgggcaggccctggctaggccgaggccaggccagggccaggggtggggggtgctggccaggcgtggggtagagcctttcatccgggcctgccaagagcggggagctgtgggggagtggtggggaggcgggtgctctttgggctccctggaaacccaaatttggagctttgcggggtggatttgggatccaggtttcggcctgtgtaggacgtttattttcctgctggtatcttgggaaataacgagcatggaatgctagagtgagctaaacctatccttgctgaggatttcctctttttctagatgaaagaaacaatcatgaaccaggaaaaactcgccaaactgcaggcacaagtgcgcattggtgggaaagtaagttttaatagttcgggtttgtgggtt

SEQ ID NO: 156290 - DNA, 601 bp, Human
ctgctggtatcttgggaaataacgagcatggaatgctagagtgagctaaacctatccttgctgaggatttcctctttttctagatgaaagaaacaatcatgaaccaggaaaaactcgccaaactgcaggcacaagtgcgcattggtgggaaagtaagttttaatagttcgggtttgtgggttttttttttaaggtttaggtattttaaaaaacatattccttttgcgcttcttatattatcggtgacaaactttgcctatcgagggaaattcacggagctagcaaatctcgaggagcgggrgagacgagggttggagacacatcagtgagacgagctaaaaacatcgcctttgtgtaaacatgtttgtgttttcagtgttacagagtgtaagtagaacacaaaagtgtttcctaatttaattagtaaggaaaatgtgtcatttcagttagatcgttgtgcacatcatacccttgacttgttttggcctgagttgtctaaagtcagtgcttgtttgtctctcttgtaaattgagacctttctgtactgctttctgaactaaatattctttagggtagttgcatatttcaagggtatttgaag

SEQ ID NO: 156291 - DNA, 601 bp, Human
cattggtgggaaagtaagttttaatagttcgggtttgtgggttttttttttaaggtttaggtattttaaaaaacatattccttttgcgcttcttatattatcggtgacaaactttgcctatcgagggaaattcacggagctagcaaatctcgaggagcgggggagacgagggttggagacacatcagtgagacgagctaaaaacatcgcctttgtgtaaacatgtttgtgttttcagtgttacagagtgtaagtagaacacaaaagtgtttcctaatttaattagtaaggaaaatgtgtcrtttcagttagatcgttgtgcacatcatacccttgacttgttttggcctgagttgtctaaagtcagtgcttgtttgtctctcttgtaaattgagacctttctgtactgctttctgaactaaatattctttagggtagttgcatatttcaagggtatttgaagatacgggtacattttggagtttaagagcagtgactattagatttgaaaatataacccaagtaggtatctttcctgttctgactttgtattactgtaaaaatgagggaattaaagtgactgatttttaaatgatcagttt

SEQ ID NO: 156292 - DNA, 601 bp, Human
tgtgaaattaggtgagttagttttgctttagagaaaactgcaggtgttaggtgctcttaggtaaatgttacgaaagccctttattttcatatctaatcacagcattaataataattatttaagtgaaaattgaactctacatatgtgaagtgtatgaaacctctagaaagtatgctgggtttgtctttacaatcttagaaattcctttgagtttcttagagaagatttctttggaaaccagatacatacatgaccatttcaaagtgatttttgtacttaatagtttggagaggttagtaamcagtactttttttttttttttgtagccatagatattttcttcagttaaataacaagatttatttaagcctttactatgttggatcctgagaatataaaattttaagaagtttaaagtccctaggtgggctttaagcctagcagtggcgataattgtcttttcttaaaaaaatcttctttcacagtgtaatatacatagtacaatagtagaagcattttcaaaatctagagatgggaatgatttggcatagggaaagggggtaattgcagaatttaggaaaggcaaacaggaggtaatgac

SEQ ID NO: 156293 - DNA, 601 bp, Human
tcatatctaatcacagcattaataataattatttaagtgaaaattgaactctacatatgtgaagtgtatgaaacctctagaaagtatgctgggtttgtctttacaatcttagaaattcctttgagtttcttagagaagatttctttggaaaccagatacatacatgaccatttcaaagtgatttttgtacttaatagtttggagaggttagtaaccagtactttttttttttttttgtagccatagatattttcttcagttaaataacaagatttatttaagcctttactatgttggatcstgagaatataaaattttaagaagtttaaagtccctaggtgggctttaagcctagcagtggcgataattgtcttttcttaaaaaaatcttctttcacagtgtaatatacatagtacaatagtagaagcattttcaaaatctagagatgggaatgatttggcatagggaaagggggtaattgcagaatttaggaaaggcaaacaggaggtaatgacttgaataagattttaaaggatgaataggaatagggatggaggttgggggacggtgaggtggttgggtgtgatagactttccttgag

SEQ ID NO: 156294 - DNA, 601 bp, Human
atccaaaggtcagaaatgaattggaaactattcccatttgaaaaatatctgttgtggtataaatgtgctgttttctttcctcttctccctgactttagggaactgctcgcagaaagaagaaggtggttcatagaacagccacagcagatgacaaaaaacttcagttctccttaaagaagttaggggtaaacaatatctctggtattgaagaggcaagtatcaaattttgttactttaaaaaacaagatttggctgggaaaagttaacgttaatgcattaaatgggttgtttttttttttttaacttagggacttcaaagtccctaagatgtgtttctaccataaattaataaatatcagggagctcattaagtctgaatgctattagaatacatattccattccaggcaaaatttcacctgtgcttcacagtgaaatactagttagccagacttagtttaataaaacatttgtttttaaagagactggtcagcattgctaatttaaatttttcttttcttaataggtgaatatgtttacaaaccaaggaacagtgatccactttaacaaccctaaagttcaggcatctctggcagcgaaca

SEQ ID NO: 156295 - DNA, 601 bp, Human
agaggcaagtatcaaattttgttactttaaaaaacaagatttggctgggaaaagttaacgttaatgcattaaatgggttgtttttttttttttaacttagggacttcaaagtccctaagatgtgtttctaccataaattaataaatatcagggagctcattaagtctgaatgctattagaatacatattccattccaggcaaaatttcacctgtgcttcacagtgaaatactagttagccagacttagtttaataaaacatttgtttttaaagagactggtcagcattgctaatttaaatktttcttttcttaataggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatgtgagtttcctagtaatggttttaccagggaattactcatttagcagctgatttctgatctcagggctcagaatggatatga

SEQ ID NO: 156296 - DNA, 601 bp, Human
gtgtttctaccataaattaataaatatcagggagctcattaagtctgaatgctattagaatacatattccattccaggcaaaatttcacctgtgcttcacagtgaaatactagttagccagacttagtttaataaaacatttgtttttaaagagactggtcagcattgctaatttaaatttttcttttcttaataggtgaatatgtttacaaaccaaggaacagtgatccactttaacaaccctaaagttcaggcatctctggcagcgaacactttcaccattacaggccatgctgagacraagcagctgacagaaatgctacccagcatcttaaaccagcttggtgcggatagtctgactagtttaaggagactggccgaagctctgcccaaacaatgtgagtttcctagtaatggttttaccagggaattactcatttagcagctgatttctgatctcagggctcagaatggatatgagtatttttaagtttggaaatgcaagctttaaaaataacagatttgtaactgattttaagcaactgtccttgctcaagtttgcagtaattgatgtagcgtgccatgattgttacacttgatt

SEQ ID NO: 156297 - DNA, 601 bp, Human
agagactggtcagcattgctaatttaaatttttcttttcttaataggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatgtgagtttcctagtaatggttttaccagggaattactcatttagcagctgatwtctgatctcagggctcagaatggatatgagtatttttaagtttggaaatgcaagctttaaaaataacagatttgtaactgattttaagcaactgtccttgctcaagtttgcagtaattgatgtagcgtgccatgattgttacacttgattttgtggaatgttttctacttacttgatttggatcagatactttattaactagaaatgatgaaaatgttaatttggtgctttgccaataactacttgtaagtttggaattgaaaaaaaaattagtgtaaattatgaaattacttcagtttc

SEQ ID NO: 156298 - DNA, 601 bp, Human
tgcttcagccgccaggtctcagctgggcctcctccagaggccactgctgttgttgcttggtgcctttgggccttgttgtgtgaagcaagatggagctgctccaggggggccagctctgatgattgtgtgttgcaggctgggaaggcagttccgcatctgttactctttcttcctatttcccctcctgccttaactgagattctgggtttggagaccctggcgacttggattcttgccatccgattactgagggctctctgggaagcctagaaaataatctataaatctgtagagacatggyggtaatgcagtaaatcaacaggcctggaacgtcccaatgtggatgcttcgtaaatgcctcttgaaaccagggaagagagatggtccctcttgctttctcaactatattcggaaagcataatgaaagctttggacatgtctcctccagagtttggaacaatagtgtttcctcggactaggctagcttcatttatttagttatgcaggactttattccaaatcgttttcgctaccaccaactactactctttggcacctcctttttctcctccctaattagcccccagcatggatttagcta

SEQ ID NO: 156299 - DNA, 601 bp, Human
tggtggtaatgcagtaaatcaacaggcctggaacgtcccaatgtggatgcttcgtaaatgcctcttgaaaccagggaagagagatggtccctcttgctttctcaactatattcggaaagcataatgaaagctttggacatgtctcctccagagtttggaacaatagtgtttcctcggactaggctagcttcatttatttagttatgcaggactttattccaaatcgttttcgctaccaccaactactactctttggcacctcctttttctcctccctaattagcccccagcatggatttarctagtggttctcattttcagcaaaaccctgcttcttggttttattttaatacatagaggacatacatccgtgtcttgcaaactgaattctagagccttgtgaacgttttcattgtttcattttttttttaaggaactaaaacatataaagaatattaagtgtctgttggatgttttcaattaccgttagattataacttttcctttagttaacactgggaatcagcaagatttgttggtgaaaagatagatgaatgtaacatctactgctctgcatttttagataaaagtttagctgatt

SEQ ID NO: 156300 - DNA, 601 bp, Human
ttttagataaaagtttagctgattacattgttacattctgatgtcacttaactgaatgtccttcagtctaagatggtaagagaatttaaaacccaggaaagatttggggtttagttttccttttcttttaacaggggaaataagaaaccaataccatatgtggtgagaattaaatgttagagagtcttaaatttactatatttgcctatacttttcaaagtcgaagacagatggatttctgcttgcactgcttaattggtattatctacgacagctctgtgatccatgctgaaacacaagscagtccccaaatttaaggtcattaaattgttcaccttctctaagggcttactttaaaaaaataagttataactttttagacaagcaaataattatgtcacttctcatttgcttgtgttgtaagatgttatctcagacctaaattatttattatcaatgctttgaaactatgagctctgtatgtaagatattatcgtcattacatacatatgttatgaacatcaagttgctggctttaaaaaaagaaaaaaagcaaattaaagatgagttcaagggaaaaaataagaattttttcctctga

SEQ ID NO: 156301 - DNA, 601 bp, Human
ctgaatgtccttcagtctaagatggtaagagaatttaaaacccaggaaagatttggggtttagttttccttttcttttaacaggggaaataagaaaccaataccatatgtggtgagaattaaatgttagagagtcttaaatttactatatttgcctatacttttcaaagtcgaagacagatggatttctgcttgcactgcttaattggtattatctacgacagctctgtgatccatgctgaaacacaaggcagtccccaaatttaaggtcattaaattgttcaccttctctaagggcttaytttaaaaaaataagttataactttttagacaagcaaataattatgtcacttctcatttgcttgtgttgtaagatgttatctcagacctaaattatttattatcaatgctttgaaactatgagctctgtatgtaagatattatcgtcattacatacatatgttatgaacatcaagttgctggctttaaaaaaagaaaaaaagcaaattaaagatgagttcaagggaaaaaataagaattttttcctctgagaaataaagcattcctaaatgtagcatttcctttagttcatttatgtagtt

SEQ ID NO: 156302 - DNA, 601 bp, Human
ttttccttttcttttaacaggggaaataagaaaccaataccatatgtggtgagaattaaatgttagagagtcttaaatttactatatttgcctatacttttcaaagtcgaagacagatggatttctgcttgcactgcttaattggtattatctacgacagctctgtgatccatgctgaaacacaaggcagtccccaaatttaaggtcattaaattgttcaccttctctaagggcttactttaaaaaaataagttataactttttagacaagcaaataattatgtcacttctcatttgcttstgttgtaagatgttatctcagacctaaattatttattatcaatgctttgaaactatgagctctgtatgtaagatattatcgtcattacatacatatgttatgaacatcaagttgctggctttaaaaaaagaaaaaaagcaaattaaagatgagttcaagggaaaaaataagaattttttcctctgagaaataaagcattcctaaatgtagcatttcctttagttcatttatgtagtttatgatttcaatctgatttcagaccactttttagcatagttttacaaatataatcttatgatt

SEQ ID NO: 156303 - DNA, 601 bp, Human
gcttactttaaaaaaataagttataactttttagacaagcaaataattatgtcacttctcatttgcttgtgttgtaagatgttatctcagacctaaattatttattatcaatgctttgaaactatgagctctgtatgtaagatattatcgtcattacatacatatgttatgaacatcaagttgctggctttaaaaaaagaaaaaaagcaaattaaagatgagttcaagggaaaaaataagaattttttcctctgagaaataaagcattcctaaatgtagcatttcctttagttcatttatktagtttatgatttcaatctgatttcagaccactttttagcatagttttacaaatataatcttatgattctaggttaatgatttaggtacttggaaaaaatatccaaaagcctgtttttcagagggagcaactaaagcccataaaggaaaatcaacttgccaaaggcccaaataactgtcagatagaacccatgtgccatcaacatacaatgcatggtcatttcattttgctttcttcaatccactgtcacctttagaaatatgaattttagcttttaaatgggaggtgcttttttaaatt

SEQ ID NO: 156304 - DNA, 601 bp, Human
cactgcctccaactgcctggagttattctgcccccacctgggtaagcccagaaggggtacagtcttagaatgctggggaaacaaagcctccaggaagagcttgacttggtgtatattggggtgaaaattagaaagagggcttccctgctccccaacagagaccaggatgacttgcttctgaaagcctctttagaacctcttcaccaacaccccaggatgccctccagccagattcagagaggggagaatatgggaagggccaaagagatatttttctgtcctgtaaactttagagggctcrctgttggctccttgttaggcacaaaggggaactacataaacctactaaatgcaatatgaaccttcattaacaactactctttgcctttaccaatattatccagcaggagatacaaagtaattacaaattattttatttctaaaattggtatggaaagtggcctgattccaaaattttcctttccaactaaaatagctggcaaatccaacataacctttattttataagtggtagtagtggttgtgcattgctaagaaacaatttgggtggaaattgctctcttgaaaaaagaaccctaca

SEQ ID NO: 156305 - DNA, 601 bp, Human
tgaggctattaatgtttccaggaagagccataaaattctcccttataatttgacctttccttaagcacgttaactcttccacatctgaattcttcccattgatcatatgagaaatttctgcctgtatttagtggacacacatctatttgaaaatattcctcctggttgaaaaggtctgtggtgtgtaatctaaagatattttagatgtgcagtgaactgagtttccagaatcttttttttttgtaatgtctatgtataatccaccttgattctttacaggataggaagactgaatacaatwtaaccaagggtaaatacaaatatgccttaaggatccagtgtgtatttaagtaacacactgctatttattccttcaagtctgtatacatgactaatgtccaacaaaaatgattacatgactgggtgttaatttagagatagttcacctgctgtgttatacctagaggttcaagcccttacctttaggaggtatgcaataaatgtctgttgttctagagatttgttcctggcaattgagaatgctgtatacaaaggtacaatgatggataccacacactggctccaccatgagcaacctatt

SEQ ID NO: 156306 - DNA, 601 bp, Human
aatgtctatgtataatccaccttgattctttacaggataggaagactgaatacaatataaccaagggtaaatacaaatatgccttaaggatccagtgtgtatttaagtaacacactgctatttattccttcaagtctgtatacatgactaatgtccaacaaaaatgattacatgactgggtgttaatttagagatagttcacctgctgtgttatacctagaggttcaagcccttacctttaggaggtatgcaataaatgtctgttgttctagagatttgttcctggcaattgagaatgctstatacaaaggtacaatgatggataccacacactggctccaccatgagcaacctattaggaaaaatgtaatatataatatgtaaacatgtaaaacacacacacacaccagagttctggggttccccaactttccctggcttactctccagacctcccttctatgatgctctctggggttccctctgggccatcccctttgggagggcaggagaaagaggacagtgggaggaggaaggaagaggctagagagtagggcatgagcacaggaagctgccctcatcccgcctcttgccctcctgt

SEQ ID NO: 156307 - DNA, 601 bp, Human
taggacttcctttccgttcagcctagggtaggaatagctgattcatgtccccaactccataaatgttttataaagtataaaaagttgccatttttctttgcctctggataagaaaattgaatacaatgaacaattgtgaataaaagagctgcctgccaagctactcaggtaacagaaaagtgcctggaaggacagacaggccaagtcttgaagattgagtggatccactctgtttatcaaagatcacataaatcttggattgatatccagggctcgataaaccaaagtcaaaaacgggatkggtaaaggaaagaaattacacatgtatactaccagaacatcattttagaaacaaaggcccgtgcttgaatggcagcccccgtgtattttctttgcctttattctacattttcttgccacctacaagtggagttagtctgtctacaagctagagttagtctgttggcctcttagcttcttaagaactaacatcttcctgccctttctagtccctccctggagtacagcctgtcattttcctaacaactgttttctttgactcttccagaagaggtgcatttactttttatgaggggcagaa

SEQ ID NO: 156308 - DNA, 601 bp, Human
gtaaaggaaagaaattacacatgtatactaccagaacatcattttagaaacaaaggcccgtgcttgaatggcagcccccgtgtattttctttgcctttattctacattttcttgccacctacaagtggagttagtctgtctacaagctagagttagtctgttggcctcttagcttcttaagaactaacatcttcctgccctttctagtccctccctggagtacagcctgtcattttcctaacaactgttttctttgactcttccagaagaggtgcatttactttttatgaggggcagaagytcagtccacactgctaattatccctcccttgtggcctggtggagagacctccctggccctcccattttgtgggcatccactgctaagccaccaagctcttcagaaaaggagttcccacatcctccctgaaagcctgagaaatattacagtgatgttgtccaaaccactctgaaatgactaactggaagtctctcaactgtctttctttccctccctaggaatccgatcatgggacacaaacctgattgaatgcaacttggaccaagaactcaaactttttgtatctcgacactctgcaag

SEQ ID NO: 156309 - DNA, 601 bp, Human
ttcccacatcctccctgaaagcctgagaaatattacagtgatgttgtccaaaccactctgaaatgactaactggaagtctctcaactgtctttctttccctccctaggaatccgatcatgggacacaaacctgattgaatgcaacttggaccaagaactcaaactttttgtatctcgacactctgcaagattctctcctgaagtcccaggtgaggcttccgctcagtgttggtcagcctagaattccaaaggacaaggagcaagctagaaagctttgtctgaggcagcaaaaagactctcytattgctaaaaggatactttgtatttgttattatcaactaggttagccagcagccacagtttaggaagtcactctaggttatcactgtgtgggttatctattttgtggattcttaatgagtttttaagttctagggttgtgtatgtgtatatatatatacacacacacatcaatgatcacacaaattttgaattgatatccagggcttgagaaagagagagagagaaagagagagagatagtatagtgtgtgtatgtgtatctcactgtactctgagctcaagggactacaaactattta

SEQ ID NO: 156310 - DNA, 601 bp, Human
tcaaactttttgtatctcgacactctgcaagattctctcctgaagtcccaggtgaggcttccgctcagtgttggtcagcctagaattccaaaggacaaggagcaagctagaaagctttgtctgaggcagcaaaaagactctcctattgctaaaaggatactttgtatttgttattatcaactaggttagccagcagccacagtttaggaagtcactctaggttatcactgtgtgggttatctattttgtggattcttaatgagtttttaagttctagggttgtgtatgtgtatatatatayacacacacacatcaatgatcacacaaattttgaattgatatccagggcttgagaaagagagagagagaaagagagagagatagtatagtgtgtgtatgtgtatctcactgtactctgagctcaagggactacaaactatttaaatgttaatcttactcaaatgaaattctgaatacaaattggatgctcctaggatcccagaactgtcttcctgcaaaagaaaaaggaaacatatactgcatttcaaaatgaaatatacatcatcatttcataattgcattatcacccgccattgcatta

SEQ ID NO: 156311 - DNA, 601 bp, Human
cccagaactgtcttcctgcaaaagaaaaaggaaacatatactgcatttcaaaatgaaatatacatcatcatttcataattgcattatcacccgccattgcattaccacttatctttcttcgtgtgggtaaaagaatctgatattacaaacttctgttaaaatagcctttttttcagagatgaaaaagaatatcaaagaataattaaaggtaaggatgcaaaaatttgtcatatgtgaagatgttcccactaaccagccaccttcctggggctatgatctgacccatgcctctggcgctggrgatgtattcatactgacccatctcgtcttcttcttgtgagcaataacctatattcctcccatttggtcacatttaggaattatgagacagtttctggcccataaagactccaaacctggaatatatttctccagacctttgccattgacccatcagaaacactgtattacatcttatttcttgaccatcacttgaattttacataagagaaagctattttctgcccatatgcttttgttatatgattcctaattttattggcattgatataacatcaggaatgagattcagcctattttg

SEQ ID NO: 156312 - DNA, 601 bp, Human
agttcttccttttgagtttaatattagaataaaatcccatacatttcagttattgaaatgcattgtagctttcaagtatggaattgagtaaatgtgctaagaaaagcttagcaagaaatggtttattaaaagttaacttcctgcaaagccacatgaaaaatcagtttttaagtaactttgctttgagaaaaaaggaatccagagactgtcagacagcatatgatttgctgaaggaaaggtacagtataaggttgtttctcttgttgttattttattgtatttttgtcttgcgatatctccrtatcttttaaaaccatctcacaaaaaaaatgagggaagtgctgttttccaaaaagtatgattatttcaaaatgtaaaaactacaagcttttattttttctctgtaggttgttctggcttttttactatgattgtttgtaagacttctttttttgtgtgtacaagtcatgtggttctcattgtgttcattcatatttggactgactttatagagtgacaactgcatattgcataatgaaaggctgcaagcattgctgaagaattaaccatttctagacccaagacctagtattgctcctgt

SEQ ID NO: 156313 - DNA, 601 bp, Human
gcattgtagctttcaagtatggaattgagtaaatgtgctaagaaaagcttagcaagaaatggtttattaaaagttaacttcctgcaaagccacatgaaaaatcagtttttaagtaactttgctttgagaaaaaaggaatccagagactgtcagacagcatatgatttgctgaaggaaaggtacagtataaggttgtttctcttgttgttattttattgtatttttgtcttgcgatatctccgtatcttttaaaaccatctcacaaaaaaaatgagggaagtgctgttttccaaaaagtatrattatttcaaaatgtaaaaactacaagcttttattttttctctgtaggttgttctggcttttttactatgattgtttgtaagacttctttttttgtgtgtacaagtcatgtggttctcattgtgttcattcatatttggactgactttatagagtgacaactgcatattgcataatgaaaggctgcaagcattgctgaagaattaaccatttctagacccaagacctagtattgctcctgtggagtaggaagatcaagttcccccaaactgtcactttagcctaatgtaccccattctcc

SEQ ID NO: 156314 - DNA, 601 bp, Human
ttgctgaaggaaaggtacagtataaggttgtttctcttgttgttattttattgtatttttgtcttgcgatatctccgtatcttttaaaaccatctcacaaaaaaaatgagggaagtgctgttttccaaaaagtatgattatttcaaaatgtaaaaactacaagcttttattttttctctgtaggttgttctggcttttttactatgattgtttgtaagacttctttttttgtgtgtacaagtcatgtggttctcattgtgttcattcatatttggactgactttatagagtgacaactgcrtattgcataatgaaaggctgcaagcattgctgaagaattaaccatttctagacccaagacctagtattgctcctgtggagtaggaagatcaagttcccccaaactgtcactttagcctaatgtaccccattctcctctcctttctcctgctatcaccttcagtaaggattagttacctacctagttgtatagtgttatgctagaggctgtgtttggagattggcctttggacacacagcatctttactattcttgccaatgctagaaaggactgatattacgactttccctgtcaagcct

SEQ ID NO: 156315 - DNA, 601 bp, Human
aatgaaaggctgcaagcattgctgaagaattaaccatttctagacccaagacctagtattgctcctgtggagtaggaagatcaagttcccccaaactgtcactttagcctaatgtaccccattctcctctcctttctcctgctatcaccttcagtaaggattagttacctacctagttgtatagtgttatgctagaggctgtgtttggagattggcctttggacacacagcatctttactattcttgccaatgctagaaaggactgatattacgactttccctgtcaagcctatgagtacrctttacaggccaaggctcccctctgggaattaagcatctagaatagagccattatagtcatgctcctgtgtggggagcatgaaggtttccaaccaggactgtaaggtgataaaagcacatgtcagattcagtttcagataagtgtgttttaaagagaagagatgttagaggataagaagacatggagatcacaggatgatcactggattgggcccagggaagcctttagcttttcctgaacaaactggaaaggttttatggaaaaatttgaagtctgtttttaagtgggtccaagtctag

SEQ ID NO: 156316 - DNA, 601 bp, Human
gcatttaacaatcatatacagaccaacataaaatctagccccctgcatcaaatccaggcttcaaacagatttttgggaggtttgggtttaaaaaaacatagagacggggtctcactatgttgcccaggctggtcttaaactcctgggctctagcaatccacctgccttggcctcccaaagtgctaggattataggcatgagccaccatgcccagccacagttttgttttgttttaaggccagcagagttatagtaaaatatttattgccttttatgacataagtaaattaaggctcaagtyacccatatatctgtcttatgttcctgttggttatgatagcttttgttgttttttaataattggagttcacttgtaaagactgaagatagcctcaaattgcagctaacagattgtgcaaatggcacaagattgattcctttgtactagtttataccttatactagtttttaaatatggttttgagatttgatttgactatttcttcaggattgtaggtctcattcaagaccactctgaaagacttagtcatcttgaataatatcctttgagcaggaatctgaaatatgagtgctttctgta

SEQ ID NO: 156317 - DNA, 601 bp, Human
cctgggctctagcaatccacctgccttggcctcccaaagtgctaggattataggcatgagccaccatgcccagccacagttttgttttgttttaaggccagcagagttatagtaaaatatttattgccttttatgacataagtaaattaaggctcaagttacccatatatctgtcttatgttcctgttggttatgatagcttttgttgttttttaataattggagttcacttgtaaagactgaagatagcctcaaattgcagctaacagattgtgcaaatggcacaagattgattcctttrtactagtttataccttatactagtttttaaatatggttttgagatttgatttgactatttcttcaggattgtaggtctcattcaagaccactctgaaagacttagtcatcttgaataatatcctttgagcaggaatctgaaatatgagtgctttctgtacacaaggtgggtggtgggtgcctcagttccccagaatgttagttctgtgatctttaagctctgtccaactctggcatactgtaattcttggagtggtcagtcatctgggcttatcttactattattttgccttactattgc

SEQ ID NO: 156318 - DNA, 601 bp, Human
caatccacctgccttggcctcccaaagtgctaggattataggcatgagccaccatgcccagccacagttttgttttgttttaaggccagcagagttatagtaaaatatttattgccttttatgacataagtaaattaaggctcaagttacccatatatctgtcttatgttcctgttggttatgatagcttttgttgttttttaataattggagttcacttgtaaagactgaagatagcctcaaattgcagctaacagattgtgcaaatggcacaagattgattcctttgtactagtttatmccttatactagtttttaaatatggttttgagatttgatttgactatttcttcaggattgtaggtctcattcaagaccactctgaaagacttagtcatcttgaataatatcctttgagcaggaatctgaaatatgagtgctttctgtacacaaggtgggtggtgggtgcctcagttccccagaatgttagttctgtgatctttaagctctgtccaactctggcatactgtaattcttggagtggtcagtcatctgggcttatcttactattattttgccttactattgcagccttgccttg

SEQ ID NO: 156319 - DNA, 601 bp, Human
atggttttgagatttgatttgactatttcttcaggattgtaggtctcattcaagaccactctgaaagacttagtcatcttgaataatatcctttgagcaggaatctgaaatatgagtgctttctgtacacaaggtgggtggtgggtgcctcagttccccagaatgttagttctgtgatctttaagctctgtccaactctggcatactgtaattcttggagtggtcagtcatctgggcttatcttactattattttgccttactattgcagccttgccttgcctaaagatcactcaacaaasctttgctgtgtgcccagggcaggtctctgctgatttgccttgatgtaaagccattcctggccacatctaagctggatcaagtgagaacagtcatcttgaaagaaaaggttaggtgttcctttatgaacactctctaatcttttactcaaaggaaagttcagtagttgagtcttttcaaaatagagcaacagtcttttgttgttgttgttgttgttttgaaacagtcttagctatgtcatcgcccaggctggagtgcagtggtgcaatcttggctcactgcaacctcaacctcctgggctc

SEQ ID NO: 156320 - DNA, 601 bp, Human
cactcaacaaagctttgctgtgtgcccagggcaggtctctgctgatttgccttgatgtaaagccattcctggccacatctaagctggatcaagtgagaacagtcatcttgaaagaaaaggttaggtgttcctttatgaacactctctaatcttttactcaaaggaaagttcagtagttgagtcttttcaaaatagagcaacagtcttttgttgttgttgttgttgttttgaaacagtcttagctatgtcatcgcccaggctggagtgcagtggtgcaatcttggctcactgcaacctcaamctcctgggctcaaatgatccccccacctcagcctcctgagtagctgggaccataggtgtgcaccatcacacctaggtaattttttgtatgttttgtagagattggatttccccatgttgcccaggctgatctcgaactcctgagctcaagcaatctgtctgccttggcctcaaagttctgggattataggtgtgagccactgtgcccggccagaacaacagtcttatatttctttaaagttatgattttaaatactatcataaaatttttatttacctattatatcatatgttttttgta

SEQ ID NO: 156321 - DNA, 601 bp, Human
cagcaagctccgcctcccgggttcacaccattctcctgcttcagtctcccgagtagctgggactacaggcgcccaccaccatgcctggctatttttttttgtatttttagtagagacggggtttcactgcattagccaggatggtctcgatctcctgacctcatcatccgcccacttcagcctcccaaagcactgggattacaggcgtgagccactgcgcccggccccacctcatagtttcaatgcagatcaaatgaattaaagtgtgtaaagctcttaagacagggcttgtcacatggaracaaatgtgaacgagtgctgtctcccttctggagtatctatttgacttgtatatttggtgattgttattatccgtgggaaataccgggtattgatatttggctagtttcctttttgtagtaattttaaatttgtattaaagatgtttctcagagaaacgactgctttcagcattctcagaaggcgcagagctgctgactatgtgtaaagggtgacaacattctatggctgagcttctaaggtcctttgggcttgagagcaaaaagccggcaatgctttaaagtgctggctggtaaagcag

SEQ ID NO: 156322 - DNA, 601 bp, Human
ggaatatttggaagaatgaagtatttcccactgtttataattttgttgggaaaataagtcattcacagctttaaaattcactgtgtttctcaacaaagaaagagagtttctttttatttttttaatctctttttgtttttgagacaggttctcccctctgtcacccaggctggagtgcagtggtgcaattacagctcactgcagtctctgcctcctgggatgaagctaccctctcgtctcagcctctgaaatagctgggactaccagcctgccactatgcccagctaatttgtttttttttgttttttttttagttttttttgaagatggagtctcactctgtcgcccaggctggagtgcagtggtgcgatctcggctcactgcaagctatgcctcccaggttcacgccattctcctgcctcaggctcccgagtagctgggactacaggcgcccgccacgacgcccggctaattttttgtatttttagtagagacagggtttcactgtgttagccaggatggtctcgatctcctgacctcgtgatctgcccgcctcggcctcccaaagtgctgggattacaggcgtgagccaccgcacccg

SEQ ID NO: 156323 - DNA, 601 bp, Human
tggagaaattaacataaatacaagacaataataatgttattttaataaactcttctaggttaaaggattgcctatagtcaggactggtgaaattgatgcttatagaaaatgcaacaagagcgtctacatgtgatttaaaaataaaagtaagtaattaggaatgaaaattgaaaagctagggtagtgttttattgaatgtggctcctctctgcagttgtaccgcacctcatttgaaacactcaagctgaggttgcctctcaaaattgctgccttgcattcctgaggggttaagacgaaataygaacatcctgaggactgtctttgttgtcatagagggaagtcctctaaacacgcactttgccattaatctggccatttctttctcaataaaacaggttttcaatgggagctgtgagtaaacacgccactgttgagcattgtggctcaaattcagatttcttgttggcttctcacgtggatagtgcgaggaaggaacagctattcccctgagggagcaacacgtttttagtgcacctggccccaggaacactgctctacatagatgtggctttttggatcctgaagtgtatccatcaatggg

SEQ ID NO: 156324 - DNA, 601 bp, Human
ccctgctgcagaaaatgttcctgaaaaaggaaggcagagacttggccactgctgagtagaaaaggaaggcaggcggctggtcccatcagacctctgaaatattttgctttttcgtgatggcattgatctagtatgtcttaaagtctcattccttatgtctcagggtaaggctcttagttcccttcccatatgaaaaaattaatcaggagcgaggtggaatcctgatgtttcagatgctttgagcccagagctgagttggtggaagagtataatttttatcagtcatttccagcccctcccrcaataggaagaaaatcattgtcagacttggggtagggagttgtggcctcctttcaagcaatctaacaataaccctgagtcagaaaatctaggttcaaataccagctctggcttttactgggctatgtaactgtaggcagcttatgggattgctccgagccttaactttctcatctgtccaatggcattaattggcaatagtacttgcatctcaaagggttatgcctggtacctatcaaccattgtttttcacctctaaaaattatttcctttcaaaacatgggccagtgttctgaggtga

SEQ ID NO: 156325 - DNA, 601 bp, Human
agagtccttgtgaatttttcttgggagtttttagaaacccttacaatagttctcagttctccatatttggatcccagaatgttcctagcatctagtttccctggaacagagtcatcctgtgaaaaaggatgaatccaatccagatcagaccctcttgtgaggtgataattttccatccagatttccctgggacctttccatttgcattcttgttttgccttgaaaggcagctggtgagctatttctttttcctcattggacttttcatgtccaattacctagatgattattgctcctgtargactgatattttagaaagaatttggaataacactgggttttgaggtgtagcccaacaggatttgaccaggagtctccatttacagttcttcaaggccagtgcatttggtgagctggttggaaggaaactttggagtgttctagaaagaactagaccatctgaatcacctgtcctgatgcccttgtgtggaataaaggagaaggcactgccttgtgctgagtacttaagtgtgctgagcacctaggtactaagtaaagtgctagttactgtactaaacatacccatgggcatgtgctatcc

SEQ ID NO: 156326 - DNA, 601 bp, Human
tttaacaaatgataccactgatcactggcaaagaggacaagataggcaccttcatattctgctatttggatataaacaaccttctgaaatgaaatttttcaatatatatgaagagtcatagaaatgctcacgtacttcacccagtaattccctaccaggaatttattctatggaaataagcagagatatgcacaaaaaatgttatgtaaaaaaatgcttattgctacgttatttctctatgtgaaaaactggaaaaaaacctgaagttctcaacaatagggcatgtataatcagtaatgaktaatcaatagaattcagtatttggcctgcattattataaaccatatcttcgaagaatctttactgatgtgtaatgttgagtgacaagggaagggttcatgaaggtatttttcaatttgatcacaatttgataccaaaataatttttgtcttttccttgacacccaatttcaatgacacccaaattgtaatatgggttatcactgagcagtaggtgaacaggttattttaattttcttccttatctttttctgtgttttttacattttatgcagtgggcacatagtattttacagtcagga

SEQ ID NO: 156327 - DNA, 601 bp, Human
tgctgggattataggcaagagccacaggacctgtcctacaaacttcttttaccttaaccatggtatagaaaatacaggctgatccatgcatacatctaaaattgaaacaaaagtttaacaaaacaatgcctatccttattatctgcaatgcattatgacattttctagtctgttttattctatactattaagaaacactggctttgaccatttcatgctacagtaaagtattgcagccttcatttgaagaacactggtatagaggtttttgaagaggtgcgcataagggagagaaaaacarctgcatgtcctgacaactattaagtatcactcataaatttattttcagcaacatgggaaaggaaaatagatcctttctttattaagttaattgtgacagaaactgggacaaaaataacgtgggaggaacatgttaaaagaggagatttacacatatccagtgttttccagcaagaagaatgcatctgaaagaggtaaaactgtgattatcgaagcaatcctattacacctatgcagatgaatgaaatcaccaactttaggcaacatgaaaaaataaaagggccaagatcaaagtggacct

SEQ ID NO: 156328 - DNA, 601 bp, Human
aactcttttacctcctggggtacatgtccacgctttactcctctcctgccctccagcttctttctttctttcctcccatttctcctctcttcccctcccttttgcctttgctctgcagagacactggtgccgtgacacacatctgagcatggctggtggggctgaccagtggtcaccagtgcaggatttaagtggttggagcttaatagtagctacaagtctttaatttcttcagcaggtttttaatggcctttgatgcacgttagaaaagacatggaaagtcctgaattcagagccttcrtgctgggtattgtatagtcagaccagccctgtctctggactgaatgggtctcttgaaatcataaatgcattgcttagggatcagtagcctcggagtgacctttctcactcatggctttcctgaggctcagaaaggccaggccttgtcctgggtgagccagcctctcagtaccctgatggcatgactcagaaagctggacaatgccctagaatgactttctccattaagcccaagaaatattgcatagaatcagtctgtctggaaattccttatatggagaggttctgagacgattgtatg

SEQ ID NO: 156329 - DNA, 601 bp, Human
catcttggagcaaggaactctcactgtctgcctgtttctcccagcacagcactgcagagaggcccagaggctataaagccctgccacgtgtttctccaaatgggtggtttttattatttctggaatgcagtccccagccccaaatcctaatatgctgacaaggcaaaagcaaaagagacctgtggaaccccacccagtgacagtttggtgtccctccccatctgggcttggtgcccaccctgtgaccctcactcttcctacttcccccaaggtggctgggagtggaaggcgaattggagcwcattcaaagccagagtggaagggagtgatttaagatcttcctgtgagatggagtcctgggcggtcgcttattgtgcagactggattgtgctatgggatctgctctgcctgtggagggggactgtgtttctacatccacctcatttcatcaggcaaggaggaggggcaggtagtctgcaaaattccgctatgtggtttaacacagtgaagacctgaaacctccttgatcaccaggaaagagatggggaaactgtacctaggcgtttctaagccaggagaccggagctcgctgaggaataat

SEQ ID NO: 156330 - DNA, 601 bp, Human
tagcctcccaagtagctagaaccacaggtgtgcaccatcatgcccagctaatttatttattttttttgtaaagacaaggtcttgttttgttgcctaggtaggtcttgaactcctaggctcaatacttggcgtacttggcttgtagatgtatcattccattatctacctccagtgtcacgtggcgtgttctccctgtttgtctctgtgttttctcttcttattcagtcattgaataagattcccaccctaatccagtgtgacctcattttaactaatgacttctataaagaccctttttccmaatgaggtcacattctgaggtttccacgtggacatttgtggggaatactgttcaatctagtacaccttccttctatgttgttgttctgaatctgctgtggattggaaaatctagtcactaagcttgttagacctcctctctaaagaagaaaaagagagagagagacttgatcccgaatcttccctaaggagtcttccgtcgtataaagtctttgagctgtaagtgctttgacttagtggtatctattttgcctgctcagaggctttccctcgctctaccttttaatgtttttttactgaa

SEQ ID NO: 156331 - DNA, 601 bp, Human
ttttaatcacttttgacatttcacagtgattcctttttctaaacacatttttatttttagataactttagatttacagaccagttgcagagatagtacagagagttcttgtttccccttcaccctgcttcccctactgttagcaacttacataaccgtgctactttttatcaaaactaagaaattaacatcctgttagttaaactacatggcagattttttcctgatctctccaggttttccactgaatgtccttttaccatgccatgatccaatgcggtatcccacattgtatttagatkgtggttctttctaaaggtgcacaccagaacagcattctagcagggtgtgttcctaaattatcctatctatggatatgtttttttttacgtaaaaagtagatgtttttttcctccaggagtggagagagggacacagtgaagcaattggcctctagctctttgaaataaatgggattccttgttctgcaaaacctggggtcggaccccgttcactccccttcctaccctgagcattatgtggactgacaccaggtctgtgaaggaaaaactgaagaataaagaaagcatttggaaaatccc

SEQ ID NO: 156332 - DNA, 601 bp, Human
ggtctcagctgtgggaccttatgagcagtgttgcacaaagacattccccccaaagcctgctactgttacttttaggatgttcatttaaaaaaaaaatctcttttccctaggtcgggaagatgaccttcaccatataatttcggactaaaatctgcagattgtaaccatagttaggaggcagttcttcattaaaataccctgcatttaatctttcacatattgtacaaaagtaaaaccaaaacaaaataatactgaatggtaaagtaatattatttttttattttgctaaaattccatgggktgttcattttctttatgactcgtctcttattcctagctcattctcgtgtgtctatcacagtgaagttgctgtagacaccctcagatttctagaaatagtatctgaagtgttcccagagggaataggatttagggccaaggaattaggatggtcccactctgtgcccatgtataatgccacacagactgagtgactttcctccaaatggatatcgggctggcatattttgggacctattgaatgtttttggtcccattccagtttactgttaacagcctcatctatttgtgaacagacaca

SEQ ID NO: 156333 - DNA, 601 bp, Human
cctggtaattcctgttaatctctgcacttcttcagagtgtcttctaaaccaggaatcctttatctggggaacttttaccctgataaatgctggtgcactgcaaattattgaatgtcattagggtgccccagaagctagattattctagactccagattgaacaatggcttatgtatttttctgaggagggcatatcctgcgaagggaagcccagacgttctggtgagttggaggtgcattgttaccgtgtccttacacactgtgtccattcactggtttagcacttgattgtaacagcatrtattattttctaaactttttatctacaaaatctcgcctcatcaacaaaattgttaaactcctcaagagtagtgatcctatgtttggtacattttgctccccccagagtactgtatagcaaagagctaactggtgaaatggcttaaattataggtcaaggagctgggatttaatcctgagggaactgaggagccattggtggttcttgagctatggaccaacttaataaaaacagtaattgagaatgtgattcatcgagactgtgttggcacaaaaatggaggttatagttttatgtattc

SEQ ID NO: 156334 - DNA, 601 bp, Human
gaagcccagacgttctggtgagttggaggtgcattgttaccgtgtccttacacactgtgtccattcactggtttagcacttgattgtaacagcatatattattttctaaactttttatctacaaaatctcgcctcatcaacaaaattgttaaactcctcaagagtagtgatcctatgtttggtacattttgctccccccagagtactgtatagcaaagagctaactggtgaaatggcttaaattataggtcaaggagctgggatttaatcctgagggaactgaggagccattggtggttcytgagctatggaccaacttaataaaaacagtaattgagaatgtgattcatcgagactgtgttggcacaaaaatggaggttatagttttatgtattcccgtccctggaagtttctgatagttatactaacaataagaatatgtgacagattaaatgaaaaatatagcaggatgtttaagtctacacaaaggtaaggtccttcattgtgacaatatgcagttttgcacatacaaccatatttggagcctgtctacaccatgttcccagcatcagtggagtcaggagagtggtgatgttctgac

SEQ ID NO: 156335 - DNA, 601 bp, Human
tggtgagttggaggtgcattgttaccgtgtccttacacactgtgtccattcactggtttagcacttgattgtaacagcatatattattttctaaactttttatctacaaaatctcgcctcatcaacaaaattgttaaactcctcaagagtagtgatcctatgtttggtacattttgctccccccagagtactgtatagcaaagagctaactggtgaaatggcttaaattataggtcaaggagctgggatttaatcctgagggaactgaggagccattggtggttcttgagctatggaccarcttaataaaaacagtaattgagaatgtgattcatcgagactgtgttggcacaaaaatggaggttatagttttatgtattcccgtccctggaagtttctgatagttatactaacaataagaatatgtgacagattaaatgaaaaatatagcaggatgtttaagtctacacaaaggtaaggtccttcattgtgacaatatgcagttttgcacatacaaccatatttggagcctgtctacaccatgttcccagcatcagtggagtcaggagagtggtgatgttctgactggtaggggctgttt

SEQ ID NO: 156336 - DNA, 601 bp, Human
cacactgtgtccattcactggtttagcacttgattgtaacagcatatattattttctaaactttttatctacaaaatctcgcctcatcaacaaaattgttaaactcctcaagagtagtgatcctatgtttggtacattttgctccccccagagtactgtatagcaaagagctaactggtgaaatggcttaaattataggtcaaggagctgggatttaatcctgagggaactgaggagccattggtggttcttgagctatggaccaacttaataaaaacagtaattgagaatgtgattcatygagactgtgttggcacaaaaatggaggttatagttttatgtattcccgtccctggaagtttctgatagttatactaacaataagaatatgtgacagattaaatgaaaaatatagcaggatgtttaagtctacacaaaggtaaggtccttcattgtgacaatatgcagttttgcacatacaaccatatttggagcctgtctacaccatgttcccagcatcagtggagtcaggagagtggtgatgttctgactggtaggggctgtttttgaaatattttctaaaatctcttcatttgttaac

SEQ ID NO: 156337 - DNA, 601 bp, Human
gagggtctagacttaggcccagagagagctggggatttcataggctagaaagaccccagaacatagtacaattcagttgcctaactccagtgtacaccatttacatcatatgactagtgaatggtacccctgggcctggggagaacatgttgtttctccttaagattctggtacatccaccttcaaagatcccaggccaggggactgagaagagtgcaaccctgagtcagccagggtgtttgactcagtggtactcaggggacagagagagaagatgagcttccatgccagatgcatgtgrgtttgagtcacaactttggcactcacaagccacctggctttggatcaatcacttaatctctctataccctggttttccatgtgtacagtgaagtcagtcatacagctgccattgagaaatggaatcaatgtcataataatactcaaacaatacataataagcagtcaatacatggtggctattgtggctcatatgaataatagtactagtgctggtgtgccaatgaaaggacaaacaaatgaaaaatactgctctctgtgagactcttttcaacccaaagggcatcttgccctgcatggc

SEQ ID NO: 156338 - DNA, 601 bp, Human
agttgcagttggtgaagagtcacagtggcattcctgacttcctctgcctgtcttttctatcccaagggacttctgctccctcagctcacacttaggttctgctgatggtgtgctgaaaacataggtgttgaaaaaaagcagagctggctcagcgcagtggctcacacctgtaatcccagcactttgggaggctgaggcgggcagatcacttgaggtcaggagttccagaccagcctggccaacatgatgaaaccctgcctctactaaaaatacaaaaattagccaggcatagtagtgggcrtctgtaatcccagctattctggaggctgaggcaggagaattgcttgaacccgggaggcggaggttgcagtgagccgagatcgcgccactacactacagcctgggtgacaaagcgaaattccgtctcaaaaaaaaaaaaaaaaaaagaaagaaaggaagaaagaaaagaaaaaaacagaattgacagccagttcagaaaccttatgaagagctagtactaagttatcatcaccagagagtgaaaaggaccttcaagtccaagacagcactgcagacacatcacgccatgccaggcagggga

SEQ ID NO: 156339 - DNA, 601 bp, Human
aaagaaaaaaacagaattgacagccagttcagaaaccttatgaagagctagtactaagttatcatcaccagagagtgaaaaggaccttcaagtccaagacagcactgcagacacatcacgccatgccaggcaggggactgaactcagtgctgcgtgcaacctaacattctgtgatgaaggattaagtcatgccactagcaaagtgggtgtgattggcgagagatgagtgtctgagctggggagaaaggaaagaaccaaaataatggcagaaatatttttatcctgtaaaagtaaaagtcaytgtcagtgtgacaattgaaagaccttttcattccctctgagatattttcaaagtgattaacttgaaaaatcttcgatgtaagggctgtaacatgactgggggggcatcttttttttttctccttcttctcttacttcttggaggaaagatgaaataaaatggttttaagaaaacgaaagacatcctgaaaaagaaagttaacaaaaacacaaaaggaaaaagctccctataaaaagcttactacctgctccctgcagttacaggtatcattttatgttagcgcttatgaaatatttctaa

SEQ ID NO: 156340 - DNA, 601 bp, Human
tggggattttcatttcactcatcatttaaagtttgtcatgaggggtctctgtgaaagaaaaatatagaggagcctcggctgggtgtgggggctcacgcctgtaatcccagcactttgggaggctgaggtgggcagatcacgaagtcaggagatcgagaccagcctggccaacatagtgacaccctgtctgtcctaaaaatacaaaaattagctgggcatggtggtgcgtgcctatagtcccagctacttgggagactgaggcaggagaattgcttgaacctgggaggtggaggttgtggtragccaatatcacgccactgaactccagcctgggtgacagaatgagactccatctcaaaaaaaaaaaaaaaaaaaagaaagaaaaatatagagaaacctaaggagagaagactcactggacatactgtgtgaagagttctctgactctaaatagctttgtaaataaggcagttatgtttcctagtctatttcttttccaaaagaagggaggatgtgtgattgcctctagcccaacatttgtagccaactggatgagattccatgcttttaccatcattgacccaaataggtaacctaagaa

SEQ ID NO: 156341 - DNA, 601 bp, Human
ggtttacctgttagcaattggacatatatgtcttgtatgatacagtgccctactgttgctattttaataccatgagaactttgaaaggctaaaaccaaagtacaggacccactgaagcctacactttacaaataaaaggtaattttgtcagctaatttgtagtggattccttgaccttaatctttcttggtcccctggtcaaaatatagtcacccaatttgctttttttcacatgtccatattttaattctttgccaatcattgtctgataattgtcttaattatttgtttatttttgctyctctgcccctactagaatggaagtcttgctgaccactatctccaggacctggcatataggaagttcctaatatatatttgtcaaatcaatgaatgaatgaatagatacttaagtcatagaatatacgtcaagtccacagacccagaatctaaaataaatcggaatttaaaatgttgtacatcagttggttaaaacgctaatagaatagagatgttacttaggggattcaatggtccgaaggagtctgtggccaggaggaagaaccaagaacaaccaacagtcctgttcctggccaaaaac

SEQ ID NO: 156342 - DNA, 601 bp, Human
tatattttactttgtcattggagtcaaaagaagtattgataagtagactttctttcccccagtaacccttcattttttttaaataaaaaagtaacattctttagagcagttttgtagttacgaaacaggaacttttataatgaatttgattagatgtgacggaaggaaatgcaagtatttttcagaacgatgtagataacacattaaggcatcatcttctgtcatttaagaattatgagaataaagagaactggagtcgggaatgtggttagactctcctctggagggatagctgacgcayggaaagcactgctcctccacttggctcttgcccctgtccagctcctgtcgcttggccaaggccctgagctgaggagggcctcaggcttgctcacctcctgcctttccaatccttaactttgaagccttgcattttccagatatctgagtttacactgagcagtggtgccctcggcaaccttagggtgctccatctcaccttccagcttctccagcaacagcctctgctccaaaataaatgaggtgttcagtgttgctttctgggcaggaatcagatgttctttctttcagttaaactcca

SEQ ID NO: 156343 - DNA, 601 bp, Human
attttccagatatctgagtttacactgagcagtggtgccctcggcaaccttagggtgctccatctcaccttccagcttctccagcaacagcctctgctccaaaataaatgaggtgttcagtgttgctttctgggcaggaatcagatgttctttctttcagttaaactccagagctctggcagagcttgatttggtccatttttctctagggccggcttacctgttggcatttttacagagacaaaatatgctcccaatttatactattttatttacgaaagagcaaagagtaatacattcyaagaactttgattagcatacatatggatcattgcatatattccaagtgtatataaatacataaaaaatacccaatggagaataatgcaagacaggaatgtagaaagtgattttatgcatgctgcctttcttaagagaacttgttacttctcatggaaattaaaatctggggatttgctcaagggcaattttccccaaagtccccagattatttccctccctccttggactcattttaaactaaaatttcagtcttttaaaaagaagatagaagaggacagaatttatttgactaccttgt

SEQ ID NO: 156344 - DNA, 601 bp, Human
ttttctctagggccggcttacctgttggcatttttacagagacaaaatatgctcccaatttatactattttatttacgaaagagcaaagagtaatacattctaagaactttgattagcatacatatggatcattgcatatattccaagtgtatataaatacataaaaaatacccaatggagaataatgcaagacaggaatgtagaaagtgattttatgcatgctgcctttcttaagagaacttgttacttctcatggaaattaaaatctggggatttgctcaagggcaattttccccaaartccccagattatttccctccctccttggactcattttaaactaaaatttcagtcttttaaaaagaagatagaagaggacagaatttatttgactaccttgtttgacttgctctttgtcatgggtttcagacctgtttctcaggagagctacgtctgttggttcagagtacatttatcaatgccttgaaaatgcccattggccagatttggttgaattgcctcagaaacaaatctctgtttgttaagtaaaccattaattaaatatatggcccagaacttaattcctttggtttactacat

SEQ ID NO: 156345 - DNA, 601 bp, Human
atttgactaccttgtttgacttgctctttgtcatgggtttcagacctgtttctcaggagagctacgtctgttggttcagagtacatttatcaatgccttgaaaatgcccattggccagatttggttgaattgcctcagaaacaaatctctgtttgttaagtaaaccattaattaaatatatggcccagaacttaattcctttggtttactacatcacattttcctaaataagcagatgtattctttcaattataatatcccagaggtcaacggtactcatcttaaaacaaataaaaaatasgttgttaaggtaagaaatcaaccttcagcaaaaaatatggtttgggggcatactgtggcaccccattaatagtgaccttgtgaagaccttgtcgttgaatataaaatcaaaatgaaatctaacgatgcctcattttaattccttaagagatcttaaggggtggcagaatgaccacaggcaaaatccaatgcgcgtgtgagaaaaccaaacacacaaacaactcctgacactttggggcagtttttggccctaatcacttgaaaagagctaggcaatgtcttctttttaattatttatgca

SEQ ID NO: 156346 - DNA, 601 bp, Human
atcaaccttcagcaaaaaatatggtttgggggcatactgtggcaccccattaatagtgaccttgtgaagaccttgtcgttgaatataaaatcaaaatgaaatctaacgatgcctcattttaattccttaagagatcttaaggggtggcagaatgaccacaggcaaaatccaatgcgcgtgtgagaaaaccaaacacacaaacaactcctgacactttggggcagtttttggccctaatcacttgaaaagagctaggcaatgtcttctttttaattatttatgcatggcagtgggtttcttstaatgatggcccaggtgtatatttttcagatcctgaaggtagatcacctgatttgcttacttctaaagacaaagtaagcaaatcacactttgattgtttactttgcttgttaaatccctctgagtgggatttaacataatagtgtggattgaatcacacacacatttcaacccacactatgatgttaaaacccattcagaagtggagtgagtgtttgtgtgtaactatgggtatctatatttttagttgtccttttttgcaaaagattgtcatcacctaaatccctataggtggaaggct

SEQ ID NO: 156347 - DNA, 601 bp, Human
aaacacacaaacaactcctgacactttggggcagtttttggccctaatcacttgaaaagagctaggcaatgtcttctttttaattatttatgcatggcagtgggtttcttgtaatgatggcccaggtgtatatttttcagatcctgaaggtagatcacctgatttgcttacttctaaagacaaagtaagcaaatcacactttgattgtttactttgcttgttaaatccctctgagtgggatttaacataatagtgtggattgaatcacacacacatttcaacccacactatgatgttaaawcccattcagaagtggagtgagtgtttgtgtgtaactatgggtatctatatttttagttgtccttttttgcaaaagattgtcatcacctaaatccctataggtggaaggctcggatctaggctttgtgagatttacatagaaattgccaccttcacaggaagttcaatgagaggtacatgaaagtatgtaaaagcattttgttaactagagtcttataagttggttggaggcaatagctcatataaatactatgtacatcctctaattgagctatatagtatagagactgttaactgctat

SEQ ID NO: 156348 - DNA, 601 bp, Human
tagttggagaaagttcttttattaaatttctcctccttctgcccaccgagaggagctgggactatcccatacacagtggctcagtatcccctgtggcagagcctctgaagaggtgatcagaacagttaacctgccaagaccttgttgcgtggtcctctttgatgtttaatatagccagacgcggttgttcacgcctgtaatcccagcactctgggaggctgaggtgggtggatcacctgaggtcaggagttcgagaccagtgaaaccctgtttctactaaaaatacaaaaaatgatccagrtgtggtagcaggtcactgtaatcccagctagtcgggaggctgaggcaggaaagtagcttgaacccaggaggcagaggttgcagtaagccgagatcgtgccactgcactccagcctgggcaacaagagcaaaactccatctcaaaaataaaataaaataacataaaataatgtttaatatatagggctagaatatctatccaaagctttatgttcatgtagcttatcaagccttcaaaagtgacacccttctcttgctgctgcgtgtcaggacaacatagagtaggaaagggtaaagtgaa

SEQ ID NO: 156349 - DNA, 601 bp, Human
acacagtggctcagtatcccctgtggcagagcctctgaagaggtgatcagaacagttaacctgccaagaccttgttgcgtggtcctctttgatgtttaatatagccagacgcggttgttcacgcctgtaatcccagcactctgggaggctgaggtgggtggatcacctgaggtcaggagttcgagaccagtgaaaccctgtttctactaaaaatacaaaaaatgatccaggtgtggtagcaggtcactgtaatcccagctagtcgggaggctgaggcaggaaagtagcttgaacccaggaggcagaggttgcagtaagccgagatcgtgccactgcactccagcctgggcaacaagagcaaaactccatctcaaaaataaaataaaataacataaaataatgtttaatatatagggctagaatatctatccaaagctttatgttcatgtagcttatcaagccttcaaaagtgacacccttctcttgctgctgcgtgtcaggacaacatagagtaggaaagggtaaagtgaaagggggaaaagactgaagtcttccctgctcagaataaggaaaaagggtaaagaggaaaacatgagcaaat

SEQ ID NO: 156350 - DNA, 601 bp, Human
tcatgccactgcactccagcctgggtgatagagtgagaccctccctcaaaaaaaattttttttttaaagtggaagaaacgtgtttgggattcaatcaaacccaaatgggagaagttgagaactaggctttaaatgagacatcattttggtttcccagacagggcctgtaactaaggataaagaacaggaaagtagaatcaggactgtgcccctggtgtgccgagaatcacccttcaggtctggaagagggaagaaccaaggtcactgggaaccgggtgtgctgttctgggcagctaggcayccagccatgactgaacaacacaggcaccgtgcaaagaggaaatgcgtaggtgctgattctgtcgtcacttacgaatgatccatctccacctcaccctttgaaatgatgcagtggagttttgaaatgatgcagtggaggaataaacacaattcatacaaacaacaaaaatcacaggtcccttgggttgggctaaggctttatgtcaaatcctgtaatgatatgaccagatttattcatcctggctggggtgcaggacctgagtgtccacctgtacattacttattacagatggtggcagct

SEQ ID NO: 156351 - DNA, 601 bp, Human
taattcccagatccatatctcaaatgctgggattattctataacattctgaggataatgtacctcagatcttattcttaaagattaaggatctggacctcgtaaacacttaaaacaatctgagaagcagtgagggacagtgaaaagagagtggggatcacgagtcctgtggactggatttaaaacctagttcctgctgggcgtggtggctcaagctgtaatcacagtactttgggaggccaaggcaggaggattgcttcagcccagtagttcgagaccagcctgggcaacatggcaaaacmtcatctctacaaaaagtacaaaaaaattagccagccatggcggcctgtgcctgtggtcccagctattcaggaggctgaggtgaaagaatcacttcagcccgggaggttaaggctgcattgagccatgtttgtaccactgcactccagcctgggtgacagagcgagaaacctcgtctcaaaataaataaacaaataaacagataaatcctagttcagtagcttattttgtctctctgatgctggacaagacagctaactcttattgaggaacctgtcccaatagcttctatttgtccatct

SEQ ID NO: 156352 - DNA, 601 bp, Human
atctatgttatttatttctacttctttcagccagaggataaaacagagaaaaagggagcaaacttcttccttccactgtctttcaccttaacccttgatatccttgattctcatccctttgccttgagaatttttaatagggagaagaaaaaaaggaagaggaaaacctaagagaatgggactgggtaggagagaaacaccgaagagaggatttagaaagcaggtcaaatgagaatcctgcacatggaaaaccaaaccaaaaccactgacaacaaaaagaaaactaacaaccacaaggtcmaggaagtatagagaaaattaggtatagactcaaattaggtaataactaaattccctgtaacacaaaagatatccaaggtaaaaaaatgttgtctaactcacaagcaatgatcaatttatttaaactaaagaacattatttgcgaagtctcctgaacttgagtttttttattctcttaagaaaacaagtgttcaaaatttggagagccatagattcaggaacattttcagagatgaaacagatacataaacaaaaatttatttcccacagaaaagaaatgtcatttctaggaatattaggg

SEQ ID NO: 156353 - DNA, 601 bp, Human
gcctggctaatttttgtgtttttagtagagacagcgtttcaccatgttggccaggctggtctcaaactcctgacctcaagtgatccacctgcctcggcctcccaaagtcctgggattacaggcatgagccaccgtgcctggcctgaaaaacagactttaaaatcaagacatttagtgcttgtggtctttcttgatcgaccaaactttacttttagctaaatcaacccagtccttttttatctcacacatttttctctctaactccagaatcttcacattgtaagttactccagtgttgaayctgggcagggggctggaagtagttggtaggtgaagagagggcagcagtgggagctgacagagcagggaggcagagatggggacaggacggcttttctcctggctaaagcccctgcccatgccctgcccctcagtcctggttaccaatagttcaggaccctcctcatcatctccctttcatactgagtagaaatcagaggcttgctttattcttcaactaccatttctatttccttcttccaaaaccagggtgaagcctctgaggggtgtgtgtgtgtgtgtgtgtgtgtgtgtgtgtgtg

SEQ ID NO: 156354 - DNA, 601 bp, Human
ggctggaagtagttggtaggtgaagagagggcagcagtgggagctgacagagcagggaggcagagatggggacaggacggcttttctcctggctaaagcccctgcccatgccctgcccctcagtcctggttaccaatagttcaggaccctcctcatcatctccctttcatactgagtagaaatcagaggcttgctttattcttcaactaccatttctatttccttcttccaaaaccagggtgaagcctctgaggggtgtgtgtgtgtgtgtgtgtgtgtgtgtgtgtgtgtgtgtgtgtggagatgaatgctaaactctgtggagaagagatcccgcaagcatcctagaaatttacatacatagaaaataatattttgctttaggagatttcagaatcagctgaatgtagcaaaacataagctactaaaaaagccaaaccttataagacacataggttcaattaatctgtcacattttcaaaaaggaataaaatcccaacaacagccaaaaaatgcaggcttccttttgagttccaaacccagctttgggagagcacaaacaaaagtctcattgtctgcaaggcccctcctgcttcgaggg

SEQ ID NO: 156355 - DNA, 601 bp, Human
ctttaaatcccctccttcattcaaatccgatcctataaaaaggcttttgttgaaggagcagccatggcatcttggtgcacgtctgtgccattcctctcaatatttccaaagatggacaaaagagaacatcgttagttgaattcctgggcaaactggtctgaagattgacttggaaggagtggaggtaaatggcaactgtcacgtggcatttgttttgtttgcaagtgatgaagccaaagaggaaaggaactgccggtggatggtaagaaggctcctgccaggggccacctcggcagcaggmgagctcactgtgtgtttggggaagagcgtgctgtggaggcaggtggactgtgcaggctgctgtcgcctggacatgggtgttgaagggtgcagctagcgggctcagggcgttgtgtaggatcacttcagaaagaaagaggctgggatttcattaccatcacttgtggagggagccactttatgtaccttgctcaagtctacttgtatggattcctgcagaatacagacgtgatgacagtcatacccggacactgcactggctgatgctctgggtgcccacaacaaaattgtgaccaaagaa

SEQ ID NO: 156356 - DNA, 601 bp, Human
ttttatttctttggacctttccctaactgtcttttggcatttggtgtctgtgccttgtctgttttaacaaattttagttccagtaaccaaccccatagggcagtgaagcagaaggactctagatccaggtgacccgggtccaaatcctggcttgaccacttactagttgtgtgactttgggcaggttaattctcttctgtagactcattgctttcgacagtaaagggggataatcatagtagctatgtcacagaactcttctgaggattaaacgaagccatgtatgtgaagtcttagaacrgtgcctgacatcatcattgttctgtttaggcttctgtctgtgatgtggggtttgttggtaaatgttagctgttactgaaagtaggatggtgggggagaatgggcttggtaacagtgatggtggttggtggtgagtatttcaacatgttgctgtttctatagtacttctggtccttcctgatataaaggaaaaagaaccagtgtatcctgaactgctttatgttttttattttctaattgctttattgagatctagtttgcataccatacaatttacccatttatagtgtactagtgaatg

SEQ ID NO: 156357 - DNA, 601 bp, Human
gagctcactcacagttggttcatctttaccacttcaaaatgcaagctttggctgtgtcttcttccaaggccgctagagttcacgcatcttgcctcattcatctcggtatccattgcacctgcacatagtaaaggcctagtaagccgctgttcaattgcattgaaattccaaagctagggctacaattctcactctgcctactgtcctgaagttgttgtttgatcactataatgtcagaatgttttgcaagattatgtccccatgtgcatgttgtacccggaggcaggtgggcatttgtctrgtagctctggggtcacacacattattagcatcttgcctcagggaagagagaaagctgcagaaggctggaagtggcccaatgacatggtgagcagttaagtggcctgcttatagctcatttgcatgcacatgggcactttccacattcctgtgcagttctgtagttattttctagtggttggtttctacccaagtcattggtttgtcttttttgccgaaaaaccagacaaaggaaatatgtaaagaaaagtgtcattgccaagattttcaataaggaagtaacacgatttggcatatttgc

SEQ ID NO: 156358 - DNA, 601 bp, Human
gaccaggttaggattgtgagagttgataatgtctatagttttcaataccatcttctattaaagaagtctaaaagtgacttttgaccatcaccatacaccattaatggtcaatggggaagtcaatggggaagagatgcaggctttgaggggctcgacaatttatataatttaagggctcttttttaagaaaaatgaaacaattattaatatacagttaagtacagggccatgccaatgaggtaccttgaagtttaagcttctttggcttcatgataaatccatttgactgtcaactaaaatycctgagtcttttccatggatattattgttaagccacatctcccaatcctgtagtttaccctgctggtttattgaaccttacatttatccctttagaatgccatcctgttagaattgacttagccaccatcatcccaatgtcaagagcttttataaataccttaattctgccattccacattttgctgtgtctcccattttcataccatgcacaaatatgatatgcatgccttcgccatttttatccaagtgaatacaggccagaaaatgagacttgaggcagcccatcatagacctccct

SEQ ID NO: 156359 - DNA, 601 bp, Human
gctgtgtctcccattttcataccatgcacaaatatgatatgcatgccttcgccatttttatccaagtgaatacaggccagaaaatgagacttgaggcagcccatcatagacctccctccaggttgacattaagcagcactatttatatggctggctggaaatccacctaattctactatcacactgttcaggggtcctattaaatgtctggctaaaacccagagatacactgtctactgtatttcctcatcagccaagcaagtaacctaatcaaaaaggaaatgtagttcgtaggccatgrtttagaaattcaaatcttgtttcattaatctcatctgcagtaaaaccatttatttcttacatcttccttcctcttccagtatgcctgcatttaatcagaaaaagtaattaacaaaaaagattatctttgtcccaaagcatattcctccttgttgcatctgtcatccaactttgtaagaaccagggtagcactcagtgtggttacatctgaagtacccactccaggaagataacatgtgttgaactggccaagtttggcacacagatcaacaaacatctactgagcctgattatgtattga

SEQ ID NO: 156360 - DNA, 601 bp, Human
aggccagaaaatgagacttgaggcagcccatcatagacctccctccaggttgacattaagcagcactatttatatggctggctggaaatccacctaattctactatcacactgttcaggggtcctattaaatgtctggctaaaacccagagatacactgtctactgtatttcctcatcagccaagcaagtaacctaatcaaaaaggaaatgtagttcgtaggccatggtttagaaattcaaatcttgtttcattaatctcatctgcagtaaaaccatttatttcttacatcttccttcctyttccagtatgcctgcatttaatcagaaaaagtaattaacaaaaaagattatctttgtcccaaagcatattcctccttgttgcatctgtcatccaactttgtaagaaccagggtagcactcagtgtggttacatctgaagtacccactccaggaagataacatgtgttgaactggccaagtttggcacacagatcaacaaacatctactgagcctgattatgtattgaggaaacaaagataactaagatacaaagatacagaagatatatttcctgctatcagaaatgtttagagtagtgg

SEQ ID NO: 156361 - DNA, 601 bp, Human
tattggagttgatggcatgattctccatcactaatttgctaggctaagaccatgaaatatatggccataatatggagtgagagagacaagtagtgtttttattaaaccacaatttctgttttggtcctgatttgcttttctatgtttacatccttgggaagtactaaacaatgtgttgaaaaatgtttcagccacatttgatcttagctgctcacacccaacttgccctgaaaagaatgggagcagtaagagaacagagtggctcactgtggagttaaacatgagcaaatggggaacgaayttggccaaaccactttaatgtcatggctttaataaaaaagtatttgtatctgcagagaatatgctgggtgacccactcatgtttcaatcagcgtgcactgatgccagaaaccagtaattttttgtagtaataggcaatccgtaacttcttgtctcctatggggaaaaacccaccaaggttttttcttttttacatgccagatcctgaaaggaggccacaacaagtgccctgttaatctgaatttctttaaggtatccatcaggcctttttttttttttttttgccaagtctagtggaata

SEQ ID NO: 156362 - DNA, 601 bp, Human
cccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcrctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaa

SEQ ID NO: 156363 - DNA, 601 bp, Human
gctgagatggaaggttagcttcagcccaggaagttgagaccagcctgtgcaacatagcaagaccctgtctccacaaaaaaaaaaaaatgttttttatagtcttagctacttgggaggctgaggcaggaggatcacttcagcccaagagatcaaggctgcagtgagccagaattgtatgtatcactgcatgccaagcctgggtgacagagcaagaccctgtctctcaaaaataaataaataagcaaatgaaatgccacttggcaagagcaggtatccctgatttttgatcattcatgtttttggtcatgattctcagatttatcaggttctcagcaatgacctgggcttttgatggaactggtctatggcagtactgcttcattttgttgcttcacatcaatcacaaggattggcattcatacattttatttgctttaggtaattattcagagatttttagatcacaattcacaaagtaatgtaaatggacccaaacatgtaaggcacaacataatttaaataacattgccctgatttattagggaaaatctgatagagtaatctttggagctctccaattaagtacactttaggatacatt

SEQ ID NO: 156364 - DNA, 601 bp, Human
gtaaaatctagctggtgttttaattggctttacagcaatgaaaccagctgcatattagaatcgcctggggtgcttttaaaagacagtagttccaggccccaacccaagcccacttaagtcagactctagagaatgaggcctgggtgtcagtattaagcatccgaggtgattctgattatatagtcaggctgaagaaccactgcctcaaaatgctagttctattaacatttcaaaagctttaaacttcctaactggaacaagttagttttcccagacctttgtgatttgactgggggttttrgttgcagtctgatatgtcctgattagctagagaaagcctagtctttctgaaccttcctttgcccaagtttggcatccagccttgtctagggaaagaagtatcacttttcagaatactgtgctaaggagagaatatggtgtttcatcagtttatgaatgagatggaggtgctgagggccttggaaatcatatggggttaagatcaaaactatttgctaggtagaatgttagggtataatatccagctgtggacaaaattgctatcaatgagaccctaaaatagagcactaagatcacttag

SEQ ID NO: 156365 - DNA, 601 bp, Human
aacagacactccaaacaattgggtcaggttttttttttttagacgaaatattcgctcttcttgcccaggctggagtccagtggtgtgatcctggctcaccacaacctctgcctcccaggttcaagcgattttcctgcctcagcctacagagtagctgagattacaggcacccaccagcacacccgactaattttgtatttttggtagagacggggtttcaccatgttggccaggctagtcttgaactcctgagctcaggtgctctccccacctgggtctcccaaagtgctgggattatagscgtgagccacgacacccggctctgggtcaggtttttaaacggcactgtcctcggtatctcaatgttaagatgactggtgatttcatgagttaaacgtgccaagcgcttagaagtgtgtcagcacattgtgacactcaacaaacttcattagtgtttccaccagtctgctgcctgaaccggccaagaggaccacctgcatccctgcgcacagtacagagagctcagagttgaggaaggtgtgggcccggtttgctatgggggcagtgaggggtgagaagaggccctggggaaactctggag

SEQ ID NO: 156366 - DNA, 601 bp, Human
aaggcatccttaactcatgtctgacgtatcaattagtgtaagagagaactaagttactctgaagttactaaaaaaagtaacatggcttgaaataaatataatcgtgcttatatttccatttaattcactttgagaggggatgtagagtctgcttttcaaagaaaaccacatgtaagattagtaacattcaaagctatcatgtagcagatttatgagaactctactgacacatggttttggctccactgggaaatggaggggaacagggccagcaaaatgtatttaacaaagagattttacmcatctcactgccacagactcacaaagactggcagaaatgagtaatagcgaggcttataattaggtcctcttttctgctgtggaatgctatgactgctgttagatgaaacagaaagaatctcgctaattctaactctgctaatctgcatttgcaataactcatcaaacaagcagtctcaccccatttctctgcaaatattttgtagtcaagagcagtggtaaggtctcaaatcattaaggctggattacttctacagaggactgcagacgacagcacatttgccaggacatgatgcagtgc

SEQ ID NO: 156367 - DNA, 601 bp, Human
acctacacttgtcccctcagcagcagccacacaatgaaaagctagtgttatacagcaaggggtgtctgggcctctgaattgctctttgttaagaagaccccacccaggagagaaataaacctggattagtttggccactgagaatttaggttgtttgttacaacaggaagtaccattctctatacctaatatagtactttatacaaaagtgaacattctctatagaaacaaaaaaaacttctgaagctgggaagggaaaagcagtcacaaaaccaagtaagaatgcacagggcactggccraaatgaaaaggacactcacaaagacgttagaagtcacagataaccaaaaatggctagggaaggctgggtgcggtggctcatgcctggagtcccaacactttgggaggccaaggtgggcaggtcgcttgagcccaggagtttgagacctgactggacaacatagtaaaaccttgtgtctacacaaaatacacaaattagctggttgtggtggtgcacacctgtagtcccagctactcagcacactgaggcgagaagatctcttgagcccaggaggccaaggttgcagtgagccaagatcac

SEQ ID NO: 156368 - DNA, 601 bp, Human
tattgtgatttggtacagcagccataggaaactgatgtgatgatgcataccacttgtgggccacaccatacggaccccagcacggcgacctacacttgtcccctcagcagcagccacacaatgaaaagctagtgttatacagcaaggggtgtctgggcctctgaattgctctttgttaagaagaccccacccaggagagaaataaacctggattagtttggccactgagaatttaggttgtttgttacaacaggaagtaccattctctatacctaatatagtactttatacaaaagtgaayattctctatagaaacaaaaaaaacttctgaagctgggaagggaaaagcagtcacaaaaccaagtaagaatgcacagggcactggccaaaatgaaaaggacactcacaaagacgttagaagtcacagataaccaaaaatggctagggaaggctgggtgcggtggctcatgcctggagtcccaacactttgggaggccaaggtgggcaggtcgcttgagcccaggagtttgagacctgactggacaacatagtaaaaccttgtgtctacacaaaatacacaaattagctggttgtggtggtg

SEQ ID NO: 156369 - DNA, 601 bp, Human
acttctgctcctcatcaccactctgtggcaggcaccgctctaaccacttggagtccacgcatctttcactgcacagcagccccacggagtagatcctgaggcagggagaaggggaagccagcggccccaaatcgcacagctggcaagcggcaaactgggttccacccttaatcgtaggtaagcctttccttgatcagattccttccaggaagcagagcaccatggcttctgagagtaactcaaaggaacggcctacagacagggccaggttattacactacctagataagggaaggtgagyttgaaatgaaaagctctccacagagcagctgcctgcccaagtgggaaggggagtggaggaagctttacctacggtcacatctgggaggtaagcaaacaccaaggaggcaaatgactatgtgggaccctgggccaagcatccgtcctcaggtgtcaggatgcctggctgtaagatgcagtcactggtggcttgctatctgctagtgccaaatagcaaactagaaaatgctactgcgggaagaagaaaggggaaatactggaagagttccatgaaccagggagcaatttccagcagggagct

SEQ ID NO: 156370 - DNA, 601 bp, Human
gccacccagtctgtggtattttgttaaggcaggccaaaccaacaatacagatgcccatttaaaaatgatctctgaatctttccaacttggcacacataaaacttttaaactgtaactcacagatgtgttcataaagtaaaaataaaaagagctgtgcaactaactataaagaaaactaatgatgaatgttaaggtgacatttgaaatgatcaagtcttctgaagctcctgcagggcagcctgtccgctcctctgctgaaataagcacacagtgtcaaggctcagtcacccagcattagcayttgcatttaatttagtttctaaaaacaattaacttcattaatccctctcagttatgtttggtgattaatgtagcaataaaaagtggcaataataacaataataactcaaagctgagacagattcattttaacttacaatactgccaaaaaatatgacagcacatatttattgtgattgttgtatcactgtctctagaactcttcatttgtaaaactacaaaagaagaattacttttgcagaaatctttgcagaattatttgcaaatcagtatttttaggagaaacagaaaaaccttagat

SEQ ID NO: 156371 - DNA, 601 bp, Human
tttcgggctcaaggaagagcttagaagaactgtcccactaaatattttttaaaaattcatttccctccctgctctatcccacctctttcccatgctcatcagaaattgatgaaagatgctattacgggctgaatagtgtccccccaaaattcataggttgaagtcctaactgacatacccttaaattgtaattgtatttggagagagggtcttaaaagacaattaagttaaaatgaggaattgaggtagggctctaatataatagaaatggtgtctctataagagaaagagacaccgggtygtgcacacacaaagaaatggcctgcaaggaaacagcaagaaagtgccatctgcaagcccaggagagaggtctcaggagaaagcagagctgccaacaccttgatcttggacttcagcctcccaagctgggagaaataaatgtctatggtttaagccacccagtctgtggtattttgttaaggcaggccaaaccaacaatacagatgcccatttaaaaatgatctctgaatctttccaacttggcacacataaaacttttaaactgtaactcacagatgtgttcataaagtaaaaataaaaa

SEQ ID NO: 156372 - DNA, 601 bp, Human
actattgtgtgtctttttaattatagccatcctagtgggtgtgaagtggtctcttattgtggtttgatgtgcaattcctttatggctaatatgttaatactgtgttgtaaggggtcgggtaatctagcatctattaagagtgggaaatgccaggttgaacaaaattaaataggtttccccaagagagaccttcttggcccttagtgtgctacctgcatgaggaagacttacaggaggcatacagcttgccagctctccccagcctatctgaccacacaactttttttttttttttttttttggctataataccagttatcctccatcagggctacagtgttccatgaacagaatttggaaatgctggctggccctaaatccaaaaagccagcctcgcatggtagccaccagcatgtgtttggggtcggcacgttcctccacgccctcagctatgtggtctcagactagtgtctcagattctcaaagattccctgcttcatctgcagaaaggagataaacctcctcagactattaagaagagagaggcgttcgggagagtggggtgctggctagaaagcagggtcattttccttgtagtcat

SEQ ID NO: 156373 - DNA, 601 bp, Human
gggtaaattcaaaatgatacagcactcaacataatctcttactacagatccactcagaaactttccaaggctcttgtttttctatctggtcacctttcaagtattttgtcagagcagcagtgtaacgagggcacaaactacacaaagagagtggctgctgctttcagttctccacagtctcaacacaagagctcacctcaaccctcccctgtgaaatttactttctcaaatatcgaagatgtttttgatggggtgatatggtgatgggtgacatgggacagctactgtgccttcacagagyccaggcaagtggcaacaaaacttctactgcagctttgcccaaactgtgctgtgaaaccctaccgctggcagatgttaacttagttttaaaaaacagctttatagatatgtaattcatgtagaatacaattcattcatttaaactgtataattcgatggttttgagtgcattcagaattgtacaaccattgccataatcaattttaggagattttcatcaccccaaacagaaaccccacagccatgaacagttaccctccattccacccctcccagctcctggaagccagtcacctggact

SEQ ID NO: 156374 - DNA, 601 bp, Human
atacacagaacagggccccacatagcccaggagttatcagaatcatagaacagagaacaaatgttaatgtttaaccgaatagggtttttggaaaacatgctcaagagtcgctagcatcatcccacctggggctttcccattcctggtcatccttgtctttctcttctttggtgtctcctgtatgtgggtgtttctgcacaattcgcattccaccagctttcactgaaatgaaaacagagagtgtgggattaatgtggaaatggggctgcctgtggatcagggggaccagctggaaaggttytggttgctcagtggccacaagtcagtctggagaatctggcaatgaaaatgattaactagggaaggtcagggttgtcggggtaaattcaaaatgatacagcactcaacataatctcttactacagatccactcagaaactttccaaggctcttgtttttctatctggtcacctttcaagtattttgtcagagcagcagtgtaacgagggcacaaactacacaaagagagtggctgctgctttcagttctccacagtctcaacacaagagctcacctcaaccctcccctgtgaaatttactt

SEQ ID NO: 156375 - DNA, 601 bp, Human
ggcttggcttgccctggcttccaggaagggaggcacactggctaaacccaggcacctgggcaggtggaggtaggtctctaactgtgcagacagacggggcaccagccctgggtgtggggtggggaacagggtgggcgcgtggcaactgctcaggaaagaggacctctaggggctctattttctcccctgactgaaaacaaagccccctcctccctgattaggaagggaaaaatacacagaacagggccccacatagcccaggagttatcagaatcatagaacagagaacaaatgttaatgyttaaccgaatagggtttttggaaaacatgctcaagagtcgctagcatcatcccacctggggctttcccattcctggtcatccttgtctttctcttctttggtgtctcctgtatgtgggtgtttctgcacaattcgcattccaccagctttcactgaaatgaaaacagagagtgtgggattaatgtggaaatggggctgcctgtggatcagggggaccagctggaaaggttttggttgctcagtggccacaagtcagtctggagaatctggcaatgaaaatgattaactagggaaggtcag

SEQ ID NO: 156376 - DNA, 601 bp, Human
aaagtcgagagaaatggattcctttcaaggtccctgaacccaactggaaatctgaacctttaaggaaaataggtgttgagcaggggaggaggggtctgcaaggagacccctgtgcaggccccaggagggttggcagcagaggtatcatataaggacacccagtcactcataagggcatggccttgtaattctagatctggctgatgatccgagggaggaaatgcttcaaccattctgaaatcagaagttcttgccccagctacacagacagccaggtccacccctgaggttcaactagtgyggcaattctcaagggtctccatgtgatttcagtatggaagcctaagttgcaaactactgcccagaaattgttagtatttgtttctctggaatgacaacagaaacctggagtacaaaagactcacaggtgcaagaatttgcctacttcgtccactctggtggtccagccttgggaagagggtggctggcagctgtgtccaccatcagaaaaccaatgagccacaggaagctgctcctgcttggcttggcttgccctggcttccaggaagggaggcacactggctaaacccaggcacctggg

SEQ ID NO: 156377 - DNA, 601 bp, Human
gccaccacacctgactgatttttgtgtttttagtagagacggggtttccccatgttggccaggctggtctcgcacccctgacctcaagtgatccacccacctcggcctcccaaagtgctgggattactggcgtgagacaccgtgcccggacaattctagcattttctttaaactgccttcttttaaaccagaactgggactgaatctttacactgctaatctcatgatttaaaatggacaataatcactaataatcactcagaaatgtcacccaaaatgctgttcttccctcacgtggccrctccgtaactcatactgtatcaggttttatagacaatactcaatggggaaggccacttagaagcagacaggcagggttaccaagaacatgcaccacttcctcatgtgggtgcctactcttggcaactatccatttggaagcctagcccgctgagcactccatgagaactgggttgaacttcctgctacgttacctagcacggtgcatgatatgggcaagctgatatcctctttggggttctgtttccttgtacataaactggggagaataccacctactattcaggactgctggaatgaa

SEQ ID NO: 156378 - DNA, 601 bp, Human
aagtattagctaataataatgaagactattactcttcctggacatgaagaaccaccagtaactagaactcaggttgacggaaattctttggcagcattttcacattttggctatattttttttaacacagcatctcaaaacaacttggtagcataagaaattacgtttaagtctgtggaaagctacaagattaaagggaataagagttgcataaacaattgcaagaaaaataactagtaaaagttgcagggctttttttttcctgtcaacacagtaacatctttaatcttccacttgtccsttttctctgtaatcagtacttgattttccaattaatggggaaggaagccaccagagatgagtcagtaaatttaaaactagtcttgaatgtctggcaaggaaaagaaagttttgcaaatgtacatctatagctaagaaggaaactggcatttggtgttaggtactcattttcatatctgaacaacactgggatcaaaattaaagaatataaaactttaggatcagggtaatgtggataggaaagtcacatgctataagacatttccaagaggataattaagtgttttatacattctgcaag

SEQ ID NO: 156379 - DNA, 601 bp, Human
ccgttcttttctggtttacccctcctgttatccattcctttttaatatcttgtaccaagcccagatcatggcagaatgtcagcaaatgtttgacattaaactgttttctctagtgaaccctgactcctaaagtccattctatgtctgcagtctctcctttacataatgaaactggctactttatcttatgacactcgacaaaaggcttggaaaccaccagtttccttaattgggtcggctcgagatggaatcaagcagccacgcaggaaagtattagctaataataatgaagactattacycttcctggacatgaagaaccaccagtaactagaactcaggttgacggaaattctttggcagcattttcacattttggctatattttttttaacacagcatctcaaaacaacttggtagcataagaaattacgtttaagtctgtggaaagctacaagattaaagggaataagagttgcataaacaattgcaagaaaaataactagtaaaagttgcagggctttttttttcctgtcaacacagtaacatctttaatcttccacttgtcccttttctctgtaatcagtacttgattttccaat

SEQ ID NO: 156380 - DNA, 601 bp, Human
accaagttcatttcaatcttctccctttcctatttgtaacctctttctctgacagtgaggaactcggctctttgtttgttgaatcctagtattcacataaggcaatttcagaattgctaaaccatgccccttaagaagcctgtttactaactgaagtacaccatttatgcatagttttttattgtctttagccttatagtatccacttaaaaatgttgttttccaaagttaattaggtaactccctactcccttaaatatggttatatcaagcaattgcatttcccactcccttcaatccrtcagtgcttgtatgccattctgggtccctcccacctcttggttgatgtgaattgttggcttacttgtcaggtgtgtgaaacagtgccatggttctaggtcagaaccatgcaaaaagtcaagctcagggaagaattgttccttattccccatttctgtttcttccttctttccaccccttttccatccaccacttgtcagtgaccaaacccgttcttttctggtttacccctcctgttatccattcctttttaatatcttgtaccaagcccagatcatggcagaatgtcagcaaatgtttg

SEQ ID NO: 156381 - DNA, 601 bp, Human
ccagcctagccaacatggtgaaaccccgtctctactaaaaaaattagccagacgtggtggcaggtgcctgtaatcccagctactcgggaggctggggcaggagaatcacttgaaaccggaagacagaggttgcagtgagctgagatcataccactgcactccagcatgggcaacaagagtgaaactccatctcaaaaacaaaaacaaaaaaatctaatactatcactttgttgcaaattattccagctaaggccataaggagattcttcaggtgggcttctataacattctgccctgcccyaaacctttctggagaacttccttatgttctggcactacagtatattccaggctcatctagtatttttcctgtcctggcctggaatcaactacttctccaaggaaccgtggttcctctgactggggaatggtgtttagacaccacagtctgggccctagggatgcttatggctgcatgggcgtcagttctttaggccctctcagtgaacaaagctaggaaatacaggtatgacactaaccctctcatccatattcatttctgtatatctgtataggtatgtttgtatctaccatccatcca

SEQ ID NO: 156382 - DNA, 601 bp, Human
aagtaactggagttcttctacaaaaaagagctatccgttctcctggcttgttaattcaattatttatgtcagtatggactcatggatatttattttaccgtatgggttaaaatctaacactatcggccgggtgcggtggctcatgcctgtaatcccagcactttggcaggctaagacgggccaatcacaaggtcaggagttcaagaccagcctagccaacatggtgaaaccccgtctctactaaaaaaattagccagacgtggtggcaggtgcctgtaatcccagctactcgggaggctgrggcaggagaatcacttgaaaccggaagacagaggttgcagtgagctgagatcataccactgcactccagcatgggcaacaagagtgaaactccatctcaaaaacaaaaacaaaaaaatctaatactatcactttgttgcaaattattccagctaaggccataaggagattcttcaggtgggcttctataacattctgccctgccccaaacctttctggagaacttccttatgttctggcactacagtatattccaggctcatctagtatttttcctgtcctggcctggaatcaactactt

SEQ ID NO: 156383 - DNA, 601 bp, Human
tatcgtgtttttcctcaaacttttacccattaattctgacatccatcagtggatcttgtctataacaattactgtgctgtttgcctcctggtgatattctagttacctcctttcttatacattaagtaactggagttcttctacaaaaaagagctatccgttctcctggcttgttaattcaattatttatgtcagtatggactcatggatatttattttaccgtatgggttaaaatctaacactatcggccgggtgcggtggctcatgcctgtaatcccagcactttggcaggctaagacrggccaatcacaaggtcaggagttcaagaccagcctagccaacatggtgaaaccccgtctctactaaaaaaattagccagacgtggtggcaggtgcctgtaatcccagctactcgggaggctggggcaggagaatcacttgaaaccggaagacagaggttgcagtgagctgagatcataccactgcactccagcatgggcaacaagagtgaaactccatctcaaaaacaaaaacaaaaaaatctaatactatcactttgttgcaaattattccagctaaggccataaggagattcttcagg

SEQ ID NO: 156384 - DNA, 601 bp, Human
tatctttctttaaacatctttaaaaggctactattaaaaacaataacaatgtaagtggaagttgtagccagtggtgtgttggagctgacttacactggcatgtagagctgactgttcacatgtcttcacaagtctatgtttagtgatgtcatgttgttagtttaaaattggctgtagctgggtgtggtggttcacgcctgtaatcccagcactatgggaggctgaggtaggaggattgcttgagctcaagagtttgagaccagcctgggcaatgtggtgagacctggtctctacaaaaaaatttaaaaatttgctgagcgtggtggtgtacacctctagtcctagctacttgcgaggcagaggtgggaggactgcttgagcccaggaggctgaggctgcagtaagccaggattatgctactgcaatccagcctgggtggcagagtgagaccctgtctcaaaaaaaagcaggtgcggtggggggctgtggtaggagtattcacaccataaaattagcaaatgctacaaatcgggcttttaaaattttttcttggagggccaggagataagtaatcaccagcacattattttttatagtattg

SEQ ID NO: 156385 - DNA, 601 bp, Human
gtctcaaaaaaagaagagaaaaatgaagcaaggatatttttgaaaagacaatggccaacaatttttccaagctgatgacaccaaaccatagataaaaaatgctcagtgaatcccaagtaagatacatacaaagacaaccaaacttggtgcatcacaaacacactgttgaaaaacagaaataaagagaaaatcttgaaagtaaccataggtaaacagaaacattacatacagagaaaaatgacaagaattatggctgacttctcgctgtacacaatggaagccagaaaaaaatggaatgccrtgtttaacacattgaaagaaaaaatttttaactaggaattcaatatatagtgaaaacatctttcaaaagtaaaagcaaaacaaagacattttcagaaagacaaaacctggaagaattcatctccagcagacatttactatcacaaatattttcagaaagagaataaaacagacagaaacccagtgggaagaaataaaggacaccagacagaatgaacattagatgtgcataatgaatctttaaaagatatttcatatctatctttctttaaacatctttaaaaggctactattaaaaaca

SEQ ID NO: 156386 - DNA, 601 bp, Human
aggttcaaaagaaaccatctacactgaaataggagaggaaaaaagagtcggcggcagagaggagaaaaacagagcatccgaggcctgtgaacatatcaaatgttcactatgggtacaactagagtctcaaaaaaagaagagaaaaatgaagcaaggatatttttgaaaagacaatggccaacaatttttccaagctgatgacaccaaaccatagataaaaaatgctcagtgaatcccaagtaagatacatacaaagacaaccaaacttggtgcatcacaaacacactgttgaaaaacagawataaagagaaaatcttgaaagtaaccataggtaaacagaaacattacatacagagaaaaatgacaagaattatggctgacttctcgctgtacacaatggaagccagaaaaaaatggaatgccgtgtttaacacattgaaagaaaaaatttttaactaggaattcaatatatagtgaaaacatctttcaaaagtaaaagcaaaacaaagacattttcagaaagacaaaacctggaagaattcatctccagcagacatttactatcacaaatattttcagaaagagaataaaacagacagaa

SEQ ID NO: 156387 - DNA, 601 bp, Human
gaccaagcctggatgttggactcatcagatgaagatttaaaataactgtgataaatatctgtgaaaagacaggaaatttcagcagagaaatggaagctatacatttttaaaagccaaatggaagtggaaatgaaaaacaggatatcaaagatgaattctttcactggacttattgccacactgggcacaagagaaaggagtcaggttcaaaagaaaccatctacactgaaataggagaggaaaaaagagtcggcggcagagaggagaaaaacagagcatccgaggcctgtgaacatatcaratgttcactatgggtacaactagagtctcaaaaaaagaagagaaaaatgaagcaaggatatttttgaaaagacaatggccaacaatttttccaagctgatgacaccaaaccatagataaaaaatgctcagtgaatcccaagtaagatacatacaaagacaaccaaacttggtgcatcacaaacacactgttgaaaaacagaaataaagagaaaatcttgaaagtaaccataggtaaacagaaacattacatacagagaaaaatgacaagaattatggctgacttctcgctgtacacaatg

SEQ ID NO: 156388 - DNA, 601 bp, Human
ctgggaaacaaatacagtatatctgcagtagttactgtttcaggcaagcatcatcagtgaatgctgaaagtagcaggcaaaagtttgatgagaaacacaatactcatagagttgcaaagtattcccccatgagatatgtatgaattacaaagggtaaaatagtaaattgatagtggagaaacttggcagatgccatcttaactgaacaatcaaagctggcatcaccggccatgagatggggagtgtcgtgtacctcctgatccaatgcatcaagaaggacaagacctcgcttctgtgcagyccctgccctgaaagcaggacctgaatccaatcatgaaggcacatcagaaaaattgaactgaggaaaatcctacaaaataaatgacctatactcttcaaacatgtcaaggtcatgaaagattttaaaaagctggataactgttctagattaaaggcgactaaagatatatcactaaatgaaggtataatcctggactgaaatttgtggcagtagtgggaaaatgggccaagtctgaagagtctgtagattagataacactactgtttcaatgttagtttcctgattttgataattatacag

SEQ ID NO: 156389 - DNA, 601 bp, Human
ttctggcctccagaactgagatgacaaatgtgttatttaaagccacccaggttgtggcattttgttaaggcagccctgggaaacaaatacagtatatctgcagtagttactgtttcaggcaagcatcatcagtgaatgctgaaagtagcaggcaaaagtttgatgagaaacacaatactcatagagttgcaaagtattcccccatgagatatgtatgaattacaaagggtaaaatagtaaattgatagtggagaaacttggcagatgccatcttaactgaacaatcaaagctggcatcacyggccatgagatggggagtgtcgtgtacctcctgatccaatgcatcaagaaggacaagacctcgcttctgtgcagcccctgccctgaaagcaggacctgaatccaatcatgaaggcacatcagaaaaattgaactgaggaaaatcctacaaaataaatgacctatactcttcaaacatgtcaaggtcatgaaagattttaaaaagctggataactgttctagattaaaggcgactaaagatatatcactaaatgaaggtataatcctggactgaaatttgtggcagtagtgggaaaatggg

SEQ ID NO: 156390 - DNA, 601 bp, Human
aaaccaccagaagctaggggagcagcatggaacacatgcttcccacagctctcagaagcaaccaacctgccaacaccttgctttcagcattctggcctccagaactgagatgacaaatgtgttatttaaagccacccaggttgtggcattttgttaaggcagccctgggaaacaaatacagtatatctgcagtagttactgtttcaggcaagcatcatcagtgaatgctgaaagtagcaggcaaaagtttgatgagaaacacaatactcatagagttgcaaagtattcccccatgagataygtatgaattacaaagggtaaaatagtaaattgatagtggagaaacttggcagatgccatcttaactgaacaatcaaagctggcatcaccggccatgagatggggagtgtcgtgtacctcctgatccaatgcatcaagaaggacaagacctcgcttctgtgcagcccctgccctgaaagcaggacctgaatccaatcatgaaggcacatcagaaaaattgaactgaggaaaatcctacaaaataaatgacctatactcttcaaacatgtcaaggtcatgaaagattttaaaaagctggata

SEQ ID NO: 156391 - DNA, 601 bp, Human
aaaactggagctgagagctggccggtgctcagcatccctggtctactgaaatctccacacacatggtagagaacagggacacgcccctcttaaaaggcagctggcaactagcctggatataaaaggtgacattagaacttaagggtaatgttgaaattggttcaccaaacggcttaaagttcaaacatgcagatcatggctaaagataaaaattcccaggcatacaggcctgagatttaagctggcacattgctgggccatcttttaactgaagttttaaattttctatttattatcttarcaatgaacttgactgagagaaccattaaaaattgctatagatcaccatttggcatctgctacgggttgacttgtgtcctccaaaaaaggcatgctgaaatcctaactcccagtacttcagaatgtgagcttatttggaagtgggatctttattaatccagttaaaatgaagtcatcaggatgggtcctaatccaatatgaccagtgtccttatgaaaaggggaaatttggacacaaagacacacaaagaggaaagatgatgtagagacacagggagaaaccatgtaaaggcacaggactg

SEQ ID NO: 156392 - DNA, 601 bp, Human
agcctgggcgacagagcaagactctgtctcaaaaaaaaaaaaaaaacaaaaacaaaacaacaacaacaacaaaaaaaactggagctgagagctggccggtgctcagcatccctggtctactgaaatctccacacacatggtagagaacagggacacgcccctcttaaaaggcagctggcaactagcctggatataaaaggtgacattagaacttaagggtaatgttgaaattggttcaccaaacggcttaaagttcaaacatgcagatcatggctaaagataaaaattcccaggcatacakgcctgagatttaagctggcacattgctgggccatcttttaactgaagttttaaattttctatttattatcttagcaatgaacttgactgagagaaccattaaaaattgctatagatcaccatttggcatctgctacgggttgacttgtgtcctccaaaaaaggcatgctgaaatcctaactcccagtacttcagaatgtgagcttatttggaagtgggatctttattaatccagttaaaatgaagtcatcaggatgggtcctaatccaatatgaccagtgtccttatgaaaaggggaaat

SEQ ID NO: 156393 - DNA, 601 bp, Human
ctgagccaggtacggtggctcacgcctgtaatcccaacactttgggaggctgaggcaggcgatcacctgaggtcaggagtttgagagcagcctggccaacatagtgatatcctgtctctactaaaaatacaataattagctgggcatggtggcatgtagcctgtaatcccagctactcgggaggctgaggcaggagaatcacttgaacctgggaggtagagcttgcagtgagctgagatcatgccactgcactccagcctgggcgacagagcaagactctgtctcaaaaaaaaaaaaaaaacaaaaacaaaacaacaacaacaacaaaaaaaactggagctgagagctggccggtgctcagcatccctggtctactgaaatctccacacacatggtagagaacagggacacgcccctcttaaaaggcagctggcaactagcctggatataaaaggtgacattagaacttaagggtaatgttgaaattggttcaccaaacggcttaaagttcaaacatgcagatcatggctaaagataaaaattcccaggcatacaggcctgagatttaagctggcacattgctgggccatcttttaactga

SEQ ID NO: 156394 - DNA, 601 bp, Human
tggagctgagccaggtacggtggctcacgcctgtaatcccaacactttgggaggctgaggcaggcgatcacctgaggtcaggagtttgagagcagcctggccaacatagtgatatcctgtctctactaaaaatacaataattagctgggcatggtggcatgtagcctgtaatcccagctactcgggaggctgaggcaggagaatcacttgaacctgggaggtagagcttgcagtgagctgagatcatgccactgcactccagcctgggcgacagagcaagactctgtctcaaaaaaaaaamaaaaacaaaaacaaaacaacaacaacaacaaaaaaaactggagctgagagctggccggtgctcagcatccctggtctactgaaatctccacacacatggtagagaacagggacacgcccctcttaaaaggcagctggcaactagcctggatataaaaggtgacattagaacttaagggtaatgttgaaattggttcaccaaacggcttaaagttcaaacatgcagatcatggctaaagataaaaattcccaggcatacaggcctgagatttaagctggcacattgctgggccatctttta

SEQ ID NO: 156395 - DNA, 601 bp, Human
gctgctgctggcaagtggtgggccctgtctgccagcacagggcactcacaatattggagctgagccaggtacggtggctcacgcctgtaatcccaacactttgggaggctgaggcaggcgatcacctgaggtcaggagtttgagagcagcctggccaacatagtgatatcctgtctctactaaaaatacaataattagctgggcatggtggcatgtagcctgtaatcccagctactcgggaggctgaggcaggagaatcacttgaacctgggaggtagagcttgcagtgagctgagatcaygccactgcactccagcctgggcgacagagcaagactctgtctcaaaaaaaaaaaaaaaacaaaaacaaaacaacaacaacaacaaaaaaaactggagctgagagctggccggtgctcagcatccctggtctactgaaatctccacacacatggtagagaacagggacacgcccctcttaaaaggcagctggcaactagcctggatataaaaggtgacattagaacttaagggtaatgttgaaattggttcaccaaacggcttaaagttcaaacatgcagatcatggctaaagataaaaat

SEQ ID NO: 156396 - DNA, 601 bp, Human
gcagagggagtgtggtcctgccaacaccttgatctcaagcttctggcctccacaactgtgagacgaaacatttctgtttttaaaccacccagtttgtgcaactgtgttatgggagcactaggaaaactaatgtgctgcttcttggtggagaggcagccagcctgcctggaagttctgcccactctaacctgggtggagatgagaatggctttgtcctaatggcagatctcgaagctgccattaggacagcctgcagcctctggagaggctgccagacgccaaccctccctgggcagcctcrcttgcacagatgtcatcctgcatggggcttcacacgcagcggatgctgccagcagactcggctgccgtcagggggtttgagggcttgtgcttgttctgtcaactttctgccgcccaagttgccacaggcaaaacgcttccttttaccactcccttgctggcacataaacggtgacacttcagcaatgccccattttgcctacaaacttggtctctgagtctcagtctgacaaacctgacaggaagaactgcccaacagcaacgggaatcttcctgattctccttcccagggcagatgggc

SEQ ID NO: 156397 - DNA, 601 bp, Human
agctcccagggaagccgtggggccgccacccaaaggcctccatgcccttcatctgctttcagtgtcttgcaacatacccatgactccatctggttaacggggtaatgagttcaattctctagtatcatcctcaatatatcccaagtgcctcaaactgtgctcagatgatgaatttagagtgaatttaagctaacttttacaaaatggacaagtagcttaaaaaaaattcctgaaaaaataacctctggaggccgaagttaatctcaatacaagcacaagtgaacataagcaaagggaagcrctcctgcctgtcgtcattggtctccatgttacaaataccaacaacctagtcacatgtgacaagaagcagctctccccaacaaaacctgaaattgcctggaagcccattagaaatttagatttacatcctgaatcattaacgagaaatcccatctcaagggtatctggaccttgagatgagctaatgatagtaccaagtcactagaaatagcaagacatttaaaatactgctgatttcatctttatcaaatatcttaccattcattttgtatatgtttcataacttatatagtggtaatgc

SEQ ID NO: 156398 - DNA, 601 bp, Human
aatgaattaagctttgccactatttactatgtggcccccaggcagactgtccctcaccggcctcctggtcctgagagctcccagggaagccgtggggccgccacccaaaggcctccatgcccttcatctgctttcagtgtcttgcaacatacccatgactccatctggttaacggggtaatgagttcaattctctagtatcatcctcaatatatcccaagtgcctcaaactgtgctcagatgatgaatttagagtgaatttaagctaacttttacaaaatggacaagtagcttaaaaaaaattcctgaaaaaataacctctggaggccgaagttaatctcaatacaagcacaagtgaacataagcaaagggaagcgctcctgcctgtcgtcattggtctccatgttacaaataccaacaacctagtcacatgtgacaagaagcagctctccccaacaaaacctgaaattgcctggaagcccattagaaatttagatttacatcctgaatcattaacgagaaatcccatctcaagggtatctggaccttgagatgagctaatgatagtaccaagtcactagaaatagcaagacatttaaaat

SEQ ID NO: 156399 - DNA, 601 bp, Human
tttaaccaccttaaattatacaatttagtggcttttaatacattcactatgttatgcaacccaccaccaccatctaattccagaactttcatcatcctcaaaagcaatcgatacccattaagctgtcactcaccattcccctttttctcctcagcccctggcaatcagtcatctgctgcctgtgtctatgcatttgcttattctggatatttcatataaatggccttgttgaatatgtggcctggtgtctggtttcttttatgtagcacaatgtttttaaagttcctccatgactgtatcrttaatcagcacttcattctttgtatgacttaccatgttttgtttctccactcattggctgatgagcatttgggctgtttcaattttttggctattgtgaataatgatgggatgaacattcatgtacaagtttctgcttgagcacttgttttcagttctcttgagtgtatacctaggaagggaattgccaggtcacatggaaatgctgtttagctttttgagggtccatcaaactgcttaccacagcagcaagggccttgttttttgttttaaaaatatttttattatggttaaaacactt

SEQ ID NO: 156400 - DNA, 601 bp, Human
tggttcccaattttcatgcctaaggacttccttcttattgaggtaacattcatagaacataaaatccattttaaccaccttaaattatacaatttagtggcttttaatacattcactatgttatgcaacccaccaccaccatctaattccagaactttcatcatcctcaaaagcaatcgatacccattaagctgtcactcaccattcccctttttctcctcagcccctggcaatcagtcatctgctgcctgtgtctatgcatttgcttattctggatatttcatataaatggccttgttgmatatgtggcctggtgtctggtttcttttatgtagcacaatgtttttaaagttcctccatgactgtatcgttaatcagcacttcattctttgtatgacttaccatgttttgtttctccactcattggctgatgagcatttgggctgtttcaattttttggctattgtgaataatgatgggatgaacattcatgtacaagtttctgcttgagcacttgttttcagttctcttgagtgtatacctaggaagggaattgccaggtcacatggaaatgctgtttagctttttgagggtccatcaa

SEQ ID NO: 156401 - DNA, 601 bp, Human
gctctaggaggagggcagagaggtggccctggaaaagccccaggcacccacctctcctgtggtcaaccccatcctgagacttcttcaaggagtcaatgtgtccttgctgcctgggcctgcagcctggctgcatgagatgcctctctccccaaccctgaagagtcctgatgtccctgaggagttcagccatggacctccagaaagtcctgtcaccacagtgagcttccgctttctcagtgatgacaatgtgcaggctgaacctagccatggttcccaattttcatgcctaaggacttccttyttattgaggtaacattcatagaacataaaatccattttaaccaccttaaattatacaatttagtggcttttaatacattcactatgttatgcaacccaccaccaccatctaattccagaactttcatcatcctcaaaagcaatcgatacccattaagctgtcactcaccattcccctttttctcctcagcccctggcaatcagtcatctgctgcctgtgtctatgcatttgcttattctggatatttcatataaatggccttgttgaatatgtggcctggtgtctggtttcttttatgta

SEQ ID NO: 156402 - DNA, 601 bp, Human
cggccacactgcctgtggtgctggtctttgtgcctgacttcccaacctccatgccactgtaaaccacatatctaaggcaatcttagcaatgtctgacttagggataggcaggtcacctgattctggccaatgagtttgctagggggcttctggcgaagctttacttgctcctaaaaagagatgaaagagaagatgcctgtttcttcctctcaatgccacttgtctgggtgtgaagcatggatctactatggccaaccctctgccagcctgtggaggcagctgctctaggaggagggcagasaggtggccctggaaaagccccaggcacccacctctcctgtggtcaaccccatcctgagacttcttcaaggagtcaatgtgtccttgctgcctgggcctgcagcctggctgcatgagatgcctctctccccaaccctgaagagtcctgatgtccctgaggagttcagccatggacctccagaaagtcctgtcaccacagtgagcttccgctttctcagtgatgacaatgtgcaggctgaacctagccatggttcccaattttcatgcctaaggacttccttcttattgaggtaacattcat

SEQ ID NO: 156403 - DNA, 601 bp, Human
ctggtggggggaatctttctctactgagagccctggtagggggaatccttctctattgagagccctggtggggggaatccttctctattgagagccctggtgggggggaaatctttctctactgagagccctggtggggggaatctttctctactgagagccctagtgagggggaatctttctctactgagagccctagtgagggggaatctttctgtactgagagccatggtggggggaatctttctctattgagagccctggtgggggggaatctttctgtactgagagccctggtggrgggaatctttctctattgagagccctagtgggggggaatctttctggactgagagccctggtggggggaatctttctctactgagagccctagtgagggggaatctttctctactgagagccctagtgagggggaatctttctgtactgagagccctggtggggggaatctttctctattgagagccctagtgggggggaatctttctgtactgagagccctggtggggggaatctttctctattgagagccctggtggggagaatctttctctactgagagccctgcgggtggaggaaa

SEQ ID NO: 156404 - DNA, 601 bp, Human
tggcacacagcaggcaacagtacctggccactgccccgggggagcttgtagtctgagaaccacccacaatggaaccacagtgtcatgagaggggaagtcccaggtgcctgtgggaacgcacaggggtcagcacaccctgatgaaggcagggctgtcaggaaagggttcctggggctggcttccaagctgagacttgacgtttggattggctggttctgagtgccaggcaggaagccctgacagtcggccgtgagagggtggtggggatggggcctgctgccttgctcctgatgctcaaggrcccgacttcattctgagggtttagatgggggggactggggagagggagaaatacatgttgattccctggttctggcttggacaactcaatatccaagttatgagagcctagtaacaagatggaaaggggagcagagtttgagggacgaaaatggtgtgctgtatgtaggcaatctgctatgtttctgggagtataaattgagatatccaatctatgcagtcatcccttggcatccatgggagagtggttccagcacccctgtggataccacaatcccacagatgctcacatccctgatat

SEQ ID NO: 156405 - DNA, 601 bp, Human
ctgaccacaaaagagagtcccaccacttaccttgtaggatgtgaagactaataagactaagtatgtaaagcacctggtctaaaggtagctgtatttgctgttatttggctattagacttcctgaatactgctgaattgcttaagtcatactggggacaatcttctaaacttctcattccccaaggaccgattaagttgagacataatcataaagtcaacaggacacatgacagatgctttcaaaatagattcaagtcccatggaaaaaaatgttcaattctgcctgttggacagttgtcayttatactctcttccgcctcccctctggagtccttataaatatggtggccaattaggaagttatcattactcacccacagtgaaagaataaactgttcatgaaccattttctccctttaacacagtgttcatacatttctgaaatgtgtaggcttcacttgcattgcagagactgggatggtgtgtgtgtctcagataagtgctgctcacagcgtggtggggaacaagcagcaccactaactctgggagctcatgagaaatagtctcaggcccaccccagccctgctgaggcagaatctgc

SEQ ID NO: 156406 - DNA, 601 bp, Human
aaatgtcaatgccaaagaaatatagacagatatgccttatgtattttgccatgtctcctccctcttgccatcacagtctcctctaaaagagtaagcaactaaaaaagaaaagctaaatgttcagtccctgtaaaacaccatttacaataacaaactcacactgatagaaaagggaagatactgtattaatagcacatcaggtcaaaaaattagaacataagaatgataaaaaccatggcaattaattcaacgccctatatatagtctatcctgtaaatataatttgatttgcacagagctsctcagctggctattagtacagcgatcagctcaggtcttctaggccagtccttgctttgcagcacgatgccttgtaagaacaattcagtggctacaaaaccttggaaatagtacttaactcctttgggtcatccaagcaaaactactctcgtgaagctcatttcattgggatattggggaaagaaatagcagagaagggatggaggcacataagaaacaatcattaagaagacccaggcaagaaacaaaacaattcttgagcattttaagtaaagaaaaaggcagcatgttacagtcacta

SEQ ID NO: 156407 - DNA, 601 bp, Human
atacatatatatacatatatacacatatatacacacatatatatacatatatatatatgttcacgactgcaagtggtcagatgctggctgctataccctgcctggacccagatgccacagcaatgtcaccttaatgaaaactatatgggggaaaatgacaacatctaagtgacaacacttcacccaccaatagcaacgcccttctcacacccaccacccaacgactgatactcatgccaaatctttcttgaaattactattccccaccatcctttacagactgcacttaagaaggaaggarcccacagaaccgaatatcaatcacagaagctgcatagccagacattcagtgttcgatgtaccgaaaaatcctctttacacgtctttatgcttctggccactacagccgcaaagtccagccattagaagggacagccatctttcagagtcatgtcccttgatgaaatgtcaatgccaaagaaatatagacagatatgccttatgtattttgccatgtctcctccctcttgccatcacagtctcctctaaaagagtaagcaactaaaaaagaaaagctaaatgttcagtccctgtaaaacac

SEQ ID NO: 156408 - DNA, 601 bp, Human
atactgataagtcctaggcggaaactgtttagacttatgcaaaataaatgcatttggcactcctgattcaccgcttgtgagaagcaaggagttcactcactctatacataatacctttgaccatatgtggagaaccaaggaacataatgcagcttgttggttgctcccaagttcagtggacaaactgatgaaagaaaatgatgaactcagggattctgtctccgggcttcagaagcagatactgaacctcaaatctgctaagattgccctgagtgagagtcttacctcctgtagagaaagmgctgaaattgtggaaaaacagacacaagcccttatgatgtgagtggctgacctgaaacaaaaggttcgtgcacagcctcgccaggtgtctactgttaaagtgagggcattgattggaaaagaatgggaccctgcaacttggaatggggacatttgggaggaccctgatgaagctgggcacactgagtttgtaaactctgatgaaccatttttgccagaaggaatttccctattcccagtagtggcaacatccccttcccgacccatgctgccaccagcctttgcacctctgtctgaggag

SEQ ID NO: 156409 - DNA, 601 bp, Human
agcctgagctgccgggggcttcctacagcaaaatcttctgagcttgagaaacgcaggcaaactggcaatgtcttgtgggtcaattaccaggcagttcctgaagacccagcaaaggtacttttgaagaagctgctgggtcatttctaggtacatagcacctctcagaagcaaaagaaaaatgctaagaagaattaacgcagttgttaggaagtgagtgagttaactaaggtctcaaggaaaacaggggtgagtcttccgatgccacggagagaaagggcaggctgctgtaggcagggaggcygttagcctcatttatcattcatgccccctggccctgggaactcaccatggaattccaacaaggagctggcactgaggtatttattgctttctttgcatgtcagcttgtcacacgtaacaattaatttgatgatcccaaattggacctgacaggaaacctctcgataatacaccatgcctagatttagcagagataaacactgctgttaatttctccagcagaggatgtgagtatcaacccagggctgctttcattaatttccatctcacacaatgtgggcccacctcatattggcattgc

SEQ ID NO: 156410 - DNA, 601 bp, Human
tgctgtacttgcactagggagtatttgtgaagtaataggaatggcagccagattacagggcccaggacagcaacaggagcaacttccaacccatcaggctgatgccccacccacctccaggtgccactcactccagttctaaacagtgcctggccacaccttgcaccactccacccttggggacatggagtagaagcctgagctgccgggggcttcctacagcaaaatcttctgagcttgagaaacgcaggcaaactggcaatgtcttgtgggtcaattaccaggcagttcctgaagaccyagcaaaggtacttttgaagaagctgctgggtcatttctaggtacatagcacctctcagaagcaaaagaaaaatgctaagaagaattaacgcagttgttaggaagtgagtgagttaactaaggtctcaaggaaaacaggggtgagtcttccgatgccacggagagaaagggcaggctgctgtaggcagggaggccgttagcctcatttatcattcatgccccctggccctgggaactcaccatggaattccaacaaggagctggcactgaggtatttattgctttctttgcatgtcagctt

SEQ ID NO: 156411 - DNA, 601 bp, Human
ttttatatcacattcctgttgttgcacatacctagaattaccgttgacattcatcactactctaaagtgatggcagtgatcagacctatcaggagaccttgttattaaatcttaaaaaaaattacaatttaaagtaatattttgataactgtacctcatacttcttacggcaagaaaacaggtaatacaaataaaaacaaagtcaggaaaaatatacagaaaaaaattcaaaaggatttgaaaagtgaggaagcatagatatgcagatacatggtgatatggggatctgtgtcccaccaawtctcatggtggaatcataatccctaatgttggaggctgggcctggtgggaggcgactgcatcatgggggtggatttctcatgaacggtttagtaccacccccctggtactgtcctcacagttgtgagtgagctctcgtgagacctggttgtttaaaagtgtgtaatacttcccctcttgctctcttgctcctgctcccaccatgtgagacgcctgctccccctttgccttctgcctgattggaagctccctgaggcctccccagaagcacaagttgccatgtttcctgttcggcctgcag

SEQ ID NO: 156412 - DNA, 601 bp, Human
gcaaagcagccttgcaatggaatcacttaaactaggccgtgggttctttccacatggaaagggcatatggggtgtagaaccgtgagagtcacgctgagatccacacctttggaaagttgtctgatgtaataaaaaatgagagtagacatatatgttttgacgtaacacagatctaggaggtataaggtaaagattcttaatctaatgggcccagaaataaaattcaggacacccatgaactaggctgggggaaaaccaaccaacaaaccagccaaccccacatctttatctccactgacawctgactgatatttagccggccttctcagggtgaactcagcagcatcagcagtgcctgtaattttttcatcaatagaaatcacagatattaatagttttatatcacattcctgttgttgcacatacctagaattaccgttgacattcatcactactctaaagtgatggcagtgatcagacctatcaggagaccttgttattaaatcttaaaaaaaattacaatttaaagtaatattttgataactgtacctcatacttcttacggcaagaaaacaggtaatacaaataaaaacaaagtcag

SEQ ID NO: 156413 - DNA, 601 bp, Human
ccgtccctccagccagcaggcacgcctggtgtgctctggcggggaagcggggctgggcaagtgctgctgtgtttattcctcattcgggtgatgacaaaggcgggaacatgcaagttctctaatggacggtaaacagaagaaagcagaggtctgagaactgaacgtcagggagcagtcaagatcccatcaggctgcccatgtatttcctcttaatatttgacaatgaaaagggtaattaggactcgcagcaaagcagccttgcaatggaatcacttaaactaggccgtgggttctttccacrtggaaagggcatatggggtgtagaaccgtgagagtcacgctgagatccacacctttggaaagttgtctgatgtaataaaaaatgagagtagacatatatgttttgacgtaacacagatctaggaggtataaggtaaagattcttaatctaatgggcccagaaataaaattcaggacacccatgaactaggctgggggaaaaccaaccaacaaaccagccaaccccacatctttatctccactgacatctgactgatatttagccggccttctcagggtgaactcagcagcatcagcagtg

SEQ ID NO: 156414 - DNA, 601 bp, Human
aggctggcatcttctcatctgacaggggttactgttttacccccactttccagctaagaagcccccctgagagctgaagtgttttccacaatcacacaggcaacaggtcccaaagctggtactcaaacccaagtctcctgccccaagccctgtgcactccgtccactagaggctgaggtaaagctggaccagcaaggagccgtccctccagccagcaggcacgcctggtgtgctctggcggggaagcggggctgggcaagtgctgctgtgtttattcctcattcgggtgatgacaaaggcrggaacatgcaagttctctaatggacggtaaacagaagaaagcagaggtctgagaactgaacgtcagggagcagtcaagatcccatcaggctgcccatgtatttcctcttaatatttgacaatgaaaagggtaattaggactcgcagcaaagcagccttgcaatggaatcacttaaactaggccgtgggttctttccacatggaaagggcatatggggtgtagaaccgtgagagtcacgctgagatccacacctttggaaagttgtctgatgtaataaaaaatgagagtagacatatatgt

SEQ ID NO: 156415 - DNA, 601 bp, Human
ctccatacgacacatgtacccatgaactaggctgagggaaaaccaaccaaccagccgaccaaccagccaaccaaccagccaaccaatctgccttacatctttatctctgttgacatctgactgatatttaacatgccctctcaggatgaactccacaggcaaccttcccaagccaaaggctccataatcgattcctaggaagcaaaggttacagggtggggaaactggaatctcagcaagacaacctaacattggaatcgaaggtcaactgactagggcaagactgagacaaggtgaccartaagaggttctgtggctaaccaagtctaggatctgtggcagtcagagcagttccttgtgggagttacgttccaggcacgacagcaggactgggctgggcagcagaggaggagatcacaatgactgattttcaagcccaggaggagcagggaatgagggaggcagaagagtgaaacagagaaccaccaccaacagccattcataacgtgctttatcttgctcaaggctggcatcttctcatctgacaggggttactgttttacccccactttccagctaagaagcccccctgagagctgaa

SEQ ID NO: 156416 - DNA, 601 bp, Human
ctcagaaggaaccaaccctgctgacaccttggtctttcaacctccagaactgtgagacagcaaacttatgctgtttcatccacccagtctgtggcactttgttaaggcaaccctagcaaactaacacagcaacacacacagcatgtgcagaaagaattcggatgggggaagctcctgtgggctggggtcataaggtaaggctttgaaaaagccgcttcagtggggcctggaaggaccggcacaattcagggtatggagggactgggagacccctccacataggaagggcaggagaggtgcrgaggaggactgagcacggtgtattctgccgagtagattctggcctctcaggtcctgattcatggaaaaggtagacattgatgtctgtgaggagggctggatggggtgggggagactgggcagggccttaaatgaccggttacaaagggcaggaacccataggaccaacatggcacaggggagagagttctagactagggcaagggaagccctgtgggtctacacattagccttgaagctggcgggaatgcccttagcttctcagggcttctgttattcagttgcagaatgactacattga

SEQ ID NO: 156417 - DNA, 601 bp, Human
caagagcaagttagtttttcattgaaaaatgacatgtgtctagcatttgcaagcactgcgtgggtacaaagtaatatactacataatccttcctcaaacgcaggaccaggcagggcaggaaggacttgaggcaggcaaccactgtgtgccaagtgagaggctgttctggctgaatttcacccccgtccttcccagcaacacattcctatgttgaagtcctaactcccagaatctctgagtgtgactctacttggggacagggcctttaaagaggtgattaagttaaaacaacatcattagrgtggaccctcacccaatatgattggtgtccctataaggggagagcaggacacagacaggcagagagagaagactgtttgaggacacagggagaagacggccatctacaagccaatgagaaaggcctcagaaggaaccaaccctgctgacaccttggtctttcaacctccagaactgtgagacagcaaacttatgctgtttcatccacccagtctgtggcactttgttaaggcaaccctagcaaactaacacagcaacacacacagcatgtgcagaaagaattcggatgggggaagctcct

SEQ ID NO: 156418 - DNA, 601 bp, Human
ggtgtgctctggagggtgcagaggaaggcacgagggtccacaccaatggacgggctggtgggaagcacagagcctgggagggtggctggagaaggtgccctgaaggcaggacgtgccttgacttctgcgggtgacagggcaagcaggctgggagtgtccttcagccctgcacctgtgcctgagtcccaatcaccgggtgttaagggacactgtggagtcagtgagaagcaggtatgaaagggaggggcaaatggaattgtctgggacaactgaaggtatctcaggcatctgcatcaagctkcccagttagcaataccaagctgagccaggggaagtggtgagggctgaggggttgtccgcagaggcacggtgtgagaaactgtggctgaaatgaatttaccctggagtgtgttgtgtgaggacagaagagacaaagagaaaaggcagtgcagctaataaataacaactgaggtctttaattaaacatcagtgaatctaagacttgaactcttgaaacatctgaagttgtcaacgtgaaataaatatggccatggggtccacactcccatgttttgaaatgaggggagagaaaagggttttg

SEQ ID NO: 156419 - DNA, 601 bp, Human
gggtttggcaaatggttaaacagggctgtgtggctttctccgaggcatggtctccaggccaggtcacaagctaaggtgcataatgaatttccaggagagaatcctagaggctgcttgcctctgaccacatgacaggaagccaaggagcaggcttggaactctgctgcacagcagggctcccaccctccacaagggcattgaaaatgcgggcaatggaccagaggctgacagttacccacctggaacatgtcccagggaatacccccaaagggaagagtgctgggcactgcagcccttcttstattctttagggcaatgatgtcctgggacccagggcatcggtatggattcacctgggactggtcagaatgcacatttctatatactacataagccttcctcaaacacagaggcccagcgatctgtgtgtaaccagccccaggtgatgctggcgctgctcgaggctgattgccaggctctgtgatgagggagaagtgcccacataaaggggctgcctgggagtttccgtcacctccaccttcagaaacaaaacagggaaaaatcacttcctcagcaaacgacccctccccttccctcggct

SEQ ID NO: 156420 - DNA, 601 bp, Human
ccaaattattaattcttctctactctggaattgcttaaaagattttctatcaaatggctttcctacattttcagtatgacccacaataaaaacctggatcattttacattgtgatgcagtgggcacaagtgcacacacacacatagagacacacagacacagacacacacatatacacacacagatacacacagacgcacatacacacatgcacagacatacatacacacacacatgcagacacatacacgcacacaggcatacacatatacacatatcagacacacacacacacacacaagcacatatctccctaaacaaacaattctgccccttgtatcctgggatgcactaatcccatgtaatatgggatctgtatggtcccatccctgctgatctccatccactcaactgacttcatgacccaccaacgggctatagcgtacagtgtgaaaagcacagcgactctgaaaccatgttattaatgataacagtttccacacttccacttttctttgtcatcgtaagcaatgggggaaagtccttgtgcggttgtgcaggtggactcctacactgcaggcccatataggaatgcgtttgg

SEQ ID NO: 156421 - DNA, 601 bp, Human
aaggtgcagtcatacctttgagtgctgattttcttttgttatgatttgatatacctatgtgttgaaaaattccacaaattatgaaatccttggttaggtgggtatgctggaccaggtgtgcttggtgagacattagttccatgagccataaaaaaagtgacattcctttggggatttactgcccctgaatcatgtgagagccccagaaacaaagcatttctcaaatatgcatcattttaggtagatgagaaagaagccacagtcacctccgccctctggactgcagagagcttagctcacrtcggcatttgcatccaacagcacaacatggaaagcagtacacaacaagaacaggcagaagtgtcttcataaacacattttgcctaaatattctgtattaaccacagccatccacttacagggtgttaggataacttttagttctaggtgcttgactataaaatgatggcgatacatcaactactaatgaacatactactaataatagctagtatttctttctgactctgggcccagaactattctatgtactggagacacattaactcatgtaatcttcacaacagtcagcttaggtaat

SEQ ID NO: 156422 - DNA, 601 bp, Human
tcctcctctgagagactgaaatgccccttagtgtaatggggctctgagtcatcttaaggaaaccagattaacttcctttcacccatttcctgatgcgtttgaatcaggaagccttttgggcagaacttccattagcatcagcccaccgcggcccacactacacacggtcgtgacacatgtattaaaggctgagttgcaattgtgttccatattttatgtagaggtgaaggtggtttacacattttggaaagagttttacctcggaggctaaataggggtcacagtgatctagtgggaggcycaggctagggaatccatttctccatcctccttttctccaccactgggtcacgtgctgtttggtcactggaaggacaagtctgtgtggcagaagcctgggctctctccactgctgtgtgagaacaaggctgtgcatttggccccagcctttcagctgccttgtcatttgtgatgaaacagaagcagttccatgcagggccacatgccctcatggtgtgtactatctgggcgaaacctgtcagacaacgggcatttttcatagagaaaggagaactcaactttggtctaagatgctctctgc

SEQ ID NO: 156423 - DNA, 601 bp, Human
tcttttctgggttaatagaactgagcaccaacacctgtcttctgtttgtgtggcctttcactgattctagagcccgttgcctgtgatccctcagtctttcctgcgcagtgtacagggccaggagcccacaagcatcactgacctccttttcatacaggtgagaaagcagcttagaggtagacagtccctgtggtcgagggaatgggaggaagtggagccaggacaagcacgtgggtcctcaaactttctggctagctctggtcttcctacacctgtcggatgcacaacctcagaattgtgrcccaaaatacattctgcctggctctcatcctgcaatgcaatttgagtagcctgtggtcaactaaattctggaaacactacttcctgtatcctcctctgagagactgaaatgccccttagtgtaatggggctctgagtcatcttaaggaaaccagattaacttcctttcacccatttcctgatgcgtttgaatcaggaagccttttgggcagaacttccattagcatcagcccaccgcggcccacactacacacggtcgtgacacatgtattaaaggctgagttgcaattgtgttccatat

SEQ ID NO: 156424 - DNA, 601 bp, Human
gagtgctctggaatgtgtatttgccttggagacatgggcactttccgctcaccacttcctatgtgtctctgtgctgtcgcccagtctgctgccaagaaagggaaatggattagaaacaggtaagacggtaaaactgtcaggaggtaaaaagattactcctggattacatggagatgccatggtcagctctatacacttatctgtatagagtaaaattggattcattcaattaagtgaaacccttggcaaagcagaatagaacaaatgtaatcagggaattttccccaaattgtatcttggycttttctgggttaatagaactgagcaccaacacctgtcttctgtttgtgtggcctttcactgattctagagcccgttgcctgtgatccctcagtctttcctgcgcagtgtacagggccaggagcccacaagcatcactgacctccttttcatacaggtgagaaagcagcttagaggtagacagtccctgtggtcgagggaatgggaggaagtggagccaggacaagcacgtgggtcctcaaactttctggctagctctggtcttcctacacctgtcggatgcacaacctcagaattgtgg

SEQ ID NO: 156425 - DNA, 601 bp, Human
gcacctaggagcagggctctgtgaggaatgactcactctgggcagtaggacacatcttacaaagcaggggtgctcccaaaatagggagcttacttgttgggacacagtaagatgtttttccctttagaaacaatatgaatgatgcttaggttcctaaactgtctcagaagacacgtaatccaagtgtaggctgtgaaatgctagtgtgctgagttggggctgagagctgggcctggctggctgtgggcttctacagagtagttgcagccctgtgcacaggcagggggggtgtcaccgactygcatgtgggcaggtctttgctgcgcatcaggtgctttaagcttcggaacaactgtgcaggattctattttagtattctggaagcatcattgaggaagtagtccagtgaagttagctctaaaaaaactctttactctaacaattaaaagaaatatgccaaaggatccataagggatgaataaattattaaactattaagaagttgctataaatatgcagtgttaattcaataattcataacggactggtacaacaagattttttaaggctcataaaatactgctggctttggcagtagcta

SEQ ID NO: 156426 - DNA, 601 bp, Human
tgcataaagcacccagagaagtcatctgcctctgtgttgcttgtttaataaaggcaggtgaagatggaacaggagcactaactcacaacaccgatttaaaagaagtcagctgtatcatggagaacgcaagtcaaagaggagttcttttcaagctcaagatgcaatctgctgcttttcctcagcatttgcctcaataaggaaccaatttgaatatttttaaacccagcatctttatggttcagtaacggggctgagagccctaaaatggttttcaaggatgtaagtacaaacatactgtgcrttgtagtttccaataatgattgcaatgtcagatgacattgtatttgtcttctatcagtttcttaaaataaataaataaataaaaaggttgagggggacggggggcgggggggcagtgggtggtgcaaccaatcccctgccatctcgtctctgaccagtagagggagaatgaacttcattcagggcagcaaattaggcctcaagttatccctaggatgatggttatgtccctgattccctgggacggtctgggttcaggcattggtcctggtgttattactagcagtgctttctttcactc

SEQ ID NO: 156427 - DNA, 601 bp, Human
gctggggcatccgggtacttggtcaagacctgaagcaaccattggctatgagggcttatttcccaaggaaacaaaaaacgcagtgtttaaagtgagatacatgcataaagcacccagagaagtcatctgcctctgtgttgcttgtttaataaaggcaggtgaagatggaacaggagcactaactcacaacaccgatttaaaagaagtcagctgtatcatggagaacgcaagtcaaagaggagttcttttcaagctcaagatgcaatctgctgcttttcctcagcatttgcctcaataaggraccaatttgaatatttttaaacccagcatctttatggttcagtaacggggctgagagccctaaaatggttttcaaggatgtaagtacaaacatactgtgcattgtagtttccaataatgattgcaatgtcagatgacattgtatttgtcttctatcagtttcttaaaataaataaataaataaaaaggttgagggggacggggggcgggggggcagtgggtggtgcaaccaatcccctgccatctcgtctctgaccagtagagggagaatgaacttcattcagggcagcaaattaggcct

SEQ ID NO: 156428 - DNA, 601 bp, Human
gtgctataggtaagatggccctactgttttacattctgttatctcaaaccagaatacattggctgaccagcacaaggcagaatgtgtgaaaacagaactttcccagaaaatctgggccatggggcccctgctctgaatagacgggtgtgaaatgcctgtgtctgtgctgttccatgcatctgatgaacaagctgtcaccttagaaaccagagggaagaagcccacagagaggtgaacacccaggaggcaaaccatggcatctggctggggcatccgggtacttggtcaagacctgaagcarccattggctatgagggcttatttcccaaggaaacaaaaaacgcagtgtttaaagtgagatacatgcataaagcacccagagaagtcatctgcctctgtgttgcttgtttaataaaggcaggtgaagatggaacaggagcactaactcacaacaccgatttaaaagaagtcagctgtatcatggagaacgcaagtcaaagaggagttcttttcaagctcaagatgcaatctgctgcttttcctcagcatttgcctcaataaggaaccaatttgaatatttttaaacccagcatctttatgg

SEQ ID NO: 156429 - DNA, 601 bp, Human
tgagcctttccagagaggaatgaaagggcaggggcaggaagcaaggggaatgtccagagtgtgctgcactaggccccaggcccacggctctcactccttcctgcttctcccaaaggttccctggggtgtcccctgccttgagggagcttcctttgctttccatgaggacagccagataatatgctttaccaccagcaaatctcaccagtgaagatatctatgtgccctgttattcacaaagtgaggaggcagatgctggatgatggacagagcaagctgcgaccctgagggcccctctccragctgagatgcacctggagggcacaacctcgagcatgaagagggtaaccagaatggggccctgggtgggcccctccgcgggcaggatgtgacatacttctagggagcattagggctcaatggaaactttccactaagacgtcagaggggaattgatgtgtagtgtataatcctcactttgaggcgctatgtacacgtagacatctacatgagagccttccttcttccacatggctgggcagataagtccacccacctgacttctgaggcccactgagaagtgacagaaagtgcaagaaca

SEQ ID NO: 156430 - DNA, 601 bp, Human
ttcttcctcctctccactaacaggcatttggtgttcacacactgtataggacgctgggttagggactgaggtgaagactggtcccagagggctccctaaatagcaagaggccaacaggccacacctgtgaggtttaccagaagctaatgcgaaagcaggtcaccatgggtttctggaaaagtgggctgtctctattttgatgtggccggtctctgtggcaaccccatgaaaactaagaatgtccttattgacaggaaggacttccacaagactgatcctccatcagggatgagaattcccscagagctattcctgaggacatgcagggaaccacagaatctctgtgaacttggtgaatgagcctttccagagaggaatgaaagggcaggggcaggaagcaaggggaatgtccagagtgtgctgcactaggccccaggcccacggctctcactccttcctgcttctcccaaaggttccctggggtgtcccctgccttgagggagcttcctttgctttccatgaggacagccagataatatgctttaccaccagcaaatctcaccagtgaagatatctatgtgccctgttattcacaaagtga

SEQ ID NO: 156431 - DNA, 601 bp, Human
gcaaatggccacttggctctatttcaaatctggacccagtgagccactaaggatctatattggaagactggcccttccaggttcacatttgttcacatctacctacctacctacctacctacttacctatctgtctgtctgtctacggtgtttataagtatcaagcatgcctgaaaataaggaagcatttgcacaatctctggagcatctcctactttttcctgcctgtccagttgctggagggacataggagcttgtctccgcttcttatcactgtcatcttcttcctcctctccactarcaggcatttggtgttcacacactgtataggacgctgggttagggactgaggtgaagactggtcccagagggctccctaaatagcaagaggccaacaggccacacctgtgaggtttaccagaagctaatgcgaaagcaggtcaccatgggtttctggaaaagtgggctgtctctattttgatgtggccggtctctgtggcaaccccatgaaaactaagaatgtccttattgacaggaaggacttccacaagactgatcctccatcagggatgagaattcccgcagagctattcctgaggac

SEQ ID NO: 156432 - DNA, 601 bp, Human
ttaaacatttcccagtaagtcgatggaaaacaaatccgttcctgccatttttagttcttgaaataccttcttggcttggtcttaatttatttgggctattaattttctggacagcaaaataataattagcatggctggtgagcagagggaaacgtctcactcgattgcacccagacatttctggataacatcattcttcagagtgtgacagtcgaggctgtctccctccttcagcctggcttcagcactgacaacatttccacaagatggcactgctggtcctctcagcccgcgaacgctycggccagctcagccacctcaaggagaaatggaagccggccaggcactgcgggcgagggctgctggcacctgggcacgagggtgccccttctccccaggagtggctaattgtcacgagtctgaccaaaggcatataaaactcaacttcagtgtcgtaaacacaattctaaacccgagagaaaataatctggaacctaattccttctaaatttggcataagaaatttataacatttttcaaaagggcacaaccagaggtgcttttctaggtgagaatgcttgagctcatgttcacattggtc

SEQ ID NO: 156433 - DNA, 601 bp, Human
gggtgactttttaaacatttcccagtaagtcgatggaaaacaaatccgttcctgccatttttagttcttgaaataccttcttggcttggtcttaatttatttgggctattaattttctggacagcaaaataataattagcatggctggtgagcagagggaaacgtctcactcgattgcacccagacatttctggataacatcattcttcagagtgtgacagtcgaggctgtctccctccttcagcctggcttcagcactgacaacatttccacaagatggcactgctggtcctctcagccygcgaacgctccggccagctcagccacctcaaggagaaatggaagccggccaggcactgcgggcgagggctgctggcacctgggcacgagggtgccccttctccccaggagtggctaattgtcacgagtctgaccaaaggcatataaaactcaacttcagtgtcgtaaacacaattctaaacccgagagaaaataatctggaacctaattccttctaaatttggcataagaaatttataacatttttcaaaagggcacaaccagaggtgcttttctaggtgagaatgcttgagctcatgtt

SEQ ID NO: 156434 - DNA, 601 bp, Human
tggaccaggtgctgagttaggcgctccccttagaagtgctgtatctaactctcttggtcctgtgaggcaggaactgtccatttcacagattggaatggtaaatcagaaaggaccagtcatttgcccaagggttgcacagtaataagtgctgggaaccagacttggaacgagggctgtatagtgcatgtaatcttggctccaagcccagtcccctcattttaaagcagagttttagcttgtcttctgtatatgatttagagatgcagagttttaaggtaagcaatctaaatgtaacctgagrgtcctttattcaaccagacagtacaatatattcaaatctacctaaagatttactttctgacttgatagtggattttttttcctgaaaaatgatcacttatgtctctagcatttaactagcatacaaagcacttccacataaatcattagctcatctgagttccttcggcaggtgatgttctattttacggaggaagaaatggtgcctcagagaggctggaaccttgcttggggtcctgggggtggagcccgggaggaagcgcaagggctgtgctcttcagtcgggtcgtctgagatctcc

SEQ ID NO: 156435 - DNA, 601 bp, Human
ttgacctgggttcatggaagtctactcaagttatcctctgcaaatgctgtctccttttcatgtaaatgtactctatcagcaggaagcatgtacacagaaggcagggacacatggcctttaataagccactggtgctctattttccctaaaggatagaaatgatctcaggttgataaaagctactgtttatcaatcaccactatgtactatggaccaggtgctgagttaggcgctccccttagaagtgctgtatctaactctcttggtcctgtgaggcaggaactgtccatttcacagattrgaatggtaaatcagaaaggaccagtcatttgcccaagggttgcacagtaataagtgctgggaaccagacttggaacgagggctgtatagtgcatgtaatcttggctccaagcccagtcccctcattttaaagcagagttttagcttgtcttctgtatatgatttagagatgcagagttttaaggtaagcaatctaaatgtaacctgagggtcctttattcaaccagacagtacaatatattcaaatctacctaaagatttactttctgacttgatagtggattttttttcctgaaaaatg

SEQ ID NO: 156436 - DNA, 601 bp, Human
aactatcaaccctgcccgccccatatcctcaggcctttccagactttaaaaactacacttatttaaattgaaaagaactgcaagccaggcagaattagccaggattagaatccagataacacttcctatacactagcagaaactgcagctttttcacacccagactaagcagccacctgatgtccgtgcacgtgggtctctattgtccatctggcaaggaccacatcaaactcttaaaaggaccctttgtccttaacaaaagtttgctattacttattttctaaattttcttaatgaagayttataccttattggcattctgtggaaactgcagacagacaggataaaatgccagaaacgctcagtgactgagtaaccctgtggaatgcagatatcatcaagactgagtttgatggtctcatctttaaaggaatgtggaaagggctgagaaacccaaattcatagttttaaaacttccctaaactcccaaacagcaactatttaactcaatatattcaagttactgctaccccaacatgtaactcatataaaaattgagaagacttttaacattcttttgtgttctaaggctttacaccct

SEQ ID NO: 156437 - DNA, 601 bp, Human
gacacctggactgctgcgaatggtgcagctatggacgtgggtgtataaatatgtgctcgagtttctactttcaattattttgtgtgtaactcagaagtggaattgctgggttatatggtaattctgtgtttaactttctgaggaatcaccaacctgttttccacagcggctgttccattttagattcccaccagcaacgcacatgggttcctatttccccatatccctgccaacgctcgttgttttctgttttgttttattctgtttttttggataaaggctctattctaatgggtgtgargaagtatcgtactgtggtttagatttagcaactaattttaagaataagcttccctgccacagaataataaatatcaatctgtattgatcattcattaaaggtctttatgaaccaaaagtcgcccccaaaattcttctctaaaactgaaaaggccataattggctgtaaggacatatggcagctgcccatgaaaagatggcaaaaggcaggcctcttccaaaatgtctaacagcgatatgtattttcatgtaacttgtcccgtgacagagcgtatgttgtgttgaaggttttcatcaagtt

SEQ ID NO: 156438 - DNA, 601 bp, Human
attttagccatttttaagtatacagttcagtggcattaagtatattcatattattatgctatcatcacctttatctatttccagaactttttcatcattcccaacagaaagtctgtccccattaaacactagctccccattctctcctcctcccagcccctggccatcaccgtgagtttaactgccctagggatctcatgtaagtggaatcatacagtacttgtctttttgtgtctggcttattccatctagcataatattgtcaaggttcatttatgttgcagaatgtgtgggaattctkttttgaggctgaataacattccactgtacagacagaccacattctgcttatccattcatctgctgatggacacctggactgctgcgaatggtgcagctatggacgtgggtgtataaatatgtgctcgagtttctactttcaattattttgtgtgtaactcagaagtggaattgctgggttatatggtaattctgtgtttaactttctgaggaatcaccaacctgttttccacagcggctgttccattttagattcccaccagcaacgcacatgggttcctatttccccatatccctgcca

SEQ ID NO: 156439 - DNA, 601 bp, Human
actcccagggcacgctctttcctttcctaaacccacatttagcacctcactcccatgtgagctgctcaagacactgtcccatcgcaactgctgaatggccatggagaccctgggggctaaaggagacccccagcagtaagaatgaccctccccccacaggcccagctcattccaggagtgtccagggccatggttgcaggttgcagcgtctaagagtccacaggaggcattcacagatggcgctgtccttgtgaaaccccaaattcacggagatagctcctttgtgctgagtcatgactgmatctgctgagctttagtggcttggtggattctgctcataaagacagaggatgtcaatgaaaatcatgctaggctcagcataagaaatgtgcctctgccaaccactgggtggcgaggggtgaggtgaggcccgccgggtgtggcgatgagccagggactggtgtcctttgtgctgcatcctatacaaagtggctagtcattctgctggatgtggtgctggcgacttggctgagtgatggcaagactgagggtctgatgccgcagtcaaagggactcactcaggatggaaaggccgtgaact

SEQ ID NO: 156440 - DNA, 601 bp, Human
gattgacacacacacacaactactgtcccatcacaactgctgaatggccatggagactctggaggctaaaggagatccccagcaatgagggtggtctaccctgtgagtacgccaccctttgcagaggtggagtggaactccaggacgcagaggcgccatccagcagtagggcgccagcctggagaggcctccatgttgggtgttcctgacaggctccttggttgagcccagccccactgtgtagtagctgccacgtgaggctctcgggggacctggctatcaggaatctgtctccagcacyggtcccctgtgtgcactgaggacgggagtctggagcccaggggcctgccacagtcccgcccttcctccctgccctcggtgctcctcagaggtgctgtcctctgggcgtctcctgcattgatcacgacaagggtggggttctatgcctcgagtatgtacccggagaaatgtgtgtgaacagtgatgatatgagatcatgacagctctgctctagcctgagtgctggaaaacacacacggaagctgaggcctagaaaccagcctctgactcccagggcacgctctttcctttcctaaaccca

SEQ ID NO: 156441 - DNA, 601 bp, Human
ctcagatgatcattagcatacagaatttttaaatttttaaaattttaaattaagttatgcattgttttttagacgtaatgctactgtacacttaataggctacagtggagggtaaacataacttttatatgcactgtgaaaccaaaaagttgtgggactcactttatcacaatatttgctttattatggtggcctggagcagaccctgcaatatctctgaggtctgcctgtacatattcattattgaaacgcagacaagcaaaacaagttaaaatcacttgtacttctgtattactgtacstgtgtatttataaagattgacacacacacacaactactgtcccatcacaactgctgaatggccatggagactctggaggctaaaggagatccccagcaatgagggtggtctaccctgtgagtacgccaccctttgcagaggtggagtggaactccaggacgcagaggcgccatccagcagtagggcgccagcctggagaggcctccatgttgggtgttcctgacaggctccttggttgagcccagccccactgtgtagtagctgccacgtgaggctctcgggggacctggctatcaggaa

SEQ ID NO: 156442 - DNA, 601 bp, Human
gccaaagtctaatctagagaaaggccctaactcccttcagttctatgaaggctaagagaggtgaggaagctgcagaagaaaagatggaaactagcagaggttggttcatgaggtttaaggaaagaagccatctccagaagataaaagtgcaaggtgaagcagcaactgctgaggaagaagctgcagcaagttctccagaagatctagctaagatcattgatgaaagtggccacactaaacaacagattttcaatgttgacaaaacagccttttattggaaaaagatgtcatctaggacttwcacagctagagagggaagtcaatgactggtttcaaagcttccaagggcaggctgactcttagtagggactaatgcagctgatgactttaatttgaagccaatgctcatttaccattccaaacatcctagggcccttacgaattacataaaatctactctgtctgtgctctatacatgggatgacagagcctggatgacggcacattggtttacatcaaggtttactgcttattttaagcccactgttgagacctactgctcagaaaaaaagattcctttcaaagtattactgctgattta

SEQ ID NO: 156443 - DNA, 601 bp, Human
ggcctcaagccatccttccaccttggcctcccaaagtgctgggattacagggatgagccaccgtgcccagcctatttttgttttttggttaaatcaacacattttaactatgggcaagcccatttatttggatttaatgagatcgtgaaacaggcgcttccctaaagcaggggagaagtagctttacatggtgtggacttggagactttctcactgcctcctcaaccctaggcttccccttccagcgtcctcacaggggagattctagagccaacacaaacctcccgtccccatcaatccstgagcattacaaatataaggtccttgggaaacatgtcacctcttgacatgttaactcacactgagctcacctaaactgccgagtattgagggaatggatgcagtaccaaagcagtacagctcagtgtgaaaaaacagacaagcccaaacaggctcaaatcgccagcaggtctaccacctggaaacacacactgttaacgtggggctatcctcccaggctttccttctatggacagatgtacgtgcttgtcttcttattaacttttttcttacaaaaatagttatactgttttgtaatctg

SEQ ID NO: 156444 - DNA, 601 bp, Human; identical to SEQ ID NO: 29969

SEQ ID NO: 156445 - DNA, 601 bp, Human; identical to SEQ ID NO: 29970

SEQ ID NO: 156446 - DNA, 601 bp, Human; identical to SEQ ID NO: 29971

SEQ ID NO: 156447 - DNA, 601 bp, Human; identical to SEQ ID NO: 29972

SEQ ID NO: 156448 - DNA, 601 bp, Human; identical to SEQ ID NO: 29973

SEQ ID NO: 156449 - DNA, 601 bp, Human; identical to SEQ ID NO: 29974

SEQ ID NO: 156450 - DNA, 601 bp, Human; identical to SEQ ID NO: 29975

SEQ ID NO: 156451 - DNA, 601 bp, Human
atggtgtggctactataattatctccattttactaagcccaaaagttctacaatcatgaaaaagctttaatgttccctttttgaaaattccttaatatgtaataattgtgacttttaatagacatgaatatttcatttaaaaaattaactgctaagtaggataagccgtctgttgttaaacacactagaaaccagaatatataccttattagcaaaaactgacacaccttgtcctttgatcaattattattaatgctattctaataaagagccctgggtattgtacgatgctcaactactwcttcatccactgacaaaaactgttcatgatcacagaattttagtgaggattacatttactggattattgaatatgaatccatgcatgtcacatctgataccattttcttcagttgtttactcatttgaaaacacatattgagaccgcctatgttattagaacaccacaatatttatttgattagtacatttgcctctgtgttggataatggaaagtttatcttgagatataatataataatttaataatgattctaacctgtgaccagctcccggatctccaggtcagtcgtcttgcgga

SEQ ID NO: 156452 - DNA, 601 bp, Human
aggtcgacggaatcacagatgattaaaagatctttttagacagtcaactatgcaatccatttgctaaatacttgctgatggggtactttttgatgaactgaaaaccaaatatcacctagaatggcagtgagcctgattaagatgagtaagcagcagagttatttgaaatgctgtattgaggccacctgggccattagtactccaagtaacactgcacattttaaaagggagggatgacagcttatggctaacacggactgtgtttacatgtattccatatatgtgccaaatgttttacagrgtctcatttatgaaaccttcacgactatggtgtggctactataattatctccattttactaagcccaaaagttctacaatcatgaaaaagctttaatgttccctttttgaaaattccttaatatgtaataattgtgacttttaatagacatgaatatttcatttaaaaaattaactgctaagtaggataagccgtctgttgttaaacacactagaaaccagaatatataccttattagcaaaaactgacacaccttgtcctttgatcaattattattaatgctattctaataaagagccc

SEQ ID NO: 156453 - DNA, 601 bp, Human
ctacttcatcagcatagctacaaggaaattttagagttaagacagaaggtcgacggaatcacagatgattaaaagatctttttagacagtcaactatgcaatccatttgctaaatacttgctgatggggtactttttgatgaactgaaaaccaaatatcacctagaatggcagtgagcctgattaagatgagtaagcagcagagttatttgaaatgctgtattgaggccacctgggccattagtactccaagtaacactgcacattttaaaagggagggatgacagcttatggctaacacrgactgtgtttacatgtattccatatatgtgccaaatgttttacagggtctcatttatgaaaccttcacgactatggtgtggctactataattatctccattttactaagcccaaaagttctacaatcatgaaaaagctttaatgttccctttttgaaaattccttaatatgtaataattgtgacttttaatagacatgaatatttcatttaaaaaattaactgctaagtaggataagccgtctgttgttaaacacactagaaaccagaatatataccttattagcaaaaactgacacacc

SEQ ID NO: 156454 - DNA, 601 bp, Human
ttactgcacggaagcctcctgtccccatcacatgcactgagctctttcttttgcaggcagttccaacttaagcacaacccacaaatataaggatgggtgttcctaaccataatggtaggaaatattttcagttacataactcacccctaaactatcatagatatcatactgtgtagataaaagtacttttactttccctgactcatgtctccccacattagtttggtgtgaaacattgctttagtagcacggcaattttaacaattattattttttccacaaagatgattttctagttatrgaaagaaaaaacaaaagaaaaaaaccaatttacatctagttctaatacaaccaagagtgagaaagaaatgtgacaataatctcaaagagtgtacatttaagaaaatatacgaaagttgggagtcttgacccgggactggacaaatatttatgactctctagcttgaataatgtattttctttaaaaacacattttcatctacttcatcagcatagctacaaggaaattttagagttaagacagaaggtcgacggaatcacagatgattaaaagatctttttagacagtcaactatgcaat

SEQ ID NO: 156455 - DNA, 601 bp, Human
attcttttcacactagaatgttctcctagatgctctcttccaatttcctttactagagtggaagcttggccaagtggcttgtggattttctaaagaatccatgatggcaacttcagaaaccatgaagttcagcttgtcaacatgttctgatatgtttttctttgagaaaggtgaaactgatggctgaagttcagccaagcacaacatgaaaatgctctagaaaggcagaaaacatctattgaagtaacaaccactgtccatcttaacggatgtggctatcacggcaaaagacagcatttcktctaggaggagacagacagagagcctcaaacccccagcacatgctgatgaaaacacagtgggtcaagacatgacagtgggtgcaaacctccttcttcttaaaagaagtggaataagagtgtatcctctccatacatcaagcaagcatccttcctacagcctgcgtttcaccaggaaaagaaacaagaggttatgcctttggttttccaaatggggctcacataggaatttctgatgttgcccaggcacacgtgaacggccgacacccagaagctgttggaagcaatgtcgaaggcaatgg

SEQ ID NO: 156456 - DNA, 601 bp, Human
taggtttgctttgtgcagtgaagctggctttggcttgctttacatcattgaggcaatgactgtgcagatgtcagctgagtcctgcaggtttccaggccccctcaggtttctgtcagtaaggaaactcagaaggctttgtctagagccaatcactagactggcttacagtagcaattcttttcacactagaatgttctcctagatgctctcttccaatttcctttactagagtggaagcttggccaagtggcttgtggattttctaaagaatccatgatggcaacttcagaaaccatgaagytcagcttgtcaacatgttctgatatgtttttctttgagaaaggtgaaactgatggctgaagttcagccaagcacaacatgaaaatgctctagaaaggcagaaaacatctattgaagtaacaaccactgtccatcttaacggatgtggctatcacggcaaaagacagcatttcgtctaggaggagacagacagagagcctcaaacccccagcacatgctgatgaaaacacagtgggtcaagacatgacagtgggtgcaaacctccttcttcttaaaagaagtggaataagagtgtatcctc

SEQ ID NO: 156457 - DNA, 601 bp, Human
caaaagacgtgaagccagcctttcttcttgtaccctactccacctcttggagtcatccactcccttgcggctcatctagcaagttcccaaaatgtggacatgtttgtcaggcctatcgctttaaatatttagcagccagtgctgcacactcctgaccattcagagcagagcctcaccactgtagggggcactggtgtagacatctccgtggctgcactgtgtggtcaactgagggcatccaaggcttggtcaacagaatccaagctttctctgaggtgaattccttttgcctcattttagktttgctttgtgcagtgaagctggctttggcttgctttacatcattgaggcaatgactgtgcagatgtcagctgagtcctgcaggtttccaggccccctcaggtttctgtcagtaaggaaactcagaaggctttgtctagagccaatcactagactggcttacagtagcaattcttttcacactagaatgttctcctagatgctctcttccaatttcctttactagagtggaagcttggccaagtggcttgtggattttctaaagaatccatgatggcaacttcagaaaccatgaagttca

SEQ ID NO: 156458 - DNA, 601 bp, Human
ttaaagacttatttttttagaatttaatgtcctaagcatcccttttcaggaacttatgagagagaaaaacaagagagaagagggcataggatcttggaaacagaagttctaatccaggattgctgtgcaggtctggagagcaatatccaaatccgtcctgaagacagaagattctggaagggacttctatggagaaaggagggaattaatgatgcccgaaatgaaggacaaggttaagtcctcagcccgactccttaactaaaaggaaaggccatctggatatgcgaagcatcagacggayggacactgtgctcctggagaagcagagctctcaagacacgtgctttcaccaaaatgaaacctatttactaagttctatagtttaataaaaaccattttattataatttgtaaagcattctgaaatctttagttgggcatactcaaaattttggtcaattatttccatatttagagagagaaaaattatattagtcaggcccaaaggacgtgcagcatttctaatcaaagtttatttgcttcggagcttttcaagcaatggctagcatacaatagcttcgattggatttaaataaaattat

SEQ ID NO: 156459 - DNA, 601 bp, Human
gatggattgtgatggggagaaccaaaaaggtactgaggatatttgggccttagagaaaaaccctcctgattaagacacttaaaagactccccactacaacagttccctcccacccattcgccctgaagtgaagcttcactgtgaacaagcttcaccgacatgcagagagctcagaaaaactccattccactattttaaaaataagcagaaaacttgaagaccaccacagatttgaagtaagcctgcaaaatcagtgaaaaagcccaccataaaaaaagaaaagctgacaatgaaaaaaatkgagataattcatgccaaagagataaaaacaaacttcagttctaactaatatccttagagaaattcaaaaatatcttacattcataaaacaaaaataggagctattaaaaaacacaaaagagaattcttagaatttttcttttaaagagatgatattctcttgggcccctggtagtgggagcatggaagtcacagaaaaattgggggaaaataaatgttggatatcagtgaattctttcagaacatatgataaaaaggcaaagggctccaaattacataagaaaatacaagagaaataatc

SEQ ID NO: 156460 - DNA, 601 bp, Human
cccctctttccacttccctaggtcctggccaggaataatcatgcagagttccgtggcaaagagcggcagctttgtgtatcactcatgtggcagatttgcagccagcgagaggcaaaagaggggtgccatttgtccccatgagtggcagctggctctggcttcccctgcttcacatcctgctgttctttctgactgctgcctgctggcccgtgtcaactgcaggcccatcaccagacacagcggcaaagccttccacaggcgttttcaccagctctcaccgtggtgtcaggtctaatcctgrtaacaagtccccctttccatgtcatctacagtgcttctgcctccctggtcaaaccatgatgcacctggagacaggcgctgcctctgctgccagtatctaaatgttgcaaggtggcaacaattcctgtgattccagtttcctaaagaagagacaatgggaatcgaggaatctcccttcgagtgggaaatgcatcatgccagaatgaacctttgcctggacttatttctcccaattcaggttaagtccacagatgatggactctcaaagccacacaacaccaggctggcatcccccgactaa

SEQ ID NO: 156461 - DNA, 601 bp, Human
ctgttagaacttggttgcagaagacagtatgaaatagaaggttctataaactatggcctgagctacctgcttgcataaatacagtttaatacacagccatacacatttgttgatgtattatctatggtgctttcatccagcacaggtagagttgagtagttgtaacagagacctagggcctacaagctaaaatattttctatctgtccttttactgaaaaagcttgccaagtcctgttctagaatctagaagagaatggtagaaaagcatattgcctctagtgcaatgctttcaggttcamgaacaacggaaaagtagaaggcaggcaggattcaatttcagcaaacactgctacacttccaagtgctgaaaagcaaagtgtccaacttaggaagcaggttcaagagaactgagccttcctgagatctgcagaaggaaagcagaggaaaatgaatcccagaaggacatcccatcccagcagtaaaaagaagtgctggaaaaatgcatttctcagggcctagagcaggagcaagcagagacagtggcctgcagtgcacacagcagaggtctgggcttgaaggcgcagcaggttcccccaatg

SEQ ID NO: 156462 - DNA, 601 bp, Human
cccagcccctcacttgctcttcccctgagaggtagaggaacttgtccaaggcactagtaagcgtgcagggcttggcccagctctgagcttcttccactttgggatgaaaggccatgaggaactctgcttcccctggtctccataagatgtgccctagtggctggcagaggagaagggaagctgccctgatccaacggctgcctgtgccatggtagataagtctaactaattctggcatctggcattctgtgtgagcaaaccaatgtggctaaaaggcctggagtctggcctccaacccaasccctagcagtaatgaggtgacaatgtggccttcttctttattctgttagaacttggttgcagaagacagtatgaaatagaaggttctataaactatggcctgagctacctgcttgcataaatacagtttaatacacagccatacacatttgttgatgtattatctatggtgctttcatccagcacaggtagagttgagtagttgtaacagagacctagggcctacaagctaaaatattttctatctgtccttttactgaaaaagcttgccaagtcctgttctagaatctagaagagaatg

SEQ ID NO: 156463 - DNA, 601 bp, Human
aggaatcagaacagtgctgagggttgtaagtttttgccctctgcctgtgcatatgatttgggcttgcctctgtgaagagataatcctaaaatgttcaaaatgacaggagacaagaatgggcaatgtctcagcatagaaggcatgagatacaaagctggttaggagatgacttgccatcaaaaggtagaccaaatacttatctcctctgcccatcattgatccatcagaattaacagcaatgtactgggaaggattcttccccaggcctgatgtttccttactgcgaatggagcacaattaygtaacactggactctcccagcccctcacttgctcttcccctgagaggtagaggaacttgtccaaggcactagtaagcgtgcagggcttggcccagctctgagcttcttccactttgggatgaaaggccatgaggaactctgcttcccctggtctccataagatgtgccctagtggctggcagaggagaagggaagctgccctgatccaacggctgcctgtgccatggtagataagtctaactaattctggcatctggcattctgtgtgagcaaaccaatgtggctaaaaggcctggagtc

SEQ ID NO: 156464 - DNA, 601 bp, Human
gttaccattagcgtcaaattattttggcgtctctcaaaacacatccatgtctcctaatcctccacccctctgcagtccactgtaattgttggtcctgttaaagtagaaagtggtgtttctcaaacatgcatgatcctaagaacctcgagagggtattgctaaatgtgtggattcccaagctattatcgtgaaaatctagggtccagaaatatgtattgttttatcaagtgcctccaaagaaactcttatgattggagaaactggaaaatcactggtgtaaagcagactggctttggaaatyaaggactacactagtaccacagaccagctgtgactttaagcatgccccttacatccaacctcacaggacctcaggagtattcaaggcaatgatagactggacggtacgtagcactatgaccggtaagtgtgggtgttcgtaaatgtatgcttatctcttcttggtccacaagaaagaaatgcagagaatacctggattctcaggttaggcacattggacaacaataagaatgtaaaacacaggaaataatgtgacatattggctctagaggcatctgcaaagtcctactctgtgacaaag

SEQ ID NO: 156465 - DNA, 601 bp, Human
gttctgatgaaacttcacaaggtttcatagggaagtaaaggactataatatatgcaagctccaccccagttaacactgccatcagtaacagttgcttactgctggctgtaagtcagagggggatacaggaaatttcttctatatccagtggaagcgattccacttattttctctctcacttgaggaagcacactgtaatatgaggtaacctcaaattcattctaatttgaaaaaagtgataaacgggccatatattttcattggatagtgtagttaccattagcgtcaaattattttggcrtctctcaaaacacatccatgtctcctaatcctccacccctctgcagtccactgtaattgttggtcctgttaaagtagaaagtggtgtttctcaaacatgcatgatcctaagaacctcgagagggtattgctaaatgtgtggattcccaagctattatcgtgaaaatctagggtccagaaatatgtattgttttatcaagtgcctccaaagaaactcttatgattggagaaactggaaaatcactggtgtaaagcagactggctttggaaatcaaggactacactagtaccacagaccagc

SEQ ID NO: 156466 - DNA, 601 bp, Human
ctcacaaaacactctctgatcggtgtacagaaggttctgatgaaacttcacaaggtttcatagggaagtaaaggactataatatatgcaagctccaccccagttaacactgccatcagtaacagttgcttactgctggctgtaagtcagagggggatacaggaaatttcttctatatccagtggaagcgattccacttattttctctctcacttgaggaagcacactgtaatatgaggtaacctcaaattcattctaatttgaaaaaagtgataaacgggccatatattttcattggatartgtagttaccattagcgtcaaattattttggcgtctctcaaaacacatccatgtctcctaatcctccacccctctgcagtccactgtaattgttggtcctgttaaagtagaaagtggtgtttctcaaacatgcatgatcctaagaacctcgagagggtattgctaaatgtgtggattcccaagctattatcgtgaaaatctagggtccagaaatatgtattgttttatcaagtgcctccaaagaaactcttatgattggagaaactggaaaatcactggtgtaaagcagactggctttgg

SEQ ID NO: 156467 - DNA, 601 bp, Human
gcacaaagacccagaaaaactttcctttaagcctttatacaattttggcatgctctgaaatgtaattagagataagcacagatacatctcacgtcaccagccctaatgatcacggaggtgaaaactgaaggcaacttcagacggttcaagaacatccaacattttactgctgcagaatgtaaaatggatcatgctcacaaaacactctctgatcggtgtacagaaggttctgatgaaacttcacaaggtttcatagggaagtaaaggactataatatatgcaagctccaccccagttaacactgccatcagtaacagttgcttactgctggctgtaagtcagagggggatacaggaaatttcttctatatccagtggaagcgattccacttattttctctctcacttgaggaagcacactgtaatatgaggtaacctcaaattcattctaatttgaaaaaagtgataaacgggccatatattttcattggatagtgtagttaccattagcgtcaaattattttggcgtctctcaaaacacatccatgtctcctaatcctccacccctctgcagtccactgtaattgttggtcctgttaaag

SEQ ID NO: 156468 - DNA, 601 bp, Human
tgcacgtgattggctgtgcataagtgattacacagatcagaaaatgccccaaggtcaaaagtagagaggatggcatcgacactctccagctagcgggtacagatacccagcagctaaggccccactgctaaagaagagcaaatcaatttagtttcttttttttttggtttttttttttttgagaccaagttttgctcctgttgcccaggctagagtgcagtggtgcaatctcagctcactgcaacctccgcctcctgggttcaagtgattctcctgcctcagcctcctgactagctgagawtacaggtgcctgccaccgtgcctggctaattttttgtatttttagtagagacagggttttatcatgttggccaggctggtctcgaacccctgacctcaagtgatccaattgcctcggcctcccaaagtgctgggattacaggcttgagccaccgcgcctggcctagttttgtgtactctctctctttctcactcgctcatgctgtctctctctgtccctccctctttctctttctctcaaactcttttctttcattaccacaagcatgcgtagaaccaatataaaattaaacatctgctt

SEQ ID NO: 156469 - DNA, 601 bp, Human
ttttactctttaaaaagtatatatataattggaaatttatggtatataaatggttttgttaaaattaattagactcagggcactcacaacattgaatcattttaagttggcaaagaatgtaatgatgattatcaatttagtgtaccaggaagacatatacaatacattcttcgccttatattgaaatttaactcttagaaagacatatgtcctactgatctttatgatactgtggaactacaatagcttatagctagaaaactcttatttaaaattaccccactgagatgacagtgcatayattttacaactatttcttaattatgaagatggtatgttcaacaatgagcagataatttttcatagcttgactaacttttctcaatttcagttgcctacagtctcttggatggacacatttcaaggcaaatcacatgggcctttattcttaaagatacagcagagcaattagtccagcgtggtggcaggtgccctgtagtctcagctactcgggaggctgaggtaggagaatcgcttgaacccaggagatggaggttgcggtgaaccgaaattgcaccactgcactccagcctgggtgaca

SEQ ID NO: 156470 - DNA, 601 bp, Human
aggaatactcttgaagcctgggaatgcagctcaatgtggggaaaattggaatatagtttccaccaaattagtccaagagggatttattgaactcctatgatatgctgggttgaacatcatggaaacaatcatgactatgaaacttcccctactcttaaggagcttataggttaatgtaggtgatagagaggcagagatgatacaacttgaatggaaaatctgtgatatgagtcctggtaggaggagtatgattaacaatgcgtcataatggaagatgatgctaacaaaatgaggcaaatgstggttatggaggtctgagaaatttgagatgtaagacatcagtagagcctagcagaattttactctttaaaaagtatatatataattggaaatttatggtatataaatggttttgttaaaattaattagactcagggcactcacaacattgaatcattttaagttggcaaagaatgtaatgatgattatcaatttagtgtaccaggaagacatatacaatacattcttcgccttatattgaaatttaactcttagaaagacatatgtcctactgatctttatgatactgtggaactacaat

SEQ ID NO: 156471 - DNA, 601 bp, Human
agtgaataccaataagtctgctactgacctaagcctttttctcagtaggttaaaaggagaacacaacagtggttattagttgaggaatactcttgaagcctgggaatgcagctcaatgtggggaaaattggaatatagtttccaccaaattagtccaagagggatttattgaactcctatgatatgctgggttgaacatcatggaaacaatcatgactatgaaacttcccctactcttaaggagcttataggttaatgtaggtgatagagaggcagagatgatacaacttgaatggaaaayctgtgatatgagtcctggtaggaggagtatgattaacaatgcgtcataatggaagatgatgctaacaaaatgaggcaaatgctggttatggaggtctgagaaatttgagatgtaagacatcagtagagcctagcagaattttactctttaaaaagtatatatataattggaaatttatggtatataaatggttttgttaaaattaattagactcagggcactcacaacattgaatcattttaagttggcaaagaatgtaatgatgattatcaatttagtgtaccaggaagacatatacaa

SEQ ID NO: 156472 - DNA, 601 bp, Human
acaaagtacaagataaattcccaattggagctataaggttaggctttgaaaaatcttttattaaaacttaagatgaaattcccataacatacagttaatagctttaacatgcacaattcagggttgtttagtgcattcacagcgatgtgcagccattacctctacctacttcccaaacatttctgtcaccccaaaaggatggttggtttttaaacaccattctggaggcatgcagcagagaacaggctgaagtgtggtgaaaagaagtgggcaggcaaggtaggaggccacttcagaaccctaagggagaaatggccagcagagatggacgtggtcaagtctgagacgtaattcagacgtaacactggctggctggcagctcggctggatgtgggggtgcagggagatggagacgttctggccttgagcacagaggtgaggaacactggaggagggagaggcctggcaggaagttgtgggctccagtttgggatgtgttaacgtttgagattccaatcagacatcactatcaagaggcagctgggtgcatgagttgagtgctgcacaaaggtagaaatgtagagccttcagcatttaaatg

SEQ ID NO: 156473 - DNA, 601 bp, Human
ttttataatgtttcattccttcttggtggatcaatagcattaaataacaaagtacaagataaattcccaattggagctataaggttaggctttgaaaaatcttttattaaaacttaagatgaaattcccataacatacagttaatagctttaacatgcacaattcagggttgtttagtgcattcacagcgatgtgcagccattacctctacctacttcccaaacatttctgtcaccccaaaaggatggttggtttttaaacaccattctggaggcatgcagcagagaacaggctgaagtgyggtgaaaagaagtgggcaggcaaggtaggaggccacttcagaaccctaagggagaaatggccagcagagatggacgtggtcaagtctgagacgtaattcagacgtaacactggctggctggcagctcggctggatgtgggggtgcagggagatggagacgttctggccttgagcacagaggtgaggaacactggaggagggagaggcctggcaggaagttgtgggctccagtttgggatgtgttaacgtttgagattccaatcagacatcactatcaagaggcagctgggtgcatgagtt

SEQ ID NO: 156474 - DNA, 601 bp, Human
accatagttaattaaaaagaactttcagctttgaaactacttttacaactaatttttcttgcaagcatttaattctgccgacctctactaaaacacacatacacacacatacacacacacatacacacacacacagctacaaccttctgtgggaagcatggaagaaacatcagattgagatttggggtaatcaaaaaacccaattgttcatctattcaccacactaatttcatgactagatctttttttcagttacatcaaaattgtctgatactgtattagtccattttcatactgctaygaagaaatacctgagactgggtaatttataaagaaacagagatttaatggacttacaattccacgtggctgaggaggcctcacaaccatgggagaagacgaaggaggagcaaagggtcgtataacatggtggcaggcaagagaatcacgtgcaggggaactgccctttataaaaccatcagctcttgggagacttattcactatcatgagaacagtatgggaaaaacctgctcccacgattcaattacctcccatggggtccctcccatgacatgtggggattctgggagctacaattca

SEQ ID NO: 156475 - DNA, 601 bp, Human
agaaaagttgagttacctgtcaaagtcattcaacttttggggaaaatgaaggtcagataagagtctgactgtgatgcatatgaacaatcagacaaacgtcagacacataaatttgctatttgaattggagggaagagatgtggcgtgctatcctttcaagcagaatatatgaacacaagagaatgttctgcttttcatcttttgccagttcccttttcgcccaggtaatgtagcttgagaaatttaaagaaggcatttgagttcacagaaggaagaacattcagttttatatgtttttaaytgacagatacaattgtatgtatgtatcttcatacaacatgatattttgaagtatatacacgttgtgtaatgattaaccatagttaattaaaaagaactttcagctttgaaactacttttacaactaatttttcttgcaagcatttaattctgccgacctctactaaaacacacatacacacacatacacacacacatacacacacacacagctacaaccttctgtgggaagcatggaagaaacatcagattgagatttggggtaatcaaaaaacccaattgttcatctattcaccacact

SEQ ID NO: 156476 - DNA, 601 bp, Human
tggtggcagagtaaaaagagcaacagctttttcacagagcatcactgaactacatgtccaaaacaagaccacattgaaaaaaacacaacacaaattgtagccgaaaatatctaacatctttgagttcttgtcatgcactaggatttttgttaatcacctgcatgtattaacttgtgtaaaccttcaaccaagtccattttacagatgaggaaactgagacacagaaaagttgagttacctgtcaaagtcattcaacttttggggaaaatgaaggtcagataagagtctgactgtgatgcayatgaacaatcagacaaacgtcagacacataaatttgctatttgaattggagggaagagatgtggcgtgctatcctttcaagcagaatatatgaacacaagagaatgttctgcttttcatcttttgccagttcccttttcgcccaggtaatgtagcttgagaaatttaaagaaggcatttgagttcacagaaggaagaacattcagttttatatgtttttaactgacagatacaattgtatgtatgtatcttcatacaacatgatattttgaagtatatacacgttgtgtaatgattaacc

SEQ ID NO: 156477 - DNA, 601 bp, Human
ggacgcttgcttatccaagagtccccggattggagaccctgttatgcactggggccactttaaagagcatcttgggttctacggctttcaaagaaaagcaaagcaaccttgatgaagatatggtggcagagtaaaaagagcaacagctttttcacagagcatcactgaactacatgtccaaaacaagaccacattgaaaaaaacacaacacaaattgtagccgaaaatatctaacatctttgagttcttgtcatgcactaggatttttgttaatcacctgcatgtattaacttgtgtaaaycttcaaccaagtccattttacagatgaggaaactgagacacagaaaagttgagttacctgtcaaagtcattcaacttttggggaaaatgaaggtcagataagagtctgactgtgatgcatatgaacaatcagacaaacgtcagacacataaatttgctatttgaattggagggaagagatgtggcgtgctatcctttcaagcagaatatatgaacacaagagaatgttctgcttttcatcttttgccagttcccttttcgcccaggtaatgtagcttgagaaatttaaagaaggcatttg

SEQ ID NO: 156478 - DNA, 601 bp, Human
gaaagctcttcacacagtagtttttttaagtaattataattgaaaataatttgtatgtcagtgtttggtagtggccatctgtaaaagtcatgggttcatctttgatcacagcattttataaatgaaccatagaatttcatatttctcaggccccaagagatcaacagttaggaatacaaaattaggcttgcttagaactatagccttcctcaatgaccttgggtgtgcaagaactttgaaaaaatgtcaccaaagcaccaaggctgagttgtataatctctggaaagtggtcctggaactyttttcctaaaagttatgacagttaaagactatactcttttatctgacagctgtcatattcttctatgtgtaaaatgatttcttatactttgttgtgtttcttggtagttttgtgccctgaattacatacattaaataaagtaacttaagtttgacttttcaataaatagcataatgaggaagaggagagagagaaagtgaaagagagagagagagagatttaaagacaaaatacccccactatctgattaaaaaaaagtaaatgcaggaggtgaaatcaccataatttttggccctgggt

SEQ ID NO: 156479 - DNA, 601 bp, Human
ttctttagaattcttctattagatgtttaccaaaaaggcacaacagatcaggctctattaatggaaaatgatgcctgtcccaaactggatgcctatctgcaactggcaatgcagctactacaagaagtagaaagctcttcacacagtagtttttttaagtaattataattgaaaataatttgtatgtcagtgtttggtagtggccatctgtaaaagtcatgggttcatctttgatcacagcattttataaatgaaccatagaatttcatatttctcaggccccaagagatcaacagttagsaatacaaaattaggcttgcttagaactatagccttcctcaatgaccttgggtgtgcaagaactttgaaaaaatgtcaccaaagcaccaaggctgagttgtataatctctggaaagtggtcctggaacttttttcctaaaagttatgacagttaaagactatactcttttatctgacagctgtcatattcttctatgtgtaaaatgatttcttatactttgttgtgtttcttggtagttttgtgccctgaattacatacattaaataaagtaacttaagtttgacttttcaataaatagca

SEQ ID NO: 156480 - DNA, 601 bp, Human
acttgagtagctaggacttcatgcacgtgctaccatacctgactttttttttttttttttggtagagacaaggtcttactatgttgttcagccaggtctagaattcctggactcaagtgatcctgccgcctcagcctcccaaagtgctgggattacaggcaggagccactatgcctgaccctcacctaaatttttgattagtttaaaaaataaccttcacttttgttttcagagcctgaattaattttatttaaaatcagttaatattacagacaaaagactataattgactgattttttwaaaaatgaaaatcaaaactcagatgtatctatgatctctcttttcattctaaaatggagtatacatatcctagtttctttagaattcttctattagatgtttaccaaaaaggcacaacagatcaggctctattaatggaaaatgatgcctgtcccaaactggatgcctatctgcaactggcaatgcagctactacaagaagtagaaagctcttcacacagtagtttttttaagtaattataattgaaaataatttgtatgtcagtgtttggtagtggccatctgtaaaagtcatgggttc

SEQ ID NO: 156481 - DNA, 601 bp, Human
aagtgatcctcccacctccgccacttgagtagctaggacttcatgcacgtgctaccatacctgactttttttttttttttttggtagagacaaggtcttactatgttgttcagccaggtctagaattcctggactcaagtgatcctgccgcctcagcctcccaaagtgctgggattacaggcaggagccactatgcctgaccctcacctaaatttttgattagtttaaaaaataaccttcacttttgttttcagagcctgaattaattttatttaaaatcagttaatattacagacaaaakactataattgactgatttttttaaaaatgaaaatcaaaactcagatgtatctatgatctctcttttcattctaaaatggagtatacatatcctagtttctttagaattcttctattagatgtttaccaaaaaggcacaacagatcaggctctattaatggaaaatgatgcctgtcccaaactggatgcctatctgcaactggcaatgcagctactacaagaagtagaaagctcttcacacagtagtttttttaagtaattataattgaaaataatttgtatgtcagtgtttggtagtggc

SEQ ID NO: 156482 - DNA, 601 bp, Human
aggctcaaaccaagcccaaaggaaagctgggcttcattcattttaaataaatgtttataaaaatgtatttacaattaattagtgaattaaggcatctacttagtgtatttatgaggatttattttaaacaaatttgtcatttcttttgggagtgacagtttgtgtacctggggggagggggaggaaaaaggagaagaatggggacaaaaaagttctttttttttttttttttgagatggagtcttgctctgtcacccaggctggagtgcagtggtgtgatctcggctcactgcaagctctscctcctggattcacgtcattctcctgccccagcctcccaagtagctgggactacaggcgtgcaccaccacgcccggctaaattttttgtatttttagtagagacggggtttcaccatcttagccaggatggtctcgatctcctgacctcatgatccacccgctttggcctcccaaagtgctgggattacaggcccgccaccacgcccggccaaaaaaagttcattttttaaaaaaaccagagttaggcttggttgatggtgggagtgggagggggaggggtataaaggggctgtcaccac

SEQ ID NO: 156483 - DNA, 601 bp, Human
tctttcttttattatttccatccaatagctttcctttatcagtgtaaaattattgctgttccaaatataattttgaaagtttaattgcgaagacatttacgtatactaaagatatttaaaaatatagtttatttttatttcaggcacagaatggctcttttccttgatattatccatattcatgagcaatgattggtttaataaaaattccttaataaaaccttaattactttcatttgcttctttataatgctttaatacagggtaattgtagtttctttttactgaaagagatgaagastatcttggttaaaaaaaccccagatgaacaaaaagaatgttttaataaaagcaagttttaaatgatggtagaatcaaacactgcctggtggctatgcaggactttacgacagcccactggcttgctttcagctctttagacgtagcatgaatcctctcatgtgggtgaggctcaaaccaagcccaaaggaaagctgggcttcattcattttaaataaatgtttataaaaatgtatttacaattaattagtgaattaaggcatctacttagtgtatttatgaggatttattttaaacaaat

SEQ ID NO: 156484 - DNA, 601 bp, Human
ccatcctccaacagggtcccaggcataaaatgaaagcagacacttgtctgaatgcccatcgtatgcagaacacagagctacagaatccctggcatacagaatatgccctgacaaacatgaaccaaacaagcactaaagaaaaataaaaaataacagctggatggtatgatcttataggatgccatgtgctgtaagcatcgaaacttctgtaagtattatagcgttagcaaaatgacgtcatgcctagagaaaataaaacagcagctgcaagatgtaatttcacaaataataaatccaaacragaatagaaaaatgttatttaagtgggattatttactttgaatctacagaaattccatttttagctagtagagaaaaatttatagcactgaaacatattaatctgctttgtattaaaaggcttatctctggtgcttcatttgggtaattttcttatattaactccctgataattctaaattagcccaggtaatactaaaatttcaatctgaggaaaaactataaaactgatgggattcacaccaattttcagcattcataacaaattaccctgtttgtttatatctgaggataacatgaa

SEQ ID NO: 156485 - DNA, 601 bp, Human
accagctgcatggggtcgtcaaaattttgagttttggttagattacctggacatgagacaggtttaagcatagaagcagcagtttctggagacaactgagatgaagatttatatcatctggcaggagttcaagtgggaaacaactgggaattccacatctttcctgctacacacacacacacacacacacacacacatacagacacacacacacacatgtcttgactgacggaagagagattagtggagagaactggacgtatctaggcatcctctgaacaaatggaaaataaattttttsctcaaacttttacttcactcctccctccccttttccatagtggtttaaaatatgtccacaaattcttggacatttccttcaaatggtggagcctaattcttctctccatgagtggggatttgatttagtgactcatttgtgaccaatgaaacatggtggaagtgactgtgacttgagactatgtcattaaaaaggctttgtggctccctccaaaccctctctcagattgttatttgaggggaagccaattgtcatgccatcatgaggatcctcaggcagccttatagagagaccagcatg

SEQ ID NO: 156486 - DNA, 601 bp, Human
atcaagcaactttatcacctcttgatgaagtcttggtaaagtggatggaacgcggcagattttcttgagggggaattcagcaaaccagctgcatggggtcgtcaaaattttgagttttggttagattacctggacatgagacaggtttaagcatagaagcagcagtttctggagacaactgagatgaagatttatatcatctggcaggagttcaagtgggaaacaactgggaattccacatctttcctgctacacacacacacacacacacacacacacatacagacacacacacacacaygtcttgactgacggaagagagattagtggagagaactggacgtatctaggcatcctctgaacaaatggaaaataaattttttcctcaaacttttacttcactcctccctccccttttccatagtggtttaaaatatgtccacaaattcttggacatttccttcaaatggtggagcctaattcttctctccatgagtggggatttgatttagtgactcatttgtgaccaatgaaacatggtggaagtgactgtgacttgagactatgtcattaaaaaggctttgtggctccctccaaaccc

SEQ ID NO: 156487 - DNA, 601 bp, Human
ctgcaatgaatctctatcaagcaactttatcacctcttgatgaagtcttggtaaagtggatggaacgcggcagattttcttgagggggaattcagcaaaccagctgcatggggtcgtcaaaattttgagttttggttagattacctggacatgagacaggtttaagcatagaagcagcagtttctggagacaactgagatgaagatttatatcatctggcaggagttcaagtgggaaacaactgggaattccacatctttcctgctacacacacacacacacacacacacacacatacagacacacacacacacatgtcttgactgacggaagagagattagtggagagaactggacgtatctaggcatcctctgaacaaatggaaaataaattttttcctcaaacttttacttcactcctccctccccttttccatagtggtttaaaatatgtccacaaattcttggacatttccttcaaatggtggagcctaattcttctctccatgagtggggatttgatttagtgactcatttgtgaccaatgaaacatggtggaagtgactgtgacttgagactatgtcattaaaaaggctttgtg

SEQ ID NO: 156488 - DNA, 601 bp, Human
tacaactgcaatgaatctctatcaagcaactttatcacctcttgatgaagtcttggtaaagtggatggaacgcggcagattttcttgagggggaattcagcaaaccagctgcatggggtcgtcaaaattttgagttttggttagattacctggacatgagacaggtttaagcatagaagcagcagtttctggagacaactgagatgaagatttatatcatctggcaggagttcaagtgggaaacaactgggaattccacatctttcctgctacacacacacacacacacacacacacacakacagacacacacacacacatgtcttgactgacggaagagagattagtggagagaactggacgtatctaggcatcctctgaacaaatggaaaataaattttttcctcaaacttttacttcactcctccctccccttttccatagtggtttaaaatatgtccacaaattcttggacatttccttcaaatggtggagcctaattcttctctccatgagtggggatttgatttagtgactcatttgtgaccaatgaaacatggtggaagtgactgtgacttgagactatgtcattaaaaaggct

SEQ ID NO: 156489 - DNA, 601 bp, Human
ttattacaactgcaatgaatctctatcaagcaactttatcacctcttgatgaagtcttggtaaagtggatggaacgcggcagattttcttgagggggaattcagcaaaccagctgcatggggtcgtcaaaattttgagttttggttagattacctggacatgagacaggtttaagcatagaagcagcagtttctggagacaactgagatgaagatttatatcatctggcaggagttcaagtgggaaacaactgggaattccacatctttcctgctacacacacacacacacacacacacayacatacagacacacacacacacatgtcttgactgacggaagagagattagtggagagaactggacgtatctaggcatcctctgaacaaatggaaaataaattttttcctcaaacttttacttcactcctccctccccttttccatagtggtttaaaatatgtccacaaattcttggacatttccttcaaatggtggagcctaattcttctctccatgagtggggatttgatttagtgactcatttgtgaccaatgaaacatggtggaagtgactgtgacttgagactatgtcattaaaaa

SEQ ID NO: 156490 - DNA, 601 bp, Human
aaaaattgaggcttataaatgttttaaaatatgggtgacatattttgctgtatggtatatatcctttaaaaactaaatagcaggcagggtgcaatggctcacacctgtaatatcagcactttgggaggctgaggcaggtggatcacgaggtcaggagctcgagaccagcctgggcaacatggcaaaaccccatctctactaaaaatacaaaaagtagctgggtgtggtggcgtgtgcttataatcccagctacttgggagtctggggcaggagaattgcttgaacctgggagtgggggggkgttgcagtgagctgagatcgtgccactgtactccagcctgggtgacagagcaaggttccatctcgggaaagcaagcaagcaaacaaacaaacaaaatagcagagagaaacctttgcatttttttacatgcagtgagtatgaaaatctcaaggctttctatgagaatacagctatttttactgttttcttacaaacagaaaagaaatagggaaagggaggaaggaaatcaaagaaaacctaaaggccaaatctagtacctgacaagaagtgaaagaatggaaaggcagatgcagtctggaa

SEQ ID NO: 156491 - DNA, 601 bp, Human
tgggtattagtgacagagactgtacagcccacaaaccataaacaatttacaaactgtccccttacagaaaaattttgtccaactgtgctttagtgaatttgaccattttatatacactttcatttgtgcttgtattgccattagtatcctaaattgagtacacaaaaagtgctcaatggtacacagaaggtgctcagaatatattctgatttggactgatttgaaatactaggaatattaacatatgcatctatcttgttttaaataaaacacaaagctgcttattcatccattgagaaaygttttgccaaagtttggtaatctaaataatcaaaatgacttcattcatttccagcctcacaaaaatgttaatttttagagtaaaataattgattttgcagttttaaatagtatattaaaaagaaattagtatctaccccagtatttgaggataactttcaggaataccatgttaagacatttgtgtctgctcttcaaagtatacaatgcgaaaatataggaacaaaatgtgcatttttttcattcccaaatccagactcaaaataccaatatctaaaaattgaggcttataaatgtttta

SEQ ID NO: 156492 - DNA, 601 bp, Human
atgtttatttccaaaatttgttttattggttccttgcgttgcacatgttgaactatccaaggacattaataatacaaatctgactgttaataactaaataagtgactataaaaataaagcaactataaagttcaataaaaatgtgactacagaggcaaactcaactgtctttagaaataccatttactggaaattttattgaagtgaatgcaaaggaaacaaaatgtttttagtgcccagcatgcataaaataatccttcagtacagggggttaacctgaaggcaaatctagcttctcttyttttatgaataaagttttattgaagcacagccatgtcggttcatttctaaattttttacatctgcttttgtcctatgaaggaatagctgggtattagtgacagagactgtacagcccacaaaccataaacaatttacaaactgtccccttacagaaaaattttgtccaactgtgctttagtgaatttgaccattttatatacactttcatttgtgcttgtattgccattagtatcctaaattgagtacacaaaaagtgctcaatggtacacagaaggtgctcagaatatattctgatttg

SEQ ID NO: 156493 - DNA, 601 bp, Human
cattctatttttctttgaaagaaagcctgtatacaccctgaacctaaacacgtaccatcactgcagatattggaaataaaacactatagttgtctttggaaatagaacttgtagcttatgtttttaatgagctttcgatatattttaacgaaatgcgattttgttccatctactgtgttatgaatagaacaaacagaacatgtttatttccaaaatttgttttattggttccttgcgttgcacatgttgaactatccaaggacattaataatacaaatctgactgttaataactaaataastgactataaaaataaagcaactataaagttcaataaaaatgtgactacagaggcaaactcaactgtctttagaaataccatttactggaaattttattgaagtgaatgcaaaggaaacaaaatgtttttagtgcccagcatgcataaaataatccttcagtacagggggttaacctgaaggcaaatctagcttctcttcttttatgaataaagttttattgaagcacagccatgtcggttcatttctaaattttttacatctgcttttgtcctatgaaggaatagctgggtattagtgac

SEQ ID NO: 156494 - DNA, 601 bp, Human
aaacaatcctgtatgtttcactttcaaaatatagattatttggctaggtgttttcaatcaccccttttgcccctatcccagcaatttcatccagcagagatttgcaactttggtacaaaatacaacacttttgggagcacagtttctagagtttagaagaatcatatcttggtaactactttccttcctaagagcaaaaattaaacaagacataaagttgattctaagaaatctcaatagattcctgatgatttttgtgaaaaacgcatcaggagagaatcacaagacatttgctactttyattatttaaaaaaccatttaatacaacaggccttattaaagagctatttctaagaattatagaatcttacagtcaaacagagaatttttaaaatgagaatttttaaaaaatggctacttgtgacagttaaccagatccctatgtatctgttatgaactctgcccaaccagtcagcctgcctggttgtgctatatgcatgatataatgtgaaattaccaagaactattgttttcggccaaagaaaatgacttattttgggttggaataaaaatgtttgtttttcaccttagacctaagaaa

SEQ ID NO: 156495 - DNA, 601 bp, Human
tcctttcaaacaccacgaagacatacttatgctactatattaatcagagagcattttaacagacagagctagccaggtccttattgattacacttctacaattgcttctgagacagttccttctgcagtcttcactagggaccctgacactgtgaaagtagggaatgctagcaagggaaaaacacttttaaatagttgtgaataagtgaaatagaaaaaaatcaggcatgggagttcagaagagcctacaattttagctttggaggagttatatttcttctggtgggacagatgtttgccmaaggataacagaatttaaggggttatgaaatggatgcctcagtagggggtttcagagtactgtatatttgccatatggtagcacctatccagagaaatcacgtcagatgttcatgatttcgtgactcagacgaaaagcagaattgtcagaggattcccattcctgcccatgaacgcatgtagatattcgtggaggcaggctcttatcttgctctgtgcacacacatttcacacaaacacataccgcctctcaagactggaggctgagagcattgggatgaatactcatgagatgacgatt

SEQ ID NO: 156496 - DNA, 601 bp, Human
ctcttacctagtatgacctgatcttcatgaactaattgtatctgcaaagaccttatttccaaataagatcacattctgaagttctgggtagacaagaattttgggggaagatttattcaacacaccgcagtgacttcagccaacatgagcttgtccagagagagcggagccagctcaatgttccctggttagcgttcagaccatggtccctcaacacatgtttttggttgaaggtgatgattatagcggccacaggttaagagatggatttgatcacacgatgtgcaaggaaacaacaatragtgcaaaactgaattgatttcaaggtctgaacctcactctatatgaaattcatttccctggaggactccttcatcataaaacaaaacagagaagactaacaaaataacctcatttattcttacatcctaagcctctccaacattttgccacatttgtttggggccatattttaaaatgttttttgttaaaaatggatgcttgaatctggcagaattggagcaaaaggaacaactagcaaaggggaagaaatgaagaagggagcattagtgtgcctgggattaggggtggtggggaagag

SEQ ID NO: 156497 - DNA, 601 bp, Human
atgacttctggctgtccatagtgtcagaaaaatccatgcaatgttcagaagctagttcaatgtcgggaggaaaaggaaaggttggctcataaataagagcagaacacacagaaatcagatccgtgtgtggggagaccctcatttcatggccatccagtcaagaggttggatatgaaccttctttggccgagacagccacatcttgacttgtagaactcaatcctgctacaggtagtgtttggttttgtagctaagctacagaggggaatggccttgtgcacagagaaaaacagaaaaacayctttgatctgggttgtttgttgagtgtgtgggcactgtttggggacaggcagcatctctgagttgtctatctcctcctcttctcagtgctgcatcctcaggcggctccttggcttcctagcttagcagcccctctcttattttcttactggagtgaccataatagattcccagggctgtcagaaccgagtaccacaaactgggtggcttaaaacaaccgaaacttattatctcacgttctggacgccagaaatctaaaatcaaggtgccagcagggccgtgctctctctgaaggctcttg

SEQ ID NO: 156498 - DNA, 601 bp, Human
agagtgtgattatcattaacattactttgtgaaggggcgtttctcaaggtcactctagaattagaggcaccgtgggaccaagcactcatccattttatgggttaaaatgactaattgagggtctgagtttaattacaatcgtaagcaaaggcacagtgcagatactttgacgggcttaataacattcttatgtacacaaagatagatggaaaaaattagggttgtatattgttgtcctttaggacaagatactgaagtgggaatagaataataaaaataaataaacgactcagcggcaccrggaaatgagctgtggaagttagccagccagccttatgcacatacttcagctggagataaagtcctaagtatccatgactaaatataatgcgactatacaggagtgcagatcacagttgttttattgagctagctgctagattaaaaggtaaaaaagtatgctctgcaagcttctacccatagttcaccctgaaatgatgataacagccacagcgggatctttaggatatgcatcggtgatattttaaatgggaaatgcagtcatgtttcacagaaaatccacaaagcatcaggtctgtac

SEQ ID NO: 156499 - DNA, 601 bp, Human
ttggagctttgtagccagagtgtgattatcattaacattactttgtgaaggggcgtttctcaaggtcactctagaattagaggcaccgtgggaccaagcactcatccattttatgggttaaaatgactaattgagggtctgagtttaattacaatcgtaagcaaaggcacagtgcagatactttgacgggcttaataacattcttatgtacacaaagatagatggaaaaaattagggttgtatattgttgtcctttaggacaagatactgaagtgggaatagaataataaaaataaataaacgactcagcggcaccgggaaatgagctgtggaagttagccagccagccttatgcacatacttcagctggagataaagtcctaagtatccatgactaaatataatgcgactatacaggagtgcagatcacagttgttttattgagctagctgctagattaaaaggtaaaaaagtatgctctgcaagcttctacccatagttcaccctgaaatgatgataacagccacagcgggatctttaggatatgcatcggtgatattttaaatgggaaatgcagtcatgtttcacagaaaatccacaa

SEQ ID NO: 156500 - DNA, 601 bp, Human
agtgagtaatttgttcatattaatggaaaaatccaaatattcatgtcttcataggaataatgactattcattcacgctgaaaagataaattaaatatttgcttgtccttttaaaagaagcccatatttgcaaccaaattacaggatacataatttaaaacaaatctcagttggagtgtgcaaattttcataattaagtagatcaaagtttgcagaaataagtgatgaaaactttaaaagggaatagcatgatgggggattttatattaatcatttatattcaaggagaaatcattatactstcactttttctagcttaggaaaacaaaatagtgtttgggaagaaattatccccaatactatttcagggaacaaaaatgccaggaagaactttggacaatgatactccttttggggaagaaaggccatctgaaagaaatgaaaaatgaagctttttcgaacttttcctaatggaaaagacagggcacatacaaaattcctaacagatacaaagctcaagggctacaagatagaaactttaagccagcttcaagtaaaaagcttttatacgtaaagaaagaatgtgttagtaagagagaggt

SEQ ID NO: 156501 - DNA, 601 bp, Human
ccagactcaagaaaaagaggatgtggggccagcagaatgtggagaagcgcagtgcagcacagatagcatccagctctgcatgctgacatcaggtggtggcaggtggtgaggcctctgaactgctgccttctttttttttttttttttttttttttttgacggggagttttgctcttgtcgcccaggctggagtgcagtagcatgatctcggctcactgcaacctctgcctctgggttcaagcaattctcctgcctcagactcctgagtagctgggattacaggtgcccgccagctcacccrgctaattttttatttttagtagagatggggtttcaccatgttggtcaggctggtctggaactcctgacctcaggtgatccacccgccttggcctctcaaagtgctgagatgacaggcgtgagccaccgcgtccagcctgaactgctgccttctgagtgcctttcatgcctctcattgctgatgttttccttcctccaacaggatcacatctacaagctggagatcttcacttaaggttcatcaacaggggcatggccccacgtggactctgcttgttctgtgagctgtactaactcacgg

SEQ ID NO: 156502 - DNA, 601 bp, Human
cgggtggaagggctcgtttctgctgctagttcgatctgcctgcaggcaggtgcatctgggcttggtggtctatggcactccttggcctttgtcttcacctgaattaaagtcttcatagctcagtaagttttaaagacagtggagggagcttccaggtccagtgaggtgagaagtgaggggagccctttctccagcagcgtccctgcctcatggtgctttggtgctgtctttctgggctgctgtccccttctgtccccgtgggagtgggaagctgctcagacaggcagctctaccttcccamggcctctgtgttagctctggggatcccggctgggtgcttgggaggaaacaggaggctattctgcctcaatgatttcccctcaaacaggaatgctccctgggaaatcctaagaagccctggcattggtttctttgtgagcctgttaccgcaggagctggcagaggatgctctgcttcatctgactcttaatctatttcagctgcttaggagtgacaggggtcaaggacaaatgacatttaatcatgtgtggtagccagtgctgcctgcagaggagaaatcagtaaagttcctttgtgttct

SEQ ID NO: 156503 - DNA, 601 bp, Human
tgccgagttgttcacttttaaatggctaatttgatgttatgtaaatttattctgaattagtttgaatgaaagggatagaaaggataggggaggaaatgcctgggaggtggagggtcataatctggtcataacagaaggtgttgccgggtggaagggctcgtttctgctgctagttcgatctgcctgcaggcaggtgcatctgggcttggtggtctatggcactccttggcctttgtcttcacctgaattaaagtcttcatagctcagtaagttttaaagacagtggagggagcttccaggyccagtgaggtgagaagtgaggggagccctttctccagcagcgtccctgcctcatggtgctttggtgctgtctttctgggctgctgtccccttctgtccccgtgggagtgggaagctgctcagacaggcagctctaccttcccaaggcctctgtgttagctctggggatcccggctgggtgcttgggaggaaacaggaggctattctgcctcaatgatttcccctcaaacaggaatgctccctgggaaatcctaagaagccctggcattggtttctttgtgagcctgttaccgcaggagct

SEQ ID NO: 156504 - DNA, 601 bp, Human
tcatagagaaagagcacagactggtaattgccagggcctgggcaaggcagaatgggagtaactgcttaatgaatatggggttttcttttagggtgatgaaaatattttggaactaggtagatgtcattttcaacacactttgaacgtaccaaatgctgccgagttgttcacttttaaatggctaatttgatgttatgtaaatttattctgaattagtttgaatgaaagggatagaaaggataggggaggaaatgcctgggaggtggagggtcataatctggtcataacagaaggtgttgcygggtggaagggctcgtttctgctgctagttcgatctgcctgcaggcaggtgcatctgggcttggtggtctatggcactccttggcctttgtcttcacctgaattaaagtcttcatagctcagtaagttttaaagacagtggagggagcttccaggtccagtgaggtgagaagtgaggggagccctttctccagcagcgtccctgcctcatggtgctttggtgctgtctttctgggctgctgtccccttctgtccccgtgggagtgggaagctgctcagacaggcagctctaccttcccaa

SEQ ID NO: 156505 - DNA, 601 bp, Human
tctaaaacatgctacaacaatgatgaaccttgaacacatcatgctaagtgaaggaagccagtcataaaagtcatctattgtaggatcctatttatatgaaatatgcagaagagatagattcatagagaaagagcacagactggtaattgccagggcctgggcaaggcagaatgggagtaactgcttaatgaatatggggttttcttttagggtgatgaaaatattttggaactaggtagatgtcattttcaacacactttgaacgtaccaaatgctgccgagttgttcacttttaaatggytaatttgatgttatgtaaatttattctgaattagtttgaatgaaagggatagaaaggataggggaggaaatgcctgggaggtggagggtcataatctggtcataacagaaggtgttgccgggtggaagggctcgtttctgctgctagttcgatctgcctgcaggcaggtgcatctgggcttggtggtctatggcactccttggcctttgtcttcacctgaattaaagtcttcatagctcagtaagttttaaagacagtggagggagcttccaggtccagtgaggtgagaagtgaggggag

SEQ ID NO: 156506 - DNA, 601 bp, Human
gaagagtgatacaaagacagatggccataataattcagcagttgaaaaaaaaaaaaaaactttttcagaatgaggcgacaacatgaaacgaaggtaatgtgagaaaaagagaagaataggcccagataatgtaatggaggtgaacatacagaaaaaaaaggaagagctgtgaaaagcagttggcggttttcaaaaagtgatacagagttaccatacaatccatcaattctgcttctaggtatatacccaaaataattgaaatgggtatgtaaacaaatacaatagccgaagagtgaacacmgctcacatgtccatcaatggataagtggatacacaaaatgtgctatatccatgcaggggaatattattcagccacataaaggactgaagttctaaaacatgctacaacaatgatgaaccttgaacacatcatgctaagtgaaggaagccagtcataaaagtcatctattgtaggatcctatttatatgaaatatgcagaagagatagattcatagagaaagagcacagactggtaattgccagggcctgggcaaggcagaatgggagtaactgcttaatgaatatggggttttcttttag

SEQ ID NO: 156507 - DNA, 601 bp, Human
tcctaaggactcaagaagagtgatacaaagacagatggccataataattcagcagttgaaaaaaaaaaaaaaactttttcagaatgaggcgacaacatgaaacgaaggtaatgtgagaaaaagagaagaataggcccagataatgtaatggaggtgaacatacagaaaaaaaaggaagagctgtgaaaagcagttggcggttttcaaaaagtgatacagagttaccatacaatccatcaattctgcttctaggtatatacccaaaataattgaaatgggtatgtaaacaaatacaatagcygaagagtgaacacagctcacatgtccatcaatggataagtggatacacaaaatgtgctatatccatgcaggggaatattattcagccacataaaggactgaagttctaaaacatgctacaacaatgatgaaccttgaacacatcatgctaagtgaaggaagccagtcataaaagtcatctattgtaggatcctatttatatgaaatatgcagaagagatagattcatagagaaagagcacagactggtaattgccagggcctgggcaaggcagaatgggagtaactgcttaatgaatatg

SEQ ID NO: 156508 - DNA, 601 bp, Human
gtttctaccataggggcagtccccaggtctgcaccagctaggggtttctatgagcagatccttagtctgccacttggcgggttagaaagtcatgctgtcagcccagtgttgtcaccagtaaacagactatttaagttccatttgtctgttttcattgtcttatttttcaattagtcctaaacttgggagaagaaaagggtgcatttattgggcccctcagtcctaaaatacggattttaaggaggcatcaaggaggcatcagggaggcaacggagggtcggggagctcgggaaggtttggsaagtggcttgagctcccactgcctccggtccacctgcaggctacccgaccagagcctggtctccccacttggactcacctgtgcttcctctgaggatctgtcacatgctctccttgtctcctggggcacaaagggctgagtgagtcagggtaagggttactgtgaccaccagcagaggagatgtcaaggccttgggggtctaccttttggtccacagaaatggaagcagagaatgaggtcttaggggacaacaggtatcctttgagttggtgggaagaagctgtatttctctcaagggac

SEQ ID NO: 156509 - DNA, 601 bp, Human
ggcagtccccaggtctgcaccagctaggggtttctaccataggggcagtccccaggtctgcaccagctaggggtttctatgagcagatccttagtctgccacttggcgggttagaaagtcatgctgtcagcccagtgttgtcaccagtaaacagactatttaagttccatttgtctgttttcattgtcttatttttcaattagtcctaaacttgggagaagaaaagggtgcatttattgggcccctcagtcctaaaatacggattttaaggaggcatcaaggaggcatcagggaggcaacrgagggtcggggagctcgggaaggtttgggaagtggcttgagctcccactgcctccggtccacctgcaggctacccgaccagagcctggtctccccacttggactcacctgtgcttcctctgaggatctgtcacatgctctccttgtctcctggggcacaaagggctgagtgagtcagggtaagggttactgtgaccaccagcagaggagatgtcaaggccttgggggtctaccttttggtccacagaaatggaagcagagaatgaggtcttaggggacaacaggtatcctttgagttggt

SEQ ID NO: 156510 - DNA, 601 bp, Human
tttgtcagcttttcaaatcccaggttttccataggggcagtcgccaggtctacaccagctaggggtttctaccataggggcttgtccccaggtctgcaccagctaggggttcctaccataggggcagtccccaggtctacaccagctaggggtttctaccataggggcttgtccccaggtctgcaccagctaggggtttctaccataggggcagtccccaggtctgcaccagctaggggtttctaccataggggcagtccccaggtctgcaccagctaggggtttctatgagcagatccttagtctgccacttggcgggttagaaagtcatgctgtcagcccagtgttgtcaccagtaaacagactatttaagttccatttgtctgttttcattgtcttatttttcaattagtcctaaacttgggagaagaaaagggtgcatttattgggcccctcagtcctaaaatacggattttaaggaggcatcaaggaggcatcagggaggcaacggagggtcggggagctcgggaaggtttgggaagtggcttgagctcccactgcctccggtccacctgcaggctacccgaccagagcctggtct

SEQ ID NO: 156511 - DNA, 601 bp, Human
gtttgtcagcttttcaaatcccaggttttccataggggcagtcgccaggtctacaccagctaggggtttctaccataggggcttgtccccaggtctgcaccagctaggggttcctaccataggggcagtccccaggtctacaccagctaggggtttctaccataggggcttgtccccaggtctgcaccagctaggggtttctaccataggggcagtccccaggtctgcaccagctaggggtttctaccataggggcagtccccaggtctgcaccagctaggggtttctatgagcagatccctagtctgccacttggcgggttagaaagtcatgctgtcagcccagtgttgtcaccagtaaacagactatttaagttccatttgtctgttttcattgtcttatttttcaattagtcctaaacttgggagaagaaaagggtgcatttattgggcccctcagtcctaaaatacggattttaaggaggcatcaaggaggcatcagggaggcaacggagggtcggggagctcgggaaggtttgggaagtggcttgagctcccactgcctccggtccacctgcaggctacccgaccagagcctggtc

SEQ ID NO: 156512 - DNA, 601 bp, Human
ggtttgtcagcttttcaaatcccaggttttccataggggcagtcgccaggtctacaccagctaggggtttctaccataggggcttgtccccaggtctgcaccagctaggggttcctaccataggggcagtccccaggtctacaccagctaggggtttctaccataggggcttgtccccaggtctgcaccagctaggggtttctaccataggggcagtccccaggtctgcaccagctaggggtttctaccataggggcagtccccaggtctgcaccagctaggggtttctatgagcagatcattagtctgccacttggcgggttagaaagtcatgctgtcagcccagtgttgtcaccagtaaacagactatttaagttccatttgtctgttttcattgtcttatttttcaattagtcctaaacttgggagaagaaaagggtgcatttattgggcccctcagtcctaaaatacggattttaaggaggcatcaaggaggcatcagggaggcaacggagggtcggggagctcgggaaggtttgggaagtggcttgagctcccactgcctccggtccacctgcaggctacccgaccagagcctggt

SEQ ID NO: 156513 - DNA, 601 bp, Human
ggtgggtttgtcagcttttcaaatcccaggttttccataggggcagtcgccaggtctacaccagctaggggtttctaccataggggcttgtccccaggtctgcaccagctaggggttcctaccataggggcagtccccaggtctacaccagctaggggtttctaccataggggcttgtccccaggtctgcaccagctaggggtttctaccataggggcagtccccaggtctgcaccagctaggggtttctaccataggggcagtccccaggtctgcaccagctaggggtttctatgagcagatccttagtctgccacttggcgggttagaaagtcatgctgtcagcccagtgttgtcaccagtaaacagactatttaagttccatttgtctgttttcattgtcttatttttcaattagtcctaaacttgggagaagaaaagggtgcatttattgggcccctcagtcctaaaatacggattttaaggaggcatcaaggaggcatcagggaggcaacggagggtcggggagctcgggaaggtttgggaagtggcttgagctcccactgcctccggtccacctgcaggctacccgaccagagcc

SEQ ID NO: 156514 - DNA, 601 bp, Human
tgggtgggtttgtcagcttttcaaatcccaggttttccataggggcagtcgccaggtctacaccagctaggggtttctaccataggggcttgtccccaggtctgcaccagctaggggttcctaccataggggcagtccccaggtctacaccagctaggggtttctaccataggggcttgtccccaggtctgcaccagctaggggtttctaccataggggcagtccccaggtctgcaccagctaggggtttctaccataggggcagtccccaggtctgcaccagctaggggtttctatgagcagatccttagtctgccacttggcgggttagaaagtcatgctgtcagcccagtgttgtcaccagtaaacagactatttaagttccatttgtctgttttcattgtcttatttttcaattagtcctaaacttgggagaagaaaagggtgcatttattgggcccctcagtcctaaaatacggattttaaggaggcatcaaggaggcatcagggaggcaacggagggtcggggagctcgggaaggtttgggaagtggcttgagctcccactgcctccggtccacctgcaggctacccgaccagag

SEQ ID NO: 156515 - DNA, 601 bp, Human
ttgggtgggtttgtcagcttttcaaatcccaggttttccataggggcagtcgccaggtctacaccagctaggggtttctaccataggggcttgtccccaggtctgcaccagctaggggttcctaccataggggcagtccccaggtctacaccagctaggggtttctaccataggggcttgtccccaggtctgcaccagctaggggtttctaccataggggcagtccccaggtctgcaccagctaggggtttctaccataggggcagtccccaggtctgcaccagctaggggtttctatgatcagatccttagtctgccacttggcgggttagaaagtcatgctgtcagcccagtgttgtcaccagtaaacagactatttaagttccatttgtctgttttcattgtcttatttttcaattagtcctaaacttgggagaagaaaagggtgcatttattgggcccctcagtcctaaaatacggattttaaggaggcatcaaggaggcatcagggaggcaacggagggtcggggagctcgggaaggtttgggaagtggcttgagctcccactgcctccggtccacctgcaggctacccgaccaga

SEQ ID NO: 156516 - DNA, 601 bp, Human
tgttgggtgggtttgtcagcttttcaaatcccaggttttccataggggcagtcgccaggtctacaccagctaggggtttctaccataggggcttgtccccaggtctgcaccagctaggggttcctaccataggggcagtccccaggtctacaccagctaggggtttctaccataggggcttgtccccaggtctgcaccagctaggggtttctaccataggggcagtccccaggtctgcaccagctaggggtttctaccataggggcagtccccaggtctgcaccagctaggggtttctatgagcagatccttagtctgccacttggcgggttagaaagtcatgctgtcagcccagtgttgtcaccagtaaacagactatttaagttccatttgtctgttttcattgtcttatttttcaattagtcctaaacttgggagaagaaaagggtgcatttattgggcccctcagtcctaaaatacggattttaaggaggcatcaaggaggcatcagggaggcaacggagggtcggggagctcgggaaggtttgggaagtggcttgagctcccactgcctccggtccacctgcaggctacccgacca

SEQ ID NO: 156517 - DNA, 601 bp, Human
atgttgggtgggtttgtcagcttttcaaatcccaggttttccataggggcagtcgccaggtctacaccagctaggggtttctaccataggggcttgtccccaggtctgcaccagctaggggttcctaccataggggcagtccccaggtctacaccagctaggggtttctaccataggggcttgtccccaggtctgcaccagctaggggtttctaccataggggcagtccccaggtctgcaccagctaggggtttctaccataggggcagtccccaggtctgcaccagctaggggtttctaagagcagatccttagtctgccacttggcgggttagaaagtcatgctgtcagcccagtgttgtcaccagtaaacagactatttaagttccatttgtctgttttcattgtcttatttttcaattagtcctaaacttgggagaagaaaagggtgcatttattgggcccctcagtcctaaaatacggattttaaggaggcatcaaggaggcatcagggaggcaacggagggtcggggagctcgggaaggtttgggaagtggcttgagctcccactgcctccggtccacctgcaggctacccgacc

SEQ ID NO: 156518 - DNA, 601 bp, Human
gatgttgggtgggtttgtcagcttttcaaatcccaggttttccataggggcagtcgccaggtctacaccagctaggggtttctaccataggggcttgtccccaggtctgcaccagctaggggttcctaccataggggcagtccccaggtctacaccagctaggggtttctaccataggggcttgtccccaggtctgcaccagctaggggtttctaccataggggcagtccccaggtctgcaccagctaggggtttctaccataggggcagtccccaggtctgcaccagctaggggtttctctgagcagatccttagtctgccacttggcgggttagaaagtcatgctgtcagcccagtgttgtcaccagtaaacagactatttaagttccatttgtctgttttcattgtcttatttttcaattagtcctaaacttgggagaagaaaagggtgcatttattgggcccctcagtcctaaaatacggattttaaggaggcatcaaggaggcatcagggaggcaacggagggtcggggagctcgggaaggtttgggaagtggcttgagctcccactgcctccggtccacctgcaggctacccgac

SEQ ID NO: 156519 - DNA, 601 bp, Human
tgagatttttgcacttgttggagctaagctataatacaggaccagggactgtgggagtcagtgatgttgggtgggtttgtcagcttttcaaatcccaggttttccataggggcagtcgccaggtctacaccagctaggggtttctaccataggggcttgtccccaggtctgcaccagctaggggttcctaccataggggcagtccccaggtctacaccagctaggggtttctaccataggggcttgtccccaggtctgcaccagctaggggtttctaccataggggcagtccccaggtctrcaccagctaggggtttctaccataggggcagtccccaggtctgcaccagctaggggtttctatgagcagatccttagtctgccacttggcgggttagaaagtcatgctgtcagcccagtgttgtcaccagtaaacagactatttaagttccatttgtctgttttcattgtcttatttttcaattagtcctaaacttgggagaagaaaagggtgcatttattgggcccctcagtcctaaaatacggattttaaggaggcatcaaggaggcatcagggaggcaacggagggtcggggagctc

SEQ ID NO: 156520 - DNA, 601 bp, Human
aactaactttatcagcaatgaacttatttccaaataaggtcacattcttcagtagttggggttaggactgcaaaatgtgaatcttggagggaggtataattttactcaaaacagcccctaataaggagagtgaatcatttgactggtgggtgatgaagctctggcattggctgagatttttgcacttgttggagctaagctataatacaggaccagggactgtgggagtcagtgatgttgggtgggtttgtcagcttttcaaatcccaggttttccataggggcagtcgccaggtctacascagctaggggtttctaccataggggcttgtccccaggtctgcaccagctaggggttcctaccataggggcagtccccaggtctacaccagctaggggtttctaccataggggcttgtccccaggtctgcaccagctaggggtttctaccataggggcagtccccaggtctgcaccagctaggggtttctaccataggggcagtccccaggtctgcaccagctaggggtttctatgagcagatccttagtctgccacttggcgggttagaaagtcatgctgtcagcccagtgttgtcacca

SEQ ID NO: 156521 - DNA, 601 bp, Human
tgacttcatctaaactaactttatcagcaatgaacttatttccaaataaggtcacattcttcagtagttggggttaggactgcaaaatgtgaatcttggagggaggtataattttactcaaaacagcccctaataaggagagtgaatcatttgactggtgggtgatgaagctctggcattggctgagatttttgcacttgttggagctaagctataatacaggaccagggactgtgggagtcagtgatgttgggtgggtttgtcagcttttcaaatcccaggttttccataggggcagtcsccaggtctacaccagctaggggtttctaccataggggcttgtccccaggtctgcaccagctaggggttcctaccataggggcagtccccaggtctacaccagctaggggtttctaccataggggcttgtccccaggtctgcaccagctaggggtttctaccataggggcagtccccaggtctgcaccagctaggggtttctaccataggggcagtccccaggtctgcaccagctaggggtttctatgagcagatccttagtctgccacttggcgggttagaaagtcatgctgtcagccca

SEQ ID NO: 156522 - DNA, 601 bp, Human
atgcccggctaatttttgtatttttagtagagacggggtttcaccgtgttagccaggatggtctcgatctcctgacctcgtgatccgcccgtctcggcctcccaaagtgctgggattacaaaatttaaactcttttattagccaactggtcttgggcaacacacttaacatcataccctcagtttattcatctataaagtgggctgatgttttagaaggattagatgaggcagtgtgtgatgcatgcaggagccagacctatttcctccttcccccttgacttctgctcactcaggcataygtgcccgagcaaagggcagaggaacccatttaacaaagagaaaataagaacaatatgtgtaaagcacctaatgtcatgcacagagggctatcctattattcagctaataccccattagctctgggaaaggtgaacctcttttcctagctttattttcctagaaactctccatgacttcccctacccttcctatacacttgcacccctgtactagtttgctagagctgctgtaaaacattaccacaagctgggtggcttaagcaacagaaatgtattgtttcacagttcaagatcaaggtg

SEQ ID NO: 156523 - DNA, 601 bp, Human
agggagaaaaaactgtttagggataggagaaaacagatggatgccttaggccagctgtgtctgcactcaggagcccaggttggcagcagacagcccttgaaggttctgcatcttcatctatggccaattttggtctgcagatgaatatgaatggctgcttgtgattgatttctttgcctgttgctatagtttgaaggtgttctccaaattcatgtgttggaaacttaatcccaatgtaacagtgttgagaagtgggaacttgaggaggcgattagatcctgagggctctcaatggattaayatttttatgggagtgggttccttattgcaagagtgagtttgttataaaactgagcctggcctccactcaccctctggctctctcttgcccttccaccttctgccctcaaccatgatgcagcaagaaggccctcaccatatgccagccccctgaccttgtacttcccagcctccagatacgtaagaaataaatctctgttctttataaattacccagactgtggtattctgttatagcagcataaaatggactaagacacctgtcaaatagatgataacttgctcaaatgaaaaggagaca

SEQ ID NO: 156524 - DNA, 601 bp, Human
tcagaggagtcacagagtaaaaggaaacttttttttttttcttttctgaggctggagtaaaatggcacgatcttggctcaatgcaacctctgcctccgggattcaagtgattcccatgcttcagcctcctgagtagctgggattacagctgcacaccaccatgccaggctaatttttgtatttttactagagacagtgttttgctatgttgcccaggctggtctcaaactcctggcctcaagtgatccactcacctcggcctcccaaagtgctgggattacaggcatgagcgaccacaccyggccagaaaccatttttgatctggaaaccaaaagagggagaaagcatcttgttacccaagaagcctgtctgcatcccagcatactgcgtgttagagttcaggactgtgtgaaagcacgctgacagtggctggatttcatttcacatttgttttctcacacctagaacgggaccagctgatgaatccctgtcttacttgaatctttgctcacctccctggggtaaccactgcatcatcatgggtgtgatgtttatggaatcttggatgatagaagagcctgggttgaaagggagaaagaaa

SEQ ID NO: 156525 - DNA, 601 bp, Human
gcattggaatcatctccccaagaagctggcactgagttttctttccctgtcttcagaggagtcacagagtaaaaggaaacttttttttttttcttttctgaggctggagtaaaatggcacgatcttggctcaatgcaacctctgcctccgggattcaagtgattcccatgcttcagcctcctgagtagctgggattacagctgcacaccaccatgccaggctaatttttgtatttttactagagacagtgttttgctatgttgcccaggctggtctcaaactcctggcctcaagtgatccrctcacctcggcctcccaaagtgctgggattacaggcatgagcgaccacacccggccagaaaccatttttgatctggaaaccaaaagagggagaaagcatcttgttacccaagaagcctgtctgcatcccagcatactgcgtgttagagttcaggactgtgtgaaagcacgctgacagtggctggatttcatttcacatttgttttctcacacctagaacgggaccagctgatgaatccctgtcttacttgaatctttgctcacctccctggggtaaccactgcatcatcatgggtgtgat

SEQ ID NO: 156526 - DNA, 601 bp, Human
ctatttgtagttactgattaattattttttctagaaaagttagctttgctaggagctacacaacaggaccaaggttggtgtcttggcttataatttaggtcatgagagctctgctccatacatatctccagtggggagtgaatgaagtggtactgctgcattgattagtcatgaggaggttccttcctgcatgtccatgcagaactaaagcattggaatcatctccccaagaagctggcactgagttttctttccctgtcttcagaggagtcacagagtaaaaggaaacttttttttttttcttttctgaggctggagtaaaatggcacgatcttggctcaatgcaacctctgcctccgggattcaagtgattcccatgcttcagcctcctgagtagctgggattacagctgcacaccaccatgccaggctaatttttgtatttttactagagacagtgttttgctatgttgcccaggctggtctcaaactcctggcctcaagtgatccactcacctcggcctcccaaagtgctgggattacaggcatgagcgaccacacccggccagaaaccatttttgatctggaaaccaaaagaggga

SEQ ID NO: 156527 - DNA, 601 bp, Human
atattctaaaccttgttacatcacacagatttaatgggtggtccagattctgttctatttgtagttactgattaattattttttctagaaaagttagctttgctaggagctacacaacaggaccaaggttggtgtcttggcttataatttaggtcatgagagctctgctccatacatatctccagtggggagtgaatgaagtggtactgctgcattgattagtcatgaggaggttccttcctgcatgtccatgcagaactaaagcattggaatcatctccccaagaagctggcactgagtwttctttccctgtcttcagaggagtcacagagtaaaaggaaacttttttttttttcttttctgaggctggagtaaaatggcacgatcttggctcaatgcaacctctgcctccgggattcaagtgattcccatgcttcagcctcctgagtagctgggattacagctgcacaccaccatgccaggctaatttttgtatttttactagagacagtgttttgctatgttgcccaggctggtctcaaactcctggcctcaagtgatccactcacctcggcctcccaaagtgctgggattacaggca

SEQ ID NO: 156528 - DNA, 601 bp, Human
tccttgttttttccttgcttgttatattcaagaacaaggttaatcctcataaacttaatagggtaatactctaagccttggtttactatttccatgtagttgtagataagctcttacaaaataacttgggaagaagacaactagcagcaggtctaacttgggtgtagggaggaagaatgcttttggaaaagaaagcaggtgactgatgactgccaggtcttcttgcaaacatgcaaaacacagacctcctagcaaacaaaacaataatgtttactagcaggcaaatccttatttatggaaygttttcttcagaatattcctgatgtctaggagtgctcatgggaaatatttaagttaggtatccatttggatatgaaattagaggtatttaatgaccaaaatgaccctgtattagctttttgctactgccacaagttacctctaatttaccagactaaagtaacataaatttattaccttacagttctctcttattacaggttgaaagtccagtatgggtctccagagctaacatcaaggtatcagcagggctgcattactttttggaggtgctaggggaaaatctgtttccttgcttatt

SEQ ID NO: 156529 - DNA, 601 bp, Human
gatctaaaggcaggaattttattaattttcctattcagagtccggaaatttgatttttttcatgccagtttagtcaagaagctgtatctagtcgtctagagcaaattatgatttggaaaatactataaatagtacatacaccccaacgtgtccaggaatttccttgttttttccttgcttgttatattcaagaacaaggttaatcctcataaacttaatagggtaatactctaagccttggtttactatttccatgtagttgtagataagctcttacaaaataacttgggaagaagacaastagcagcaggtctaacttgggtgtagggaggaagaatgcttttggaaaagaaagcaggtgactgatgactgccaggtcttcttgcaaacatgcaaaacacagacctcctagcaaacaaaacaataatgtttactagcaggcaaatccttatttatggaatgttttcttcagaatattcctgatgtctaggagtgctcatgggaaatatttaagttaggtatccatttggatatgaaattagaggtatttaatgaccaaaatgaccctgtattagctttttgctactgccacaagttacct

SEQ ID NO: 156530 - DNA, 601 bp, Human
ggcctgtgcctttcttgtcactcatatatcaccagcagctagtacagtgtctggcatcaagtaggcactcaataaatagttgttgaattgaaaagacatactattgtatctctaatccaattccataaataacatacttattccagattggtctggaggagctgaatgacagaaaagccatatgaggaattaatccattcattagttcatttcttatttattaatataagacatcccaattttattgggagcatgttgatctaaaggcaggaattttattaattttcctattcagagtccrgaaatttgatttttttcatgccagtttagtcaagaagctgtatctagtcgtctagagcaaattatgatttggaaaatactataaatagtacatacaccccaacgtgtccaggaatttccttgttttttccttgcttgttatattcaagaacaaggttaatcctcataaacttaatagggtaatactctaagccttggtttactatttccatgtagttgtagataagctcttacaaaataacttgggaagaagacaactagcagcaggtctaacttgggtgtagggaggaagaatgctttt

SEQ ID NO: 156531 - DNA, 601 bp, Human
atggccaatgccttgatttcagactcgagaggctccaaacagagaaaccagccaagacccctgcatttctagagtgcaggactctgcagtaatcaattagtaatgttctcagccattacgtttgtggtaatttgttatggtagcaatggaaaactactatattcacataagataaaacaaaaggaaacccaccatagtaattttcacaaatgttcattttaacatttctgctaacgtatttcaaaagttttagataaacatcgtttcttcagatgggggcatttcacaggctctgaatgayaagacgagatgtagtcattaagatttttagatgtctcttgttgcaggaagaacagtaagctaaatgagtttctcaccaactctaggtagcacctaagaatgacttttcttgctttactactaccagatggcttgcacacaatatgagtgtaggataatggcaccactgggtgcacaatttccttttactgcttcagttgtgaaaggagtaatgcttcaaaaatccaagaattataaagctgcacagaaaggtcaaatagcaatgacactttgaggagccacagagcatcattaaaaacag

SEQ ID NO: 156532 - DNA, 601 bp, Human
caggcatgcaccaccacgcctggctaattttgtattcttagtagtgataaggtttctccatgttggtcaggctggttccgaattcctggcctcaggtgattcacctgccttggcctcccaaagtgttgggattacaggcatgagccaccacgcctggcctattcttaaatttctgaaagaaatttctggaaggcttattaaaagaaagcaggagttatttctgtaaagagaagtaccaatgaggtcttgcaagtttatgcacaggtcttaatcactagttaggaataatgttggaaaatgsgttaacagggcagctcgaagattctgcattttaaaagcaaggctgccatagtaccgatatagtctgtctgcttccattattgtcatgattgcacttttccccttcactgtggtagggagaattctaaagacatctctccaagattcctaccctttggtcgctcaaccaaatactaactggggaaggggctttgcaggtggaatcaaggttgctaatcagctgaccttaggatagggaaatgatcctggattatcctgctgggctcagtgtaatcacaggaactcttcaaatcagaagagg

SEQ ID NO: 156533 - DNA, 601 bp, Human
cgagaccatcctggctaacatggtgaaatcccgtctctactaaaaaaataaaaaaaattagccaggcgtggtggcgggcgcctgtagtcccagctactcgggaggctgaggcaggagaatggcatgaacccgggaggcggagcttgcagtgagctgagatggcaccattgcactccagcctgggcgatagagcgagactgcgtctcaaaaaaaaaaacaaaaaacttccaactttcatttcaattcatcccctaattccacatatgcagtcatgtaatcttttaatttatttacttgcagkatattttaacaaatcgtacttcaaagacttattaaagctgagaataaatgtgatttttaaaagctcacttatctagatggtaaagttttccttgaggtctatttcttgtttttgtgattgctttgatcactgactgatagcttactgaataccaataaccatcatcaaaaaactgaaagaggcaaagaactgcatatactctcacatactcttgggtcttaaccctttgttttgtgcaattctccagcccctctaaaatattgttttattgtggggagtcaccccagtatttctgtaagc

SEQ ID NO: 156534 - DNA, 601 bp, Human
aaatgtcagactgtgggcgttaagattttcaagatctggcattatgttctggattattaacagctattattaaaacagcctttccggctgggcacagtggctcacgcctgcaatcccagcactttgggaggccaaggctggcggataacgaggtcaggagatcgagaccatcctggctaacatggtgaaatcccgtctctactaaaaaaataaaaaaaattagccaggcgtggtggcgggcgcctgtagtcccagctactcgggaggctgaggcaggagaatggcatgaacccgggaggcrgagcttgcagtgagctgagatggcaccattgcactccagcctgggcgatagagcgagactgcgtctcaaaaaaaaaaacaaaaaacttccaactttcatttcaattcatcccctaattccacatatgcagtcatgtaatcttttaatttatttacttgcaggatattttaacaaatcgtacttcaaagacttattaaagctgagaataaatgtgatttttaaaagctcacttatctagatggtaaagttttccttgaggtctatttcttgtttttgtgattgctttgatcactgactgat

SEQ ID NO: 156535 - DNA, 601 bp, Human
ggcacatgcaagtttcaagaagagttttctagataatcaaacaactggattgctttgctcaagaccaaaatgccatatatataatatatatatttatatatattatatataaatatatatattatatataaaatatataaatatatattatatatatacaatatatataatatatattatatattatattaagtatataatatatataatatatataatatataaatatataatacataaatatatattacatatataaatatatataatatataatacataaatatatatattatatatwatatataaatatatataatatataatatataaatatatataatatataatatataaatatatattatatataaataaaaaatataaatatatattatatataaataaaatatatattttatatataaataaaatatatatattatatataaataaaatatatatattatatataatatatatttatatatattatatataaaatatacatatattatatattatatattttatatataatatataatatatattatatatttatatattatatataaatatatattatatattatatatt

SEQ ID NO: 156536 - DNA, 601 bp, Human
ccctccaagaggtctataacttaattcttggagtctgtgaacaggttactttatatggaaaaaagaaaaaaaaaagacgttgcagatggaattaaggttacaatgtttaaaatagggagactttccctattttgtccctggaaaatctccctattttattctctgctttccctggctggagtcagagaggtgcagcagaagggatggcagagatcccaagagtaaaggttcagctcccagctgctagcttcaacatatggggtagccacaggcaaaggggagggagaggccattaggagtrcaggagctgagggcagctctcaactggccaccaccaagcaagtggagacctcagtctcatggccataaggaacaaggttctgctaacaacctgcagtagcttggattcttccccagagctgctagtaaggagaacgatcccaccagcaccttgattttaaaccagtgagtccagtgtctgaagttctggcccagagaagctgtgggctaatgtattttgtttttttaagtcatggaatttgtggcaatttgttacagcagcaagaggaaactcacagggaggctgcagctcgttttgctc

SEQ ID NO: 156537 - DNA, 601 bp, Human
tagatgcaaagggcaaggcttaaagtacaggcacaggtttgggctaagttccaggtgaacagcctgtgcaaataccatccacgcacatccgtgcaggggtggggtctgcaggctccaaccaaggacaggacctggcagggagccatggcattctgtggcaaatgttaattttggcatataattctccatttttactaagcctggcatcctcagccagtgcaatatgtctactaaaactgtggctggctcatggtggaccaagggcaaatcttgttaatggccttttactcaaccacattcyctgtgctaagtgcttcctgagatctggccacaggacagcccaggtggattgctgcaaatcctgggccatccctcaccagaggtaccactcctgcctcttgtagttccacggcaggtggaaatgcagttctgtccttgtcgttctgtgcaggtggaaatgtgtgacgtttgcacgatactcaaaagtggactgaagcagggcttcttcccccaccagcctgatgcattcaagtcccttacaagaggcatttccactgtcatctttttctgacatctgacccggagggcaaagctgaggctg

SEQ ID NO: 156538 - DNA, 601 bp, Human
ttaagttgtaattctgtaaatgtagatatcagttattttccttcacacttacagcagcaagtcatgggtggtaacttaaaaaataaggacacggaacataataaacatgtttccagcaaaaaagcagctcatgcaatgtaaatggaaagtattaaaaatgcgtacttttagatgcaaagggcaaggcttaaagtacaggcacaggtttgggctaagttccaggtgaacagcctgtgcaaataccatccacgcacatccgtgcaggggtggggtctgcaggctccaaccaaggacaggaccyggcagggagccatggcattctgtggcaaatgttaattttggcatataattctccatttttactaagcctggcatcctcagccagtgcaatatgtctactaaaactgtggctggctcatggtggaccaagggcaaatcttgttaatggccttttactcaaccacattctctgtgctaagtgcttcctgagatctggccacaggacagcccaggtggattgctgcaaatcctgggccatccctcaccagaggtaccactcctgcctcttgtagttccacggcaggtggaaatgcagttctgt

SEQ ID NO: 156539 - DNA, 601 bp, Human
ttttttactgtattatgtaatgtttggttcaattttggaggagatatgggctttagaggaatcattctaggaagataaaatagcagagataaataatttcaaatcaacaaagcagccaaccttgactgggtgcctgctttcttccatacgcaatgctaagtcctgggataaactgatgagagtacctggcttgtgacctttagaaggtcaccgtccagcaaggtaaacagacattatatttgatgtgagtaaccacgatatcatcagtatgtaactagcagtgtgaagaatttgggaaccmatcttctttggaagtgacatctagatatacaacagaaaacaaatataggctgaaatggatgaaaattttactcttcatctgttttagtaaaatatttccttaagttgtaattctgtaaatgtagatatcagttattttccttcacacttacagcagcaagtcatgggtggtaacttaaaaaataaggacacggaacataataaacatgtttccagcaaaaaagcagctcatgcaatgtaaatggaaagtattaaaaatgcgtacttttagatgcaaagggcaaggcttaaagtacaggca

SEQ ID NO: 156540 - DNA, 601 bp, Human
atccttttcttccgtgcaggaagattgtcctctttgttgagtgcccaggggtggggaaggaaggggtgtcttcgcccagccactgggtctgctgactccacctggcctttactggagtgacagtaatccagccacagcctctctctctaggtgcagaggttgcagggctaggggggcagcatgagaccctccaagtctgtccatccccttcattcttccacgagggctcatccctttgatttgtagcttctttgaaaaaagggagtggctggcttccttattattcaaaatgttcacaaargtggcttctcctgtacctgctgcggtgcacatagctgcgctacttagctgtgaaggcgctttctttgctttggcctcctcatccgggaggtgctgctgggaatggtgtggacatcacaggggatctgcagtgacacagggcagctgctcagcgccgggctggtttcttctcagtaaacgttagctgagcagctgctccaccagagacctcccagcccagaggggagaaacatgccaggcgggttaccagcaccccacaggaaaagtgtctcccgcaaatgtgtgagaggaaagaacagaa

SEQ ID NO: 156541 - DNA, 601 bp, Human
gatgcctataattagctcctttctgtggagaacatccttacatcctcgatggcttgaatttatcataaattacctgatctgagtaagtgtgagaatgggaaattatgccaatcatacttttctcgattccacgaagcacacttgcttttgcttcaaaaacattaaattttaaagagatcttctatccgtgaacacctagatcaggagttaaaaactctctgtaaaggatcagagaataaatatttcaggctttgcgggccacacagggtttctgccactttttcttctctcctcctctttytccttctttcaacaaccttttaaaaaatgtaaaacctgttcttacttgaagccatacagaaacgggtcactggcacgatcaacccctgaccgagattctcatctgaagctcagatataggattcaggagggtgtctgtgaactcctgatattttgttccaagttttgtatatttttatatgcacgttatgcatggttttttgtttttattttctgtgctagaggtacagaactttcagcatattctgaggctgggatcctaaactgtctaaaaacatctcaccaaaataagtggtttgag

SEQ ID NO: 156542 - DNA, 601 bp, Human
cagtaacaagatctccagaactcccagcctctcctgcctgctctctcttgcttaggctaagcagagactgaacagacctaatagctaccccttcaaagagccatattattagcagccaaatcgattatcaagtattaattacacgtaaaaatgcaaaaaattggctctttggagtttgatgcctataattagctcctttctgtggagaacatccttacatcctcgatggcttgaatttatcataaattacctgatctgagtaagtgtgagaatgggaaattatgccaatcatacttttctygattccacgaagcacacttgcttttgcttcaaaaacattaaattttaaagagatcttctatccgtgaacacctagatcaggagttaaaaactctctgtaaaggatcagagaataaatatttcaggctttgcgggccacacagggtttctgccactttttcttctctcctcctctttttccttctttcaacaaccttttaaaaaatgtaaaacctgttcttacttgaagccatacagaaacgggtcactggcacgatcaacccctgaccgagattctcatctgaagctcagatataggatt

SEQ ID NO: 156543 - DNA, 601 bp, Human
acagtcgcagttgccagggctcaatccaagcactgccttttctaccttctaagccttgcctcagccccgctactccttccttcatagctccaggcacaagcttctcttagagcacctgtaacacacgatgtttgagtctggtcccacaaggcgttaggaggtaggggggagcatcatcttatttggttgtttgtgctccccactgtgcaggacacagtaggaactcactggatatcgactggatgaaagagcatatggttcttttcaggactctttctagaccagtggttcctaactaggwtgactgtgccaccagggaatatttttggttgtcaccgctgggtgagtgttggggacattacaggcatctcatgggtagaggcagccagggctgctgctaaccatcccacaatgctcaggactgcccccaccacaaggcacaccaactgtttcgaggctgagaggtctgctctggatagctgggctccatgaggatctaatctacatgtgtgcttccccagcacctaacctgtgttcagccctgtggcttctcaaacctatgctcctctgctgcatcagaatcagctttggagcttgatta

SEQ ID NO: 156544 - DNA, 601 bp, Human
cctgcgacccctcagggcagagctgagggcctctggacgcttgaccaaggataaggagaggctgtctggggttcccaggcccactgatccctccccctggaatgttcttccttccaccttgaagccatcaactctgacagtcgcagttgccagggctcaatccaagcactgccttttctaccttctaagccttgcctcagccccgctactccttccttcatagctccaggcacaagcttctcttagagcacctgtaacacacgatgtttgagtctggtcccacaaggcgttaggaggtagsggggagcatcatcttatttggttgtttgtgctccccactgtgcaggacacagtaggaactcactggatatcgactggatgaaagagcatatggttcttttcaggactctttctagaccagtggttcctaactaggatgactgtgccaccagggaatatttttggttgtcaccgctgggtgagtgttggggacattacaggcatctcatgggtagaggcagccagggctgctgctaaccatcccacaatgctcaggactgcccccaccacaaggcacaccaactgtttcgaggctgagagg

SEQ ID NO: 156545 - DNA, 601 bp, Human
ggtttaagtgatacagagagtcccaaggcaccgtcccgtcgaaaaatgaagtcacatacttagtacagccttgatgcaacccagcaaggcaggccggggaggcagaagacaccagagatgatggcatggaccagagaccagacccgaccctggggatacctgcgacccctcagggcagagctgagggcctctggacgcttgaccaaggataaggagaggctgtctggggttcccaggcccactgatccctccccctggaatgttcttccttccaccttgaagccatcaactctgacagtcrcagttgccagggctcaatccaagcactgccttttctaccttctaagccttgcctcagccccgctactccttccttcatagctccaggcacaagcttctcttagagcacctgtaacacacgatgtttgagtctggtcccacaaggcgttaggaggtaggggggagcatcatcttatttggttgtttgtgctccccactgtgcaggacacagtaggaactcactggatatcgactggatgaaagagcatatggttcttttcaggactctttctagaccagtggttcctaactaggatgactg

SEQ ID NO: 156546 - DNA, 601 bp, Human
ggttgtcttcctatgtctgtttcctcctctcctctctccctcaccttctccttggccttcagggtctggactccactggagttgtctcatacccagcctacttacatgtccttgagccctgggtccagccctgctataatcaccgtccatcaggtggcccagcccttcacatccctgggcaggcgctccctgagctcctacatctcatcttccaatttataaccatcagagcccagatgctgggtctctgcaggatctggcctgggttcctgagaccatatactagtttgaggagtggggkgggctgtctggagggtgttagagaacagaactaggtttaagtgatacagagagtcccaaggcaccgtcccgtcgaaaaatgaagtcacatacttagtacagccttgatgcaacccagcaaggcaggccggggaggcagaagacaccagagatgatggcatggaccagagaccagacccgaccctggggatacctgcgacccctcagggcagagctgagggcctctggacgcttgaccaaggataaggagaggctgtctggggttcccaggcccactgatccctccccctggaatgttctt

SEQ ID NO: 156547 - DNA, 601 bp, Human
ataaccttccgcgatgctcactaaatggttagttgtaatcatggtccttagtgtttgacaattaatcaatgttcaatctagaaagttcctccctcccattgtacttaaaccatcttctgcccatcatgaggaaggtgacttctatgtctggttagaaatgggtatggaaaaattctatgcataaacatagtattaaatacctgtagattatttgttagaagcacaaaaatgtgcataatatctcatccttattagtaacctttacaatcgtgactgaattgtcagttgctatgtcattggraagttcctgctaaaagtggattctataatctttttatctaatagataaaaaatgaaacaattcatttttatgtcttccaaattaaaagaccaatctattttttattttaatgcaactaaactgcttcctttcccctgtcttctgtgctgcttgaaatctcatttctttgaatctccatcactcagtgctctcctaggacccaacgtggaactcagaccatatgttcacctgtatgactacggcattttccatgaaagatgtgtctctgcttcagatggccaggatactgaagatcaaacc

SEQ ID NO: 156548 - DNA, 601 bp, Human
gcatgtcagtcttacgtctctacctagcattcagctgaggaggagctggaacaaaacctgtgaagatgggaaagaaagggcttcaggcctgttgtcaaatatgaatgcagaatatgattttttaagaattaaaataaaataaaacaggtttcatgttaaaatgctactgaacatgaagagttttttgatacctaaaaagttccacagacgtgttaagataggctctatcagcagcatttttgtgtaacactgggaaaggttatacaattcaaattagtatttttggcatttgctgatcttygaatataaacaaaatttctcagcttcctagataatataactaggcaaatactgacagcatttttatgtaaaattttataaattccatcctgtgatggccaacctttgtttctgacacaatccgtggtggtggccagagaggaactaactttctgctagggaaaaggtggtgacaggcatttggatattattttaaactaaaagaatggcccttttaaaggagcattttagatcattccttcttgaaatgattttcaccaggttgagctgtgaagctgttaaaataataagtttgtcaaag

SEQ ID NO: 156549 - DNA, 601 bp, Human
ttgaacctcctttactgatcaccattgattttgtattggaattatttggctgtgacctcattactgcaccgagactttctggagggtagaaggcatgtcagtcttacgtctctacctagcattcagctgaggaggagctggaacaaaacctgtgaagatgggaaagaaagggcttcaggcctgttgtcaaatatgaatgcagaatatgattttttaagaattaaaataaaataaaacaggtttcatgttaaaatgctactgaacatgaagagttttttgatacctaaaaagttccacagaygtgttaagataggctctatcagcagcatttttgtgtaacactgggaaaggttatacaattcaaattagtatttttggcatttgctgatcttcgaatataaacaaaatttctcagcttcctagataatataactaggcaaatactgacagcatttttatgtaaaattttataaattccatcctgtgatggccaacctttgtttctgacacaatccgtggtggtggccagagaggaactaactttctgctagggaaaaggtggtgacaggcatttggatattattttaaactaaaagaatgg

SEQ ID NO: 156550 - DNA, 601 bp, Human
acacatcccagagttgggtaagtcacagatgtctgtaatgcaactcctggaatagacaatgaagaactcctaatacgggatctgtgagtcccatgaccgtggagggtgggggaccttcagaaagtcttctaggtttactccatgtacaatcagaagctttttgattcaaaggattcctctttgagaggtccgaaacactttcaaagacagaacttgtaacttctgaaatattttagacatctaaatttgtctgccacaaaagatacctaccttggcccagccagaagtagacttctaggamttcattctaaggacatagttagaggtttctgtgacaatttagtcattgggatgtgcatgatacctcttatgagaaggggctgctccaagctcttttctgtactagcacatgctgagctaatggcaacagatggggtctactgtaatgaaatgtgtggctacgaagcagagagatcttctagtcctacaagagacagagataatccgaaggaaaatcttggggtgcttttagttactctaccacctgagcatatgttgttcttctcctacccacagttagcatatggttccagtagagaat

SEQ ID NO: 156551 - DNA, 601 bp, Human; identical to SEQ ID NO: 21630

SEQ ID NO: 156552 - DNA, 601 bp, Human; identical to SEQ ID NO: 21631

SEQ ID NO: 156553 - DNA, 601 bp, Human; identical to SEQ ID NO: 21632

SEQ ID NO: 156554 - DNA, 601 bp, Human; identical to SEQ ID NO: 21633

SEQ ID NO: 156555 - DNA, 601 bp, Human; identical to SEQ ID NO: 21634

SEQ ID NO: 156556 - DNA, 601 bp, Human; identical to SEQ ID NO: 21635

SEQ ID NO: 156557 - DNA, 601 bp, Human; identical to SEQ ID NO: 21636

SEQ ID NO: 156558 - DNA, 601 bp, Human; identical to SEQ ID NO: 21637

SEQ ID NO: 156559 - DNA, 601 bp, Human; identical to SEQ ID NO: 21638

SEQ ID NO: 156560 - DNA, 601 bp, Human; identical to SEQ ID NO: 21639

SEQ ID NO: 156561 - DNA, 601 bp, Human; identical to SEQ ID NO: 21640

SEQ ID NO: 156562 - DNA, 601 bp, Human; identical to SEQ ID NO: 21641

SEQ ID NO: 156563 - DNA, 601 bp, Human; identical to SEQ ID NO: 21642

SEQ ID NO: 156564 - DNA, 601 bp, Human; identical to SEQ ID NO: 21643

SEQ ID NO: 156565 - DNA, 601 bp, Human; identical to SEQ ID NO: 21644

SEQ ID NO: 156566 - DNA, 601 bp, Human
atacctatatctatgtacgcacctgtttttatattgctttttttcactttacttgtgaaactctctgtaagctccttgatgagataaatcagtttccaggccctgaagttaaccgctgttccagtgttagcaaaggtggggatgctttgtcctcccatcgctccctgtcctggtggggcctgtggtgaggggtttggtctctcatgggctccccaagacaggagcagagactgttctgatgcatcagggttgtgagttgctgcctagcggccttcgttttgctgcaggggaacctacttcmcgctgcagcaggtgagggccattctgttctcaagaggcctccagctccagctcaacattgttctgaattcacctgaattgttccccacggccaagcttctaatgccatcctgtggaagggctgtgaattctctgttaccccatttccaatggaaagtgtgagactgaaaatctaaatgcttcgaaaccagcgattaaatacatgatggatctttggcctccctctgtctctctctgtttcccttcttataccacatctcctgttccacccatccctgtcacctggatggcatcaaatcca

SEQ ID NO: 156567 - DNA, 601 bp, Human
atgacatattatacaaaactggccagattgtatctgtatcatctatacctatatctatgtacgcacctgtttttatattgctttttttcactttacttgtgaaactctctgtaagctccttgatgagataaatcagtttccaggccctgaagttaaccgctgttccagtgttagcaaaggtggggatgctttgtcctcccatcgctccctgtcctggtggggcctgtggtgaggggtttggtctctcatgggctccccaagacaggagcagagactgttctgatgcatcagggttgtgagytgctgcctagcggccttcgttttgctgcaggggaacctacttcccgctgcagcaggtgagggccattctgttctcaagaggcctccagctccagctcaacattgttctgaattcacctgaattgttccccacggccaagcttctaatgccatcctgtggaagggctgtgaattctctgttaccccatttccaatggaaagtgtgagactgaaaatctaaatgcttcgaaaccagcgattaaatacatgatggatctttggcctccctctgtctctctctgtttcccttcttataccacat

SEQ ID NO: 156568 - DNA, 601 bp, Human
gttgtagactagataacctttcattttacataatgtcttacacctttcagtgaggtataaatttctctgaaaaaaaccatacacttttataagcatacattaacttagtgcctttatgaacattattttttaaaggccatttgcaaagattacaaatgtaattttcattgtagaagatttataaatacagaagtacaaaaggaatcaatcattatcttctcttggatcttactctgctttttcaagaaacacatatattttgtacaggcaaatagcattttgtatttgcatatgacatatyatacaaaactggccagattgtatctgtatcatctatacctatatctatgtacgcacctgtttttatattgctttttttcactttacttgtgaaactctctgtaagctccttgatgagataaatcagtttccaggccctgaagttaaccgctgttccagtgttagcaaaggtggggatgctttgtcctcccatcgctccctgtcctggtggggcctgtggtgaggggtttggtctctcatgggctccccaagacaggagcagagactgttctgatgcatcagggttgtgagttgctgccta

SEQ ID NO: 156569 - DNA, 601 bp, Human
agaacaccaatgccaaaggtaagggtcaacataaatttctggactagaaaaagttctagaggccatcattaaaccaattattatttgtatcacttttactcctgttataatatttggctcctctgtcctggaaggtctgtgttgtagactagataacctttcattttacataatgtcttacacctttcagtgaggtataaatttctctgaaaaaaaccatacacttttataagcatacattaacttagtgcctttatgaacattattttttaaaggccatttgcaaagattacaaatgtawttttcattgtagaagatttataaatacagaagtacaaaaggaatcaatcattatcttctcttggatcttactctgctttttcaagaaacacatatattttgtacaggcaaatagcattttgtatttgcatatgacatattatacaaaactggccagattgtatctgtatcatctatacctatatctatgtacgcacctgtttttatattgctttttttcactttacttgtgaaactctctgtaagctccttgatgagataaatcagtttccaggccctgaagttaaccgctgttccagtg

SEQ ID NO: 156570 - DNA, 601 bp, Human
tgctgtcataaagccctgctgagggcagagagggtccttctgggggagacgcgccttcttggcagatgacatgctgactgtttcatgggaggttttgtccaaaacggactagagaaactagcaattccttagaactcagcaacaggcacacagcagatgcaaaaatggatgagtttgcaaggacctcttagaccagaaagtgatgcatagagtgtcaaacacttctgcacacaggagctcgtagtctggtgcttctagactagaatggcctagaagtctgatacttctagtatggttcaayagcaaccatttcttgaactaacagcatgcatgcatcatatttttgtatcatatattttctagaattatccctacagggatttttttttaaagtttctgagatttttcttatagctaaatttgacatgcagaatattatagtgtctttttaaggtcaagaacaccaatgccaaaggtaagggtcaacataaatttctggactagaaaaagttctagaggccatcattaaaccaattattatttgtatcacttttactcctgttataatatttggctcctctgtcctggaaggtctgtgttg

SEQ ID NO: 156571 - DNA, 601 bp, Human
ttccctggaccccaatcttcggattccctccaccaaccatgcagtgacagtctgctgtcataaagccctgctgagggcagagagggtccttctgggggagacgcgccttcttggcagatgacatgctgactgtttcatgggaggttttgtccaaaacggactagagaaactagcaattccttagaactcagcaacaggcacacagcagatgcaaaaatggatgagtttgcaaggacctcttagaccagaaagtgatgcatagagtgtcaaacacttctgcacacaggagctcgtagtctgrtgcttctagactagaatggcctagaagtctgatacttctagtatggttcaatagcaaccatttcttgaactaacagcatgcatgcatcatatttttgtatcatatattttctagaattatccctacagggatttttttttaaagtttctgagatttttcttatagctaaatttgacatgcagaatattatagtgtctttttaaggtcaagaacaccaatgccaaaggtaagggtcaacataaatttctggactagaaaaagttctagaggccatcattaaaccaattattatttgtatca

SEQ ID NO: 156572 - DNA, 601 bp, Human
ctgtcatgagaggctggggaacagctcaaaacacagggagggaagactgcggaagacgcttggctcacagcagcccttggggcaaagtctcaccaggaaagaaacagatgagtctgggaaaagtcacagctatgagcatccacccacaattaaacccacagcaagagctaggggccaccataggccacagtgtaattggggccaggcattgggctagaagtcacagaccgaaataagacccacagagtcctttgccccagaaaattcgctctctttggggatcaattgctatacttaaccyataatatgataataactagcagagaagtttaaataaaattatggagaagtagattagggagtaattgtttacttgaaagaagtcttggaaagatagaggggatgttttatttgctcttgaatgattattctccaagtagtgagtggggaaagggagggccaggcagtggaacagcatgaacagaagcgtagaggctggtctgcgggatcctaagacaggccaggaaagagtgcgggcaagaagccttgaaagttcttccaagacatctctttcattgtgggaaaaataagggggcattga

SEQ ID NO: 156573 - DNA, 601 bp, Human
gttttggtggtgattgcagattcagaatactgactaacagtgagataaatgcagcactgtcatgagaggctggggaacagctcaaaacacagggagggaagactgcggaagacgcttggctcacagcagcccttggggcaaagtctcaccaggaaagaaacagatgagtctgggaaaagtcacagctatgagcatccacccacaattaaacccacagcaagagctaggggccaccataggccacagtgtaattggggccaggcattgggctagaagtcacagaccgaaataagacccacasagtcctttgccccagaaaattcgctctctttggggatcaattgctatacttaacccataatatgataataactagcagagaagtttaaataaaattatggagaagtagattagggagtaattgtttacttgaaagaagtcttggaaagatagaggggatgttttatttgctcttgaatgattattctccaagtagtgagtggggaaagggagggccaggcagtggaacagcatgaacagaagcgtagaggctggtctgcgggatcctaagacaggccaggaaagagtgcgggcaagaagc

SEQ ID NO: 156574 - DNA, 601 bp, Human
cctcctcattccagtgtgaagaactgcttactggcaaggaaaaaagtcagtctgtgtcaaatgataagctgtcataaagtggtcagcaaagtgacatagagcagacttgtgcctacaccttcccgcccatcagtggtgtgccaaagtgggcagtgggggctgtcacctgggggcaggtaataagaggctgcactctttgcagggaatgtacaggtaatgaaatgaatacaagttgggtttttgttcactaccatgtgcagacaatgctacacgatttcactggtaagagactcctcctcayaaggagagccccctactcactgcacaccctgaatgggccactacatgcctttttttctttattaagagaatgcccaaggttcacctagggtcatagttgtcacaaaagactacaatccccagcctccctcgcagctctggtgccactacgagccagtctaggccacagggatgtaacagtgatgtgtgcaacttctgggtggggtcctaaaggaaaggatactcctgtcttctttcccccatttctgctcctgaactgtggatgtgaagagccagaatcgtgaccatggggaggaaggca

SEQ ID NO: 156575 - DNA, 601 bp, Human
tgctgccccacatgtgaccagtgccgaagccgagaggccctggtgaagttgtaaaagacagtattgatggtgtggaaggctgagagataaaatacaattaagaaaactaaacgagacacctgaaacagagttttaagtctataaactcactgaaactaaaatagcagcacttttaggtgatgggctatatcttccactagaggtgagaaagaagtagaagaatatggttcatccatggataatggcagacgagagttgctgcgcaaaaatgcacagccgtgatctttgcaggctcatgagrtatgttgcttccaggacatgaaatatcatgccttgagtcaacaagctcccagcatatggtgaggtgaaggccgagggagactgtactcgaaccagccaagaggaacgggcggcagctgaaagaagcagatggttagaaaggaaatgatattaagcggcaaaagaaagagtatggttactaatgagaaaatgaaaactgtctggaagaaaaagaaaaacaacctgtgatattaggaaatgaaagcctaggagcatccaaatgtcatgaggagcagatgcatgaagtgataataaaaaatca

SEQ ID NO: 156576 - DNA, 601 bp, Human
tgccaacctccttcagataatcctgtggtcttggtttatatgtttggtaatatgtccttcgaaggacaatctagtccaatggtctcaaccagggcaattttaacacccagggggacaagcggcaatgtctggggacatttttggttgtcatggctgtggcagaaggtgctactggcatccagtgggtagagtccagggaggctggcaaataccctgcaatgcacaggccggctccctggaacagagaggtatgctgccccacatgtgaccagtgccgaagccgagaggccctggtgaagttgtaaaagacagtattgatggtgtggaaggctgagagataaaatacaattaagaaaactaaacgagacacctgaaacagagttttaagtctataaactcactgaaactaaaatagcagcacttttaggtgatgggctatatcttccactagaggtgagaaagaagtagaagaatatggttcatccatggataatggcagacgagagttgctgcgcaaaaatgcacagccgtgatctttgcaggctcatgagatatgttgcttccaggacatgaaatatcatgccttgagtcaacaagctcc

SEQ ID NO: 156577 - DNA, 601 bp, Human
atctgcagcatcagggaaacattctgattttaagatcccactctttcctctcaggggaagtcacacattgcaaaatgtaggaagagaagatggctctaagtaggtaaactgtcagagaatgttctctcaagcagggtttggtttaattaagctgcagccagcactatgtactttaaaaagcaacaataaaaacccaagtccatccaccgtctgccactcttgcttggcttgctttgaacagcagagttattacataatttgcctttacagtgtttcatggccacttccagcttttgggggkttaaaggtggaaggatagaggtgatgggtattcaaaaactccagttaactgtaaaaagccagcgagaaatgattctttgtgttgattcttaggaatttcaaagaaaacggtagtgcgggtgtctgaatcccccaggagctgttcagaagacttcggctgcagctgaggctgaggctgtgcaaagaggggatagagttgatggctaattagctgtatttatgtggcactgcattgtctccaggctctccttgcaaaagacaggaggggctttgcatttgagagattagaaacccgcattaa

SEQ ID NO: 156578 - DNA, 601 bp, Human
ccatttcaggagaagtgctaaaatacacagctcctctttccacctgtcacaggcttcatacagtctccgccaatcaagtttgtgtgcagaaaagaccttttactgctgagtcgtatcttcagaacataaacagaaaaggctggcttcaccagcggaatgcacctctatcacctagatttctctactaattagggagcatcacagtcattacatatgtgcaggctcactttcattttttaagatatttcagtgaaataaacaacagaccagagatgctgcaagataaaggtagcagatctgyagcatcagggaaacattctgattttaagatcccactctttcctctcaggggaagtcacacattgcaaaatgtaggaagagaagatggctctaagtaggtaaactgtcagagaatgttctctcaagcagggtttggtttaattaagctgcagccagcactatgtactttaaaaagcaacaataaaaacccaagtccatccaccgtctgccactcttgcttggcttgctttgaacagcagagttattacataatttgcctttacagtgtttcatggccacttccagcttttggggggttaaa

SEQ ID NO: 156579 - DNA, 601 bp, Human
tgccctagtctctgatctccaatgcactgggctgggtactgaggagacaccaacaaggagcagtcagggagtatggagaaggatttccatttcaggagaagtgctaaaatacacagctcctctttccacctgtcacaggcttcatacagtctccgccaatcaagtttgtgtgcagaaaagaccttttactgctgagtcgtatcttcagaacataaacagaaaaggctggcttcaccagcggaatgcacctctatcacctagatttctctactaattagggagcatcacagtcattacatawgtgcaggctcactttcattttttaagatatttcagtgaaataaacaacagaccagagatgctgcaagataaaggtagcagatctgcagcatcagggaaacattctgattttaagatcccactctttcctctcaggggaagtcacacattgcaaaatgtaggaagagaagatggctctaagtaggtaaactgtcagagaatgttctctcaagcagggtttggtttaattaagctgcagccagcactatgtactttaaaaagcaacaataaaaacccaagtccatccaccgtctgccactct

SEQ ID NO: 156580 - DNA, 601 bp, Human
tgtctcaaaagcaaaaaacaaaacaaaaaaacccctgaaagtaaagatgtcaacatactatattaaaaaaaaaaaaagactttgtaaacatggggttctttaagttatagagagtcacaggagtactctaattatcacattcataaaagccccctaatgaatgagaagaattacaggacaatttacaagactcttctctgtgagccatcctgcaactgccctagtctctgatctccaatgcactgggctgggtactgaggagacaccaacaaggagcagtcagggagtatggagaaggatktccatttcaggagaagtgctaaaatacacagctcctctttccacctgtcacaggcttcatacagtctccgccaatcaagtttgtgtgcagaaaagaccttttactgctgagtcgtatcttcagaacataaacagaaaaggctggcttcaccagcggaatgcacctctatcacctagatttctctactaattagggagcatcacagtcattacatatgtgcaggctcactttcattttttaagatatttcagtgaaataaacaacagaccagagatgctgcaagataaaggtagcagatct

SEQ ID NO: 156581 - DNA, 601 bp, Human
aggcaggcagatcgcttgaggtcaggagtttgagaccagcctggccaacgtggtgaaaccccacctctacaaaaatacaaaaatcagctgggtgtggtggcgcacacctgtaattccagctactcaggagactgaggcaggagaatcacttgaatccaggaggtggagtttgcagtgggccaagatggcgccattgcactccagcctgtgtgacagagcaagactgtctcaaaagcaaaaaacaaaacaaaaaaacccctgaaagtaaagatgtcaacatactatattaaaaaaaaaaaaagactttgtaaacatggggttctttaagttatagagagtcacaggagtactctaattatcacattcataaaagccccctaatgaatgagaagaattacaggacaatttacaagactcttctctgtgagccatcctgcaactgccctagtctctgatctccaatgcactgggctgggtactgaggagacaccaacaaggagcagtcagggagtatggagaaggatttccatttcaggagaagtgctaaaatacacagctcctctttccacctgtcacaggcttcatacagtctccgccaatc

SEQ ID NO: 156582 - DNA, 601 bp, Human
attaagcagaatagagaaagtgagagaaatagcacgaagacagaggcatttgtggttttaaaaaagcttttttgctgggtttcatcttgttccagcttgggggaaattttcaatgaaaatatcccttcctcctcagaattttactccttatgtttgagagttacataaatgttccacaattctgtgcaacatgttaattttcatctgttatattttaacgaataaaatttgcaaaagttctagtatcccttgagtcttacagatattacttcaatgttcaaattacactttgtgcaagtcrttcacatgctgttgaacaggaaaacagaccaaaggatatatcactagtgtaatactgaacctcctcttatgaattgtcttgttcatagaaatttctaattttacacacatatttagagttcataaagctaaggattaaggtggctataaccagagtgtttgaaaactgagtaattgagaattagagctctgttggagacaggctggtagcaaagcagtgagtgtacatagatcatagaacaaaccaatagattgattttttgccactccaaatagtgcttcacccaataatgtatcagca

SEQ ID NO: 156583 - DNA, 601 bp, Human
gggctgggacccggtacattttaagtgttcacatgggattttacacaggtatttgagcattaactctcttaccagttaatgatagtgctttgaaaaaatatcaacctgtcacaatctgcactgaaaacaaagtagctcagctacaagaatagaatgaaaaacatttcacagcattttcagtgactataaccacatctagtcctctctgtttgtagtgatcttcaaggactcctgagcctttaagatcaatttttaaaaggaatacatttccaagtaaaacagttcaatataattttttttyctctaacatcctagaaatctttattagagttgcatttctcaaaactggacttatattgttttctgaggagttgctcataactccagatttctttttattgtaatgaactggccataccttccagctccctgcagccaagttctgcagggcgcctgccgccccttccagcgtgtctggatttgagcactcagagagcagtgtgaggtagggtttgactattgatgggtgccacagcatctggatcccttttggtggttcagcacagtctggaagaggtcctactccatcccactggcggaa

SEQ ID NO: 156584 - DNA, 601 bp, Human
ttctgatgtccgtgtgtatatgttaacatggtttggatgaaaataaatgtaaaggaaaggagtgattgatgaatatcccacaccccaggatttgatatgagattaatggaacatgcatggcagaagtgcaaactttctctcttggtattctccccacctgccctcattcttctaataggtcaaacttttttatgcaacaaagcaaattagcgcattggtgaccagactcaggaatgaattactatggtgaatctctttttgcccaaaatgagtgttatgaaaatcaatcaggaacagtgtyagtttataaggactcagaaaaaggctgttctaatctcctctccaatcataaatttactttaacatgtttgccaaagtcaactaacaatactattcttctctgtaagcccatgctttaaaaacataaggggttcttttcttttcttttcttttcttttggggctgggacccggtacattttaagtgttcacatgggattttacacaggtatttgagcattaactctcttaccagttaatgatagtgctttgaaaaaatatcaacctgtcacaatctgcactgaaaacaaagtagctcagct

SEQ ID NO: 156585 - DNA, 601 bp, Human
gctctgtaggaagaattgtcagggcctggcacccatgagctgggatggcacacttgagaaagaaggaagttctgtagcttggactgtagtaatggaaacaaaggatgacagagagaatgacaagaaggcagacatccaaaggaataagcaaaggggagggtgtagttacataatgttgaggccagggtgtggtgagtgtgtgacatctatggccttgagcttctgatgtccgtgtgtatatgttaacatggtttggatgaaaataaatgtaaaggaaaggagtgattgatgaatatcccamaccccaggatttgatatgagattaatggaacatgcatggcagaagtgcaaactttctctcttggtattctccccacctgccctcattcttctaataggtcaaacttttttatgcaacaaagcaaattagcgcattggtgaccagactcaggaatgaattactatggtgaatctctttttgcccaaaatgagtgttatgaaaatcaatcaggaacagtgttagtttataaggactcagaaaaaggctgttctaatctcctctccaatcataaatttactttaacatgtttgccaaagtcaa

SEQ ID NO: 156586 - DNA, 601 bp, Human
agaagtgggtctggcatggggcagcggctagctctgtaggaagaattgtcagggcctggcacccatgagctgggatggcacacttgagaaagaaggaagttctgtagcttggactgtagtaatggaaacaaaggatgacagagagaatgacaagaaggcagacatccaaaggaataagcaaaggggagggtgtagttacataatgttgaggccagggtgtggtgagtgtgtgacatctatggccttgagcttctgatgtccgtgtgtatatgttaacatggtttggatgaaaataaatgtmaaggaaaggagtgattgatgaatatcccacaccccaggatttgatatgagattaatggaacatgcatggcagaagtgcaaactttctctcttggtattctccccacctgccctcattcttctaataggtcaaacttttttatgcaacaaagcaaattagcgcattggtgaccagactcaggaatgaattactatggtgaatctctttttgcccaaaatgagtgttatgaaaatcaatcaggaacagtgttagtttataaggactcagaaaaaggctgttctaatctcctctccaatcata

SEQ ID NO: 156587 - DNA, 601 bp, Human
gcttgagtttgttcttttacatatttttcctatttctactttttgaacatatggaatatagagttgaaaggttgaagtcttacattcaaaatcttctagaggccaaagatatttctccacttttaagttgttattattacatgataatgaaataagtatttctcaaggaaaatgataattgataaaaataaaggaagagagaaagaagagagagacagagggagggaggaagagagagagagacagagagagagagagagagagaaacaacatcttaagatggcacacctgatttgccacmatctagatctttgtgtcttagtcaggctgatgcctgaagcccagagcccattttcctgtacccatctagttagtgctgcaaggcaggggagctgggtagggtcttttagctcatgagcacgtgagtggtcatgggcacatacagtgtcttggcctatcacatcttgctaccatccttgcatccagcgttgtgactgatgtgcatgatgtagagtgaggcagccctgattttctctgcagatgacacatctgagacacagtgatatgctgtagtttgcccaggctcaccatgctcagaaaa

SEQ ID NO: 156588 - DNA, 601 bp, Human
agccccccacccctgccaggccccggtgtgtgatgttctcctccctgtttccatgtgttctcattgttcaattcccacttacgagtgagaacatgtggtatttggttttctgttcctgttttagtttgctgagaatgatggtttccagctccatccatgtccctgctaaggacatgaactcatccttttttatggatgcatagtattccatggtgtaaatgaggcattatattttaattctagaagcttgagtttgttcttttacatatttttcctatttctactttttgaacatatggawtatagagttgaaaggttgaagtcttacattcaaaatcttctagaggccaaagatatttctccacttttaagttgttattattacatgataatgaaataagtatttctcaaggaaaatgataattgataaaaataaaggaagagagaaagaagagagagacagagggagggaggaagagagagagagacagagagagagagagagagagaaacaacatcttaagatggcacacctgatttgccacaatctagatctttgtgtcttagtcaggctgatgcctgaagcccagagcccattttc

SEQ ID NO: 156589 - DNA, 601 bp, Human
ttagtgccactgatccttaaatttggtgtttagatgtggcgcagttctttgtactttaacatgtcttttttatctgtccgcttttaggattttttttctttgttactaattttgagcaatctgattaaaatataccttggtattttttcttcctgttttctgtgcctggggctccttgagctgcttagatctgtgagtttatagttttcattaaatttggaaaattttcaaccattattttttaaaatatttttttctgttctctttcttctctcatttggggactccgtttacacatatrtgaggtcacttgaagctcactgatgcactgttcattttttcttcttttttctttgtgtttcattttggatcattcctattgctgtcttcaagttcactaatcttttattctgtaatcttataatctgctgttaatcccattccacataatttttgttcaggcattatattatattatatttattatactttaagttctgggatacacgtgcagaatgtgcaggtttgttacacaggtatacacataccatggtggtttgctgcacccatcaaccgttatctacattaggtatttctccta

SEQ ID NO: 156590 - DNA, 601 bp, Human
taggaaccgcagaactggccctttgctactgagctctgcaacctgcaaaacattgttcagtctgaacactgaaaagaaaatggttctctcataacttctttctatcaattttacattgtattgacagtatattgccagctgaaccaaagaatcaaaatatcataaaatgtgaccatctgaggatggcctggaacataatatgtgctaccaaattcttattgactagtagacattaataaatagaaaacactgcaaccctcaaggaagacatatagacatggatagtaattgagaaaaatamtcacatttgaattttttcgctcagccaatcacaggggtagtcagtgggacagaaagataaatggggcttggtctgcccataaggggcgtacagactaaattctcttctagaggacagtcttagcagctcagaaggaatcattgtatgaatgaatgattagtgccactgatccttaaatttggtgtttagatgtggcgcagttctttgtactttaacatgtcttttttatctgtccgcttttaggattttttttctttgttactaattttgagcaatctgattaaaatataccttggtatt

SEQ ID NO: 156591 - DNA, 601 bp, Human
gtaggaaccgcagaactggccctttgctactgagctctgcaacctgcaaaacattgttcagtctgaacactgaaaagaaaatggttctctcataacttctttctatcaattttacattgtattgacagtatattgccagctgaaccaaagaatcaaaatatcataaaatgtgaccatctgaggatggcctggaacataatatgtgctaccaaattcttattgactagtagacattaataaatagaaaacactgcaaccctcaaggaagacatatagacatggatagtaattgagaaaaatratcacatttgaattttttcgctcagccaatcacaggggtagtcagtgggacagaaagataaatggggcttggtctgcccataaggggcgtacagactaaattctcttctagaggacagtcttagcagctcagaaggaatcattgtatgaatgaatgattagtgccactgatccttaaatttggtgtttagatgtggcgcagttctttgtactttaacatgtcttttttatctgtccgcttttaggattttttttctttgttactaattttgagcaatctgattaaaatataccttggtat

SEQ ID NO: 156592 - DNA, 601 bp, Human
tattctctactcgcttagcagtagagaaatttaccaaagaaatgcgctctggatatgtggaataactgtgctgaactaatgcacagatttattgtgctggaaacagtaagaggctattgccagaaaatattaagaataattatcatacttcttccataattcccattatgtaaagtagaagagactcttaaaatataaaaatagtaaatgctttttaaacttgtcattttcttactctacacacctaaagatccacacatatctaagcagttcttgcagctgatctggttgcccctgagayacggaacctgcaaacttacacggaaatctcagcacagtaggaaccgcagaactggccctttgctactgagctctgcaacctgcaaaacattgttcagtctgaacactgaaaagaaaatggttctctcataacttctttctatcaattttacattgtattgacagtatattgccagctgaaccaaagaatcaaaatatcataaaatgtgaccatctgaggatggcctggaacataatatgtgctaccaaattcttattgactagtagacattaataaatagaaaacactgcaaccctcaag

SEQ ID NO: 156593 - DNA, 601 bp, Human
tctgacagtttttctttcttgcattcttatattcagttttcctaactcctctgtcttttctctttgccaccacagtatctactctccctccttatgatggtctatgtgtctgcttacaagagttcttgcttttttttttttttttttgagatggagtctcactctgtcaccaggctggagtgcagtggcgtgatcctggctcactgcaatctccgcctcccaggttcaagggattctcctgcctcagcctcctgagtagctgggactacaggcacacgccaccatgcccagctaatttttktatttttaatagagacagggccaggatgatcttgatctcttgacctcatgatccatccacctcagcctcccaaagtgttgggattacaggcgtgagccacaacacctggccagttcttgcattttttaacatgttgatttccgataaggacagggaaatctatggtcgtcattgttaagctttgtctaaaacagaacagcttctgttatgctgactttggctattctagacctttctgccattttcctattattctctactcgcttagcagtagagaaatttaccaaagaaatgcgctct

SEQ ID NO: 156594 - DNA, 601 bp, Human
gaacagccatgacattaaatggtctctgacagtttttctttcttgcattcttatattcagttttcctaactcctctgtcttttctctttgccaccacagtatctactctccctccttatgatggtctatgtgtctgcttacaagagttcttgcttttttttttttttttttgagatggagtctcactctgtcaccaggctggagtgcagtggcgtgatcctggctcactgcaatctccgcctcccaggttcaagggattctcctgcctcagcctcctgagtagctgggactacaggcacaygccaccatgcccagctaatttttgtatttttaatagagacagggccaggatgatcttgatctcttgacctcatgatccatccacctcagcctcccaaagtgttgggattacaggcgtgagccacaacacctggccagttcttgcattttttaacatgttgatttccgataaggacagggaaatctatggtcgtcattgttaagctttgtctaaaacagaacagcttctgttatgctgactttggctattctagacctttctgccattttcctattattctctactcgcttagcagtagag

SEQ ID NO: 156595 - DNA, 601 bp, Human
ctaagaggcaaaatcctactttaaccattgggatggaaatcttttgcaaatgctttctgtcttctaaaattactagtaataacattttcttgatgacagagggccaactttatgactcgcagagtagatggaacagccatgacattaaatggtctctgacagtttttctttcttgcattcttatattcagttttcctaactcctctgtcttttctctttgccaccacagtatctactctccctccttatgatggtctatgtgtctgcttacaagagttcttgcttttttttttttttttttgagatggagtctcactctgtcaccaggctggagtgcagtggcgtgatcctggctcactgcaatctccgcctcccaggttcaagggattctcctgcctcagcctcctgagtagctgggactacaggcacacgccaccatgcccagctaatttttgtatttttaatagagacagggccaggatgatcttgatctcttgacctcatgatccatccacctcagcctcccaaagtgttgggattacaggcgtgagccacaacacctggccagttcttgcattttttaacatgttgatttccgata

SEQ ID NO: 156596 - DNA, 601 bp, Human
tgataagaaatgtttatatatgtatgtacatatttataattactcccaaatattacttatcagcctctcgtcatgcctgagaactatcccattatctagaattattagggaagcagcgcttctcataagcaagactgacatcctaagaggcaaaatcctactttaaccattgggatggaaatcttttgcaaatgctttctgtcttctaaaattactagtaataacattttcttgatgacagagggccaactttatgactcgcagagtagatggaacagccatgacattaaatggtctctgrcagtttttctttcttgcattcttatattcagttttcctaactcctctgtcttttctctttgccaccacagtatctactctccctccttatgatggtctatgtgtctgcttacaagagttcttgcttttttttttttttttttgagatggagtctcactctgtcaccaggctggagtgcagtggcgtgatcctggctcactgcaatctccgcctcccaggttcaagggattctcctgcctcagcctcctgagtagctgggactacaggcacacgccaccatgcccagctaatttttgtatt

SEQ ID NO: 156597 - DNA, 601 bp, Human
aactttagaaatcagatcatccaatgacagtactaaaattaatgcaaaactattaaaaatgggttttctccatttatcgatttggatgcatgtggcatttgcaacacagatgtggtctttgctatccgtgctgcttcccgggtcttgcagggaagaaatcactgagtcctgtgattaggaccaatgacctggttgtggccatgctcctcccatctcctgctccacagagtgggtctgttcttgtcctgcaacagactggtcattgcctgtgtctgagtgtaccatctccaggacactgctsactagacagggtgctctgatcacctctgtgtttatactggcctagtttctaattgatgaggcacgatgcttcgcgttgtattttcatcacagtctttcaaaactctgtttctttacatttaaatctaaagcttggcatcacaccattaactagaacaaagacaagtcactttgtcttagacaataaaccatgattcttaacttgcgtttgatagactccactaatctgccctggttcacttttacatgatacactacctactaagctatgctaaagtcagtctttctcaaggctgttatc

SEQ ID NO: 156598 - DNA, 601 bp, Human
tgtcttttctttgttgctgttgtttttccttgaagaaaggtaaatttgaaccttgtcattccatcttggcatcttggctggaagtggaaatccctctggttcagctgtttctacaactttaaagttctgtaatttagaactttagaaatcagatcatccaatgacagtactaaaattaatgcaaaactattaaaaatgggttttctccatttatcgatttggatgcatgtggcatttgcaacacagatgtggtctttgctatccgtgctgcttcccgggtcttgcagggaagaaatcactragtcctgtgattaggaccaatgacctggttgtggccatgctcctcccatctcctgctccacagagtgggtctgttcttgtcctgcaacagactggtcattgcctgtgtctgagtgtaccatctccaggacactgctgactagacagggtgctctgatcacctctgtgtttatactggcctagtttctaattgatgaggcacgatgcttcgcgttgtattttcatcacagtctttcaaaactctgtttctttacatttaaatctaaagcttggcatcacaccattaactagaacaaagaca

SEQ ID NO: 156599 - DNA, 601 bp, Human
tcctacgggtatcttaaagctttgttctaggatgcagttaatttacttggaaactgttgatccttttgggtctaatttaagatttgataggaaagactagagcatggttagtccagggctaattattcctctgtactgaggcaagaccctactgactattctccccagtggcccatggattatgagattttcttctctggctcttgagaacatgcactatatgcacccccacatgagtgtccgatttcattctccctaataatttcaggtgtttctttcccagccttgggtatttgcctcrgacacatgtgctgagagttctctgttgaatatttaaggggagtcctctgcacatctctagggttctatgtgtggctctctcctctttgatattttgtcctatgaactctgatcactttgatatctcccgattccccgatccatctcctgaacacagtgagtctaccgagatccccctggtccctcaatcttcataccatggcttggaaactctctctcaaggtggtgagctgagacaatcagaggactcaccttcttttgtttcctgtctttcagagatcattgtcctttgctgactaat

SEQ ID NO: 156600 - DNA, 601 bp, Human
cttttaaaatgttttgaacacatggaatactgttataataattgcttatttgataattttaacatctgtcagttcttagttttcatttatttatttttctccttattatggattgcattttctatttacttgcaggatagtttttagttgtatgccagacattctcaattttaatttgttgggtgctgaatatttttgtattcctacgggtatcttaaagctttgttctaggatgcagttaatttacttggaaactgttgatccttttgggtctaatttaagatttgataggaaagactasagcatggttagtccagggctaattattcctctgtactgaggcaagaccctactgactattctccccagtggcccatggattatgagattttcttctctggctcttgagaacatgcactatatgcacccccacatgagtgtccgatttcattctccctaataatttcaggtgtttctttcccagccttgggtatttgcctcagacacatgtgctgagagttctctgttgaatatttaaggggagtcctctgcacatctctagggttctatgtgtggctctctcctctttgatattttgtcc

SEQ ID NO: 156601 - DNA, 601 bp, Human
tttatacattttccatgtgtaacttttaaaatgttttgaacacatggaatactgttataataattgcttatttgataattttaacatctgtcagttcttagttttcatttatttatttttctccttattatggattgcattttctatttacttgcaggatagtttttagttgtatgccagacattctcaattttaatttgttgggtgctgaatatttttgtattcctacgggtatcttaaagctttgttctaggatgcagttaatttacttggaaactgttgatccttttgggtctaattkaagatttgataggaaagactagagcatggttagtccagggctaattattcctctgtactgaggcaagaccctactgactattctccccagtggcccatggattatgagattttcttctctggctcttgagaacatgcactatatgcacccccacatgagtgtccgatttcattctccctaataatttcaggtgtttctttcccagccttgggtatttgcctcagacacatgtgctgagagttctctgttgaatatttaaggggagtcctctgcacatctctagggttctatgtgtggctc

SEQ ID NO: 156602 - DNA, 601 bp, Human
cctattctcttcctcctttctctgtcctctcattagggtactctgtctacatatagcgggtgccacttgacacccacagatgatctgtacctttcttttttctttctgtgtttcatgctggatagcttctattgtcttcaagttcactgatcttttcctctgcaatgtctaaactgctgttaatcacaccccatgtatttttcatttcagacactgcatttcagactctagaggttttatttgagtcttttatacattttccatgtgtaacttttaaaatgttttgaacacatggaatacwgttataataattgcttatttgataattttaacatctgtcagttcttagttttcatttatttatttttctccttattatggattgcattttctatttacttgcaggatagtttttagttgtatgccagacattctcaattttaatttgttgggtgctgaatatttttgtattcctacgggtatcttaaagctttgttctaggatgcagttaatttacttggaaactgttgatccttttgggtctaatttaagatttgataggaaagactagagcatggttagtccagggctaattattcct

SEQ ID NO: 156603 - DNA, 601 bp, Human
taattcctgatgatctgaagtggaacagtttcattccaaaactattcctcgccccattggatccacggaaaaattgtcttccacgaaactggttcctggtgccaaaaatgttggggaccactgctttagggataggctgtgtctgctagacaccaaactaaaagtcaatttaatatatgattgagcccagtaagttcagccttttttttctttttttttttagtgctttatagatgctgcctccctgtcttctcactggcgttgttgctgataagaaatctgcggtcttccttatcttgtrtggaacatgtcttttcttcctctggatgctttgaagattttctttttattgctgactttgagcagtttgattttgatgcaccttggttttatttcttcatgttccttgtgcttgaggctgtttaagctgctttgatctgtgagtgtatgagtttcattaaatttgggaaattttcagtcattattttttcaaaaattttttcctattctcttcctcctttctctgtcctctcattagggtactctgtctacatatagcgggtgccacttgacacccacagatgatctgtacctttctttt

SEQ ID NO: 156604 - DNA, 601 bp, Human
caaaacgactgctagggtttaaaatggttacacagctgggcacagtggctcacgcctgtaatccgagcactttcggaggccaaggagggcggatcacttgaggccaggagttcgagaccagcctggccaatatagtgaaactccatctctactaaaaatacaaaaattagctgggcttggcccaggctcctgtaataccagctcctcgggagactgaggcaggagaatcccttgaaccagggaggcagaggttgcagtgagccaagatcccaccactgcacaccagcctgggtgacagaaygaaactctgtctcaaaaaaaataaatagatagatagataaataaaatggttacatgctcctttgggagtgtgttctaaagccaaacaaatcccttcattctgaggcccctggtgtggtgctggaacctttgactcagggcttatgaatacttgtttgtctccaggactgaagaacagaatactgaggtggcatgtccggagccaccatagcgctgtgatcatgctgtgtcaatttcatctaagtttttgtgttagaattcctctgtgaagttgactgctcaggtgacaggttagcccatg

SEQ ID NO: 156605 - DNA, 601 bp, Human
tatagcagcatctgtaatggattttgtagacactttgtttacatgtttaccatattgtaagggaagagaccgagtcatattcatctatttatctcaattgtcttgtcttttttggcccacagttggagattttaaactgtttaattgatgaaaaaagatgtcaggttgatttacagcatcaagtctgatgatttaacaacagcattctgcacagaggggaactatgcaaaaaggatcaaagccactgaaattactaacagggccaaaaaattctaaccacttccacaaaacgactgctagkgtttaaaatggttacacagctgggcacagtggctcacgcctgtaatccgagcactttcggaggccaaggagggcggatcacttgaggccaggagttcgagaccagcctggccaatatagtgaaactccatctctactaaaaatacaaaaattagctgggcttggcccaggctcctgtaataccagctcctcgggagactgaggcaggagaatcccttgaaccagggaggcagaggttgcagtgagccaagatcccaccactgcacaccagcctgggtgacagaacgaaactctgtctcaa

SEQ ID NO: 156606 - DNA, 601 bp, Human
tgaattaattcgtggaggggaacttctgccttaacctgctcttaactgtgacatcaggagaaaataacttatctcgcttgggtatttgcctatgtgggggtctctttgttatagcagttagcactctcctaaatactatgctagtgtactaaaataaactctcaatcatggaaccctagccctaaggctttaacaagcaatgctggaagtgtgcttcctcacctcctccacttcattgcaaaaacaacctcatggatggccctgtgccggcacatactgctatagcagcatctgtaatggrttttgtagacactttgtttacatgtttaccatattgtaagggaagagaccgagtcatattcatctatttatctcaattgtcttgtcttttttggcccacagttggagattttaaactgtttaattgatgaaaaaagatgtcaggttgatttacagcatcaagtctgatgatttaacaacagcattctgcacagaggggaactatgcaaaaaggatcaaagccactgaaattactaacagggccaaaaaattctaaccacttccacaaaacgactgctagggtttaaaatggttacacagc

SEQ ID NO: 156607 - DNA, 601 bp, Human
gctatcagcctgggtgaattaattcgtggaggggaacttctgccttaacctgctcttaactgtgacatcaggagaaaataacttatctcgcttgggtatttgcctatgtgggggtctctttgttatagcagttagcactctcctaaatactatgctagtgtactaaaataaactctcaatcatggaaccctagccctaaggctttaacaagcaatgctggaagtgtgcttcctcacctcctccacttcattgcaaaaacaacctcatggatggccctgtgccggcacatactgctatagcrgcatctgtaatggattttgtagacactttgtttacatgtttaccatattgtaagggaagagaccgagtcatattcatctatttatctcaattgtcttgtcttttttggcccacagttggagattttaaactgtttaattgatgaaaaaagatgtcaggttgatttacagcatcaagtctgatgatttaacaacagcattctgcacagaggggaactatgcaaaaaggatcaaagccactgaaattactaacagggccaaaaaattctaaccacttccacaaaacgactgctagggtttaa

SEQ ID NO: 156608 - DNA, 601 bp, Human
tgagaagggacatagagctgtgatcttgactttcataagagaacatatgttgttatgaacttgtgtttttgctgctgttgtttttgcttcctgctggtggatagtgatgacaacagcagtcctctaagtcacacattgaagatggcagaacagctatcagcctgggtgaattaattcgtggaggggaacttctgccttaacctgctcttaactgtgacatcaggagaaaataacttatctcgcttgggtatttgcctatgtgggggtctctttgttatagcagttagcactctcctaaatactatgctagtgtactaaaataaactctcaatcatggaaccctagccctaaggctttaacaagcaatgctggaagtgtgcttcctcacctcctccacttcattgcaaaaacaacctcatggatggccctgtgccggcacatactgctatagcagcatctgtaatggattttgtagacactttgtttacatgtttaccatattgtaagggaagagaccgagtcatattcatctatttatctcaattgtcttgtcttttttggcccacagttggagattttaaactgtttaattgatgaaaaa

SEQ ID NO: 156609 - DNA, 601 bp, Human
gagactcaggctgcctcagatcttattctgagacccctgtgtgttccttagtaacagtgatgcatgaatacaccattgagaaggggaaactgaccacagtggaggtccaaaatgaaactgctcacactactaccctctaaacaagagtggtggttgagaggtgcaggctctgagccactacattcacagacatggaagatttggtgatatttttatccaatttaggaaaataaaattaattcagttgtttcttgttctaagttaataggcactaagtcagaaaacttttcatctacatatytttttttctctttaaacatagtgcctcatgggtggaagtgatctggacttcatgtttttcttttggaaccagaaaacatgccatttttggaatattaagcaatttctttcttttggatatggggagggagaaatctgaaatgtatctttagggcacagtttggaggggccctattgataagccctttcagtcttgcaactataaggcaaagtttttgctgaagtcttaggtagtaagttaactacagtgcaattatattttactaagatagtgtgttttattttctaatagtctagtata

SEQ ID NO: 156610 - DNA, 601 bp, Human
tccccaactctcaagctatctcaaggattagtaattttcaattaaaaaatttctttaaaaaaggaaactttctgaacatgaaaaggttttttgtttgtttttactgtggatgtaatcaaatattagagatgtcatccttgtgtgcaactggtatctagaaatgccttctggggaactaaatacaaccctgttaaatgatagacagtgcatggtatgagactcaggctgcctcagatcttattctgagacccctgtgtgttccttagtaacagtgatgcatgaatacaccattgagaagggraaactgaccacagtggaggtccaaaatgaaactgctcacactactaccctctaaacaagagtggtggttgagaggtgcaggctctgagccactacattcacagacatggaagatttggtgatatttttatccaatttaggaaaataaaattaattcagttgtttcttgttctaagttaataggcactaagtcagaaaacttttcatctacatatttttttttctctttaaacatagtgcctcatgggtggaagtgatctggacttcatgtttttcttttggaaccagaaaacatgccatt

SEQ ID NO: 156611 - DNA, 601 bp, Human
aagcttatttagttagtcttatttttaccagtagtttattataaaaacaatgcataaaatattaggaaacggcatggcttttgctgtatgccccagattattctgtctagaatggattattatttgaattaccagattctcccagctggaaaggaactgtgcttggttcctgctctaggatttatgaaataatggggtggtattagcacaaggtccttcaaatgatggggttactctgcaatggatatagaagtcaggtgttggctcttcacatccagagttatgttatggatttacatawctttgttttcaaaatttctaaatctattttgaaaactggtatctctagtcaagatgactagtgaagaattccattctgttagtaaagaaataaatcaatttaataagcacaaattttggttaaggcaatggcaactattgcatgtttagtgttttttgttgctgttgtttctttgtctgaattttaaaaatctaagtcaagttagggcaaagactgaattttagcccatatgtttatgcaatgctcaaaatattaatgtacaggcaagataatttcctggggggaaaacatttagatgtg

SEQ ID NO: 156612 - DNA, 601 bp, Human
tttaaaaccaaactcttccaatgaaaaatacatacaatgaatttggtacaaatggcatgtgattcctaaatttgtttctgaatttatttacaataccagggtgtctcattcccatgacaagagggtaggaaacacctcctgcactgaaaagcttatttagttagtcttatttttaccagtagtttattataaaaacaatgcataaaatattaggaaacggcatggcttttgctgtatgccccagattattctgtctagaatggattattatttgaattaccagattctcccagctggaaargaactgtgcttggttcctgctctaggatttatgaaataatggggtggtattagcacaaggtccttcaaatgatggggttactctgcaatggatatagaagtcaggtgttggctcttcacatccagagttatgttatggatttacataactttgttttcaaaatttctaaatctattttgaaaactggtatctctagtcaagatgactagtgaagaattccattctgttagtaaagaaataaatcaatttaataagcacaaattttggttaaggcaatggcaactattgcatgtttagtgt

SEQ ID NO: 156613 - DNA, 601 bp, Human
ttgctaaattacaatgacagtgttttcctttaagtactaaatattctcttctgaggctgaatccattatagtgctaaaattctgaatttgttgaataattctctatattctaaaagtactcttgtgttagaagtatagtctgcaattaaatgattttcagttaaataatcatttgtgcattaattttctttatcaaattagccatatcctcagtttttcttttaacaaggtaaagtcaaattttaaaaccaaactcttccaatgaaaaatacatacaatgaatttggtacaaatggcatgygattcctaaatttgtttctgaatttatttacaataccagggtgtctcattcccatgacaagagggtaggaaacacctcctgcactgaaaagcttatttagttagtcttatttttaccagtagtttattataaaaacaatgcataaaatattaggaaacggcatggcttttgctgtatgccccagattattctgtctagaatggattattatttgaattaccagattctcccagctggaaaggaactgtgcttggttcctgctctaggatttatgaaataatggggtggtattagcacaag

SEQ ID NO: 156614 - DNA, 601 bp, Human
atttgactgggtttgcctagaaatgttgagattcacatttctttcctttctatttgttggcatcaggcaaatgagggctcagagatgaacctgaagtaaattaacaaagatacttgcacacaagtttgtgtcccatgaaattcctagttgtatgtattgagaatttggtaacaaggagaagtcagtatcttttaaccctttaaggccagactgtctcattctaatgtggatttccagggatttgacttttacaaatcccagcccagctataaatacaactgatggtcataatttttccaaraagttcccccttgctgaaactgaggtgattctgtgaaggcctatttgttcctgaaaggagattaatactataatttaactagcttttcctcattgaaatcctaataatttgctaaattacaatgacagtgttttcctttaagtactaaatattctcttctgaggctgaatccattatagtgctaaaattctgaatttgttgaataattctctatattctaaaagtactcttgtgttagaagtatagtctgcaattaaatgattttcagttaaataatcatttgtgcattaattttcttta

SEQ ID NO: 156615 - DNA, 601 bp, Human
caggagaggatgaaggtgaggaacgtaaaatgtggccacgcttgcagactgacgggactgggaaacagctgaatttgactgggtttgcctagaaatgttgagattcacatttctttcctttctatttgttggcatcaggcaaatgagggctcagagatgaacctgaagtaaattaacaaagatacttgcacacaagtttgtgtcccatgaaattcctagttgtatgtattgagaatttggtaacaaggagaagtcagtatcttttaaccctttaaggccagactgtctcattctaatgtgsatttccagggatttgacttttacaaatcccagcccagctataaatacaactgatggtcataatttttccaaaaagttcccccttgctgaaactgaggtgattctgtgaaggcctatttgttcctgaaaggagattaatactataatttaactagcttttcctcattgaaatcctaataatttgctaaattacaatgacagtgttttcctttaagtactaaatattctcttctgaggctgaatccattatagtgctaaaattctgaatttgttgaataattctctatattctaaaagtact

SEQ ID NO: 156616 - DNA, 601 bp, Human
tggagcacatggtgggagcagacggtgcctctctggattaaggagaggaggtggttggatttcaggggagctcaaaagggatggaggcaggtgtgggccaagacaggaccctggaccggagatggtccaatcaccaatcaccacgtccatgtgtgtcctggagaagaggctgcatagaacagagttgattctacactgagaaatggacaccacacccccatcctctgtgcgggactatacctgtaagacccccaagtttagcaccaactgcaggggcaggagaggatgaaggtgaggaacrtaaaatgtggccacgcttgcagactgacgggactgggaaacagctgaatttgactgggtttgcctagaaatgttgagattcacatttctttcctttctatttgttggcatcaggcaaatgagggctcagagatgaacctgaagtaaattaacaaagatacttgcacacaagtttgtgtcccatgaaattcctagttgtatgtattgagaatttggtaacaaggagaagtcagtatcttttaaccctttaaggccagactgtctcattctaatgtggatttccagggatttgacttttaca

SEQ ID NO: 156617 - DNA, 601 bp, Human
gcaggccccatgcgactggcttatatatttgagatctcttctaattcttgaaactccagggaggtcagcatttttattttatacagggggaaatttaggcacaaagatattcaataacctgcccacaggagacacctgtgcccttgactctgggtcctgttacttcatatctgtctttttttatgctgctgacattataccccctctaccatcatctcatcccctctcctttaatcctccatgctcagtctcccagatatgacctagcctttccctccatccttccagacacagacagaggagaacctggccacatctgaaatgagccaagaataaatggacataactttgtccttagaagtccaggtactagccacaccccccaatgctggatgaaaaggtgatttggtatttggagaataatgggaatccttcagctttgctgggaattgatttgagagcaacaataacaaaaaaggctacttaggaccaaaaatgtggatgatatagaaacacatttttgatacgagaaactggtgagcagtgatgtgttttccctaagaaagaaaggataaccagacaatagatttgatatttttat

SEQ ID NO: 156618 - DNA, 601 bp, Human
tacaatgccaatttccatcgatgcatttaaccgacatgctgaaacatgacttcctgtggacacatctgcctcccctactccttgtgccctgctgagtctccagtccccagcttggaaaagcctggaaatctgagcttatgcagcccacttaatcctgggatcttccctaaaactaaggagagaagctagaaaaaggaagagaatgcaaatcagggtgtggggtcaacaatgacatattgcaaaaggaacatcaacaataacttgcaacatcggggagatattcttgaccttctgggagatrgcaggggtactcctggcaacttaggcaggctgatgcaagtgccctcagcctggtggggaagagatgaactggggaagatgagttcatctcttccaccataccacttctttgcaggccccatgcgactggcttatatatttgagatctcttctaattcttgaaactccagggaggtcagcatttttattttatacagggggaaatttaggcacaaagatattcaataacctgcccacaggagacacctgtgcccttgactctgggtcctgttacttcatatctgtctttttttatgctgct

SEQ ID NO: 156619 - DNA, 601 bp, Human
gtagggtcctcctggggaccagtcctttcccacccagtccccccaccaggccacctccaccccccttcccccatgggggcaggcaccccagagctggctctcacctgtggcaggcagggagccccctctggcagtgaacgtagggcatatgccatgcctgccacatcctcagcccagccctgcatgaaatatgaaatcaaaaaaacaacttcatcctgtcctacattagaaatcacattcacacagtttcttatcaccatcaacccacactgtatgcttttgtctcacctctactttgtayctcaagctctaggaagccttgagggggtagggagcaggtaaagctcactaaagcatctcttggctgcagtgaactatttgacagctccactttcagggagcaaagaagtggaaggttaggaagtgtcagacatgacaaaacattgaggtttgcaaactgcttcttgggatgtgggaatccggaactgatatcccctcccagggaggaagccctttctcctggtacaatgccaatttccatcgatgcatttaaccgacatgctgaaacatgacttcctgtggacacatctgcctcccctac

SEQ ID NO: 156620 - DNA, 601 bp, Human
gaaaccctgcatgcaaatagtacatttgcgttttcaggcggctgcttacaggagccaaaaaggttgaattaccaagacctagttgtagaatgggttgaatacgttagacatgcatttaaactttttaactgtattttttgccttcaacttggggacaaagatttcagggttaatcagtgaaccacattaggtttcttttgtgacactgttttcagtacttgaagttgaaagccatttgcgtgatgcgtatacttgatgcttcaagatacagaggtttgggacaagcggatgtggccagtgrcattaaagagaaataaaacaagaaccctgaaaaagtagaaaatgagaatgggttgtgtgggagtgatttctcaagacagctttgaatttggagatggggcacacaggtgagttgctgaacgtgctgtcaataagtcgtttgctgaacaataaagagtcaactagtcagaaataggcaggggtggataaatgtaaatatgacattgaaaagcaagagtgcacatggtaaaatgttttttaaaaaacattaaggttaaactgtataatgttcagggccataattcaatgtcttctttataaa

SEQ ID NO: 156621 - DNA, 601 bp, Human
gaaaagtaatcctatcagaattcctcagttcactgcatgggaaacaaacaaacagcctgtcagagattcagaggattgagacaacggtatcctgtgccgagcattgaggttctttttaatttgcaaggattagaaatgtcaacgagcatcacattttcctctaaattctaaaagatgactcagtgcagtggatttaaatcagaaggacagcagaaaaaatgaggctgctaataaatgcacggcttctgtgtaagcataggctatgcatacgggttcaaccacacctacccctagagaaaayattttcacttaacacttgagacactgtgaatcagggagaacataccgatgagctccttatttctgacgtccaaggccatgttccgcagcgcagtggccaccgcgcacaccacacggtcattgtctattcggagcagctccacgaggatgggcaggcctttctcttttcggacagcggctcggatatatactgaccactgcaaaaacagggaaggcgaagggcgttagaaacaggaagaaaccctgcatgcaaatagtacatttgcgttttcaggcggctgcttacaggagccaaaaaggt

SEQ ID NO: 156622 - DNA, 601 bp, Human
acaggtgaatgtattacctcttttgtgccttattaataaaagatcctctgtatttcttgaataccaaattaaagagagataatttcttaaaagaataggattaaagggctagtggtctcatccaaaataaatttaaaatagagaggggaagaaaagtaatcctatcagaattcctcagttcactgcatgggaaacaaacaaacagcctgtcagagattcagaggattgagacaacggtatcctgtgccgagcattgaggttctttttaatttgcaaggattagaaatgtcaacgagcatcrcattttcctctaaattctaaaagatgactcagtgcagtggatttaaatcagaaggacagcagaaaaaatgaggctgctaataaatgcacggcttctgtgtaagcataggctatgcatacgggttcaaccacacctacccctagagaaaatattttcacttaacacttgagacactgtgaatcagggagaacataccgatgagctccttatttctgacgtccaaggccatgttccgcagcgcagtggccaccgcgcacaccacacggtcattgtctattcggagcagctccacgaggatgg

SEQ ID NO: 156623 - DNA, 601 bp, Human
atttattatgcaacaaggtgactacagttaataataatgtattttatatttcaaaattgctaagagtaaattttcaaatgttcccaccaaagataagataattatttgaagagatgaaatgttaatcagcttgatttaatcagttcacattgtatgcattcaggttgagaaccccttatccaaaaatgcttaggaccagaagtgttttcggattttagatgttttcggatttgggaatattggcagaatacataccagttaagcatctctaatttaaaaattcaaaattggaaatgctcaytggagcatcatgttggcactcaaaaaattacggattcggcagcatttcaggattttggacttctggattagggaccctcaacctgtatatcataacatcactttgtgtcccatgaatgtctatgattataacttactagtttaccattaaagaaacacaatccttatgctaagtgaaaaaagtcagacacaaaggtcatatgttctatgattccatttataccaaatacccagaataggaaaatccatagacagagagcagattgatggttgccaggggctggagaagggggatggagag

SEQ ID NO: 156624 - DNA, 601 bp, Human
ttgtagaagcagaaggtagaatggtggttatgagagactgaaggtaagaggaatggggagatgttggtggaagggtgcaaagtttcacttgagaagaacagattttttgagatttattatgcaacaaggtgactacagttaataataatgtattttatatttcaaaattgctaagagtaaattttcaaatgttcccaccaaagataagataattatttgaagagatgaaatgttaatcagcttgatttaatcagttcacattgtatgcattcaggttgagaaccccttatccaaaaatgcytaggaccagaagtgttttcggattttagatgttttcggatttgggaatattggcagaatacataccagttaagcatctctaatttaaaaattcaaaattggaaatgctcattggagcatcatgttggcactcaaaaaattacggattcggcagcatttcaggattttggacttctggattagggaccctcaacctgtatatcataacatcactttgtgtcccatgaatgtctatgattataacttactagtttaccattaaagaaacacaatccttatgctaagtgaaaaaagtcagaca

SEQ ID NO: 156625 - DNA, 601 bp, Human
cggtatatatacacaaaggaatactactcagccacagaaaggaagggaatcctgtcctttacaacaacatggatgaacctggaggacattatgctaagtgaaatgagccacttacatatgtacacataccacatgatctcacttaaatgtagaatctaaaacaaatgaatttatagaagcataggctgggtgccgatggctcatgcctgtaattccagcactttgggaggccgaggtgggtggattacctgaggtcaggagttcgagaccatcctggccaacatggtgaggccccacctcyactaaaaaatacacaaattagttgggcatggtggcacgtgtctgtagtcccagctactcgagaggctgaggcaggagaactgtttgaacttgggaggtggaggttgcagtaagtcaagattatgccactgcactccagcctgagcaacacatgagaccctgtcacacacacacacacacacacacacacacacacactcacacacacacacaaacatgctttgtagaagcagaaggtagaatggtggttatgagagactgaaggtaagaggaatggggagatgttggtggaagggtgcaa

SEQ ID NO: 156626 - DNA, 601 bp, Human
agtaaccaaaaatataattatgggttgatatcaaaaatatataaagaattcaaacaattcaacagcaagaaaacaaataacctgattaaaaaatggacaaaggatatgaatagacattacttaaaagaagaaatacaaatggctagcacatatatgaagaaaggttcaatatcactaagcaatgcaaattcaaaccacaataagttatcacctcacacctatcagaacagtaattatcaaaaagataaaaaccagtgttggtgaggatgcagagaaagagaaacccttgtactttattagygggaatgtatattagtacagccactactgtactgattagaaaaactgtatataggttctacaaaaagctaaatatagaattactatatgatccagtaatcccacttctgggtatatatccagaggatctggtatcagtatgtcacagaaccatttataactctcatgttcattccagcattattcacaatagttaatgtatagaagcaatctaagtgtccatcaatggataaatgaataaataaaatacggtatatatacacaaaggaatactactcagccacagaaaggaagggaatcc

SEQ ID NO: 156627 - DNA, 601 bp, Human
agataacccttaaattaaatgcaaactaagtgtaaatagcaagttgcaagcttatttcccgctgtataatgaattacaagtatggtgaatctgttagacacagatttgcagcctggccttgcagtgaataaataaatggctgaagagctgcaaatattatggtttttcttggaggatatgatggctattgtgaaatggcaggagaaaaagtggctgcttcccaggtcataaaaggcttaatataccactatctgtaatttggataggggaaaaagaaccatgtaactataaaaacattttrtctgcaatttggagtcacacttggtcttccagttgccccaggaatggaatcttgagctctttgcctattgtcacctaatttctcccagttcccaagatcacctgcacccttgccacgggggttggtccagctcccttctgctgagcctctggatgctacctactgacttctgttccctgcattcaggctgccagatttcatgctgtcattggactagtgaccctacagaaatgatatccctaacaccagatgcctaccagccagaccaatggcctgtggggactgtgtcatcctctgaga

SEQ ID NO: 156628 - DNA, 601 bp, Human
gtagttagtatccaggcagtagactgattagctattgatttttttctccatttttcagagaagggataggattttattgggaatcccagtgctgtcctgtctgaaacaactgtgcaacgaaaaaaagaaaagagtatatgggaagagtaccttgacctttggagctaacgacctactttagatataccaaatctacacaattcacagataacccttaaattaaatgcaaactaagtgtaaatagcaagttgcaagcttatttcccgctgtataatgaattacaagtatggtgaatctgttagacacagatttgcagcctggccttgcagtgaataaataaatggctgaagagctgcaaatattatggtttttcttggaggatatgatggctattgtgaaatggcaggagaaaaagtggctgcttcccaggtcataaaaggcttaatataccactatctgtaatttggataggggaaaaagaaccatgtaactataaaaacattttgtctgcaatttggagtcacacttggtcttccagttgccccaggaatggaatcttgagctctttgcctattgtcacctaatttctcccagttcccaa

SEQ ID NO: 156629 - DNA, 601 bp, Human
atgttgttcttgtcaaattctgctattctcagtcaagaaaaaaatattgatttcataaagcctgtgacttagatattttcccttctactttcaaatgactggcttcatttcccatctggtgacatttgatagtaaaggtttcgttgaacacaggcagtatagtggtctaaatattcctgtctccgagagaagactagataactggcttttgagaaagaagagatgcctaggagctgtcaaaccaatcaatagttcactattttgttatattttaatccaccaaaagaaaaaaaacacacayacaaacacacaataccaagtagttagtatccaggcagtagactgattagctattgatttttttctccatttttcagagaagggataggattttattgggaatcccagtgctgtcctgtctgaaacaactgtgcaacgaaaaaaagaaaagagtatatgggaagagtaccttgacctttggagctaacgacctactttagatataccaaatctacacaattcacagataacccttaaattaaatgcaaactaagtgtaaatagcaagttgcaagcttatttcccgctgtataatgaattac

SEQ ID NO: 156630 - DNA, 601 bp, Human
tttggaccagagagaaagcaatgaagatgaagagaagtgttaaagtctgcgaaaattcagaaggacaaccagatttgttgatagattaggtatgaggtggattgcatacgagtcaaagaagacgccaaggtgtctgtcccaggtctctgcaagaataactggtcattttctgggggaatactatggaagggtcaggtctgggagagaccttggttgtggacatgctatatttgagacactcataagacatccagtggagaggatagagcagacagttggacacaggatctgaggttcatgstggagatacctgtttggagtcaccagaatacagatgatcttcaatgccatgaaaccatatgatgtcaccctagccttctgtgagaggtgatggagaggagaggaggtccaagattaacctttcattgttcttcactcaaagtcactgcagctttcttctgtgtataaagttctgtatagcattttcctacaaaaaccacttgggtacagtatttaaagtaaaatagttagcaaaagtcgcatttcctctctcttaaatacaatccaatgttgttcttgtcaaattctgctattctcagtc

SEQ ID NO: 156631 - DNA, 601 bp, Human
ggtgaggactgagctgcatgaatgccaagaggaagagactccaggaagcagcaagttcaaattccctgaggcaggatctcagagcatgtaatataggaatcacagtcaaccagtggcctcagaaaatttattaatttccagaggactaggtggggttggagaggtcatagggagcttccacatctgccctgcaaagacttgattttacactgagatgaggagggtttggtgtgaaggagtgacgtgctctgactaaggtttcaacaggataactctggttgccactgcaataggagaccawctagggtgaaggaagcacagggagactaggtaagggggtgctcaggaataagccaggagagggatgatgagagttttggaccagagagaaagcaatgaagatgaagagaagtgttaaagtctgcgaaaattcagaaggacaaccagatttgttgatagattaggtatgaggtggattgcatacgagtcaaagaagacgccaaggtgtctgtcccaggtctctgcaagaataactggtcattttctgggggaatactatggaagggtcaggtctgggagagaccttggttgtggacatgct

SEQ ID NO: 156632 - DNA, 601 bp, Human
cgcatacacaaaaaacataagagacaatgtgaggataaaattacacaatggaaatctaaaacaagtgagaaggtttcttatcaaataggtgctgcccacttcagctctgggtgcagggagtagcctttatcaggaaaggccactgcaaggtgggctttgaatggtggtggcaggtagtaaatgcaagctcatgttatgctttaaatgtttggtttgagtttgttttgttggcagagaggatgggatttgcctaaaataagtgtctgccatctacaccaggaactgtccatgtgccgaaatrggtggcattttgctaaactttctgttgaagcaatacaatattgtttgctcttttcactgatgctaattattaccattccttttttaaaccttccatactcagaaggataattaacattttttgaaggttgcaaagaaatgtatggatgtgcattaacctcggctactattctatgccagtaggaagaacacaaagatctatctatagcatacttattgctgtttcccagagacatacacataactatggaaacaacccaaatggaaagccaagggagaggcaaagcgtgtttcattctgc

SEQ ID NO: 156633 - DNA, 601 bp, Human
agacacagacatccctctaccccttcctctctctatttggattccccaaacctcctccagatctgctctttgaataaatacgctgtgttatttatccaccagttaattcattcagcaactacataccgagttcttgttatgagcatagcaaagtgctagacactgtcagacataaaagtaaatacatcacctgatgcttgcttattatttcatttggggaagacatacgcatacacaaaaaacataagagacaatgtgaggataaaattacacaatggaaatctaaaacaagtgagaaggyttcttatcaaataggtgctgcccacttcagctctgggtgcagggagtagcctttatcaggaaaggccactgcaaggtgggctttgaatggtggtggcaggtagtaaatgcaagctcatgttatgctttaaatgtttggtttgagtttgttttgttggcagagaggatgggatttgcctaaaataagtgtctgccatctacaccaggaactgtccatgtgccgaaatgggtggcattttgctaaactttctgttgaagcaatacaatattgtttgctcttttcactgatgctaattattac

SEQ ID NO: 156634 - DNA, 601 bp, Human
acatgagttgtgtaatgctcactacacaggggggcgctgtgtagcgcccttcccttccatcttggttggtggatgcctgtgtttgagaagcagcagattccccctaggaaatggccctattctgaccccagagaaagtcagatcccatcttgtgctccttttgaggttggaatggggagagaaggcattggctggacagaagctcagctagttggtaaagtgaaaagaaagcccagcgtgaaaagtggattatagaataggaacatatgggggcgtcagtcaaaggaagattcttacacakcctccccaatgtggtgaagcagccatccaaatgggagcagaatgtagggaaacagtcctgcaaagcacagaaggatgaggccaaaggatgatggcaaactgggaaagggccaggctcatgacacggaggataggtccttctcttcagcctcaggagggtgcagggagctaggaggatgcttgcagcatcccagccctggttcgcctgctggaaactgtggcaagttgccaccacccggggcagccagtggaggggctctgtgagctccgccagtacccgcagggatgcggtggccccgcc

SEQ ID NO: 156635 - DNA, 601 bp, Human
tcaaatctattatttgaatatttaaaacattgtggtaagtaaaggaagcttgaaaggatggccctaattccccctgcccaccccccacctccttaacccccagaatgaatgaaaaggatgatctaaagatccatgtggggaaaggaatagcaatgatttttactacttaaaaaataataaactcccaggcaagaaaccacccttattttgttcctgattttgttcacgtgggaaaacatgagttgtgtaatgctcactacacaggggggcgctgtgtagcgcccttcccttccatcttggytggtggatgcctgtgtttgagaagcagcagattccccctaggaaatggccctattctgaccccagagaaagtcagatcccatcttgtgctccttttgaggttggaatggggagagaaggcattggctggacagaagctcagctagttggtaaagtgaaaagaaagcccagcgtgaaaagtggattatagaataggaacatatgggggcgtcagtcaaaggaagattcttacacagcctccccaatgtggtgaagcagccatccaaatgggagcagaatgtagggaaacagtcctgcaaag

SEQ ID NO: 156636 - DNA, 601 bp, Human
cacctaatctgaagatacaaagttccagccaaggtacagagcttgccttctgtctaaaatgtggcttgtgaaatcaagttattaaaacaaaccagcagagagtgctccaacaaatcactttgtctaagaaataaggtttctttttaaaatactaattgaaattccaagtgttctaataaaaacgacatctgtctgggtctgaagaaacatattttgaaaagcagagaagatatgtctctaaaatttcctcagatcaacgtaataaagtgaacttacatatttccagtactaaaaacagcaygttgccttcctgggttgcactggactttccacagccttgtatctttccctggacggaggtgggattcgtcagggccaagagcacaagtaaagaaggtgcctacagtgccacgtgatcagtgaccctcaagaggtctgtttcccagaatggagcacccatatcccagaacgttctgtcacgtgccagccattagcatgagacgcaaaaataagaaaacacatgggtatctattttaactgataggactctaaatgtttcttagagccctctgtttctcagtttcgccagcagacagtgggg

SEQ ID NO: 156637 - DNA, 601 bp, Human
aagtaaaaactggggtttatgttcgaatctgaggaagaaaggagatggtgactggaaaattaaacctagtgagtttctaacattttaagaggaataaggtcactcccatagacactgggggtattagtctgtggaggtaatagtcaattaaaatgtaataccaccagtttccatttcatcactataactttcctttctgaccaataaattaaactgttcaagtctcaaggtgaggaccacagggatttgtatcttttgatctctcttgagcactgaataacctctaatgttaatgttgcartcttagtgagccttaattgaaagtaacacactgcacattaacatatatgtgcatcagcccaggctatactgcctgaagttcagttgcctacatcaaatgataagaaacatacactcactttgggattgaaggctattatatgcttaggaaataagccactctatgcttcaaatccattcattttacctgacattgcttaagtacattataatacacgaaattgaataggaaaattttgttttaactttaaaaaaccaagtttcccaaatggacagtatattgttacgaactttctggtta

SEQ ID NO: 156638 - DNA, 601 bp, Human
tcccagcactctgggaggttgaggcgggcagatggcttaaggccgggagttcaagaccagtctggccagcttggcaacaccttgtctctactatgaatacaaaaattagtcaggcatggtggcgtctgcacctgtaatcccagatacccaggtgcccgaggcatgagaatcgtttgaacctcggaggctgaggttgtagtgagctgagattgtaccactgtactcctgagtgacagagcctgagtgacaaagtgagaccctgtcttcaaaaatttttttttcaaaaaacgaaaaaaaaaaatgaggcagcagagttcactttgtgtcattcacatcaggaaacactgactagtctgtaactggagtaccttgcaaaggtaagcgtggcagcagtgatgtgggaggggggagtgcagactgggtaagaaggggcagagggcaggaacccccacagagtgcgcgtgtgtcctgggcttgtcatgctatgggctgaaactgaaaagtaaaatgctgaggggtagtaaagagaactcaagaaactccttggcaaagtatcaataagatatcacacttggtttactcacttgggataaagaaaagg

SEQ ID NO: 156639 - DNA, 601 bp, Human
agaacactaggaaagttttatcttaggaacaaaggtacgtgaatatgccaaatgctgccggaaggttccagcaagtttggaagagagacatatctactgcactaagaagcacaaaggctcttgggggcctcaataaaaatttttactaagaaaaaaatcagggctgggcacagtggctcatgcctgtaatcccagcactctgggaggttgaggcgggcagatggcttaaggccgggagttcaagaccagtctggccagcttggcaacaccttgtctctactatgaatacaaaaattagtcrggcatggtggcgtctgcacctgtaatcccagatacccaggtgcccgaggcatgagaatcgtttgaacctcggaggctgaggttgtagtgagctgagattgtaccactgtactcctgagtgacagagcctgagtgacaaagtgagaccctgtcttcaaaaatttttttttcaaaaaacgaaaaaaaaaaatgaggcagcagagttcactttgtgtcattcacatcaggaaacactgactagtctgtaactggagtaccttgcaaaggtaagcgtggcagcagtgatgtgggaggggggagt

SEQ ID NO: 156640 - DNA, 601 bp, Human
gaagaacactaggaaagttttatcttaggaacaaaggtacgtgaatatgccaaatgctgccggaaggttccagcaagtttggaagagagacatatctactgcactaagaagcacaaaggctcttgggggcctcaataaaaatttttactaagaaaaaaatcagggctgggcacagtggctcatgcctgtaatcccagcactctgggaggttgaggcgggcagatggcttaaggccgggagttcaagaccagtctggccagcttggcaacaccttgtctctactatgaatacaaaaattagycaggcatggtggcgtctgcacctgtaatcccagatacccaggtgcccgaggcatgagaatcgtttgaacctcggaggctgaggttgtagtgagctgagattgtaccactgtactcctgagtgacagagcctgagtgacaaagtgagaccctgtcttcaaaaatttttttttcaaaaaacgaaaaaaaaaaatgaggcagcagagttcactttgtgtcattcacatcaggaaacactgactagtctgtaactggagtaccttgcaaaggtaagcgtggcagcagtgatgtgggagggggga

SEQ ID NO: 156641 - DNA, 601 bp, Human
tagaaattatcaaaactaaagcacaaagtgaaaaagaacaataaaaaaatcttaaactgaagatctaagacctacctacaggacaatatcatgtagtgtaatatacatgtaattgaattcccagaaggacaggaaagtgagatggggtagaggaaatataataatcaataatgaccaagcatcttgaaagcaggtagtataaaaatacatactcagggaacaacagtaacaactgacttctcatcaaaagcaatggaagccataagacaacagaataatatctttgaagtgctgaaaaaaattattctcagaattctaaggagaggtatcctttgtggatggaggcaactaaagacattttcaaaatgacacaaagctgagagaatttatcttcatcagacttgcactataaaaagtgctaaaggagtttcttcaggcagaagggaaattatatcagatttatacaagtttattgcaggaagaaatgaagaggacctgaaataaaatggaggagaggtcttagatatagtgtgtatatggagagggaagaggaggagtgcgtaggggaggggagggaggaggaagggaggagaggagaggg

SEQ ID NO: 156642 - DNA, 601 bp, Human
agaaagagatcttatatggctcagaaaactgataactgggcaatagtatacggagtatagagaaatctttggaatctacaggtgctcaacttctgagcctaatggtagattaaatactgatcatgctcttgaaacatttgcactcagtggtaaactgaatttaactgggctgcaactgggctgaatttaactaaagcccagatatagttaaagcatgcattagattatctcagccctctaccttagcaaccccgtagatgaaatgaggtgctttttaggaggaaagaattaccaacttcaktctattcaaatctttcaacataaaacgtccggcatacaataacaaatcacaagacttgcaaagaagtaagacaatatgaccgaaaattaagagaaaataaagttatcataggcaaatccacaataatatagatgttagaatatgtagataaggactttatctgtgatatatttgttaaattatctagtgagataatggacaacatgcatgaaaaaaattggttaaattcagcagagaaatggaaactataagacataaccaaattgaaattctagaattggaaaatacaatatcagacag

SEQ ID NO: 156643 - DNA, 601 bp, Human
aaaagatgctctggtataggttataatggcaaactgatttaaattacttaggaaatctatgtatgacaataaaaatttggtttataaaaccacaatattatgacttcaacctattatgcattacaacacaacttaataagaatctactaggccaggcgcggtggctcacgcctgtaatcccagcactttgggaagccgaggcgggcggatcacgaggtcaggagatcgagaccatcctggctaacacggtgaaaccccgtctctactaaaaaatgtaaacaaattatccgggcgtggtggygggcgcctgtagtcccagctatgtggggggctggggcaggagaatggcgtgaacctgggaggcgaagcttgcagtgagccgagatcgcaccactgcactccagcctgggcgacagagcgagactccgtctcaaaaataaaaacaacaacaaaaaaataagaatctgctagacgacagaacagatccgttctgggggttatagtagcaaagaaggaagacactgtccgtgtccgtgttcccacagagctcatattctagcagaacagtaactacgcaacgtgtatcttcatcacaacatta

SEQ ID NO: 156644 - DNA, 601 bp, Human
ggtctcagttataaaagatgctctggtataggttataatggcaaactgatttaaattacttaggaaatctatgtatgacaataaaaatttggtttataaaaccacaatattatgacttcaacctattatgcattacaacacaacttaataagaatctactaggccaggcgcggtggctcacgcctgtaatcccagcactttgggaagccgaggcgggcggatcacgaggtcaggagatcgagaccatcctggctaacacggtgaaaccccgtctctactaaaaaatgtaaacaaattatcsgggcgtggtggcgggcgcctgtagtcccagctatgtggggggctggggcaggagaatggcgtgaacctgggaggcgaagcttgcagtgagccgagatcgcaccactgcactccagcctgggcgacagagcgagactccgtctcaaaaataaaaacaacaacaaaaaaataagaatctgctagacgacagaacagatccgttctgggggttatagtagcaaagaaggaagacactgtccgtgtccgtgttcccacagagctcatattctagcagaacagtaactacgcaacgtgtatcttc

SEQ ID NO: 156645 - DNA, 601 bp, Human
gaatggtgttctttagaaaggactttttgtctgctttggtttgcagagtaaaaataaagcatgtagttctatttttataagtttgtggtggtgatgtgttcaagttaaggaaagagagtagagggtaagtaggtctcagttataaaagatgctctggtataggttataatggcaaactgatttaaattacttaggaaatctatgtatgacaataaaaatttggtttataaaaccacaatattatgacttcaacctattatgcattacaacacaacttaataagaatctactaggccaggcrcggtggctcacgcctgtaatcccagcactttgggaagccgaggcgggcggatcacgaggtcaggagatcgagaccatcctggctaacacggtgaaaccccgtctctactaaaaaatgtaaacaaattatccgggcgtggtggcgggcgcctgtagtcccagctatgtggggggctggggcaggagaatggcgtgaacctgggaggcgaagcttgcagtgagccgagatcgcaccactgcactccagcctgggcgacagagcgagactccgtctcaaaaataaaaacaacaacaaaaaaat

SEQ ID NO: 156646 - DNA, 601 bp, Human
tcaatctcttgacctcgttatccacccacttcagcctcccaaagtgctgggattacaggcatgcgccaccgcgcccagccttccacaatcttttaacttaacctgagcatttccttcctattgatcccaggcctttagacaagctcaatcaattgtcaaccagaaaatgtttaaatttacctacagcccccctcactccctcctcccccaccctgacccctgccatccccaaccaccccctgcactttgagttgttccacctttctggaccaaaccaatgtatttaattgatgtctcatgmctctctaaactgtataaaaccaagtgcaccctgaccactttgggcacatattctgaagacctcctgagggctgtgtcatgggccatggtcactcatatttggctcagaataaatctcttcaaatattctgcagagtttgactcttttcgttgacacctccaagaccaacagcgagactcagtgagagtgaaatacaattgcaatcgtgttctgatgggctaagcaagctgtcacagaagaaggcaatgctaatgccagaatgtggtctcaggtcaatttaggaatattcaaggcagacca

SEQ ID NO: 156647 - DNA, 601 bp, Human
catgtttctttgccatattttgaaatggtcctgcagagctgtcctttgtgagggaaaatttgcatctgtaaagaatctctgctaacataactagatctttttatcgcaggccctccccatcctgaagagattaactgagagtctagcaccctttaaaggtctgaataggaaacatttgtcatctattgtctctaagggcagccattataagacttcaaaagaaccttggtctccacaatcttttatctttttttttttttttcagatggggtctcactctgtcaccaggctggagtgcagyggtgtgatctcagctcactgcaacctccgtctcctgggtttaagagattctcctgcctcagcctcccaagtagctgggactacaggtgcacgccaccatacccagataatttttgtatttttagtagagatggggttccaccatgttggccaggatggtctcaatctcttgacctcgttatccacccacttcagcctcccaaagtgctgggattacaggcatgcgccaccgcgcccagccttccacaatcttttaacttaacctgagcatttccttcctattgatcccaggcctttagac

SEQ ID NO: 156648 - DNA, 601 bp, Human
tgggtctacagccctgtcagctctaccatctaaactcatccctttgtctcttgccaaagcaaaacggagatatagttatttttcctaaaagttcatcagaatgcttaaaggaaagttataaagtaaacaaatttataggaaagtctgtgtacctgtcaatcacactgttactatctagactgattccttatctaattagactaactgggattttaggcagtggtgatttgttttttctgcacccagttcaagctggtcgctcagcttccttcaagccacctaggagctggtgggttacagwttaaccagttggaggggtggttgtggttgttcttgttactgctagttattgtctaagctgcagttttcctgcatttcatttttattctaaacatttctacatcttccactccatctctgctttgagttaacgaggggtggaggtggcctttggagacaactgggaagctaaaatgcaggtttgctagaagtcctgctttaagccaagctggaaggattttataacctgattcagtcacctgggcctttcccacgggtgcctaataactgtggatgcagccatgattataagtatgaggtc

SEQ ID NO: 156649 - DNA, 601 bp, Human
caatcatatagactgtgaaaagtcctgaacctggagacttcataaccaatcagaggctgattcccaccatccgggaggaagaacagggctcagagtggaaggatgagaagagaggagtctgcagaagatgtgccttcgagatagagaacattccatgcgctccctcccctccttctccggtaactgtccccactcttcacatgcagtaagggtcacttgggattgcttatctattctgcagaagacaagaccagagttggcctacagctgtttaaaccccctacctcatgcctgggtctacagccctgtcagctctaccatctaaactcatccctttgtctcttgccaaagcaaaacggagatatagttatttttcctaaaagttcatcagaatgcttaaaggaaagttataaagtaaacaaatttataggaaagtctgtgtacctgtcaatcacactgttactatctagactgattccttatctaattagactaactgggattttaggcagtggtgatttgttttttctgcacccagttcaagctggtcgctcagcttccttcaagccacctaggagctggtgggttacagattaaccag

SEQ ID NO: 156650 - DNA, 601 bp, Human
aacatgtgtggtcttataattttcagtatcatccacacaaggaaacattacctcttgtcttctttattccaaagtaaaaatgaagacaattatgtaagaaacctgtcttgggttaatgagccaagaaatgcttatctacctgtggatgggcattttattttaagatgagacttcctgtagatgtttctgtacttagagattaacataattggaccatgactttaactatctttttttttctttttcacactgatgacacacagattaatatctcagtcctgagctctaaatgaatattgtyggctttctacgtggcatgtcccctttcatgtctcacagatatttcaaactttcagtccaaaatcaaagttgtgatctaccatcccctcccctcctctgtctttttttgccacttacggcattttgtatttcatccatcagcaaaccttgctggttccaccttcaaaatactttttctacccctgtgctacaactctggtcctggacagcatgagctctttcccagactcctgaatccaagtcctcactgctcttccatcttatctactgtctagtgttcaaccagcagccggagaggact

SEQ ID NO: 156651 - DNA, 601 bp, Human
taaaaatttcaggagtaagatgtgaccattcggaataataagcctaaagaaataaaagtaagacagataatacccaacacgagagtctagactcgtggatggaaattcagacttctgatcagtctcaactgattggccttttcctcatgtcccatattttttcctggggtggataaacagccaagatgcctcaacagtagtggcatgaataaatctgtttaagttttgttcttaaacaagtaagaggaacttaaaatggcttcacgtgatgacctacagtcaacctaaaataatctgaacrtgtgtggtcttataattttcagtatcatccacacaaggaaacattacctcttgtcttctttattccaaagtaaaaatgaagacaattatgtaagaaacctgtcttgggttaatgagccaagaaatgcttatctacctgtggatgggcattttattttaagatgagacttcctgtagatgtttctgtacttagagattaacataattggaccatgactttaactatctttttttttctttttcacactgatgacacacagattaatatctcagtcctgagctctaaatgaatattgtcggc

SEQ ID NO: 156652 - DNA, 601 bp, Human
gatgactacacacacacacacaaattacctgacagataaaaatttcaggagtaagatgtgaccattcggaataataagcctaaagaaataaaagtaagacagataatacccaacacgagagtctagactcgtggatggaaattcagacttctgatcagtctcaactgattggccttttcctcatgtcccatattttttcctggggtggataaacagccaagatgcctcaacagtagtggcatgaataaatctgtttaagttttgttcttaaacaagtaagaggaacttaaaatggcttcaygtgatgacctacagtcaacctaaaataatctgaacatgtgtggtcttataattttcagtatcatccacacaaggaaacattacctcttgtcttctttattccaaagtaaaaatgaagacaattatgtaagaaacctgtcttgggttaatgagccaagaaatgcttatctacctgtggatgggcattttattttaagatgagacttcctgtagatgtttctgtacttagagattaacataattggaccatgactttaactatctttttttttctttttcacactgatgacacacagattaa

SEQ ID NO: 156653 - DNA, 601 bp, Human
ctggatgttagacatggaatcaaagcaggtcattttggagcttcaagatttgacttccacactggatttcagacttgcatgggtcctgtagcccctttgttttggccaatttctcacatttggaatggctgtatttacccaatatctctaccccattgtatctaggaagtaactagcttgcttttgattttacaggctcataggcagaagggacttgccttgtctcagatgagactttggactgtggacttttgagttaatgctgaaatgagttaagactttgggggactcttgggaaggyatgattggttttgaaatgtgaggatatgagatttaggaggggccagtcacagaatgatatggtttggctgtgtccacacccaaatctcatctagaattgtaactcccacaattcccacatgtcatgggaagaacctagtgggaggtaactgaatcatgggggcaggtctttcttgttctgttctcacaacagtgaataagtctcatgagatctgatggttttaaaaggaggagctcccctgcacaaactctctctctttgcctgctgccatccacataagatatgacttgctcctccttg

SEQ ID NO: 156654 - DNA, 601 bp, Human
gtagtgatgccttgaacatagaatcactttgttaatgttcattgactgattatcttggatttctgctaaggaaatattgaaaaatgagatgtagaaaacaaatggaaatgaatctgggaaaaagttttagtgtttagtatatattaaaacctgatgtgatacatatagctcatttcaaaataatgacatatttgcccctccaatttgctaaggtattttaaaaattattattttgttattataatttctagaaacaggggtctcactgtctttcccaggctggtctccaactcttgggctyaagcgatccttctgccttagcctcccgagcagctgggactacaggcatgtgttattgtgcccagcttgcttaagtattttaaattcatgggctcattgcacaatcttaatagcacttgacttgagttttgaaggtcctaagaacttttgtaagtaataatttagagctcagtgagaagcagcttcatatgaatggaaagggcagtgccattcataagaggaaatggctgaactagctagggctaacactgcaatgcagatatgtgatgctcagcctgggctgtgtatcagaatcccctgg

SEQ ID NO: 156655 - DNA, 601 bp, Human
gaagacaagggagcagtaagaagcacatttcctactaccttcagcagaggctccctgcaagccccaacttgtagtttgggtccactgggatcccctcagctgctcccgccttcccgccagtccccacgcttgcctcccatcgctcatcatctcccagctcctccttgaagaccgcacttgccctttgctgggcactgctgaaactgaagtttttgagcattttctctgcgaaagttgaaggcttgctatagagtcagggtgatttaacattttctgaatgactccaggactctttggggarcatcatttatttttctatattataataatattctcacaaagagcttctgccctacactaagtggtcctagatagttccacgcttgtgtttatataaagagcctttacatttccatcctctcctattgcctatttatttctcattactttttaaatattctctactgttcaatgtttgactgagagccttaatgtgttttctgagagcaatgcatgggctctctggcagctctgtccctggctgaagctgagcaatgccaagggtcccattttccacctggcatgggaatgctggcttgaa

SEQ ID NO: 156656 - DNA, 601 bp, Human
cactgcagttctttccatcttaaacatgaagacacaaaggcacagagacagaaagtaacttgcccaagggagtcaagctagaaaatgtacaacaatgcccaacacttagccagaaataaaaggtatgcaagaggaaaagaactaagaggagtattagagaagacaagggagcagtaagaagcacatttcctactaccttcagcagaggctccctgcaagccccaacttgtagtttgggtccactgggatcccctcagctgctcccgccttcccgccagtccccacgcttgcctcccatcgytcatcatctcccagctcctccttgaagaccgcacttgccctttgctgggcactgctgaaactgaagtttttgagcattttctctgcgaaagttgaaggcttgctatagagtcagggtgatttaacattttctgaatgactccaggactctttggggagcatcatttatttttctatattataataatattctcacaaagagcttctgccctacactaagtggtcctagatagttccacgcttgtgtttatataaagagcctttacatttccatcctctcctattgcctatttatttctca

SEQ ID NO: 156657 - DNA, 601 bp, Human
tacattgcataatgcactaaaatccttcctgagaatcctcatctcaaaggatttgctgaaaaatatattaatacattttccctgagatttttcatggttcattgagacacctagagacggctcttttctggcgtgcaccatttagacagtgcagcgctaatgggtattaaagacgcagcactgttaccttgaagatacaagctcatggaagatatatgtgcatggggccacaaaatgcatttgatcttctactttgtgttcatgtgtttgaatttgtttaaggcaagcttattttggtaawtaaagcttaggagttcttggcagttttttcctcttaaaggaataataaaactggctctctctttttatcaaactctgcacatgtgtaggagaatataatgacaggtacttgggattccagcttctgtgtggttgcagattactctttagtggcgacactgcttcattgttccattatttaccagtgggcttcttggaagaatgcagatgtgatgaccaaatagaaaaccttgttgaaaggagtaagttgctttttgggaaaaattaagcatctgcattagaaagatttgtgcctacaata

SEQ ID NO: 156658 - DNA, 601 bp, Human
aaatacattttagatcattgatggttttgtactacctgtgcttctatttcttctcaatatcatctggcttttttttccatgatgaaacagagcaatttttgagatgtgtatatactttcagttcatggagaactaaaactatgtaccctcctaaaacttctgcccaatactcccctgacacacatacagctagacaacaaatctacatgcagatagaaatggttttattaccatcacttaattacccctgtcctcattaacgtcacttactattccaggagattcttgccaatgcaaatawcttgattgttcaatccagaaacttgtagaaaaacctactgactcttccatggaaagtatcaaaagacagtttgtgccctaagacatactgaattcctgtttctaccaatcctgaatggtggcaagtcttagcattgggagattcaccttaaaccagaattcaaattctccacaaaatctcatctccctcctcccaggcactgccaaagctcccttgagtgctgtcccccttaccacagtaagaaataaattcagctttgtttcagcaacaggttgtgttgatgatctttagggcggcggc

SEQ ID NO: 156659 - DNA, 601 bp, Human
aaatggacaatggtcagacaatgcataaaaacagaactttgacccacaacctgagcatcctgcccaggaaaccaactccttacctgtaataagcaactcaggaagcaagcctgctattagtttcacagaaagacagattgccatctctattcagaacttgtgcaacatttggccccagatggccaggacgtgattcataaatgaaagcttccctagtttttgtctctgcttccaactgaggaccaaccagagaaggccaggcatacaccccaaccaatcaccaggggtgctccacttctgkttggctcataacatctccgtgctatcagcttccaattagggcacaactgaagcttcccttttctccactataatatttaccactcttctgcctttaagtctctgccaaaacacaagtgataatggccagcccccttgctataggaagctcagaatagacagcctttgcttttctcctttggttgtttatttccacaaagcctgccctaccagaacaaaagcgcattcattcttagtaaattgctagtgaatttccttctcaagggtctcaaaaaggctctttattaacatatactgccat

SEQ ID NO: 156660 - DNA, 601 bp, Human
aactttgtaagccacaagcaattcgctgtcttagtggagggaaatactcttctgtccatgttgctacatacagactactgttaacaaataagaatggagatatttccagtgccaggctcatagtagtgcccaaccaatttcagtgaaggagtctagcaagttgaacaaagtgctacttcaataatctattcctgaaaacttgtttttaatgtggtttagaggatacaattgtgcatgtatattttagcctatggaattttaactggatgctctttcttcttccctttctaccaatttctgktagatttctttctactttcaagccatgttctttttccacccaggtctattggtccctaggccttgagacccagagtcaataacaccttccctacaagaaacacacccagaagtgtccaccacctcaggtcccagtgaaaagaggtccaaggagatactaagctacgttcaatgtttccctttggttaactgcctgcttcttacatttccacaatgatttcctttacaatttgtatctactgctacaaatggcttatagatgtagtaccagaaggagaaaaactaataatagataattttc

SEQ ID NO: 156661 - DNA, 601 bp, Human
taaacatgcattggcacagacagtacactaactttcaacctaatgaaagaaacctaatgaatgaaaatgtaaggcttgccaaatgtgttatgataactctccagtgccaaggaaatatcaccctccccacggataccctggcaagcctgtgagtttaccccagtcagcaggtgcaccaaccatctcccctgcattgtaggtgagtgtatctatccctcattacaaggcttcttgaaattccttctgaactttctttctggaaatgctatccattatccaggcacccaaacccacccctttrtgcatggaatgtgtccaataaataactgggtttcataccacttgtgcaaaagcaacataaaaagtgctttttccttaaggggaaatatctcaccatttatacctcctgggagttagtagtttcatttaaatactaactttgtaagccacaagcaattcgctgtcttagtggagggaaatactcttctgtccatgttgctacatacagactactgttaacaaataagaatggagatatttccagtgccaggctcatagtagtgcccaaccaatttcagtgaaggagtctagcaagttgaac

SEQ ID NO: 156662 - DNA, 601 bp, Human
catgggcttttggaggcttttgtgtgattagaggggaggacaagggtgtgatttggtaaaactgacataatacaaattgcttgtcaaatttcctctcacttgtctgtggagtgcaatagtaggaacatttgcacagagaaaaataaatgtctaaacatgcattggcacagacagtacactaactttcaacctaatgaaagaaacctaatgaatgaaaatgtaaggcttgccaaatgtgttatgataactctccagtgccaaggaaatatcaccctccccacggataccctggcaagcctgygagtttaccccagtcagcaggtgcaccaaccatctcccctgcattgtaggtgagtgtatctatccctcattacaaggcttcttgaaattccttctgaactttctttctggaaatgctatccattatccaggcacccaaacccacccctttgtgcatggaatgtgtccaataaataactgggtttcataccacttgtgcaaaagcaacataaaaagtgctttttccttaaggggaaatatctcaccatttatacctcctgggagttagtagtttcatttaaatactaactttgtaagccac

SEQ ID NO: 156663 - DNA, 601 bp, Human
caggatatgtgtatatttaggggtataaagagtatggctccatgtctacatacacacagatgcacagatacatgcatacatatgtgccgtgactttcgtttatcagcaggtcaataaaaacatagaaagatcagtgtattccattgcttgctgctctggtataggtccagcgtcaccctaataaatacaaatcacatacttcaatcctagcagaagtaggctgggggcacaagactgtgagtgccattttttctgttgaccatgtcatgtcgctagctccctcttgcttaccaggtaaaayaccagctcttgggactggccaacaggacccctgcagggctggggagctgctgtgttcctagcaggtgaccctgcttgtaattttgtaaatatgctccaggagatgggactctcaggtttaagtcctgttgttttcgcttcctgcattgtttgctcctttgtctggttaacttcaacttctccgggctcaattcaggggttccaccatttagggaggctttcctaaatcgctcctcccaaagctgcttctgctggccgcttcaccatccccaaatcctggcattcctctagcacagcacaa

SEQ ID NO: 156664 - DNA, 601 bp, Human
tttcatgggcataatcaccaacattattggggacagaaaataaagtttaaaattctgtcatcagtgactcttctcagcagagcctcctcatgaatttccggagggttaatgagctgagtttcatgaccgtgagtgcctctgtgaaagccatgcttctctcagagagatgagtgtgcacacaggctcttcatcttggaaatgaaagattacttgcacatggcactccggctgcttcagaaagcagggaaagctgccagtacacacctctgcctgtccaggaggatgatgtcacaggaagcgkgactgggcaactggttctacaggaacgcagggacccaatcacatcacatacagttccccaccaacagcgatggcaaaaatgccttttgtattgttttcccacgtaaaaggcattgttttggggtctgagtttaaaccaaagagacacaattatccaccaaggggtgtgctggctagggaagggacggagagagggacaggatatgtgtatatttaggggtataaagagtatggctccatgtctacatacacacagatgcacagatacatgcatacatatgtgccgtgactttcgtttatc

SEQ ID NO: 156665 - DNA, 601 bp, Human
tactggagtggggtgggctcctaatccaatatgacagagatccttacagaaaggggaaatttggatccagagatagatgcacacaaggaaagcaccatgtgaagatgaagcagagattgaggcgatgcttctacaagccaaggaacgccatctattgacagcaaatcagcagaagcgagggcggcagcctaggacagattgtccctcacagccttccaaggcaatcgaccctgtgacacgctaatctgaaacttcctgcctccagcacatttaacccatgcagttaggggcactttgttayaggaaccctattaaaccaacacactgcttgacttttgggtttaggtacgtttcagagctgctactttgaagaagagaccacaaagaacagttctattttgctttatttgacaaataatcatgtctcatcagtcatatggaatcccacggaatttgccatttcacttttaacgctgtctgaaatctcattgaatgatatctcaacttggtatttaagaccaaataagcaaaagcaaataaataaaataaataaaaatgatgcttcagttaatcacattggctgccatcatcactgtcacta

SEQ ID NO: 156666 - DNA, 601 bp, Human
ggtcacactcacagattctggggacttagacttggacagatttttggggggccaccatctcacccactacactttccttatctcctctcccatccctcctttatcttaaagaatgttcccttcccttctctgtcctctcttcctgtcttccactgataagttggagactcaggaccttcctccttggtggttttaaccagaaatattaagtggctggtcccctgtctgtgctgcagggcagggtggctgctggctcagcagctgttggggctacttggtgtgggatggggtggaaacgggwatgctgccggttctgggttgaattgttaccccctcaccaaaattcttatgttgatatcctaacccccagtccctcagaatgcggccttatgtagcaacagggtcattgctgatgtaattagttaagaggtcatactggagtggggtgggctcctaatccaatatgacagagatccttacagaaaggggaaatttggatccagagatagatgcacacaaggaaagcaccatgtgaagatgaagcagagattgaggcgatgcttctacaagccaaggaacgccatctattgacagcaaatca

SEQ ID NO: 156667 - DNA, 601 bp, Human
acccttaacttaattgtatctgcaaatactctttttccaaataaggtcacactcacagattctggggacttagacttggacagatttttggggggccaccatctcacccactacactttccttatctcctctcccatccctcctttatcttaaagaatgttcccttcccttctctgtcctctcttcctgtcttccactgataagttggagactcaggaccttcctccttggtggttttaaccagaaatattaagtggctggtcccctgtctgtgctgcagggcagggtggctgctggctcrgcagctgttggggctacttggtgtgggatggggtggaaacgggtatgctgccggttctgggttgaattgttaccccctcaccaaaattcttatgttgatatcctaacccccagtccctcagaatgcggccttatgtagcaacagggtcattgctgatgtaattagttaagaggtcatactggagtggggtgggctcctaatccaatatgacagagatccttacagaaaggggaaatttggatccagagatagatgcacacaaggaaagcaccatgtgaagatgaagcagagattgaggcg

SEQ ID NO: 156668 - DNA, 601 bp, Human
tccatttgtactgctataaaagaatacctgagactgggtaattcgtaaagaaaataagtttatttggatcatggttctgcaggctgtacataaagcatggtgccagcatctgcttttggtaagggcttcagaaagcttccacccacagcagaaggtgaagggaagccagtgtgtgcagagatcgtacggggagagaaggatgcaagagggagggggggaaggtgccaggctctgtttataacaatcagatcttgcaatatcgaacagagtgatactcactcattaaggcaccaagccattmctgagggatctgtccctgtgacccacatacctcccacaaggccccatctccaacactggggactgcattctagcatgagattttgaggggacaaacatccaaaccaaatcaggctgcatcgctcccatctctgcctccaccctcacatggccttctcctctgcgtctgtgtcatctcctcttgtgtctcttacaaggacacttagctttggatttatagcccacttggataatctaggatgatctcatctcaagacccttaacttaattgtatctgcaaatactctttttccaaataagg

SEQ ID NO: 156669 - DNA, 601 bp, Human
gagactacagcacaggatcagctggtggttctgctattcctcatgtgagtcaggccagagcagagctggagaaaaatgtaggacttcaggggtttcagggtagtgcccccttgggccaccactggggaccctgagggcccctgaaaatggtacttctttcttttcctttccattagtttcctgtgactgcttcagtggattattacaaacagggtgacataaaaaatcagaaatgtatccctcacagttctggaagtcacaagtctgaaatcaaggtatcagcagacagggccatgctccygcctaaggctctaggggaggcctggcatttattctggtggctcctgacatttactggattggggctgtgtcttagtccatttgtactgctataaaagaatacctgagactgggtaattcgtaaagaaaataagtttatttggatcatggttctgcaggctgtacataaagcatggtgccagcatctgcttttggtaagggcttcagaaagcttccacccacagcagaaggtgaagggaagccagtgtgtgcagagatcgtacggggagagaaggatgcaagagggagggggggaaggtgc

SEQ ID NO: 156670 - DNA, 601 bp, Human
atgaactgttcacaagtagataggtagaaaaaacataaggtatgatgaaatgaataaaaagagaccaagtagatataaaaacagaagcaaaaaatgagcttagaagaccaaaaatggaccaaagtttattttaactaatttcactcaattaaaatgacttattgttatatctgagccaagtgatgacccactttttacaagcaatattaatatggtaaaatttcaggaaaagaaaagaagctgcagtgctgtggcaatttctttattgagatgggatttcacttgtagcaaaggagaaagwtttgatgagtaaaagagattgcatggaagattaaaaaagcaggaaaatactagacacagagcttctgtaaatcacttggctcaaacctcaggaaagtgttcagtgtttgagttttctcttctgaaattgcaatttttggaaaagtttaagtatctatttgtctccctcactagggagcccaggcaggggatagaggctgtcattcacacttggctgagagtaactggcccacaggcacaggccctgcatcttccagcaggttgtacagcggggtagcagcctctgcccggcaggactctg

SEQ ID NO: 156671 - DNA, 601 bp, Human
cccaggattccagcattcatattgtaggcttatgtcgtatgcataaaacatacaggatttacatgtgatgagtttaaaactttggtagttgtatttgcgctatactaaaaaaaatcagtaactgtatgttgtaattgtatgaactgttcacaagtagataggtagaaaaaacataaggtatgatgaaatgaataaaaagagaccaagtagatataaaaacagaagcaaaaaatgagcttagaagaccaaaaatggaccaaagtttattttaactaatttcactcaattaaaatgacttatygttatatctgagccaagtgatgacccactttttacaagcaatattaatatggtaaaatttcaggaaaagaaaagaagctgcagtgctgtggcaatttctttattgagatgggatttcacttgtagcaaaggagaaagatttgatgagtaaaagagattgcatggaagattaaaaaagcaggaaaatactagacacagagcttctgtaaatcacttggctcaaacctcaggaaagtgttcagtgtttgagttttctcttctgaaattgcaatttttggaaaagtttaagtatctatttgtc

SEQ ID NO: 156672 - DNA, 601 bp, Human
tagaagacaaatagaagttaaatggtatgggaaaggtcacagagctgtctcctgagctttggtgaccataagtctcttaggcagaagctcttttctccagcctaaccctcctgactccttcctctgagctcttttcacagggatagactgcctttaccacctgtgtgacaccttccctgtcatgcatttattcagccagtcattccaaaaacattcattgaagttgcatctagtttgctgatgtatataatttatccttctatcatataaactgaggataggatgatagctaacaaacctmtgtctactgataataaacaaattgcatgaggcttttgaccacacaaggtaagaaggtacaacagcactttgatcactgaaaattgcattcatatttatcctgttgcagttgttatttacttctatgcaggtctggggaatactagttttaaaaggtgctatgttataaatagggtttcactgcaacataaatgcaggaaatactgtacttgatactcatctcagagatttataatgtattagcaaatttactttgaattagcaaagtaaaggctctgagcagaccaacagacacaatgaa

SEQ ID NO: 156673 - DNA, 601 bp, Human
ttgactaattttagcagaaaggaatgatgaaaatttaaacttactgattctagcttcaggagagaaacctatgaagggtgttttatttttaggtcaagattgctatctagcaaagacccaagaactctcctaagatgaaaatttcagaagacaattgtctgtctgagacagatgagatcagtgtttctctgaagaaaagtttgttttcaggaatagagtctgaaattagtcctccaacctgagcgacattggaatagcagtaattcattgattactgcaatggcttaatgattaattatayaatcacattccctcattcttgcttttccaaattgatttacacctctgccaaaataaaaatcagacccaattaaggatatggagagagggaatcatctgttggttttcttcatatgctgttactcatagatgacattatgtagtgttctaacttttttaagaacattcatattcattatttccatttgtgtcttacattaccctagggatataaaaatggcaggtataatttccaatttatctagaagacaaatagaagttaaatggtatgggaaaggtcacagagctgtctcctgagctt

SEQ ID NO: 156674 - DNA, 601 bp, Human
atttaaataatttgattaactattaagcatgataaccataaaaataattatctcaattcattgactaattttagcagaaaggaatgatgaaaatttaaacttactgattctagcttcaggagagaaacctatgaagggtgttttatttttaggtcaagattgctatctagcaaagacccaagaactctcctaagatgaaaatttcagaagacaattgtctgtctgagacagatgagatcagtgtttctctgaagaaaagtttgttttcaggaatagagtctgaaattagtcctccaacctragcgacattggaatagcagtaattcattgattactgcaatggcttaatgattaattatacaatcacattccctcattcttgcttttccaaattgatttacacctctgccaaaataaaaatcagacccaattaaggatatggagagagggaatcatctgttggttttcttcatatgctgttactcatagatgacattatgtagtgttctaacttttttaagaacattcatattcattatttccatttgtgtcttacattaccctagggatataaaaatggcaggtataatttccaatttat

SEQ ID NO: 156675 - DNA, 601 bp, Human
aggtggctgagatatgcatatttaactagtataagaatggttctaaaaataaaaatggcagttaattaacaagagatttgctgaagttcctttttgaactagaaataaattgatttttgagaaatactgaaaatgaggcaagcaactaatatgatacattttaacaggatttaaataatttgattaactattaagcatgataaccataaaaataattatctcaattcattgactaattttagcagaaaggaatgatgaaaatttaaacttactgattctagcttcaggagagaaacctatsaagggtgttttatttttaggtcaagattgctatctagcaaagacccaagaactctcctaagatgaaaatttcagaagacaattgtctgtctgagacagatgagatcagtgtttctctgaagaaaagtttgttttcaggaatagagtctgaaattagtcctccaacctgagcgacattggaatagcagtaattcattgattactgcaatggcttaatgattaattatacaatcacattccctcattcttgcttttccaaattgatttacacctctgccaaaataaaaatcagacccaatta

SEQ ID NO: 156676 - DNA, 601 bp, Human
aactttgagaaagtggagtgcctactaatccaagatcaacaaaacaaggattaattacctcaacaaaatgatacaaatttcgctgtgattactgttctgatttgaatcgggcatgttatagaagccttctgtctatttcctctgtctccagtgcttgatctaacaggttatgcttataaagactagaataaaacattccttaaatggtatcttctaattaatccttcaaaactcatttttaaaatcctttaaaaattttaaaacagatgatgataataaattatcaggaaaagctaataaytataatagtcctgcaaatatcatgacatatattgattggtctgaaactatacaacaactgaaagcaatagttacattattatttaactattattattactaatctgggtgtttttctttagccataggccttcatatttacctagaatctgtcctccttcctaccagaatgtaattgagtaaatcaaatctgtgataatgaccatgccagagatgttacatttaaagggaaatataatgtaattagacatgacaagctcatttaaaatgagtgcatttcatatgtggggttaatgcctac

SEQ ID NO: 156677 - DNA, 601 bp, Human
gaatggcacaataatggtcaacaattttttaaaagaagatcccatttccacatttaaaatagccttttcagttggtggtaatccaaacacacattggatggaataaattaaaaggccatggagattgttctgtgccctcaccactctcatggccgtcactgactaattctttatgaaactaaactggcctcaatttggatattagtggttataatgagtaaacaaccagacctattcagccttagcaccaacaggtggtttctgattttttgtcacacgatcctaaatacccctgccaaarccatgcgtcagtattgatggctgctggaagaaacatcacaacagctcgattaaaggactctaacaagttctttcgacacttcatagaatagaaaattggatcttagttacacgcatccctatatcagctgatatcaccaccacatatgaagactaccaagggactgagtcaggagttccagaacttgtttgcactggaggcagaaaactttgagaaagtggagtgcctactaatccaagatcaacaaaacaaggattaattacctcaacaaaatgatacaaatttcgctgtgattactgt

SEQ ID NO: 156678 - DNA, 601 bp, Human
ctggtgcgctgcacccactaactcgtcatctagcattaggtatatctcccaatgctatccctcccccctccccccaccccacagcagtccccagagtgtgatgttccccttcctgtgtccatgtgttctcattgttcaattcccacctatgagtgagaatatgcggtgtttggttttctaatgctgctgtaacaaatcaccacaggttcagtgctttaaaactagatacatttattatttcacagttctgcaggttagaagtacaacactggtcttactaggcttcaattagggtgtgggyagattacggtgtgggaaggactgcattctgggagctctaggagagaatcattttcttgccttttccagttcctagaggccacctgatttccttggcatgtaaccctctgtttctacctttaaaactagcaacaatgggcctttcttgtgtcacatcgctctgaccctttcatttgcctccagctgctcccttttccacttttaaggacctttgtgattacattgggcccactgggataatccagggtcttcttcctatctcaaggttagctgattataaaccttaattccccttggccac

SEQ ID NO: 156679 - DNA, 601 bp, Human
aattaacagccttggtagctaggttaaaaaatttaaagcaaagaaataaaagttgataccaggttagcaaagacaaggtaaaaaatagtactaagacacttcaggacctttaaggatatttgaagaggtttcaatatttagtatctaaggtaaaaagagttgatgcagtattttcaggtaaaggaaatccttgcaaaatcagactgatttgataatattaggggaaaaacagagatgtctttcccctggttttatcatttcataaatcttttgttagcatgatctgttttataaaagattmggtttgtttcctcaatttttaataatacgaatttttaagatttccaattctaggtttattaaacagataagctaatattattatttaaacatttaaaaaggttaacgagtgttcagctagattgaattgtaataactgctgtttcatgaaggagtcgctcttcttcaccttagggaattccacaacaatctgttactgagttactccaccaaattcctctgagtaaaattcttagtgtcctctttttgaaaaaacactgtccactaaacacataggcacacacatatatgcgcttcaaat

SEQ ID NO: 156680 - DNA, 601 bp, Human
aatatatctaatttaaacacagtctatcatcaaaggggaaaaatatatgcaaaaaatatatattttaaaactggttagtgtggcttacagaccaaattggtgaagcattcaaaatggtattgcttagttactgaaaatgtctgaatgcttgttaatgtgggaaaagtctcttctggattgtccggagatctctgacctctggaaacatctggaaggttctgagtgcttatttttttttcccctaaaacaaaatacatggaatactacttagcaatcaaaaggaacactatgtgctacaacrtgaaaagatttgaatggtattatgctaagtgaaaaaagccagtctcaaaaggttctatattgtaagataccacttatataacattcttgaaataacaaaattatagagatggagaacaaattaatgattgctaggagtttaggatacttaggaagactgtgactatgacaagatggtacaacaaatatcattgggttgagggaataattctgtattttgatagccttgatggttacacaaatccacacatgtgatgacactgtacacatatactgcaatgttaatttcctgatttattgt

SEQ ID NO: 156681 - DNA, 601 bp, Human
agctgagattgaccaaatatactgtactttactgtccaagccttctgaaatttttaagtcttcaatagactccagagtttcaaaatagttatatcagtgtgatggttaatattaggtgtcagcttaattggattgaaggatgcctcggtgggctggtaaagtagtgtttctggtgtgtctgtgagggtgttgccaggggagattaacatttgagtcagtggattgggagagacagacccaccctcaaggtgggtgggcaccatccagtcggctgccagcatggctagaacaaaagcaggtrgaaaaaggtgtgataagatggcttgctgaaccttctggctttcacctttctcccatgctggatgcttcttgcccttgaacgtcagactccagttctttggcatctggactcttggacttacaccactggtttgacaggggcttttgggccttcggccacagactgaaggctgcactgttgtccttccctacttttgagacttttggtgtcagactgagccactgatggcttctttcttcatcatcttgcagatggcctatcatggggcttcaccttgtgatcatgtaagccaattctcct

SEQ ID NO: 156682 - DNA, 601 bp, Human
acttcaataacatacaaacactttgttcatttacagttccatctcacacttttcagttattgatgtcacacaattacatctttaaacattgtgtgtccaaaaacataaataattggtttttaaaaacgaattatgtagaaaatttctctttaattatgtagaaaaaaatgtggagttaggaaacaaagtcacaataatgctagcctttaaactagtaattgctttttcttaaatgtactgaattatgtagaaaacaaaagtagcattataaaccattgttaaaacaatatgagctttatarttgcccatgtatttatctctactaagatctttatttcttcttatacctttgaattactgtttagtgttcttgcatttcaacatgcaggactccctttaggatttcttacagagcaggtctagtggtagtgaactctcttagtttctgtttatcagggaatgtcttaagttttccctcacttctgctggacataggattcttggctgacagtttttttttctttcagcaccatgactatatcaacctactacctctggtcttcaaaattttgattaaaaaatcagctgataaccttatttt

SEQ ID NO: 156683 - DNA, 601 bp, Human
ctgatgtgcatactaccatttggttttcgcattggtggcaggaatgttgagtggtggtcttatggtctaaagacctgcattctctaaggcagcagacaacagggaagtcacttgagttccttcctacacttactatagatctcttctgatcactgatggagtcctatgtgtagatggtctttgttgtgcaccattataaacttaaatgtctcaaactgattagagaaaatatatttttccagaaggtcagctggactggagagcaaccccggatgagaaacatcacaactcctttgtcttygaggtttaagtagttctatggccctcctgtttctgcagctgctaaaactgatctgtgggtttttgctgaggtgctctgagtttattttttctaaaaaacttctttattgcagtaaaatacttataaaatttaccattttatccattttaagtatatagttcattgatattatgtagactcatatcattctacaatcatatatctccaaaactcttttcatcttgcaaaattgaaactttaaaagcatttaaacaactccccaacccttcccttcagtccctggaaacccccattctactt

SEQ ID NO: 156684 - DNA, 601 bp, Human
ttctgtttctatttctgaactaagcctgtatttgttactgatgtgcatactaccatttggttttcgcattggtggcaggaatgttgagtggtggtcttatggtctaaagacctgcattctctaaggcagcagacaacagggaagtcacttgagttccttcctacacttactatagatctcttctgatcactgatggagtcctatgtgtagatggtctttgttgtgcaccattataaacttaaatgtctcaaactgattagagaaaatatatttttccagaaggtcagctggactggagagyaaccccggatgagaaacatcacaactcctttgtcttcgaggtttaagtagttctatggccctcctgtttctgcagctgctaaaactgatctgtgggtttttgctgaggtgctctgagtttattttttctaaaaaacttctttattgcagtaaaatacttataaaatttaccattttatccattttaagtatatagttcattgatattatgtagactcatatcattctacaatcatatatctccaaaactcttttcatcttgcaaaattgaaactttaaaagcatttaaacaactccccaa

SEQ ID NO: 156685 - DNA, 601 bp, Human
tgtatgtgtgtgtgtgtgtgtttccttcaaatacctgtattttgtatttggtgaaccagttttctaaatccagattttcttgaaaaactgcaagtaaagattattttctctttacagtgcttcattctcgaactcttctgttaagcattgttgggcacaccaaggtaccccaagggactcactcaggagacctaacaaaccatgttgcccaagaaaggcactccttgcagaccgcttgtgcagaaaggagctggtggggatttcatgatgaggtaacagccttgctctcgttgactgcttyggtttccatgttgtgtttgtgactttctgtttctatttctgaactaagcctgtatttgttactgatgtgcatactaccatttggttttcgcattggtggcaggaatgttgagtggtggtcttatggtctaaagacctgcattctctaaggcagcagacaacagggaagtcacttgagttccttcctacacttactatagatctcttctgatcactgatggagtcctatgtgtagatggtctttgttgtgcaccattataaacttaaatgtctcaaactgattagagaaaatatatttttc

SEQ ID NO: 156686 - DNA, 601 bp, Human
accttgccttgcttctattttgaataaatgtgctaccaacgatccactatcatggactcacatctgaaaaagggaaatcatggtgctcgcttcggcagcacatatactaaaattggaatgatacagagaaagattagcatggcccctgtgcaaagataatacataaatttgtgaggcgttccatcttttgtttttttaaaaagaaaagcttgttctttgtcagatcaaaacaatacaaaacaagactgtaccaccaccactaccacaaacaaagtcactctttcttgctacagttcccaayagaaatgaatccttgggccatttcttttaagttacttagtctctagtaacaatgactatatgtctgatttttgcaatactggtaagagactaccattggtgataacataattgtgcagaaaaaggactgtattttcatcaatgatggactaactgaaaccttgtaactttgctaccctttccactgtgtgtatgtgtgtgtgtgtgtgtttccttcaaatacctgtattttgtatttggtgaaccagttttctaaatccagattttcttgaaaaactgcaagtaaagattattttctctt

SEQ ID NO: 156687 - DNA, 601 bp, Human
tgcactgagattctctgtggatgcagagcataagcttcctcctgtgtttgagcctggcatggggcagaagaagtgcctgtcttggaatgacctgcttaggccctcaaaaggagcaggcaccagtaaccactgcaaatagatgactgctccagctgactactccaccttcttcttctttttttttttttttttttttaagacagtctcactctgttgtccaggctggagtgcagtggtatgatctcatctcaatgcaacctccatctcctgggttcaagcgattcttctgcctcagcctccygagtagctgggactacaggcacatgccaccacacctggctaccttttgaattttagtatagatggggtttcaccatgttagccaggctggtctcaaactcctgacctcaagtgatctgcctgcctctgcctcccaaagtgctgggattacaggtgtaagccaccatgcacagctgactctaccttctagatttaatttgattaaaagatatgacacagactgaaaataatagagtgattcattcatttggcaggaaactataatatttcaggaacaaacaagaacctgtgactacaaaaa

SEQ ID NO: 156688 - DNA, 601 bp, Human
aggactggggaagaaagaggctggatcaccaggtggaggttgtgggcagttcttcacagtcccagggacagaaagggcacctagagcccagctgtggtcctgtggtgcactgagattctctgtggatgcagagcataagcttcctcctgtgtttgagcctggcatggggcagaagaagtgcctgtcttggaatgacctgcttaggccctcaaaaggagcaggcaccagtaaccactgcaaatagatgactgctccagctgactactccaccttcttcttctttttttttttttttttttttaagacagtctcactctgttgtccaggctggagtgcagtggtatgatctcatctcaatgcaacctccatctcctgggttcaagcgattcttctgcctcagcctcccgagtagctgggactacaggcacatgccaccacacctggctaccttttgaattttagtatagatggggtttcaccatgttagccaggctggtctcaaactcctgacctcaagtgatctgcctgcctctgcctcccaaagtgctgggattacaggtgtaagccaccatgcacagctgactctaccttctagatttaa

SEQ ID NO: 156689 - DNA, 601 bp, Human
ttaatttatcccacctgcagcttccatttctgctcctttaattgacttctggaagtaagtaaatgagtgcctgtagcaaagctggctgttctcacatttttcagatggaattggcaagtgcctaaagttagatccctttcttgtctcccatcccccaattaggcacatttagctagctcctaaaggctgtttgaaatatttcacctccatgtacatatctataaataatagtcttcttctgctatttaattctctggtgtatggtgcctggcagcaggaagggaaccttgtgggagtaggygatgatatcttaattccaggcagtgatacataaaacacaggcccttgtaattttggtatctgctcttatcctatgtttaggtggcttattttagcttagagagaaaatgctgatacttaaattactgaaatagaaaagtgtgttcattcacttgatgatagctgaggaagtgtctgacaaaaatggtttgcctgcaaacccccaaatgtagcatatttattttctaatgacagcacctaaaatagtttatctatttatcattaaatcagccttaactctggttaagagtttactttcgta

SEQ ID NO: 156690 - DNA, 601 bp, Human; identical to SEQ ID NO: 21645

SEQ ID NO: 156691 - DNA, 601 bp, Human; identical to SEQ ID NO: 21646

SEQ ID NO: 156692 - DNA, 601 bp, Human; identical to SEQ ID NO: 21647

SEQ ID NO: 156693 - DNA, 601 bp, Human; identical to SEQ ID NO: 21648

SEQ ID NO: 156694 - DNA, 601 bp, Human; identical to SEQ ID NO: 21649

SEQ ID NO: 156695 - DNA, 601 bp, Human; identical to SEQ ID NO: 21650

SEQ ID NO: 156696 - DNA, 601 bp, Human; identical to SEQ ID NO: 21651

SEQ ID NO: 156697 - DNA, 601 bp, Human; identical to SEQ ID NO: 21652

SEQ ID NO: 156698 - DNA, 601 bp, Human
ttccatatataaagatatatatacatatatatatatatatctttccatatatatatatatctttccatatatatatatatatttccaaaattacttgttaacatttgttgatttttttttccccaaaatccctctgtcattacttgttagtctactgtagaatactgaagctcaggaaaatgagcttattttcttttctgtaagatgacttagggtaagaccctgtgagcacaggtctgtccagtccagaaagttcatggatcttaggagctactcaggggacacattgcctcttttctgrcttcttcactgattctcgtttcagttgtgtttcaatgactgaggctgtgggaaagtgccctccacgtctgtgacgcctctcagggtcccgtgttgagtgtttggactcagggcccaggtgaagccagccttacctttttgtagagactcctcagatctcggtactgccacatgctgttgaggacctgagatgcagccttgaccacttttggagagtgtctgatgaagaaaagacaggaaaggcaagatgtgagtgggacagctgtgtcacatttctgtaattcttgtagtatttcaaacc

SEQ ID NO: 156699 - DNA, 601 bp, Human
agactctttggaggtatgcgatatgaattcctgcctgccttgtgagaggaacaaatgccgagcatcttggtgatccacgtttgtcactgggagcactgtctttttccttctggccagtaacactgtgaggttctcaggggcttagtgacgtgggccagacagttgagtctcctattcagtgttcctagtttgcagtggttcttgatttcctgaattacgtgctctgtttctctctttccatatataaagatatatatacatatatatatatatatctttccatatatatatatatctttcaatatatatatatatatttccaaaattacttgttaacatttgttgatttttttttccccaaaatccctctgtcattacttgttagtctactgtagaatactgaagctcaggaaaatgagcttattttcttttctgtaagatgacttagggtaagaccctgtgagcacaggtctgtccagtccagaaagttcatggatcttaggagctactcaggggacacattgcctcttttctggcttcttcactgattctcgtttcagttgtgtttcaatgactgaggctgtgggaaagtgccctccac

SEQ ID NO: 156700 - DNA, 601 bp, Human
aagtgattctcctgcctcagcctcctgagtagctgggattacaggcgccgctaccacgccgagctttttatttttttttgaattattagtagagacggtttcaccatgttggccaggctggtctcaaactcctgacctcaggtgatctgcctacctcagcctcccaacatgctgggattacaggtgtgagccactgcacatggccttctacccctatttgttaactcgaatttaaactcccatgcttgctggccttgtcacaataaaacaacaacttctgggaaatgttaaaaaaaaaaaaattctcccctcctaaccaaaaaggaaaagttaggcaccccttattgagcagattttggaaatgaggccttgaataaaactttctagatgtgacttttttctcttaagggatttttgagccatgttgggggtgaagactctttggaggtatgcgatatgaattcctgcctgccttgtgagaggaacaaatgccgagcatcttggtgatccacgtttgtcactgggagcactgtctttttccttctggccagtaacactgtgaggttctcaggggcttagtgacgtgggccagacagttgag

SEQ ID NO: 156701 - DNA, 601 bp, Human
ggaagcccaggcacccttctgtagtcctgtttgtgcttcctgaatccctgcatggaaaccaatgcctatgccattctccccgcttattggtgatgtcctctatcccctatatatttttttttttgagatggagtctcgctctgttgcccaggctacagtccagtagtgcgatctcagctcacctcaacctctgcctcccaggttcaagtgattctcctgcctcagcctcctgagtagctgggattacaggcgccgctaccacgccgagctttttatttttttttgaattattagtagagatggtttcaccatgttggccaggctggtctcaaactcctgacctcaggtgatctgcctacctcagcctcccaacatgctgggattacaggtgtgagccactgcacatggccttctacccctatttgttaactcgaatttaaactcccatgcttgctggccttgtcacaataaaacaacaacttctgggaaatgttaaaaaaaaaaaaattctcccctcctaaccaaaaaggaaaagttaggcaccccttattgagcagattttggaaatgaggccttgaataaaactttctagatgtgactt

SEQ ID NO: 156702 - DNA, 601 bp, Human
caggaaacgttcaggatctaaaggaaagagggttttatttcaggcagtaatatttcattgagcttctggagccactgattcagaatggccagttcctttctaatttataccatgttcctcatttctggctgcctatttagctgaaggactctttcctgggcgagacttcatttgcctcctggaggaattcaagaaggaattaactaaggaggctgggataggaatttcaaacaaaatagaatggaacccaaaacattgtagataaaaggcttatgctaacccattatatgaaatgctttgkgaaggacttaacagttgtcccttgagccatatgggtttaacactgtgggtccactaatatgcagatttttttcaaccaaatgcagataaaaaatacagtatttgcgagatgcaaaacccatgtataaggagggctgactaatttccatagggccttgaatattcacggattttgctatctgccgcagtcctggaaccaatcccctgtgtatactgagggatgactctcattgatctagaacttccacttaattttgcattctgtttcaacttaaacacacttcctcttagggaacaggaa

SEQ ID NO: 156703 - DNA, 601 bp, Human
atggcctggcttgtcttccaggcaagcagtccacggagaggcaagggcacggaagcatgcaggtagcatcccctccattctgatcaccagctttcagcacctagcactctctgttgtaaacatgggactctgtttcctataggaatatcgctagcaggcagagctgcatgggagaaaggagaaagaccgtgggaaagcagaaagacagtgggactagaggagacagagtagagagaccagggggagaggagctgtaaaaatgtaggcagaggtgactagtgatgatgatgatgatgatgaaaaaatgaaatcctcggatccaaaccttcagctgcctgtggacaggatggcagagacggcacttgccaatcaaacagcttggaaaagtgttgttgaattaatggcagcaactcccatggatatattactttccattttacaaagcactgtgatgactgctgttccatttgagacatcagcaatccactgaggcaagtgttatggctttcccatcatggatgggaaaaccaagggagggggtgggattgagggagagatgcccacagacttcatgaaaggccatgaaggttctttaacacaa

SEQ ID NO: 156704 - DNA, 601 bp, Human
cctgtgatttgatccatacgcttaggaactatggattttatttattttttatttttattttttgagacagggcctcactctgtcacccaggctggagtgcagtggtgtgatctctgctcaatgcagcctccacctcttgggttcaagcgattctcccacctctgcctcccgagtagctgggattacaggcggattgcactgccacacccggctaatttttgtatttttagtagagatggggttttaccatgttggccaggctggtgttgaactcctgacctcaagtgatctgcctatctcrgcctcccaaagtgctgggattacaggcatgagccaccatgccccgcctgaactatggattttaattcattcggagagatactgagtggacgctgttctctctgaagcactttgagattcttagagcaaaatgagcttcaggaccataagctgaacattggaaaaatcatctaccactttaacaacagggactgccctgaccctttccatagtaactttacagggtctgtttgaatggcctggcttgtcttccaggcaagcagtccacggagaggcaagggcacggaagcatgcaggtagc

SEQ ID NO: 156705 - DNA, 601 bp, Human
gtctgatctacctgtgatttgatccatacgcttaggaactatggattttatttattttttatttttattttttgagacagggcctcactctgtcacccaggctggagtgcagtggtgtgatctctgctcaatgcagcctccacctcttgggttcaagcgattctcccacctctgcctcccgagtagctgggattacaggcggattgcactgccacacccggctaatttttgtatttttagtagagatggggttttaccatgttggccaggctggtgttgaactcctgacctcaagtgatcygcctatctcagcctcccaaagtgctgggattacaggcatgagccaccatgccccgcctgaactatggattttaattcattcggagagatactgagtggacgctgttctctctgaagcactttgagattcttagagcaaaatgagcttcaggaccataagctgaacattggaaaaatcatctaccactttaacaacagggactgccctgaccctttccatagtaactttacagggtctgtttgaatggcctggcttgtcttccaggcaagcagtccacggagaggcaagggcacggaagca

SEQ ID NO: 156706 - DNA, 601 bp, Human
gtattcactccttcatccactctgatttggacatgtgaggaaatctacaggcattcccttacccatctataattacttattgatttcttgttttgtgagtgcaatggccgcaagagccaatgaaatgaatccaagagcagtaaggaaagagagcctggtgtgagacaggccatgaagggcatgactccactcccatcaaagctcattcttcacttgctgtgcaacccaagagtctatcttctctgacaataaaaggaaggacattgaaagattagttttacgttttctttctctcatcacraaggcaagagtgaatacagtgtctctattcagagaaatatgatcttactctgtttcaagcacaggcagtctggcattcttcaagacatgagctcactgtgcaagataacaacattgtgtgtggggtggagtggaggggggcacaaccataaaaacaccagaccactaacattaggagggataatgcatctggtttctaaccccattgcttgtcaacaagaggttgggtctgacgtctgatctacctgtgatttgatccatacgcttaggaactatggattttatttattttttattttta

SEQ ID NO: 156707 - DNA, 601 bp, Human
tccagcacagtaggaagattaataaattcccattaagcaatttccttgataaaatgacagctctacatttggtagtttatttctatagaggatttactgctttttcatccctatcttagatacccagaaagtagaatctattaattctcaaaatggcaacatattggaagacatattaaagcccttcagtattcctcacccttcatactgcaaagcttaaataaaattatgaattttgactatattgtgtttttcctcgacaatatttcaaagtatctttctaattctcactggaatctgrtattgtttttcaaatgtccagcagatgagggtgatggagtaatgttaaacatgagaacatgacttcagtttgcagggccatggctactggctcatctatgtagagtggtcagtctcccacaagcaagctgcgaaagatgacaaaaggctgtattcactccttcatccactctgatttggacatgtgaggaaatctacaggcattcccttacccatctataattacttattgatttcttgttttgtgagtgcaatggccgcaagagccaatgaaatgaatccaagagcagtaaggaaagag

SEQ ID NO: 156708 - DNA, 601 bp, Human
agacaggggaagccacagcttatgagaaggggagggagaagagatggagctgggaagagagaagaaactgatcacgctgtctctcaagcacaccgagttctcatagatgtgatatcacccaatctactggatccaccagaaaacgagggagtaagtttgagttaattgccccaaagtaagtgagaagaatggatgtagacttacattaaacttactgagtttactagctcctgatctggtcctttgattctgccttttgtctctggggtatttttgtagggtttgattcaaaaatgttacragcgaagccttgtgaaatggtggaattatagaggaagtgtttagtttgggtactgctatatgggatttcccctgacttggggatctatcccagcaacagctgtaacttagtgacttcttgtttagcaactgccatgtgcattgatttccacttttgcacaattgatttttgcttcttttcccatttgtgcctttgcttttggacagatatcatatgatgagtgtctgagagttgtctcagagaggtcaggagacctcgtgaagaaagaccttctttgtcaataccaaacatcaacaagta

SEQ ID NO: 156709 - DNA, 601 bp, Human
tccagaagcccagggagtggactatgtaaagaccttcaccatgagctccctgaagtttgggggtggcaggcctggtgtcttcagtggcattagcggggcaatacagagattcagtgccagaggtgaactgaccatggagccatgaactttcatgcccgcccatcgcatgggccccttccagggtctgtacctaattttatattcataaagtgtactcttcttcttaaataggacttccaaaatgacaaaagctacaggggcacaaaatttgtatcttccctggtctgtgtgtagtctgagsctgattgagaattctgaggcggatggctgtggaggtcaggcatccccagttgggaggtccttggttgcagggtggtacttctgagcaacccaccccactgccctcatgagagatggagctagccagcagacatctcccatgggcagagtgtaccagagccaggatataaccaagatggtcaggttctgctctcctctccttgagtctcctttcccacttagctcaacctcattgggaggcattgagacaggggaagccacagcttatgagaaggggagggagaagagatggagctgggaa

SEQ ID NO: 156710 - DNA, 601 bp, Human
ggacaaaatagggttctgcagtattagcatatgactcaactccagattatataagattaggctgagggtggaagcggctggtggtgagaacttccttggaagtaatcaattggttggggattcctcagcctccctctccagaagcccagggagtggactatgtaaagaccttcaccatgagctccctgaagtttgggggtggcaggcctggtgtcttcagtggcattagcggggcaatacagagattcagtgccagaggtgaactgaccatggagccatgaactttcatgcccgcccatcrcatgggccccttccagggtctgtacctaattttatattcataaagtgtactcttcttcttaaataggacttccaaaatgacaaaagctacaggggcacaaaatttgtatcttccctggtctgtgtgtagtctgaggctgattgagaattctgaggcggatggctgtggaggtcaggcatccccagttgggaggtccttggttgcagggtggtacttctgagcaacccaccccactgccctcatgagagatggagctagccagcagacatctcccatgggcagagtgtaccagagccagga

SEQ ID NO: 156711 - DNA, 601 bp, Human
ctgtgacctcacttcttcccttggttgttgctaatgttcttatattgttccagctacaaaacggagtctgaaaacgtacagttctctttccatcgaactggctggcctccctgcatagggcaaaggagtcatggacttggggccgttttcaaggttgaagccaattggtaattactgtggaagtatttccaacgaaatgacagcactgtgggatctcccaagaatgtggcttttataaaaactgggcacagatactcaaaaggagcattggtgctgttgcacacatagcgtggatgtccasggaatgaacatctccgtagcctttcttcactttcgcaccgtgtaatgaaactcggcttttcagttaagcccctagacagggagatgtgggtggccacttgattaagaactggaagtatttacattcttgtctctaaaagaaaaaggcatgccctccctggctcttttccattccagttgtttggaatgtgggcaaactgatagccaatgtggataatacagatgagggcaacactccagaggtggtgagcatggagttaggaggagccaaacccctggctctggcaggcgttatatcaga

SEQ ID NO: 156712 - DNA, 601 bp, Human
aaaaaaccatgggagcagatgagatcatctacattagcaggtatagggtcccaaacaaggatgttgcagggaagaccaggaccagggtattggcaaaaaagactgagaaggggcgctttcccacatagagaaaaataagaatagtgacaaagcagccagggaggaggctgtttaacagagaaagatgtgtcagggcctccccagtccatgcccttttcttcctggatgcccatctagaccacatgtcccagcctctccttgtggcagcctttcacacccacgtgatggagatctagccaayggaggtgaggcagcgggcatgtgtgttgccaggtatagctgcggcccttacggcgtgccagagccacagatggaaggaggagtctgggtcccgagtgcccacatggagaagagctgacccatctacttgaacacctgtccaggatgactacaggagcaagaaaataaactttcgtgtagttggatcattagatgtttaggtctgcgtgttacagtggggagccctccctaagtcacacaggcaatgagactcgttggatgctccagttaggagccctttccgtggaggcatgaggactga

SEQ ID NO: 156713 - DNA, 601 bp, Human
tattaaaaaaaacaacaacaaaaaaaccatgggagcagatgagatcatctacattagcaggtatagggtcccaaacaaggatgttgcagggaagaccaggaccagggtattggcaaaaaagactgagaaggggcgctttcccacatagagaaaaataagaatagtgacaaagcagccagggaggaggctgtttaacagagaaagatgtgtcagggcctccccagtccatgcccttttcttcctggatgcccatctagaccacatgtcccagcctctccttgtggcagcctttcacacccaygtgatggagatctagccaatggaggtgaggcagcgggcatgtgtgttgccaggtatagctgcggcccttacggcgtgccagagccacagatggaaggaggagtctgggtcccgagtgcccacatggagaagagctgacccatctacttgaacacctgtccaggatgactacaggagcaagaaaataaactttcgtgtagttggatcattagatgtttaggtctgcgtgttacagtggggagccctccctaagtcacacaggcaatgagactcgttggatgctccagttaggagccctttc

SEQ ID NO: 156714 - DNA, 601 bp, Human
cagaactcaaagtataattaaaaaacaattgtcttaagatggtagtggtttgtgaagggatcttgcctatatgctgtgaagttctcatgagacaggttctattaaaaaaaacaacaacaaaaaaaccatgggagcagatgagatcatctacattagcaggtatagggtcccaaacaaggatgttgcagggaagaccaggaccagggtattggcaaaaaagactgagaaggggcgctttcccacatagagaaaaataagaatagtgacaaagcagccagggaggaggctgtttaacagagaragatgtgtcagggcctccccagtccatgcccttttcttcctggatgcccatctagaccacatgtcccagcctctccttgtggcagcctttcacacccacgtgatggagatctagccaatggaggtgaggcagcgggcatgtgtgttgccaggtatagctgcggcccttacggcgtgccagagccacagatggaaggaggagtctgggtcccgagtgcccacatggagaagagctgacccatctacttgaacacctgtccaggatgactacaggagcaagaaaataaactttcgtgtagtt

SEQ ID NO: 156715 - DNA, 601 bp, Human
ggcaaccacggaagaagaatagatttagggaatatactgagagctaagcactggatgtatggacagttacagctgatgagccatctaagtgcagatgtcatgtgggtagttgtatggatgggtttagtgttaaacagtgaagaccagatagagaaataaatgtggatacaaactagtcttcaaatgcatttaaaaaccatgggagcagggtgcagcaaaccaccatggcatctgtatacctatgtaacaaacctgcatgttctgcacatgtatcccagaactcaaagtataattaaaaaayaattgtcttaagatggtagtggtttgtgaagggatcttgcctatatgctgtgaagttctcatgagacaggttctattaaaaaaaacaacaacaaaaaaaccatgggagcagatgagatcatctacattagcaggtatagggtcccaaacaaggatgttgcagggaagaccaggaccagggtattggcaaaaaagactgagaaggggcgctttcccacatagagaaaaataagaatagtgacaaagcagccagggaggaggctgtttaacagagaaagatgtgtcagggcctccccagtcc

SEQ ID NO: 156716 - DNA, 601 bp, Human
gcaccatgctgagcacagggcaagaaaagagagactggcatggttgttgaggggaagatgaaggagaaacaggtgttcagacatgatcacatcaatagccaggctgtaagagccatgaaggaaaagtacaggttattgggaaggactgctattagccttagagagctggggaaagtcaggaagtttttctggagggtgttatagttacactggggcagcaataaccaggattggaggcagagaaggggaggcattcctgggggaggaattgacctgtgcccaggcaatgccaaggctctgrggtggaaactgctttgtacctgcagaggaagagcaaggggaagcaagaacagcgtggctgaggcaaagcgatcgcaggcagggtggacggaagtcagcgcagggaggtgagcaggactttgtgagaaaatggaaggtactgaagagttttaatcaggagaatggccaggtcagatcgggatttttaaaagtatattctgaatgcttaatggaaaatagactgaagatggtaacgttgattccagaaaaccaattaggcagtaatattgtaccaggaccagggacagatgatgatggaagt

SEQ ID NO: 156717 - DNA, 601 bp, Human
agcctgggcaacaagagtgaaactccttctcacaaaaaaaaaaaaaaaaaaaagaaaaatgctaatgacaatgtgaatggaagcagagtcattgaacatgccctctgctaggcttacactctggggtagctacactggtgcttttattcaataaaaattagtaagtagctagcaccatgctgagcacagggcaagaaaagagagactggcatggttgttgaggggaagatgaaggagaaacaggtgttcagacatgatcacatcaatagccaggctgtaagagccatgaaggaaaagtacrggttattgggaaggactgctattagccttagagagctggggaaagtcaggaagtttttctggagggtgttatagttacactggggcagcaataaccaggattggaggcagagaaggggaggcattcctgggggaggaattgacctgtgcccaggcaatgccaaggctctgaggtggaaactgctttgtacctgcagaggaagagcaaggggaagcaagaacagcgtggctgaggcaaagcgatcgcaggcagggtggacggaagtcagcgcagggaggtgagcaggactttgtgagaaaa

SEQ ID NO: 156718 - DNA, 601 bp, Human
gacatactcgcaactgtgctaaaggtagtgttagcttaggtaaaatagtacctaacaacaatcacaagaaaagtggcctttggcttgcctgctctattttaaatggtaattcctctccactgaccatgtttcagtgtgagtacatacaattgcctcctctttaaccggtctggaaaataattttgaagcatcattatctctgccacctctggcccctgggtgggtgctgactcagttggagcacacagcttgtccctccacctccagtgcttcttgccccatggagctcagaagaagatayaggtacctgcccatggcaaatgcattcagttccccacaaacacagatccataggggaatcaggaaacaggataaaaggggagagtatattacctttctcattagctatgccccaattccttttagggctgggtacagcagtccacacctgcttccagaatgtgcctactaaactgaaggggttggtttctggatgggtcaccttgtgggaatattactgggtagggaacagtgatgaccagtggtgctccagaaaacatgcagagcatgtcaataagagagtggagagaatttagatgtg

SEQ ID NO: 156719 - DNA, 601 bp, Human
atcttttcactacttggcttgctaaccctgggtgtctcagcagatagagaggtggaattagagagctgtcaggagttggcccttctctcacaattactggtaagctccatctcagcttcttttccacacattaagggcaatgtgactcatcaggctggggagttttaaaaatagtaatgcctgggccccagccctgaggttctctttaggttattccgggtagggcctgggtatccttattttcaaaagctccactcctcccccaaatggatgctaatgaacagccagggctgtgaaccaytggcttggggtttctttgcataggtgtcagtgacaagttggggcacattttttaaagtgctaaatcccaggaggcccttcagtctccattcccaaggttgacttctatagtaacaaaacaggtcaaaatctcaggccagagaggtgccacacacactgagccccaatcacacctgatcacccagcatgcactgcttatgagactcaatttcaaacatccccacctttgatcaggcagctctatgacatagcagggcaccttgtctttttctacctgttaaatcttatcctgcttggttct

SEQ ID NO: 156720 - DNA, 601 bp, Human
ctgaagacgcagctaagctgtcaaaaatgtgatatgatatctgtgcctcaaattggtttttatttttaacacattacacttaaaactggaggttgttaaattgttccaagtatatagagatagaaatccaaaaaagaagatgagttcaaagtcactgaactttaaattgccaccaggaacaatctgatgttctttatcttacaccctttagctgtccctccaccactttcagcctctgtgctcaagttttcaatgtgtttcttatgaaactttattattccccaaagctacaatcgtccayacgggcatttccaatgtgcacgacaatcgggcgatgttcatccccacagccccactaccatcggtcttcacggtatttctaggacgtggtcagtctgtttagttgatacaggtcttctttttatggatttcgacggccctgaatctataacactctccattttatatttctgaacatcctgtaaacatcgccaagaagaatgtattactagagagacttctactaacagtttgaatgaggggactaagtagctttcattcggactggtctacaggaggttaggacaacacacacttgagc

SEQ ID NO: 156721 - DNA, 601 bp, Human
tgtggcaatgaaccaaaaaggagctgactggtcagcatccgtgtgtgcctctctccagccacagtcagctgccctagggcaggtgtggagtgggtagagttgatgggtcatcaggcaacttggagagagacaagggaacgtcacggaagctaagcccagtagggaggaaaatgtaggtgctagagacgatatggagagtgtatattgatcagggtactggtgggcttatgagggccacaggctgttgggaggatacttcacaggtgctgggggttttcttgagggaggggagcggagatcsttctcaaaagagcaatgaggagggggcaagaaagacgactgctccaagaaggacgtctgttccacctccagggtgggacacaagggagggagggtgggtgggaaattaaacagccctcgaggagggggctcggggggctgtgtcctcagggccgacaggagatgagcagaagaggtttgcgaaacggacacaggggattttgctgatttatttatttatttttcttttgagacggagtctcgctctgtcaccaggctggagtgcaatggcgtgatcttggctcgctgcaaactccacctc

SEQ ID NO: 156722 - DNA, 601 bp, Human
ggggtcagggaggtgctgtcgggagccttaacgttgcagaaggacctgcagatgacaattgaaccagaccctggtgacacagatcttggcttcccagcccacagaagaacagatgtgaaggccctgggtgggaacggcttcgctggtgtgagaacaggctcctgggactgaataggcgtgagcagggggccaggaagacaggaaagctctgggtgtccaggacagtttggggaggagtagccacagcaaagctgcttgggaggtcactcccctggacagaggagagatggcccaggcttgragggtgctggtggtgggaagcgtgcagatctggtatccacactggagggtttgctggtggcatggctattggtgtgggaaagaggaatcaagccttaccgcagtgcttctggtgtgaaccacaggggcctgaggtccccttcactgagccaggaacaatgggagggagggaagcagctttagggagtggaactaggactgcctcatggggacgtatatggttaccgaagagggacagagaaggaagcaggatctgcaaactgggatctcagggctggaggcagaattttggacgtcagca

SEQ ID NO: 156723 - DNA, 601 bp, Human
ggggaaggaggaaaggggtggggaaagaggagcgggggccgggaaggaggaaggggggcggggaaggaggggcggggtgggtatagaaaagtaggggtgaggatgctggcatctctattttgtggagtggggtcagggaggtgctgtcgggagccttaacgttgcagaaggacctgcagatgacaattgaaccagaccctggtgacacagatcttggcttcccagcccacagaagaacagatgtgaaggccctgggtgggaacggcttcgctggtgtgagaacaggctcctgggactgaakaggcgtgagcagggggccaggaagacaggaaagctctgggtgtccaggacagtttggggaggagtagccacagcaaagctgcttgggaggtcactcccctggacagaggagagatggcccaggcttgaagggtgctggtggtgggaagcgtgcagatctggtatccacactggagggtttgctggtggcatggctattggtgtgggaaagaggaatcaagccttaccgcagtgcttctggtgtgaaccacaggggcctgaggtccccttcactgagccaggaacaatgggagggagggaa

SEQ ID NO: 156724 - DNA, 601 bp, Human
acgcgcacaggggagatggagggcgtgcgggaggaggagtagggcctttgccggtccctctcgatggttgaagacgaggctacaaagtggtattgtgaccatccatcctgcaaaacacagcacgctcctgttagatgggcaagacagagtgatttttcacctccggacatttttaagttccaagtatctggatttgcataatatttctatggtgtgtcagaagaggttcttgaagttctgcgctctcatggaggtgaacagagccaaatgtgaatgaagacacacctccttccctccagasagcctggcgggtagggcctgctttccttcatgaatgttgaataaatggtccctttacaaacccgctctggtcagaagcttcgacttcgatgaaaatacgatgctcagaatgttaggggacccggaaactgtctattttttgccgacctggttccagctctgcctggctccctcttccgctgcctcaagattttccacaagggtttacccctttgctcccaggacctatctgttggcaaccagaatccagggcagcgtcctcccttcccgtttacctgcctgtgtcctttccagccccaaa

SEQ ID NO: 156725 - DNA, 601 bp, Human; identical to SEQ ID NO: 21653

SEQ ID NO: 156726 - DNA, 601 bp, Human; identical to SEQ ID NO: 21654

SEQ ID NO: 156727 - DNA, 601 bp, Human; identical to SEQ ID NO: 21655

SEQ ID NO: 156728 - DNA, 601 bp, Human; identical to SEQ ID NO: 21656

SEQ ID NO: 156729 - DNA, 601 bp, Human; identical to SEQ ID NO: 21657

SEQ ID NO: 156730 - DNA, 601 bp, Human; identical to SEQ ID NO: 21658

SEQ ID NO: 156731 - DNA, 601 bp, Human; identical to SEQ ID NO: 21659

SEQ ID NO: 156732 - DNA, 601 bp, Human; identical to SEQ ID NO: 21660

SEQ ID NO: 156733 - DNA, 601 bp, Human; identical to SEQ ID NO: 21661

SEQ ID NO: 156734 - DNA, 601 bp, Human; identical to SEQ ID NO: 21662

SEQ ID NO: 156735 - DNA, 601 bp, Human; identical to SEQ ID NO: 21663

SEQ ID NO: 156736 - DNA, 601 bp, Human; identical to SEQ ID NO: 21664

SEQ ID NO: 156737 - DNA, 601 bp, Human; identical to SEQ ID NO: 21665

SEQ ID NO: 156738 - DNA, 601 bp, Human; identical to SEQ ID NO: 21666

SEQ ID NO: 156739 - DNA, 601 bp, Human; identical to SEQ ID NO: 21667

SEQ ID NO: 156740 - DNA, 601 bp, Human; identical to SEQ ID NO: 21668

SEQ ID NO: 156741 - DNA, 601 bp, Human; identical to SEQ ID NO: 21669

SEQ ID NO: 156742 - DNA, 601 bp, Human; identical to SEQ ID NO: 21670

SEQ ID NO: 156743 - DNA, 601 bp, Human; identical to SEQ ID NO: 21671

SEQ ID NO: 156744 - DNA, 601 bp, Human; identical to SEQ ID NO: 21672

SEQ ID NO: 156745 - DNA, 601 bp, Human; identical to SEQ ID NO: 21673

SEQ ID NO: 156746 - DNA, 601 bp, Human; identical to SEQ ID NO: 21674

SEQ ID NO: 156747 - DNA, 601 bp, Human; identical to SEQ ID NO: 21675

SEQ ID NO: 156748 - DNA, 601 bp, Human; identical to SEQ ID NO: 21676

SEQ ID NO: 156749 - DNA, 601 bp, Human; identical to SEQ ID NO: 21677

SEQ ID NO: 156750 - DNA, 601 bp, Human; identical to SEQ ID NO: 21678

SEQ ID NO: 156751 - DNA, 601 bp, Human
gtcatgggcgggctccacgagatagctctgcaccgggcgtccggctccttcgccccgggctctggctccttcgccccgggctccggccacggacttttctggcccaagacccagggttcggacttggcgcctccaagcgcctcgggcttgggagcagcgcctagaccttcgccgccgggctttgagaactcgttcccccaggtctttcaccagactctcctccctccccgcactctttgcttacaacgaaatcctcggggcgcattgcccccgggtaccttccgaccctgggcaagccccrccgggcggggtgcggttggtcccccggggccctctgcgtagcccggcgatgccggccagttcgcagtagcggggtttcgcactaacggggtctcctgtttttttttttccctccaggatcgccacgacgggagcagcaatgggaatccgcgggtcccccacctctcctccgccgggcagcacctctacagccccgcgccacccctctcccacactggagtcgccgaatatcagccgccaccctactttccccctccctaccagcagctggcctactcccagtcggccgacccctactcgc

SEQ ID NO: 156752 - DNA, 601 bp, Human
cttcatctccggagttgttactgcctagttttttttcttggaaaaatgtccatgaattccagtgggtgtttcacaatgtgagagaaagtcttccagagcgagtgaacactgatttaacttgaaaaacaacaagaaaaaagtcacaggcacaccttcgttgagtggttggttctgtaacaattttaattgttgaataagttgtgattttatttttgatttcaaacacgtgtatggaaaacctccttaattctgacctgcaagaaaagttttgaagcaatttggcctaccaaatgaatacctstaaaaggaacagagcttggaatgatctgtcagagggagagttttgcaggatggggaggaggggatttggaaaattggattacttggtgagtgagtggtttatgaaattaagttacttaactgacaggattaccaggattaccattttgactgttttgggaaatagagtaggcctaaattgaaggtagttttggcctgttacttgaactgcttaaatggattgaggatggaggaaaaatggattttaaagaaaaactcagaaaagactacaaattttcagtaaacttagaacgtattagtt

SEQ ID NO: 156753 - DNA, 601 bp, Human
ggtgagtgagtggtttatgaaattaagttacttaactgacaggattaccaggattaccattttgactgttttgggaaatagagtaggcctaaattgaaggtagttttggcctgttacttgaactgcttaaatggattgaggatggaggaaaaatggattttaaagaaaaactcagaaaagactacaaattttcagtaaacttagaacgtattagtttggatgattaaatttactgtgatcaactgcactgaaaaattttggaaagaatcttaatgtgtcctatgattttggttgttcttggggggaaaaaactcaccgtttatttagtattgaagcagtcttctgaaaacaaatgttctaattaaatagttttcagcagctgctaggaaaaaaaaaaaaagaaaccctccaagctttggatcttcactaattaacttcccaaggtgttaacttgtgaatttcagattagatttgtctctgaagtagggggcttttttaaaaagtcagccatggccaggtgcagtggctgacacctctaatcccagcactttgggaggccaaggtgggcagatcacttgaggtcaggagtttgagaccagcc

SEQ ID NO: 156754 - DNA, 601 bp, Human
gcctaaattgaaggtagttttggcctgttacttgaactgcttaaatggattgaggatggaggaaaaatggattttaaagaaaaactcagaaaagactacaaattttcagtaaacttagaacgtattagtttggatgattaaatttactgtgatcaactgcactgaaaaattttggaaagaatcttaatgtgtcctatgattttggttgttcttgaggggaaaaaactcaccgtttatttagtattgaagcagtcttctgaaaacaaatgttctaattaaatagttttcagcagctgctaggaaaaaaaaaaaaagaaaccctccaagctttggatcttcactaattaacttcccaaggtgttaacttgtgaatttcagattagatttgtctctgaagtagggggcttttttaaaaagtcagccatggccaggtgcagtggctgacacctctaatcccagcactttgggaggccaaggtgggcagatcacttgaggtcaggagtttgagaccagcctggctaacatggtgaaactccatctctactaaaaatacaaaaaattagctggatgtagtggtgggcacctgctggagaattacttg

SEQ ID NO: 156755 - DNA, 601 bp, Human
gctcccatacaatttgaaatattcggtgatgcagagttggatgctaggaaagattgattttgtatcttacggggactaattgaaagaggaccctgctatcacttttcattatggttcacgtgatgtagatagtctttgatgggtttcagctttgacagcagcactttaggagtttagaatttttaaagtgtgcgtgtgtatgtgtttttgtttttgagagtagccagagtcaatttttctttttcttagagccaaatcgaaaaatggaggccggtccttgcgggagaagttggacaagatygggttgaatcttccggccgggaggcggaaagccgctcatgtgactctcctgacatccttagtagaaggtcagtggggttttgtttttggttcgtgatgtttttaatttgtgcctgtgtctttaatacttattgcagaaaaactggaaaacaactcttaaaacttggttgcaagtagagatgaaagcaattggaattgttctctaagtttattggaatgaatcacagttaattttatcgaataagttaacatttaagtatctggttgctcaggtaggctcttctgtattcccccagagaat

SEQ ID NO: 156756 - DNA, 601 bp, Human
tactagaaagagagaaaatgggggctgggtgctgtggctcatgtctataatccctggcatgagccattggttgagaccaggagctcaagaccagctggccaatgtggcaaaaccctgtatctactaaaaatacaaaaattagctgggtatggtggtgcatgtctgtaatcccagctattcaggggctgaggcacgagaattgcttgaattccggaggtggaggttgcagtgagcagagatcgggccactgcactccagcctgggcaacagagcgagactccgtgtcaaaaaaaaaaaaaaagagagaggaaaagggcagtttggcctcagtgaccacagccatcctaaaagctgttgctgattattctaggtgaagctgttcatttggctagggactttgcctatgtctgtgaagccgaatttcctagtaaaccagtggcagaatatttaaccagacctcatcttggaggacgaaatgagatggcagctaggaagaacatgctattggcggcccagtaagtatctgaacttgaatttgatgatgactcaatgctctagaccttgaggttgagaagattccccctccacagtcccgatggct

SEQ ID NO: 156757 - DNA, 601 bp, Human; identical to SEQ ID NO: 35244

SEQ ID NO: 156758 - DNA, 601 bp, Human
agctgaagaagagggaaactgtaaggaaaaactatgtagaaggtgatgaaaatcaggagtgtacaggcatagaaagaatgggcatttaggtagaaggagcagtgtgagaaaaagcatgggagtctaaaattagagagtagcatctgcaaaaatagcaagtataatacagggtggtggcaagacctgaaactggggagataggcagagaccaaattatggatcttgcagaccatcagaataattacaattttattttataagcaaataggagtcattgagaggacaaagaagagacctaagmcagctcagcccatttttaaccctctgctataggtcaggcactgtattaggtactgtatattttatgtccttaagcttaaagaaggcttagtcatgactaatgcagaaattggggggctagggcagggatggggaaggaacttttagagggaaaggtgggcagaaacgtaggtgagaaagaacatggaacacttttttttttcccaatacagacaccatcactcagttttattggttttgtcgtattagcctctgaagtaggcaattattggtgtgaacatacattttgaaaaacatctgg

SEQ ID NO: 156759 - DNA, 601 bp, Human
tacaattttattttataagcaaataggagtcattgagaggacaaagaagagacctaagccagctcagcccatttttaaccctctgctataggtcaggcactgtattaggtactgtatattttatgtccttaagcttaaagaaggcttagtcatgactaatgcagaaattggggggctagggcagggatggggaaggaacttttagagggaaaggtgggcagaaacgtaggtgagaaagaacatggaacacttttttttttcccaatacagacaccatcactcagttttattggttttgtcktattagcctctgaagtaggcaattattggtgtgaacatacattttgaaaaacatctggagtcaagagtgcacgagtgtcaactcagtgcaagtactgttggtaagcattatgtcccgaggatgaaatcggaggaccaacaggcccaggaggcttcacagcgaacaccacatgcctcgcgcccaaaaggacagcagaccgcgcttcagaacggaaccgccttctccatgtaaacttttgacgtaaactgtgtgcttcagggtggcctcttcttctccgagatcctctcctgcgtcccgagt

SEQ ID NO: 156760 - DNA, 601 bp, Human
tggcctcttcttctccgagatcctctcctgcgtcccgagtttgggaatggcccggccgtgctcaggcccaggcggtggaggcctcggtgtagtagtgccgtgcttgtcgacgttcccaggagtccgggttcagaagccccctctccggtggattggcagcttcgcggtagctgggctagtcttcctctggaaactcagtaaaaagagtcggcgctgtccgcctgagcgcgggtttcctaccgagctagaggccagcctgcctcaggcgcagaagggtttgccgccggccttggtcagggcragcagctccctggtggcgcccagagctggggtgtcctggggcgcggcaggcggaaaggcacgcgcgggccaggggtgcagtcagcacagaatatggaagagaatgggaagttgttttctgtagctgtagcattagttgtggtgataagtagcagaagatgaggttgcaggtatcctcaaaagtattgcgtgccattccaaggaccttaccattttttcctgtagataacaatagggtttatgtattttaatgaacagagagacatgataagatttttctttttattttttttttactttt

SEQ ID NO: 156761 - DNA, 601 bp, Human
agtgccgtgcttgtcgacgttcccaggagtccgggttcagaagccccctctccggtggattggcagcttcgcggtagctgggctagtcttcctctggaaactcagtaaaaagagtcggcgctgtccgcctgagcgcgggtttcctaccgagctagaggccagcctgcctcaggcgcagaagggtttgccgccggccttggtcagggcgagcagctccctggtggcgcccagagctggggtgtcctggggcgcggcaggcggaaaggcacgcgcgggccaggggtgcagtcagcacagaatrtggaagagaatgggaagttgttttctgtagctgtagcattagttgtggtgataagtagcagaagatgaggttgcaggtatcctcaaaagtattgcgtgccattccaaggaccttaccattttttcctgtagataacaatagggtttatgtattttaatgaacagagagacatgataagatttttctttttattttttttttacttttttgagataaggtctcactgtgtcacccaggctgaaatgaagtggcactcaccgcactccgtcatggctcactgcagcctcgacctcccaggct

SEQ ID NO: 156762 - DNA, 601 bp, Human
tgagggaaaaataatagaataagatgacttggattttaacttgggtgattgaagagacaatggtaaaatatactgagatggggaattcaggaagagaagcacatttgaggagaaacagtattttagcttcagaacatattgagtggaagttatctgtgaaacatccaggtggaatcatctgctatggaactgtgaatgtggatttggagtacagtataacaggctatattatgagtggtatctgaattctttgatttagataacaccaaataagaagagtttgttaacataaaatagttckggaaataggctgtggagaacatttaaagccagatagaagaagagctgggaaaggaaattcctaagtgtttggagatgtagagaaatcatgagaaaatgtcatagaagccaaagtgggatctggcaccatcacagctcactacaacctccgcctcctgggctcaagccatcctcctacctcagccactcaagtagctgggactgcagacacataccaccacacctggctaatttttgtatttttggtagggatggggttttgccatgttgcccaggctggtcttgaactcctgggctcaag

SEQ ID NO: 156763 - DNA, 601 bp, Human
ctcactacaacctccgcctcctgggctcaagccatcctcctacctcagccactcaagtagctgggactgcagacacataccaccacacctggctaatttttgtatttttggtagggatggggttttgccatgttgcccaggctggtcttgaactcctgggctcaagcgatctgcctgccttggcctctcaagtgctaggattacaggtgtgagccactgcattgggctgggatcatttttaaaggaagttatacttcacaatcaactctcaagaaaaaatagaaattaatttttttttttwaaaaaggaaagcctcaggcacagtggctcacacctgtcctcccagcactttgggaagctgaggtgggaggattgcttgagccaaagagtttgagaccagcctgggaaacatagggagactggtgtctctgcaaaaaaaaagcaattagctggctgtggtggtgcacacctgtggtcccagctactcaggaggctgaggtgggatgatcgcttgatcctgggaggttgcggctgcagtgagctgtgattgtgccactgcattgcagcatgggtgacagagtgggaccctggcctaaacaaa

SEQ ID NO: 156764 - DNA, 601 bp, Human
atttggtcttggtctggttcctagcctagaacttcaaagatccttggaactccctgagtaatagaggtaatagagcatattttggaattcataataagtctctcagtcacatctgaatttatgctaataaagtgattcttggtaggcccctagacaacttcaggatggaagctggttgccagaagaaccaactgtgttgattagagagttggaacttgcagccccacccctggatgggtgagggggtggtggtgaggactgggtattgagatcagttatcagtggccagtgatgtaatcartcatgcctgtgaaatgggacctccataaaatcttctaaacagtggttttcagagagattctgggttggtgaatgcatccttatgctgggaaggtgttgcttcaacttcatgggacagaaactcctatacttggaacccatctcggcctcacccttgtgccttttgatttggtggtttatttatatcctttataataaactgataggcataagtaaagtgtttccctgagtttcggtgagccattcttgcaaattattgaacatgaggagggggttgtgggaacccctatttatagctatt

SEQ ID NO: 156765 - DNA, 601 bp, Human
tgagatgtgtgaattcttcgactttgctgtttccagtatttgttggctcttcagggtcccttgcaattccatatgaaactgaggatccatttctgtaaaaaaggccattggaattttaatagagattgcattgaatttgtaaaacattttgggtagtatttctgttttaaaaatattaagtcctccaatccattaacaataggatgtcttttcacttatttagtttgtctttaatttcttgcacaatatttgtagttatcagtgtcaagtctttcacttccctggttaaatttatttctatttttttttttaggtgctgttgcaaatgaaattgttttttaaatttgtttttcaatttgtttttcacaattgtttttcacaattgcctagtgtttagatatacaacttattttctgtcaccttatatcgtgtgactttgctgaactccttattagttcccatagttttctagtgtattcttttgagttttgtatataagatcatgctgtctgtaaacagagatagttttacctcttcttttcctatatgggtatcttttatttatttatttttcattcctaattgcccaggctagaacttc

SEQ ID NO: 156766 - DNA, 601 bp, Human
taaatgaaagtggcaataacagacttccctgtcttgttccttatcttaggaggaaagcttccagtcttttaccatttagtataatgttaactgtgggtttttctttcttttcttttttttttgagacacggtctcattctgtcacccaggctggagtgcagtggtgcaatcatggctcactgcagccttgacctcccaggctcacgtgatactcccacttcagcctcctgagtagctgggtctacaggcatgagccactatgcctggctaatttttgtatgctttgtagagacagggtctscctatgttgcccaggctggtctggagctcctgggctcaagcttctgcttcagcctctcaaaatgctgggattataggcatgagccaccatgcctggcaactgtgggtttttcattgatacactgtatcagtttaaggatgttccttatgttcccagtttgttgagtactttgttgagtgtttgtcaagtgtgttgcttaattatctacatatttttgaagttttcaacattttgtctgttatcgattttcagtttcatttcattgtgatcagagaacatactttgtatgattttagtctt

SEQ ID NO: 156767 - DNA, 601 bp, Human
ctccatctcttgaccttgtaatccacccaccttggcctcccaaagtgctgggattacaggtgtgagctactgttcccagcctggaatatctttttctatctttttactttcagcttatttctgtctttgaatctaaagtgagtctctgtagacaggctacgattgcatcttgttgttttttaaatctgtctgccaataactatcttttaattgaggagtttgatttatttacatattactgataagaaagaacttctgccatattgctatttgtttttgatacatcttttttgttcctcarttcttccattgctgcctccttttgtgttaaatacatacttttcattgtaccattttaattcctttatgtttcatttgttatatattttcgtagtagttgacctgggattacaattaacatcttaatttgtaacaatctagttcagattaatatcaacttaattttaatagtgtagaaaactttactcctatgtagtcctaccccctttatgccgttattgtcacaattacatctttatacattgtatgctcatcaacactgatttacagtgattgctttatgcagttatttaactcagat

SEQ ID NO: 156768 - DNA, 601 bp, Human
cttatttctgtctttgaatctaaagtgagtctctgtagacaggctacgattgcatcttgttgttttttaaatctgtctgccaataactatcttttaattgaggagtttgatttatttacatattactgataagaaagaacttctgccatattgctatttgtttttgatacatcttttttgttcctcaattcttccattgctgcctccttttgtgttaaatacatacttttcattgtaccattttaattcctttatgtttcatttgttatatattttcgtagtagttgacctgggattacarttaacatcttaatttgtaacaatctagttcagattaatatcaacttaattttaatagtgtagaaaactttactcctatgtagtcctaccccctttatgccgttattgtcacaattacatctttatacattgtatgctcatcaacactgatttacagtgattgctttatgcagttatttaactcagataggagaaagaagaaatacaaacaaaaatacatttatactctttttaatatttacctacatactttttttttttttttttttttgcgacaaggtcttgctgtcttgcccacact

SEQ ID NO: 156769 - DNA, 601 bp, Human
actatcttttaattgaggagtttgatttatttacatattactgataagaaagaacttctgccatattgctatttgtttttgatacatcttttttgttcctcaattcttccattgctgcctccttttgtgttaaatacatacttttcattgtaccattttaattcctttatgtttcatttgttatatattttcgtagtagttgacctgggattacaattaacatcttaatttgtaacaatctagttcagattaatatcaacttaattttaatagtgtagaaaactttactcctatgtagtcytaccccctttatgccgttattgtcacaattacatctttatacattgtatgctcatcaacactgatttacagtgattgctttatgcagttatttaactcagataggagaaagaagaaatacaaacaaaaatacatttatactctttttaatatttacctacatactttttttttttttttttttttgcgacaaggtcttgctgtcttgcccacactggagtgcagtggcatgatcctggctcactgcagccttgaccttctgggctcaagtgatccactttggcctctgaaactgttggga

SEQ ID NO: 156770 - DNA, 601 bp, Human
aggagtttgatttatttacatattactgataagaaagaacttctgccatattgctatttgtttttgatacatcttttttgttcctcaattcttccattgctgcctccttttgtgttaaatacatacttttcattgtaccattttaattcctttatgtttcatttgttatatattttcgtagtagttgacctgggattacaattaacatcttaatttgtaacaatctagttcagattaatatcaacttaattttaatagtgtagaaaactttactcctatgtagtcctaccccctttatgcygttattgtcacaattacatctttatacattgtatgctcatcaacactgatttacagtgattgctttatgcagttatttaactcagataggagaaagaagaaatacaaacaaaaatacatttatactctttttaatatttacctacatactttttttttttttttttttttgcgacaaggtcttgctgtcttgcccacactggagtgcagtggcatgatcctggctcactgcagccttgaccttctgggctcaagtgatccactttggcctctgaaactgttgggattataggcatgagcc

SEQ ID NO: 156771 - DNA, 601 bp, Human
tattttcgtagtagttgacctgggattacaattaacatcttaatttgtaacaatctagttcagattaatatcaacttaattttaatagtgtagaaaactttactcctatgtagtcctaccccctttatgccgttattgtcacaattacatctttatacattgtatgctcatcaacactgatttacagtgattgctttatgcagttatttaactcagataggagaaagaagaaatacaaacaaaaatacatttatactctttttaatatttacctacatactttttttttttttttttttttgcgacaaggtcttgctgtcttgcccacactggagtgcagtggcatgatcctggctcactgcagccttgaccttctgggctcaagtgatccactttggcctctgaaactgttgggattataggcatgagccatcatgcccgactgtaattacctttaccagtgttctttattcatgtggatttgagtatcgtctagttagtgttttttcaaagcagcatgatggactccctttagcgtattttttttaacaggataggtctactagcagtgagttctcttagtttttcttaatctaggaat

SEQ ID NO: 156772 - DNA, 601 bp, Human
acctatcttcatgttcactgtttctttgttctgcctgcccaaataagctgttgagcccttctagtgaacttttcatctaagttattatacttttcaattctataatttctattagattttttaaaaaattctctttatcaatactctctttttggtgaaacagagttatcttgctttccttcagtttttaagacatggtttcctttagctttagaacatacttaaaatagctgatttaaagttcttatgtagtcagtctagtcagtgtctgggcatccttagggacagtttcttttttctwtttttgtgaggcagagtctcactctgtagcccaggctggaatccagtggcgcaatcttggctcactgcaacctccgcctcccgggttcaagcaattttctttcccatcttggccttccaaagtactgggattacaggcgtgagccaccgtgcctggcctggaacagtttctgtgattgctttttttttttttaatggatcattccttcttgtttctttgcatatgtgtaagtttttgatgaaattggacgttttgactccatcgctatatttcctagtttctttacagatggataggcgg

SEQ ID NO: 156773 - DNA, 601 bp, Human
tatgtgtaagtttttgatgaaattggacgttttgactccatcgctatatttcctagtttctttacagatggataggcggctggatgagatataaataatatgattgtctttttagttaaaaacatgtaaaatttagtttattttgaaaaagataatacccatggcacataaaggttaaattgtctttccccctttacccttttctcagctgagatctctttgaagggataaaaacttaatatttccttgtatattcttccagagatgttttatatacatgcaagtagtatgtgtgaacatrtaaatactctattgtaaacagtcacgaggaagtaatatgtacaggaagggaatcagtatttgttgacacctattgtgtaacaggcactgagcctgtttctttatatttgagggaagtgtttcaaactgatcgccttgaacgtttatacaattattttatgaagcttttatataaaacgttattgaaaacaaaaatactggcagaagtcatttggaattgcttctagagctggcaccatgtattgaagcatggcagtccctcaacaagtgaaggttaagttagttcagaagcactaaaaat

SEQ ID NO: 156774 - DNA, 601 bp, Human
gacgttttgactccatcgctatatttcctagtttctttacagatggataggcggctggatgagatataaataatatgattgtctttttagttaaaaacatgtaaaatttagtttattttgaaaaagataatacccatggcacataaaggttaaattgtctttccccctttacccttttctcagctgagatctctttgaagggataaaaacttaatatttccttgtatattcttccagagatgttttatatacatgcaagtagtatgtgtgaacatgtaaatactctattgtaaacagtcaygaggaagtaatatgtacaggaagggaatcagtatttgttgacacctattgtgtaacaggcactgagcctgtttctttatatttgagggaagtgtttcaaactgatcgccttgaacgtttatacaattattttatgaagcttttatataaaacgttattgaaaacaaaaatactggcagaagtcatttggaattgcttctagagctggcaccatgtattgaagcatggcagtccctcaacaagtgaaggttaagttagttcagaagcactaaaaattgagaaccaggtattgtgataggtt

SEQ ID NO: 156775 - DNA, 601 bp, Human
tgtgtaacaggcactgagcctgtttctttatatttgagggaagtgtttcaaactgatcgccttgaacgtttatacaattattttatgaagcttttatataaaacgttattgaaaacaaaaatactggcagaagtcatttggaattgcttctagagctggcaccatgtattgaagcatggcagtccctcaacaagtgaaggttaagttagttcagaagcactaaaaattgagaaccaggtattgtgataggttgaaaataaaactttataccattgccgatgtttaaaaatgaggtatactkgtcatttataaaactgttgttgtgtgactagaactttctttgtaagcttttttatatgtattgacttttcacaatctgccattgataggtgccatcagataaatacataataaggaactattattgagaaatgaggatcgagggggagatgagagaagaaagatttttaaggaaaatgcaaaaattgaagtaggacattggcaattttcaatgtttccttccaaagtagaaatatgatttgttttgtttttgtttttttgttttgttttgtttgagctggagtcttgctctgtcgtgcag

SEQ ID NO: 156776 - DNA, 601 bp, Human
ttatcagcagcataaaaacgaaccaatacaccttaactgaaatcttcatggggtggtggttcttacttacccaaccaagataattgaccactttataacttttgagcagctctctacatttaaatgtttacagatcacctattaaggaaacttctacttagaattgtcagctgaggattttctctaactatcgtgggtgatattagacctacttgttattctatatcagtagttaataatctaaggtaattttttcctcaatctcatttttaggaaatttttttgaagaaaattataaaarttaatatatatattttcaaaaatttaagtaggacccaaatggagccctttgtccccccaagtcctctggtaccacatcccatacattaacccagatgtcatatcatttcatccaggtatattttagtgtgtatctctaaccacaacacagtgatcacactaacaaaaattaacaattgtttcttaatataaaatattgaattaatattcagatttctctgattttcataactttttttcctaactattttttcacttcttttcttttttgagacagagtttgtctctgtcacccaggctg

SEQ ID NO: 156777 - DNA, 601 bp, Human
aaaaacgaaccaatacaccttaactgaaatcttcatggggtggtggttcttacttacccaaccaagataattgaccactttataacttttgagcagctctctacatttaaatgtttacagatcacctattaaggaaacttctacttagaattgtcagctgaggattttctctaactatcgtgggtgatattagacctacttgttattctatatcagtagttaataatctaaggtaattttttcctcaatctcatttttaggaaatttttttgaagaaaattataaaaattaatatatatagtttcaaaaatttaagtaggacccaaatggagccctttgtccccccaagtcctctggtaccacatcccatacattaacccagatgtcatatcatttcatccaggtatattttagtgtgtatctctaaccacaacacagtgatcacactaacaaaaattaacaattgtttcttaatataaaatattgaattaatattcagatttctctgattttcataactttttttcctaactattttttcacttcttttcttttttgagacagagtttgtctctgtcacccaggctggagtgcagtggta

SEQ ID NO: 156778 - DNA, 601 bp, Human
catggcaattggttgatgtcttttaagtctttcttttttttcaaggtaatgtgtcatttttttgtagtatttttgtgtttcttaaccttttacaaaaatagactttatttttaaagctgcgtttgtgttagagttcgctcctggtatgctgtacattccgtgtgtttagacaaatgaataatgaacatgtgtccaccactaaagtaccaatacagaatagcttcactgccccaacaatcctctgtgttccacctattcatttcttcctcctccctaaaccctggctactactaatccttcyactgtctctatagttttgctttttgcagaatgtcatatggcctttttaattaacgtctttttttttgagacaaggtcttgctttgtcgtgcaggttggggtgaagcgctgggatctcagctcactgctgagcctctacctgctaggctcaggtgatcctcccatctcagcctcccaagtagctgggactacaggtgtgcaccaccacacccagctaattttttcttttttttttttgggtagagatgaggttttgccatgttgcccaggctgttctctgactgctgtgcttaagcagtcc

SEQ ID NO: 156779 - DNA, 601 bp, Human
ctgccccaacaatcctctgtgttccacctattcatttcttcctcctccctaaaccctggctactactaatccttctactgtctctatagttttgctttttgcagaatgtcatatggcctttttaattaacgtctttttttttgagacaaggtcttgctttgtcgtgcaggttggggtgaagcgctgggatctcagctcactgctgagcctctacctgctaggctcaggtgatcctcccatctcagcctcccaagtagctgggactacaggtgtgcaccaccacacccagctaattttttcttttttttttttgggtagagatgaggttttgccatgttgcccaggctgttctctgactgctgtgcttaagcagtccgcccaccttggtctccaaaagtgctgggatcgcagttgtcagccactgtgctcaacttcttttacttagtaatatgcatttacatttcctctgtatcttttcatgacttgatagctcatctctttttagcactaaataatattccattatctggatataccacagtttatccattgctgccttttttggggggatttataatatacctgctataaacatctatgt

SEQ ID NO: 156780 - DNA, 601 bp, Human
tattgcattcctatcagccatggataaaagttcctgttgctctatatccttgccagcatttggtggtggtagcattttgggttttgccataataatggtatgtggtagtatcacattgttttaattggtagttctccaatgatatagcatgctgagcatcttctcatgtgcttattttccatttacatatctttggtgaggtgcctgttcaggtcttttgcccatttaaacaaaatgaattgttttcttactgtttagtttaaagagttttttttttttttttttttttttgagacaaaaytcccccaggctggagtgcaatggcactatcttggctcactgcaacctctgcctcccaggttcaagcgattctcctgcctcagcctcccgattagctgggattacaggcgcctgccaccattctcggctaatttttgtgtttttagtagagacgggattttcatgttggccaggctggtctcgaactcctgacttcaggtgatccgcctgccttggcctcccaaagtgctgggattacaggcatgagccaccgcacctggcctaaagagttctgtgtatatttttgggtaatagtacttta

SEQ ID NO: 156781 - DNA, 601 bp, Human
tatagattttgcagcttgatctgtgtgatatgagatatatagatctatctgtttatctatctgtccatatatgttttcatccagaattcctggctcataactcccatagcccctgttatttcttaagtgacttaaacaataagcatatcttttgttaaagtattttgccttttgtctttggttcctgaagaagctttgaaacagcttctgagcaataaaggtgaaagacagtcttttgttataatgttggagtactttagatctcagaagtaggcctcagaagacagatctctctctctcyggccttctcctggtctttgttcacttgctcatttttctccccaaggcaggccatagaaactaaaaacatgctctaatcttcccccggctttctgtccacaagctggccataaaggaattctctgacttacattgtctgattttaggtcataagacccccatttcaaaatggatcttgtcccataccatggaggaagcaatgctgcacagagaggccaagaagaatctgaacaaaacaggccttactgggtttccccactcaatctattagtattagattataccctttttgttcagtcgc

SEQ ID NO: 156782 - DNA, 601 bp, Human
tcaggacctcctggggctatgtcatgagtcagtgtcagaggtgtttgaaccagaacatctctgtcttgaataggggctaggtaaaatgaggctgagacctactgggttacattcccaggaggttaggcattctatgtcacaggatgagataggaggtcggcacaagatacaggttataaaaactggtcgtggtaaagaagtcggccatatcacaccaaaaccaagatggcaacggaagtaacccctggtcatcctggctactcatatatgctaattatgatacattagcatgctaaaagasactcccaccagtgctatgacagtttacaaatgccatgccaatgtcaggaagttaccccatatggtctaaaagggggaggaatcctcagttctgggaaatggccacctctttcctggaaaactcataaataatccacccttatttagcatataatcaagaaataagtatccttagtacagcagtccaggctgctgctctgcctgtggagtagccattctttattcctttactttcttttttttgagactgagtttcgctcttgttgcccaggctggagtgcaatggcgcgatcttggctca

SEQ ID NO: 156783 - DNA, 601 bp, Human
atgaatggctcgtagaaccatgtaaacactttacttactattactggtttattacaaagcattttttaattttttaatttttaagattttttaaaataaatagagacgcggttttgctgtgttgcccaggctggcctcaaaactcctggcctcaagcaatccgcccatacgggattacaggcgtgagctagcgtgcccgtatttcttattatatcacagtatcacaagaagttaatagccgtttgaaaaaataatacacgtaagttgaaagaggaaataatatttttatttcactcctacrtaactaaaattactaatggtttgtgtgtgcctgtaggacagtgtacagcttgtaataccttgcagtcagattggacatcactaccctcatttcttgttccatgttgatttttacatggcacttttctttttttgtcacatgaccccagaaaactcagcttcacaagatatattgtcaagaggaatgcagtgctatctaatgttgaaactgaactacttttagctagtattttgtgctgtttctgaaagatgtccagtattgctgtttccctcaaatttaagatgtcccgaaactcccctc

SEQ ID NO: 156784 - DNA, 601 bp, Human
gttccatgttgatttttacatggcacttttctttttttgtcacatgaccccagaaaactcagcttcacaagatatattgtcaagaggaatgcagtgctatctaatgttgaaactgaactacttttagctagtattttgtgctgtttctgaaagatgtccagtattgctgtttccctcaaatttaagatgtcccgaaactcccctctgagtttgcttgcggtgcccctgggtgcttcagtgcactctttgggaatcttgactaaatactattatccaggtcttattataatcaatgtgtgawttttatttttattaaataaatgtgttggtccccccatcacctcagttgagttctaatttaagatttacttgaggccaggcatggtggctcatgcctataatcccagcaatttgggaggctgaggtgggcggatcacctgaggtcaggagtttgagaccagcctggccaacatggtgaaaccccatctctactaaaaatacaaccattagccaggtatggtggtgggcacctgtaatcccagctactcgggaggctgaggcaggagaatcgcttgaacccgggaggcggagattgccctga

SEQ ID NO: 156785 - DNA, 601 bp, Human
ctgtaatcccagctactcgggaggctgaggcaggagaatcgcttgaacccgggaggcggagattgccctgagctgataccacgccactgctctccagcctgctgacatagtgagactccgtctcaaaaaataataataataaaggcaagagtccaaagtggatttttccttctgatacttaatatatgtatagttatgtgtcacataatgtttcagtcagggatagactgcatatacagaggtggttgcctaagattataataccataactgtacttttttctgtgtggaggtatgtttakataccaaggtgttacagttgctgacagtattcagtacagtaacatgctgtacaggtttgtagcctaggagtaataggccataccatatagcctaggtgtatagtaggctctaccatccgggtgaaaataatttgttaattttcctactttcttgtcattaatcgtttttaaaaacttttttttttttttttttagacagggtcttgtgctgttgcccaggctggtgccatcataactcactatggcctcgacctcctgggctcaagtaattcttctgcctcagccctcccgagtagctgg

SEQ ID NO: 156786 - DNA, 601 bp, Human
ggtatgtttatataccaaggtgttacagttgctgacagtattcagtacagtaacatgctgtacaggtttgtagcctaggagtaataggccataccatatagcctaggtgtatagtaggctctaccatccgggtgaaaataatttgttaattttcctactttcttgtcattaatcgtttttaaaaacttttttttttttttttttagacagggtcttgtgctgttgcccaggctggtgccatcataactcactatggcctcgacctcctgggctcaagtaattcttctgcctcagccctccygagtagctgggactatagacacatgccaccacactcagctaatttttttttttttttgaaatggagtctcgctctgtcaccaggctggattgcagtggcgtgatctcatctcactgcaacctctgcctcccaggttcaagtgattctcctgcctcagcctcccaggtgtctgggactgcaggcgcccaccaccacgcccggctaatttttgtatttttagtagagatggggtttcaccatgttggccaagatggtctcgatctcttgacctagtgatctgcccgtctcggccttccaaag

SEQ ID NO: 156787 - DNA, 601 bp, Human
tgggattaccaccatgcctggcccacgtttggctaattttttattttctgtagagacagggtcttatgatgttgccaaggctgatcttgaattcctgggctcaagcagttcttccaccttggcctcccaaagtgttaggattataggcactagccactccacccggtcgattaatcttttaatagttgtcgtcagcatgaaaagggcattcatacattcatattcattataatgaatttgagaatttcacattttctaaactgattataccggcatatcttgtctgaagcatgtgagtagsgcagaagctaaaataaagattaagtctcacggtatagaagaagggtacagaaaataacccaaataaagagtaaaatcttgattagagtacaagcctaaacaaagttaatagatatgaaaggattaattatacagctactaaattggataataattgctctgtggaatgtacatgagaaattatttttgagcctgtatatgtgagtagtttgcatttaatgggtcccggtcataaacctcaaacatattatcatgagaagaatttcactgttgatatgaaatcttttaaactttatctgct

SEQ ID NO: 156788 - DNA, 601 bp, Human
tactaaattggataataattgctctgtggaatgtacatgagaaattatttttgagcctgtatatgtgagtagtttgcatttaatgggtcccggtcataaacctcaaacatattatcatgagaagaatttcactgttgatatgaaatcttttaaactttatctgctcagtctgaaggattatttctgtcccatttcagcttataaatgtaaaaaaagagaatgtgctcctcatatctaatgagctgctggtagaccacacttcacacatgttaactgttgatggagagattgaacctgtccrgctttacacactgggagaggaccctaggaagctggagaggacctaggaagctggtgtctgatttcctctggacttcaccctatgtgcttcttcctttgctttttttgttttgtattctttctctatggtagatcttagctgtgagtacaaactatatgctgagttatgtgaatccttctagcaaatcaccagtcctggggggtacagcccccaacacagtaataaatgacttaaaaaggaaaacactattccctgcctcatccttgcacctctctcagtcttaggtttttttttttcttt

SEQ ID NO: 156789 - DNA, 601 bp, Human
tctagggttgaatctcaatcaagtcttcctactgtttgtttactgccttgtttttgtaggaattattgagaaagtatattattgggattgtaaattattgggaaagtaaatttcttgagactattagtctgaaaatgaccttatttgttgcgggaagtcagggaccccgaacagagggaccacctggagccatggcagaggaacataaattgtgaagatttcatggacatttgttagttcccaaataatacttttataatttcttatgcctgtcttactttaatctcttaatcctgttatgtttgtaagctgaggatgtatgtcacctcaggaccactgtgataattgtgttaactgtacaaattgattgtaaaatgtgtgtttgaacaatatgaaatcagtgcaccttgaaaaagaacagagtaggccagacacggtggctcacgcctgtaatcccagcactttggaaggccgaggcaggcggatcacgaggtcaggagattgagaccatcctggccaacatggtgaaaccccgtctctactaaaaaaaaatacaaaaaactagccaggcgtggtggcgggcgcctgtagtcccagctac

SEQ ID NO: 156790 - DNA, 601 bp, Human
cttactaggattgggaaactccatcctggtaaatttttggttagaccggttctctgctctcgaaccctgttttctgttaagatgtttatcaagacaatatgtgcaccactgaacacagacccttatcaggagttctgattttgcccttgtcctgtttcctcagaagcatgtgatctttgttctgccttttgccctttgaagcatgtgatctttgtgacctactccctgtttgtacactccctccccttttgaaatccttaataaaaacttgctggtttggaggcttaggtgggtatcacgrtcctactgatatgtgatgtcacccctggcggcccagctgtaaaattcctctctttgtactctttctctttatttcacggccagccaacacttatggaaaatagaaagaacctacgttgaaatattgggggcgggttcccccgatacttaagttaactatacacttgaatgattgttggaactaattttctttcagcgtttgaagatactttaatgtctttaagcttccagtgtttctgttggcatattggtcctgatcctgtgaatataagctgcttccccagctccctcacccacagga

SEQ ID NO: 156791 - DNA, 601 bp, Human
cttgctggtttggaggcttaggtgggtatcacgatcctactgatatgtgatgtcacccctggcggcccagctgtaaaattcctctctttgtactctttctctttatttcacggccagccaacacttatggaaaatagaaagaacctacgttgaaatattgggggcgggttcccccgatacttaagttaactatacacttgaatgattgttggaactaattttctttcagcgtttgaagatactttaatgtctttaagcttccagtgtttctgttggcatattggtcctgatcctgtgaatataagctgcttccccagctccctcacccacaggacactttttggtatcatctttttacccccagtgctctgaaatttcatgagatgcattgtcacagttctcttcatttatcatgaggggtgctcagtggtcctctcaaaggacactcttgtacttaaattctgggacaaatttatttccttattgtgggaagaacaagaatgtattgtgcctgcaaacagtgcttacaaaatataacatttccaaataatcttttaatactggttagtgttcagtgtataaggtattgataagtcaatat

SEQ ID NO: 156792 - DNA, 601 bp, Human
tccagtgtttctgttggcatattggtcctgatcctgtgaatataagctgcttccccagctccctcacccacaggacactttttggtatcatctttttacccccagtgctctgaaatttcatgagatgcattgtcacagttctcttcatttatcatgaggggtgctcagtggtcctctcaaaggacactcttgtacttaaattctgggacaaatttatttccttattgtgggaagaacaagaatgtattgtgcctgcaaacagtgcttacaaaatataacatttccaaataatcttttaatrctggttagtgttcagtgtataaggtattgataagtcaatatttggattcccttatacaattctagattagagaattttaatttacagattattttttaaaactataaaagtgaggaaaggttgcttttagtgaacttaaggctgatatttattgataaagaatgtttacaaaatattgaatctgtttaactcgtaaactagttaagcaagttattgtttttctggaataggcctttttatgtttagatagtatcaagtttaataaactagtaggtttattcttgaaagctaatttcagga

SEQ ID NO: 156793 - DNA, 601 bp, Human
caatatttggattcccttatacaattctagattagagaattttaatttacagattattttttaaaactataaaagtgaggaaaggttgcttttagtgaacttaaggctgatatttattgataaagaatgtttacaaaatattgaatctgtttaactcgtaaactagttaagcaagttattgtttttctggaataggcctttttatgtttagatagtatcaagtttaataaactagtaggtttattcttgaaagctaatttcaggagacattaatttacttaatttctttcttctctatttrtattgctttgtcctcttgcatgcgtgactgattcttactgtgtgtgctgattaatattggcataggagcagaaaatactactttaagaacaatgtataacctagtccttcagagaagtgaatgtttttaaacaattgtttagttaagtttgagtctagttttgtgaactttttgtctgtttcatctcagttgtaactgtcataactgtacttcttacttgaaatattcattttcaaatgtacgattgtttttggttctaaagtaaaattctggatatgtggtttttgctttatactttta

SEQ ID NO: 156794 - DNA, 601 bp, Human
gttctctctagagagatattgttcttttacacaggaaccagccacatgctttcattttggaatgattggaaatagtgatattgggtgtgaatgtaagctgattccccagctccctcacccacgggacacttttggtgtcatctttttatcccctgtgctctgaaatttcatgaggtcaggtccatatttgaaaaggaaagtcctttttcttttttgtttgttttttgagacagggtctctctctttcagccaggctggagtgcagtggcaccatcttggcttgctgcaacctccgcctccygggttcaactgattcttgtgcctcggccttccaagaagctgggattacaggcatgcatcaccacgcctggctaatttttgtgtttttagtagggaagtggtttcaccatgtcgtccaggctggtcttgaactcctggcctcaagcagtccacctgcctttgctttccaaagcactaggattacaggcgtgagccactgtgtctggccaacatccatattttttaatggcttatgatcacatctctgtaaggcattcatggccctttattttccttctcagagtttttattgaaatataat

SEQ ID NO: 156795 - DNA, 601 bp, Human
tattcaacccctgcctcttctccacaccctagtaaccacagttctaaattcttttgacacctaggtgactacctgttctagaacttactataaatacagtcatatattatgtactctattgtgttcttatgctattttatgaaattatgttttgttgtatatatggattatttgtttcttattaaaatgctgaatagtattcccttatatgaatccaatcatctgtttgttggcaatgtgggtgcttctagtttctagttttagctattacaaataaagttactctgatgataagtggggttttttttgtgaatatttgttttcatttctcttgggtaaataaggagtggaattgctaggtcatatagaaggatatgcttaagtgaagatactgccagttttccaggtctcaatgtgtgagacttctgggtgctccatatccttgccagtgttagggattgttgttctttttaaattttagccattctagatgatgtctattgatagctcattttaattttaatttgcatttatttgatttttttccttgggcttactaaccatcagtatgtcaaaatgaaataaaatatagagatgaatc

SEQ ID NO: 156796 - DNA, 601 bp, Human
gcagcaggttgtttcggaagtgattagataaaactagtttcaggttacagcaggcagtttcagcggccaggctggcagaaaattacattcttggagcaatggtgtgtgcccagagtgctttttcctcttggcttcttgactcagttttatttgggtatgacaagtgacccaattcatatgatcaattttcatactatattttcctttgtaaactgtttgttcaactctgcccatttttttatgggttttttatctttttattattctaaataaaatcctttgtcagatacacacacacaacacacacacacacacacacacacaaatgtagtcttcaagtctttggcttgactgttcattttctctttttttctttctctttccctacaagacaaggcctcccgctgtcacccaggctgaagtgcactgtggtcatggctcactgcagcttacctcctgggctcaagtgatcctcttgccttggcctcccaaagtgctggcatgagtgactgtggttggcctgtttattttcttaatagtgtcttttgatgagcagaagtccaatttgtcagtttttaattttatagttagtgctttctgg

SEQ ID NO: 156797 - DNA, 601 bp, Human
aaactagtttcaggttacagcaggcagtttcagcggccaggctggcagaaaattacattcttggagcaatggtgtgtgcccagagtgctttttcctcttggcttcttgactcagttttatttgggtatgacaagtgacccaattcatatgatcaattttcatactatattttcctttgtaaactgtttgttcaactctgcccatttttttatgggttttttatctttttattattctaaataaaatcctttgtcagatacacacacacaacacacacacacacacacacacacaaatgtaktcttcaagtctttggcttgactgttcattttctctttttttctttctctttccctacaagacaaggcctcccgctgtcacccaggctgaagtgcactgtggtcatggctcactgcagcttacctcctgggctcaagtgatcctcttgccttggcctcccaaagtgctggcatgagtgactgtggttggcctgtttattttcttaatagtgtcttttgatgagcagaagtccaatttgtcagtttttaattttatagttagtgctttctggtaatgtctgggaagtttttaccctctcaaa

SEQ ID NO: 156798 - DNA, 601 bp, Human
cagcttacctcctgggctcaagtgatcctcttgccttggcctcccaaagtgctggcatgagtgactgtggttggcctgtttattttcttaatagtgtcttttgatgagcagaagtccaatttgtcagtttttaattttatagttagtgctttctggtaatgtctgggaagtttttaccctctcaaagccctcaaaaatatgtttttagaagttgtatagtttttagctattaagttttaggtctgtaatttatgatgaattatattttgtacatgatatgacatggagagtggagcttcawtttttttcatatgcttatctagcactatttgttgaaaaagattgtcccctcattgtattcctctggaacctttgttgaaaatcaattaactatacacgtgtgcatttctttttggaatttctatttgttcctccaatctattatctgttcttactgcaacaccttactgtcctgattactgtagctgtttttcttctgtttttgtctatgcttgttggtgtttctgggtttcccagcttctatcattccaagtctatggtgtgagatagaagaaaactctgagaactcaccaccatattc

SEQ ID NO: 156799 - DNA, 601 bp, Human
ctgtaatttatgatgaattatattttgtacatgatatgacatggagagtggagcttcaatttttttcatatgcttatctagcactatttgttgaaaaagattgtcccctcattgtattcctctggaacctttgttgaaaatcaattaactatacacgtgtgcatttctttttggaatttctatttgttcctccaatctattatctgttcttactgcaacaccttactgtcctgattactgtagctgtttttcttctgtttttgtctatgcttgttggtgtttctgggtttcccagcttctrtcattccaagtctatggtgtgagatagaagaaaactctgagaactcaccaccatattcctcctatcctgaggtactgaaccggtctgcctccttctgtctacctttcagagtctttttttgtttcttcttcttcttcttctttttttcttttcaatctgatctgggaattttagttgtacgtaccaggaagaatagggataaataatctttactcaaattttcaataatttacaccaggtatcctcttgcctcagaaataagaatttctgatttttgttgtttgttttcttgcctttgaa

SEQ ID NO: 156800 - DNA, 601 bp, Human
tgcaacaccttactgtcctgattactgtagctgtttttcttctgtttttgtctatgcttgttggtgtttctgggtttcccagcttctatcattccaagtctatggtgtgagatagaagaaaactctgagaactcaccaccatattcctcctatcctgaggtactgaaccggtctgcctccttctgtctacctttcagagtctttttttgtttcttcttcttcttcttctttttttcttttcaatctgatctgggaattttagttgtacgtaccaggaagaatagggataaataatctttaytcaaattttcaataatttacaccaggtatcctcttgcctcagaaataagaatttctgatttttgttgtttgttttcttgcctttgaatatttatacttaaattttattatggaccatttgaaacctctctcttctgcccttttcttcagtgaagtttaggcttgctatagctccccagtggtcaaacaatgtgtcctaatgcaaacatgttgttcttcctttcttactaaaccgtcatgcactcagactctcactccttcatgtctgcctttagtggctccacttatcttcagctctaga

SEQ ID NO: 156801 - DNA, 601 bp, Human
ctgtttttgtctatgcttgttggtgtttctgggtttcccagcttctatcattccaagtctatggtgtgagatagaagaaaactctgagaactcaccaccatattcctcctatcctgaggtactgaaccggtctgcctccttctgtctacctttcagagtctttttttgtttcttcttcttcttcttctttttttcttttcaatctgatctgggaattttagttgtacgtaccaggaagaatagggataaataatctttactcaaattttcaataatttacaccaggtatcctcttgcctcmgaaataagaatttctgatttttgttgtttgttttcttgcctttgaatatttatacttaaattttattatggaccatttgaaacctctctcttctgcccttttcttcagtgaagtttaggcttgctatagctccccagtggtcaaacaatgtgtcctaatgcaaacatgttgttcttcctttcttactaaaccgtcatgcactcagactctcactccttcatgtctgcctttagtggctccacttatcttcagctctagatgaattaacttgtcttagtctgtttagacttctataacaaa

SEQ ID NO: 156802 - DNA, 601 bp, Human
ctaatcccattaatgagaactccaccctcacgacctagtcacctcccaaaggccccccctcctaataccatcaccttggggattaagtttcaatatatgaattttgaggggacacattcagtccatagcacaagtcaataaatatttctttagagtagcttttgtcagataatctattaaatactttatgaacaaaactgtctaattgtctttatcagtctagtatggaaacaaaaataattgtgtaccaggagaacatggaaatgtagtatagtataacttacaaatgttgtaggggtgmatgatcaaaagccacctggcattttgctgctggtattcctgcccttactcctctcttagccccagttttgtcactttctggctttggaattggtaatgactcccacaccaggtctgaactcaacatgacatttagtgtctgagcccaccttatcttttaatgtcttttccattacttcttagcaagaactgcccaggtcaggctggtcttcaccccattctcataataagtcccaaatgttcctgtgtgtctttaaccacactgttcctcctggcataaatgtatttattccctttcttt

SEQ ID NO: 156803 - DNA, 601 bp, Human
attttgaggggacacattcagtccatagcacaagtcaataaatatttctttagagtagcttttgtcagataatctattaaatactttatgaacaaaactgtctaattgtctttatcagtctagtatggaaacaaaaataattgtgtaccaggagaacatggaaatgtagtatagtataacttacaaatgttgtaggggtgaatgatcaaaagccacctggcattttgctgctggtattcctgcccttactcctctcttagccccagttttgtcactttctggctttggaattggtaatgastcccacaccaggtctgaactcaacatgacatttagtgtctgagcccaccttatcttttaatgtcttttccattacttcttagcaagaactgcccaggtcaggctggtcttcaccccattctcataataagtcccaaatgttcctgtgtgtctttaaccacactgttcctcctggcataaatgtatttattccctttctttgtgtgtatacgtgaagggtggttcagtgaaaaaaaagtgttttgagtcaaacagatcccagttttatctcttacttgctatgtgatttagggaaagttat

SEQ ID NO: 156804 - DNA, 601 bp, Human
ctgcccaggtcaggctggtcttcaccccattctcataataagtcccaaatgttcctgtgtgtctttaaccacactgttcctcctggcataaatgtatttattccctttctttgtgtgtatacgtgaagggtggttcagtgaaaaaaaagtgttttgagtcaaacagatcccagttttatctcttacttgctatgtgatttagggaaagttatttaagctctctgagccttactttctctgtttataaacatggaaaaatactgcttttctcacagggttagctaaattaatgtatgtgaamgttccagaagccacaggaactcaaataaattgttgattccctttatttcctgaattagaacttaaggcttagggcaagattcatttcttctaatatttgtctcatcagcagtaaatatgttgagaacagaaaagataccaattagtttattaaataaacatttgactacttactgtgtgccataggtagtgttaaattttggagctcaccattagcaaggtgaacacatgcatatgtaattgaaatacagtatggtaagtgctgtgaagaggtatgttcaggatgttctaggacacagaa

SEQ ID NO: 156805 - DNA, 601 bp, Human
gagaaaaagtgattctgatagtatttcaaatgaatatcataatgacattaaagaggaataagaattaatccaagtaactttcaaacgcagtactttgactgtgtacctaccatcctaaagaagggagaaaatgcaaacaaattttgaactcctcttacatttgtcctttgtagcatctgttgtagtaaaactattttgcatgtattttaggattgattaaatgagggttccttcatttcttttagcataactgcagtacaaaaatatagttattatcaatacatgagctgcatataaaatygcatgcatcgtagaatcagtggtctgtaattatatgaatcattaaatatatcattttaattataaaatttaattatgatgtgaactgttcatatgtagttataaagtcgtctttgtaacttatttatagttgtttagtcataaagcaaaatagtaagattttatgttggggagcagtcaaaatgaagcactttagaatgatgagtggttttttttttttaaggaattccatattctactttgagaactctacctctgattttcatttgatttattttttgaatactcgaagatcccagtg

SEQ ID NO: 156806 - DNA, 601 bp, Human
gagcagtcaaaatgaagcactttagaatgatgagtggttttttttttttaaggaattccatattctactttgagaactctacctctgattttcatttgatttattttttgaatactcgaagatcccagtgctttcaaccctgagaactgaaatgtgtgatgcatggaatatatctcgagacaataaaatgaaagagttttttacaagggggtttgtggagaaaatatttttgatttgtaaatgctgtggtgtttttgttccttggtgttaggtgactctgctaatgttttttctcttggtrcaggtgtaatggataggtaacagagaagacctcgtcccttcctagtcagggcatcagcatgactgagtgcttcctgccccccaccagcagccccagtgaacaccgcagggtggagcatggcagcgggcttacccggacccccagctctgaagagatcagccctactaagtttcctggattgtaccgcactggcgagccctcacctccccatgacatcctccatgagcctcctgatgtagtgtctgatgatgagaaagatcatgggaagaaaaaagggaaatttaagaaaaaggaaaagag

SEQ ID NO: 156807 - DNA, 601 bp, Human; identical to SEQ ID NO: 35245

SEQ ID NO: 156808 - DNA, 601 bp, Human; identical to SEQ ID NO: 35246

SEQ ID NO: 156809 - DNA, 601 bp, Human; identical to SEQ ID NO: 35247

SEQ ID NO: 156810 - DNA, 601 bp, Human; identical to SEQ ID NO: 35248

SEQ ID NO: 156811 - DNA, 601 bp, Human; identical to SEQ ID NO: 35249

SEQ ID NO: 156812 - DNA, 601 bp, Human; identical to SEQ ID NO: 35250

SEQ ID NO: 156813 - DNA, 601 bp, Human; identical to SEQ ID NO: 35251

SEQ ID NO: 156814 - DNA, 601 bp, Human; identical to SEQ ID NO: 35252

SEQ ID NO: 156815 - DNA, 601 bp, Human; identical to SEQ ID NO: 35253

SEQ ID NO: 156816 - DNA, 601 bp, Human; identical to SEQ ID NO: 35254

SEQ ID NO: 156817 - DNA, 601 bp, Human; identical to SEQ ID NO: 35255

SEQ ID NO: 156818 - DNA, 601 bp, Human; identical to SEQ ID NO: 35256

SEQ ID NO: 156819 - DNA, 601 bp, Human; identical to SEQ ID NO: 35257

SEQ ID NO: 156820 - DNA, 601 bp, Human; identical to SEQ ID NO: 35258

SEQ ID NO: 156821 - DNA, 601 bp, Human; identical to SEQ ID NO: 35259

SEQ ID NO: 156822 - DNA, 601 bp, Human; identical to SEQ ID NO: 35260

SEQ ID NO: 156823 - DNA, 601 bp, Human; identical to SEQ ID NO: 35261

SEQ ID NO: 156824 - DNA, 601 bp, Human; identical to SEQ ID NO: 35262

SEQ ID NO: 156825 - DNA, 601 bp, Human; identical to SEQ ID NO: 35263

SEQ ID NO: 156826 - DNA, 601 bp, Human; identical to SEQ ID NO: 35264

SEQ ID NO: 156827 - DNA, 601 bp, Human; identical to SEQ ID NO: 35265

SEQ ID NO: 156828 - DNA, 601 bp, Human; identical to SEQ ID NO: 35266

SEQ ID NO: 156829 - DNA, 601 bp, Human; identical to SEQ ID NO: 35267

SEQ ID NO: 156830 - DNA, 601 bp, Human; identical to SEQ ID NO: 35268

SEQ ID NO: 156831 - DNA, 601 bp, Human; identical to SEQ ID NO: 35269

SEQ ID NO: 156832 - DNA, 601 bp, Human; identical to SEQ ID NO: 35270

SEQ ID NO: 156833 - DNA, 601 bp, Human; identical to SEQ ID NO: 35271

SEQ ID NO: 156834 - DNA, 601 bp, Human; identical to SEQ ID NO: 35272

SEQ ID NO: 156835 - DNA, 601 bp, Human; identical to SEQ ID NO: 35273

SEQ ID NO: 156836 - DNA, 601 bp, Human; identical to SEQ ID NO: 35274

SEQ ID NO: 156837 - DNA, 601 bp, Human; identical to SEQ ID NO: 35275

SEQ ID NO: 156838 - DNA, 601 bp, Human
caatacaaacctgcttaactcttttgtcttttctatcgtgacccaaattattttctgaggcttagaaaagtacatataagacgaaaaattcctttctaaatatcaattccgtcgccatcaggaaatgtcagaaactttgtctttttaaaaataaaagcgtcaactctttaaaaacttcagtacctcaaaggaaagctgcactgttaacactgaaggagggctgggtgatttctgaacatccgcattaaagaaatatgctctccaaacctagtaattcctgcggaggccacaccttctaaccttctcgtaatccactaatcaaatcgggagcatctgaaaactgctaccagccaaagtaaaatgacaggtatgtcatcctcaaacaatccaaaaccgggtcggggagcccagacggctagccggggcccaggctgacccccgggcgctcctggaagagcgactctaaggaaacacacctcccgcgcgagcctcttccttcctagagtgacgggggaaggggacaccaggggcagaaacacacccaaaccccacttcaaatcctgccccaccgcttctccttccaaaacagccgcgccactgc

SEQ ID NO: 156839 - DNA, 601 bp, Human
tgcagccgggcgcagtggctcacgcctgtaatcccagcactttgggaggccaaggcaggtggatcacctgaggtcgggagttcgagaccagcctgatcaacatggagaaaccccgtctctactaaaagtacaaaattagccaggcgtggtggcacacgcctgtaatcccagttacttgggaggctgaggcaggagaatcacttgaacccgggaggcagaggttgcggtgagccgagatcgcgccattttgcactccagcctgggcaacaagagtgaaactccatctcaaaaaaaaaaaaaatttagttgcgagcattggcagcatctttaagtaccttcattctgtaaggttcaacatcagtgtttccttctctgctcttcttttaagcttcccttgctcttttctcataacagcaaacataatcataatcatcgctgtttaccaggaattgttccaagtgcttcagaggcactaactcatgtacagccttgaacaactctatgaagtaggtaatatttcttatgcctacttacaaatgacaaaactgaggcatagggaggttaagtgagttgcccaagtctgcccaaaaagacactgcta

SEQ ID NO: 156840 - DNA, 601 bp, Human
tacatagagaaaaacaaaagaatgataggagacttttccatctaaaatacaagccagaagacattaacatctttcaagtacataaagaaaaatacctacaactccatacctaagaaacaagacatctttcaaatatgaagctgaaataaagatttttttcagccacacaaaaactgacatcatcaacagcagacatgcactataggaaataataaagcaaaccattccagcaaaaggaaaattacaccagatgagaatctggatctatacaaaagaataaaggacatcagaaacaattaayatggggccaggcacagtggctcacgcctgtaatcttatcactttgagaggccgaggcggatggatcacttgagctcaggagttcaagatcagcctgggcaatatagtaaaaccttgcctctaaaaaaaaatacaaaaattagctgggcatggtggcgtgcacctgcagtcccagctacttaaggggctgaggcaggaagactgcttgaacctgggaggtcaaagctgcagtgacctgagatggcaccactgcaccccagtctggaagacaaagcaagaccctgtctccagaaaaagaaag

SEQ ID NO: 156841 - DNA, 601 bp, Human
ctttcaggcagccggagaaaaactcatgttacatagagaaaaacaaaagaatgataggagacttttccatctaaaatacaagccagaagacattaacatctttcaagtacataaagaaaaatacctacaactccatacctaagaaacaagacatctttcaaatatgaagctgaaataaagatttttttcagccacacaaaaactgacatcatcaacagcagacatgcactataggaaataataaagcaaaccattccagcaaaaggaaaattacaccagatgagaatctggatctatacaraagaataaaggacatcagaaacaattaacatggggccaggcacagtggctcacgcctgtaatcttatcactttgagaggccgaggcggatggatcacttgagctcaggagttcaagatcagcctgggcaatatagtaaaaccttgcctctaaaaaaaaatacaaaaattagctgggcatggtggcgtgcacctgcagtcccagctacttaaggggctgaggcaggaagactgcttgaacctgggaggtcaaagctgcagtgacctgagatggcaccactgcaccccagtctggaagacaa

SEQ ID NO: 156842 - DNA, 601 bp, Human
ctatcaatctacagacagattcaaggggttcaatgaaacccatgagcaagaaacatgaagaaaagtataccaaggcacaatataatcaaattgcttaaagctagtgataaaaactttcaggcagccggagaaaaactcatgttacatagagaaaaacaaaagaatgataggagacttttccatctaaaatacaagccagaagacattaacatctttcaagtacataaagaaaaatacctacaactccatacctaagaaacaagacatctttcaaatatgaagctgaaataaagatttttttcagccacacaaaaactgacatcatcaacagcagacatgcactataggaaataataaagcaaaccattccagcaaaaggaaaattacaccagatgagaatctggatctatacaaaagaataaaggacatcagaaacaattaacatggggccaggcacagtggctcacgcctgtaatcttatcactttgagaggccgaggcggatggatcacttgagctcaggagttcaagatcagcctgggcaatatagtaaaaccttgcctctaaaaaaaaatacaaaaattagctgggcatggtggcgt

SEQ ID NO: 156843 - DNA, 601 bp, Human
ataaagattatttattttgttctgttcctaatgtttaaaagaagacagagttgcacatggttatataatgaaagtaaacagtcaacaaataaatataaattgaagttttagcaataagaaaatattactgatggaaacaccatggggttggaaaggatgcgatccagaggtaaatcagggcctttcccaaagccctaagagctttccaagaaatttttattattatttcctggcacttcctattctatcccctgcattacttgatttactttctcaatagtgcctgtcaacatctggtacrtattagttgttttacttatagtctgtctctctagagtaagttattggctccatgaggacagaaatttttatcccatacactgcttcatctccaggatatttccaggcacaaagtaagcatttaagtatttttgaaacaaataaatctgttcatcactcacaatgagattttgtcgttgctcctttagctcttaagagagaaaaagaaaaccacctaagaaactcctcccaaatgttgctatatgagagacagaaaagattcatcatttcctgatgaactgttattgctgttagggcattt

SEQ ID NO: 156844 - DNA, 601 bp, Human
tccagacgaatttatcacttttctaatttaccatgagaattactactatccgaactcaggaaccagatgtgaatcacaacagatactactctatactaattcatgccctatcatggccttcaagtaatcagaatatttgcaaaccatgtcaaaaaaaaacccagaaacttcctattacatttgactttatgatatgcgtaatgacttaacaatctgtatattcttctgataaccatcactgatgtcatatatcctgggaaatgtacttgcctgaccatccttcccacaaagaccatacctktcagagcaggagcaaagtattattttatttccactgtgcttacacagtgcctagaaaagtgttcaatacctactgaaggggttcaagtgtttcttcgttcagtccagggtttttaaaattttaactgcactgataaaataaccatttcagttttccactttgacataataatttacaattatgtattttttcgtattgtgtgcagaaggtacactttcctttgtaagcctttatgtccctttctagccctgattgtatttcaaatttaatgatttgtggcaactttaacagaaagcagcc

SEQ ID NO: 156845 - DNA, 601 bp, Human
gttatacaactttgtgaacatattaaatgccactaacactaaaatgattttatgtcatgtaaggttcacttcagtaaaaacattactgaaaaagtaaatttattattaactggtaactgagtatctaaaaataatagattcaagaaattcttcaagggaaagagactagagagatcatctaattcatcccattactgatgatccagaagcactaaatatagtgtgattattaaaaaatatcaacaaagacgcaaccatattattttaggcttaaggagtgaactcttactatccaaatagrtatgaataaatttccagacgaatttatcacttttctaatttaccatgagaattactactatccgaactcaggaaccagatgtgaatcacaacagatactactctatactaattcatgccctatcatggccttcaagtaatcagaatatttgcaaaccatgtcaaaaaaaaacccagaaacttcctattacatttgactttatgatatgcgtaatgacttaacaatctgtatattcttctgataaccatcactgatgtcatatatcctgggaaatgtacttgcctgaccatccttcccaca

SEQ ID NO: 156846 - DNA, 601 bp, Human
tcttactactacttcatcattttgcctggtaattttaaaagcaaaacaaacaaacaaacaaaaacctacattttcccaatttaaaaaattggtgactgttcaaagggaaaactatccccaggaaagatctagatttagcatatctgtattgctaagaaaaaattcagtcctcgccttgcaaagcaccctgtgaactaaagctcatacatatcagaaccatgtcctggttttgcaaagcttcagttccagggaaagcatgaacacagttctgatataggcatgtttcagttaacacaatagsaggcaaagtgaggattaactttatttgaaaactggccctctatttagatacattgttcccacagttaatacagaaagaaatgggatagcctgttgtcatttatcaattgtatcaattgctagactgtacaaacaggacaaaataaagaagtaaaagagatacagattgcaaagaaagaaaattctctctattcaaatacgacatggttgtctacacagaaaatcagaaggaatctacaaagaagccaccagaataagtatgtttaggaaggttgtaggctataaattagaatataaaaat

SEQ ID NO: 156847 - DNA, 601 bp, Human
tcactgatcaaattaataaaaagtgctgataatttggtccgtcggatttcttgacatgttgcacatgaaaccgccatgaagcattcagcacaagcctttcggactccccatacattatcagaacaaagctggaaaaatctgggcagctatgtgaaaaggaaagagtcttgttagttggataaagatagcagatttcatcagttacttcgctttcattttctgctttcacgcttcttttgtttgtttgtttgttttgagacagagtctcactcttttgcccaggctggagtgaggtggtgcratcttggctcactgcaaactccacctcctgggttccagcaattctcctgcctcagcctcccaagtagctgggattacagacgtgtgccaccacgcccagctaatttttgtatttttagtagaaatgagggttcaccatgttggccaggctggtctcgaactcctgacctcaggtgatccacctgccttggcctcccaaagtgctaggattacaggtgtgagccaccacgcccagcctcagtgttttaaatgttggattgtcttaaaaagtaggatctattagtatttatactcaacaatt

SEQ ID NO: 156848 - DNA, 601 bp, Human
cactaagcccctgtcataccagggtggctgtgggcagacccaaagctgtacctcctggagtggggaaatagtcttcactcaagcattccagccagtcactaaacaagcaaataacagtaacaagcccccatgggggagcgaggacaaccagtatcaaactacacatattatctaaaatgttcaactctcaacaaaacattacaaggcaggcaaaaaaaaaaaaatccatacattagggggataaaagagacaggcaacagaaactgattgtgagagcaatcagatttcagacttaaaaaaagacttcaaagtagctattataaacatgttcacagaaccaaaggaaatgatgattacagaagtaatgggagttatggggacggtgctgcatcaactagagtataacatcaataaagagaaattacaaaaaagaaccagatggaattctacagctgaaaagtgcaatgactaaaataaagtcagtacatgagctcaacagtagatctgaactggcagaacaaataattgttctattgaagatagatcaatagagattatgcaagccaaagaatagagagggggaaaaaattgaggaaaaatg

SEQ ID NO: 156849 - DNA, 601 bp, Human
gatacaggatataacaaaaacattaatataatatcaaggcttaagagtcttgccctctatgtcaattttgttttgggaatgaatatgcaaaggtcctgagattgatctctgccatgacggtgtgaggagctcagctgacccacttctcagtgaagtaagtgaaaattataaaacaataattcaaagcccctggaaatggccctaggagcaagcagcaattgaagggataacaattaaagaaaactgacaaaatgtagtatacatcataaaaaagctgagagtctaattttttttttttttttgagacagagtctcgctctattgcccaggctggagtgcaatggcgcgatctcggctcactgcaagctccgcctcccaggttcacgccattctcctgcctcagcctcctgagtagctgggactacaggcgcccgccaccacacccggctaattttttgtatttgttagtagagacggggtttcaccgtgttagccaggatggtcttgatctcctgacctcgtgatccacccgtctcggcctcccaaagtgctgggattacaggtgcgagccaccgcgcccagctgaccattccctccttgt

SEQ ID NO: 156850 - DNA, 601 bp, Human
atacagttctctgcaaatttatagtttcttactagacccatttcagattttaaaacagaagttatgtaacagtcttcagtataaacaggtaattttttaagtatgctgatttcaaaaatgaaaaatagataacattccccacccaccatcatcacttttgtcaaagtcctggcagcacctgttttcaaaaaaactgacagactttgcttgctaggaagacaggtttgagtgattttcttcctttacaaaaaacagtacctcaggtttgtttggctattcagcaggacagtaggagaacggrcaaaaaggtaaaacaaggcagcagagaagaaagaagaactgccaaatcaaaacaccaagaaagcaaatagcacagtatcaagacctacagaagaaaatgtccattagcatcatgacaagggagggaaaagacactatggtaactcaagcattatagcagggactgtttcaaatatttgtactaaaattacttcaagtgcataactgtaaaagtttgtgtacatttcccgcatactagtaagttaggcttgaattagtttttcccctaaatatatattataataaatttttaaaatttaaa

SEQ ID NO: 156851 - DNA, 601 bp, Human
ataactccttccttagccaggaatgctctctttcccctaccatatcattaacataatttaataagctctaatattactgaagatcagcaatacaagtagtattgcctggacattaagacatacctcattacaatggaagaagaatcaaggaattgaactacctttaaatagctattgcagtaatgctacacaccggtaggcggcaaacatggccttgataggcacactgttgaggtcagtgaagttttactggaacacagccaagcttgtccatttatgtaatgtctacggctgcttatayactgcaaaggccgagtgagtagttgtgaaacagaagaaagtttaccagctcgtcctatacagttctctgcaaatttatagtttcttactagacccatttcagattttaaaacagaagttatgtaacagtcttcagtataaacaggtaattttttaagtatgctgatttcaaaaatgaaaaatagataacattccccacccaccatcatcacttttgtcaaagtcctggcagcacctgttttcaaaaaaactgacagactttgcttgctaggaagacaggtttgagtgattttcttccttt

SEQ ID NO: 156852 - DNA, 601 bp, Human
ttaaaaaaactgatgaaagatattacatatagcatttagacaagttaaacattaaaaattacggattatctgtacaaactgagtttatgtatattatttataatgcttctttctccatcagctgttctgtgttcaaagatgtaaatacctgttaagtataagtctagatagtcaagcaatatatattagttagagaaggtaacatttaagaatcctgggattctataacaccatgctaatttcaataataaataactaaagaaaagtagtggaaacagaaattcctacaatcattttaagwtacataacaacatttaaattattttatttttagggttatttgtattacctctctactccaacgacatattgcaaagctgagacctaaagcctatttgcttacattacacaaggaaaataaaataaaaacaattttaagatagtagtaggaaagatacttatttgctatctcacaaaatatattaaaatctgcttgagtgtaaatattacttctgtttcttctaaaatattcatctctactccccaaggttttcctaaaatgaggacataatttaattgataaggacagatggtacaaatt

SEQ ID NO: 156853 - DNA, 601 bp, Human
gagtggctgggactacaggagtgtgcaatcatgcccagctactattcaaaatctttttagagatgggggtcttgctatgttgcccaaactggtctcaaactcttggccttaagctatccttctgcctcagcctcccaggtagctgagattacaggtgcaagccactgcacctgtggttttatgcactggaaaaccacaaatttgtgtgactctattgcaatatttgctcttttgcagtggtttggaactgaaccagcagtatctccaaggtatgctgttatttgtattgaagtctctcaaytgcagctagtaaatttacagtacaaagagtattagatatcttctgaaacacaaagtcacatcaagaaacttgtatgtatgtacatgtaagtctttttagaaagcaatctatgcatatttctttgcatttatttgctgaaagaaaaacttagagcagttctttcaatatttcaattaatatttaagtgactagtctatgtcagagaactagcaggtactataatacaatgagagctcccagaaccggcttaaggacaactggtaatcttttgttcataaaaatatagtttaagaaaaataa

SEQ ID NO: 156854 - DNA, 601 bp, Human
gaagactgactctaatttttaaagatgtctcctgcaggtaatatgccaacaaacaccattgctagctatggatacatctttcatgaaaggaagagtcaactgacacagcaagcttccacgctgttttattttcagaaattgccacagccaccccagccttcagcaaccactgccctgaccagtcagcatccaccaacattgaagcaagaccctccaccagcaatgagactacaacttgtgtaaagctcagatgatcatcagcattttttagtattttttcaatgaaggtatgtgcattttyttttagacaaaatgctatcacatgcttactacagtatagtataaacacaacttttataaaattctgagactgggtcttactctctcacccaggctggagtgtagtagtgcaatcatagctactgaaaccttaaactcctaggctcaattctcccacctcagcctttagagtggctgggactacaggagtgtgcaatcatgcccagctactattcaaaatctttttagagatgggggtcttgctatgttgcccaaactggtctcaaactcttggccttaagctatccttctgcctcagcct

SEQ ID NO: 156855 - DNA, 601 bp, Human
attaaagggagtatggaagaaggtaatttcaaccctcataaatgactgaaggattcaagacttcagtggaggaagtaactgtaggtagggtaaaaatagcaggagaactaaaattaggagtggagcttgaaaacgtgagtgaaatgctacaatctcataatcaaacgttttctgttgttttaattttagagatggggtcttgttatgttgtccaggctggagtatagtggttatatgtaggcacaatcataaccactacagccttgaactcctggtctcaagcaatcctcctgtcctcagytgggattacaggcacatggtcactatatccggctctcctgaccaaacttgaacaaatgcctcttaggatgagcaaagaaagtggtttctcaagatggaatctcctcctagtgatgatgctgtgaacattgttgaaatgacaacaaaagatctagaatattacataaacctattgataaagcagtggtggtgtttgagaagactgactctaatttttaaagatgtctcctgcaggtaatatgccaacaaacaccattgctagctatggatacatctttcatgaaaggaagagtcaactgac

SEQ ID NO: 156856 - DNA, 601 bp, Human
tcctttcaaattattactgctcactgacaatacacctggtcacccaagagctctgatagaggcgtatgaggagacaatgttgttttcatacctgctaacacaatacccattctgcagcccaaggatcaaggggtaatttcaactttcaagtcttattatttcaggaatacattctgtaaagttatagctgccataaatagtgatttctctgatggatctggacaaagtaaactgaaaaccttctggaaaggattcaccactctagatgccattaggagcattcacgattcatgggaggagrtcaaaatatccacattaaagggagtatggaagaaggtaatttcaaccctcataaatgactgaaggattcaagacttcagtggaggaagtaactgtaggtagggtaaaaatagcaggagaactaaaattaggagtggagcttgaaaacgtgagtgaaatgctacaatctcataatcaaacgttttctgttgttttaattttagagatggggtcttgttatgttgtccaggctggagtatagtggttatatgtaggcacaatcataaccactacagccttgaactcctggtctcaagcaatc

SEQ ID NO: 156857 - DNA, 601 bp, Human
aaagtttgagtggtctggacagaaatcaaaccagccacaacgttctcttaagccgaagtctaactcagagcaaggccctaactggcttcaattctgtaaaggctgagagaggttaggaatctgagaagaaaagctgaaagctagcagaggttggttcatgaggtttaaggaatggagccatctccataacatagaagtgcaaggtgaagcagccagtgcttaggtaaagctgcagcaagttattcagaagatctagctaagattacttaagccactaaggtagctacaccaaacaacaaawttttttttttttgagatggagtcttgctctgtcacccaggctggaatacagtggtgcaatcttggctcactgcaacccctgcatcccgggttctagcaattctcctgccccagcctccctagcagctagaattacaggcatggaccatcatgcccagttaatttttgtattattagtagagacagggtttcaccatgttggccaggctggtctcaaactcctgacctcagatgatccacccacctcggcctcccaaagttctgggattacaggcgtgagccacctcgcccggcccagatt

SEQ ID NO: 156858 - DNA, 601 bp, Human
acagacacacaagcaacatacaggatgaggttctagtctattaggtcattacttgctaacttaagaaaattgaacatattcactcacaaaaagttgtagtggaatattttcattatcttcagaatttcggctgcaattttcaccaacccttttaatcacttcagccactcccttttgggatcactcccaagccaaaccaaaacagtactcaaaatagactgtacaagaaagaaaggttaaaatgttttgtcccatataaagtgcatggtgtgtgtgtgtgtgtgtgtgtgtgtgtgtgtgtgtgggtatcatcccccatccattctgttccctggaaagtgcaggcatactttgttttattgcactttgtagatactacactttggcttttttttttttctttaaagaggtgaggtcccactattttgcccaagttggagttacttgcagaaagctattcacaaggcatgatcatagctcactgaagcactgaacccctgggctcaagcaatccttctgcctcagcctcctgagtggctgggactacaggcacacaccaccatgctgggcgtgataactgtactttttctaaactaaaggt

SEQ ID NO: 156859 - DNA, 601 bp, Human
tcctcatgtttttaaaagcttataaacatacctaagaacctaccctactttaaatctaacttgctgaataggttgtcaagtgtacgaaaaccaattccagaaaaattagagtaattaaaaacaatatttgaaagtaattttgaaatggtccaaacagctcaaattagcttatttatgaaatagtactgagaggattcttttggtccattgttttagagaccatggagtgtcatatgcagtttttcttctatttctattcttggctgttaatatctaatttcacaaattatatatatgttamcagccaaaaacagtaacaacaacaacaacataaacaccttctaaaatgcagatatattaatactattcaaatctccaataaatagtcagggcttcaatccaaagcagtggtattatacagatttctaactataccacatgccatccaacagaaatcaaaacagaaatgcactaaagctctaagaaccctcctgccatccccagtgtgtgcaggtactctttcctgagcttctcattcaagccactatgatctgtgaccatgcgattctggcaatcggtggtgcattccttctccccattt

SEQ ID NO: 156860 - DNA, 601 bp, Human
agtaaataaagtaaaaattggctagatgtggcggtgcacatctgtagtcccagctacttggggggctgaggcagaaggatcgaatgcttgagcccaggagttcgaggctgcagtgagctgtgatctcgccactgcactccagcctgggtgacagagcggagaccccatctctaacaacaataacaaaataaatataccatttgatctgggaaatctacttctaacaataataatataatcctaaggctgggcacggtagctcatgcctgtaatcacagcattttgggaggctgaggtgggyggatcacttgaggtcaggagttcatgaccagcctggccaacacggcgaaacactgtctctactaaaaacacaaaaaattagctgggcatggtggctcgcaactgtagtcccagctacttgggaggctgaggcaggagaactgcttgaacccaggaggcggaggctgcagtaagctgagatggtgccactgcactctagcctgggtgacagagtgagactccatctctaataataataataataataataataataataataataataataaagtcatagaagcaaacaacacgtacagac

SEQ ID NO: 156861 - DNA, 601 bp, Human
gaggaaaagaagaacatatttgcaatcttgcttaggtgtgtataatatagctgtggaaggatataaaagaaaggtaaaactggttgtatctcaggaagcaaaatggatgagtggagaagaaaaaactgagaagggaacatcactgaatgccttttaagtatcttgaattttgagctacataaacgaattatccatatacacaaaatgaaaatggaaataaactcattaaaatgagatttgaaatactgaaaatgtctgtaagtggggaaaagcatgtttcaaaacactattgttttgaatrctgatttcatttttagtaaataaagtaaaaattggctagatgtggcggtgcacatctgtagtcccagctacttggggggctgaggcagaaggatcgaatgcttgagcccaggagttcgaggctgcagtgagctgtgatctcgccactgcactccagcctgggtgacagagcggagaccccatctctaacaacaataacaaaataaatataccatttgatctgggaaatctacttctaacaataataatataatcctaaggctgggcacggtagctcatgcctgtaatcacagcattttgg

SEQ ID NO: 156862 - DNA, 601 bp, Human
ttgaaagtatggagttataacttatataaatatatatgaaattatatctattgtaatttatataagcaaatgtatatatacagcatatatatatgtatgtacatgtgtataaatatcttcatatgtatcttaatcttaaagtttctactacaactcttttgattattacaattgaaaactattactttaaaaaagtaattgctgggaggccaaggcaggcagatcatgaggtcaggagttcaagacaagcctggccaacatggtgaaactgcgtctctactaaagatacaaaaaaaaaaaattagccaggtgtggtggcgcatgcctgtaatcccagctacttggaaggctgaggcaggagaatcacttcaacccgggaggcagacgttgcagtgagcagagatcacgccattgcactccagcctgggtgacagggtgagactccatctcaaaaaaaggttgttgcattgggatacttgacatcttctacacaagctatttagatccacatctacataaaaataggaattaatttttagtcctggaataagaatatatgctaatatactatctggtactattttgctataaatagagctca

SEQ ID NO: 156863 - DNA, 601 bp, Human
acatattctcttccttctccagaaaatggtgtcatcagtcatgtcactgggcagattcatccactggcttattcctactgtaagagtggatatgctcagagcttttcaaacactattagaagggttaatagagaaaaatggttgtttgcaacaaaagcaatagatgttttaacatttgaaagcaatgacaaagtaaagaaggttgaatatgtctacagaaaaatctttaacagtaggtgcaattctgatgaaaagagcagatcatccatcacataaaaattgccttgcacatgtgaaggayaatcataagctgtagaagaggaaaagtgattggctaagtggggagaaacactagagagtattactaaaatatcagatgcctcttagccaaatgttaattaagaagaagcctagaattttaccagaatttaaaggctgggggtgaaaatgttgctgacaaactttctattgcagacctcagatagttcagtaggttcaaatccatttgagtctacacagggtcaaagggaacagagtgttaacatattagcccctgagaagttctctgcagacattggcagggataaatacctgtctatag

SEQ ID NO: 156864 - DNA, 601 bp, Human
aacaggatctttcaaactctcaatatgaatacattagaatattcagccaacataaaacagactttataaaaatgtgcttacaacagacaataacctcattatgttctcctcataaaatccaacactataatgtgagaataaatcattccttccatccttatggtgttatttttgtcttgcccaaacctgggaacttatatgaaagtacattttctaaaggaacataagaattgatatataaaagcatttccttttaaaaagccatgcaaataataattccaaccaaattctctttcctctmataaaaggttttgtttgggatttgtttttgttttctttcatagcttcttcttaaaaagcactaccattaaaggcaaggtcgactttgcttaccacaagttacaaatgactgaattggtaacccaatatctgagaagtcatttgctgttataaatctattatcagtgcttcagaagagtaagaggataatgccttattaggacttggccacaacagggtagagtttcaaacttcttgaactctgtatatgcacaggggaaaaatgtgatggtgttgtagcctataaatacattgtcagctc

SEQ ID NO: 156865 - DNA, 601 bp, Human
gatttcagaatgcctgatcataatcagaaagagaaattttggggacttcagttattacagatggctccagggttaatggatgtatgtgagtgtgtgtgtttataaatggagaagctttaccaactttatatgcacaggctaacatgttattggattgaagtagaagatacaagcaagaaagggtgactaattaagtaagtgactgaaaaaacaggtgtaagtgagacctaacacaaggaatctagctttgggaagatcattctacttctgtgaaagaggagaaaaaatagagctgaggctsataaggacattttagatttctggggaggaagttgaagattttaagtttttattagattttcccaataaagtcataggcaaattcgtctattgagtgtatggggagaaatgatgaagtatgaggttgaatgagagaagtgaaatgtaccaaatataccaaatggaatggaagataatgggctaaaacaatgccagctggataaggtagaggccccaactgagatggaagaccactcactggtttgtaaaagcaagaatctgcaagttgttgtgggactatcttccaccacagcagcctgga

SEQ ID NO: 156866 - DNA, 601 bp, Human
acaaacactatcccccaatacagcttccatttatgcttttccctactgcctggaatgctctttcttgggttctacaaaagcatggcttctctcttttcaggaacaggttacaatgtcttctaaccactgtttaaataggtccttccctaatatatttttgtttctgaactctcatagtattggcattttgtaattagttattcatttttttatgtattacctgtcctactgactacattctaagctgctttaggacaagcaatttgtctctctttatttattattggacatccagtgttgcgcaaatattaggttcttaataaatattaattaaatgaacaaatcagtgaatgaggaaaaaagccaataataataatatagtattaataactaccacatattaaatgcttatagatgtcaagacctattgcacatgttttacatgtattaatcttttaatctccccaacagccctatgagctaggaactattactatcctggttcagtgatgagtttactaagataaagagaagttaagtaatatgccaaaggacccatagctagcagagccagaatttgaatgcaggaagtctgattcca

SEQ ID NO: 156867 - DNA, 601 bp, Human
gacaaacactatcccccaatacagcttccatttatgcttttccctactgcctggaatgctctttcttgggttctacaaaagcatggcttctctcttttcaggaacaggttacaatgtcttctaaccactgtttaaataggtccttccctaatatatttttgtttctgaactctcatagtattggcattttgtaattagttattcatttttttatgtattacctgtcctactgactacattctaagctgctttaggacaagcaatttgtctctctttatttattattggacatccagtgtttggcaaatattaggttcttaataaatattaattaaatgaacaaatcagtgaatgaggaaaaaagccaataataataatatagtattaataactaccacatattaaatgcttatagatgtcaagacctattgcacatgttttacatgtattaatcttttaatctccccaacagccctatgagctaggaactattactatcctggttcagtgatgagtttactaagataaagagaagttaagtaatatgccaaaggacccatagctagcagagccagaatttgaatgcaggaagtctgattcc

SEQ ID NO: 156868 - DNA, 601 bp, Human
aagtcactcaggatgaagaattagatttagaaggacagaatgttaagtaaaggacttgaggagcatcaatatccaaggggtaagagagactaaaagaatctcaaaaaagtattacacaaggaaagtcaagacagaacaccatcacaaagctaatgtaggatagagtttcaagaaaaaagtggttaacaaaatcaaatgcctcagggatgagggaagagaaggagcagaagatatccccagcagactgagaaataactgggtcactggcaagcctcaggagaattagttcagggacttggcragaacagaaatcagcctgcagggattggaggaactttgtgaactgtcagtgaggagacctcagggctcagactaggcaccttcttctctctctccacattcttcccatagaggatctcatcagtgctcatggttttaaataccagctatatgctaatgactcccaaatttgcatttctgttccctatctctgtgtgaggatggaagctcacatgcagtgacttgaacagtgaattgggggtgccacaggtacagcactaagcacctcctcctccctctattcactttccatgtgaatgac

SEQ ID NO: 156869 - DNA, 601 bp, Human
gacttctgattgatttatacaccacgatgaagggaaaggaagattcacatattatgcattcagatgaaatgggaaatagtgaagaagatggcaccaaaataaggaatagaagtgaaagcaaaatgttgaaggaaagaagaagaattcagcattgggcttaatgaaatgagagcctgtggaacatgtaaggggaaggtctagttcacagctaagatgtgcagatttagagacacaaacgtggtggccagtttagaagccactgcatcagggttttagataaagtcactcaggatgaagaatyagatttagaaggacagaatgttaagtaaaggacttgaggagcatcaatatccaaggggtaagagagactaaaagaatctcaaaaaagtattacacaaggaaagtcaagacagaacaccatcacaaagctaatgtaggatagagtttcaagaaaaaagtggttaacaaaatcaaatgcctcagggatgagggaagagaaggagcagaagatatccccagcagactgagaaataactgggtcactggcaagcctcaggagaattagttcagggacttggcgagaacagaaatcagcctgcag

SEQ ID NO: 156870 - DNA, 601 bp, Human
gtttgtggtaattttgttacagcagcaatagaaaactaatatatacttatatatcattatcaatattatatttataatataattataaattattagaattatataattctgagttttattttctcattcttatagcacctgaaattttgctgatggtttctatcaaacacgtttcctggaaatgctggtgccatggtatttccccatcataactgaagtaacttgaggaaaattctgacaaaggtcagtttcctaaatctaatgcctttaatcaatccctcaatgttattaaatgctctartagtagaagttataaaggaaaaaagttctctctttttctccctttctttctcagcatgatctgaagaaagtgtagatgagaacaaattacaatagaaaagaaagcagaagctatccataaggaagtacaagcactaccctaagctttgttcttacagccccgatgacacacttgaggcttttagtaggataataatgtgatcaattagcatttcagaaatatccctcaggcaataatataaagggggagttattgaaagaccttactgggtaaaaggacgaaaaaaagaaaaaagaagat

SEQ ID NO: 156871 - DNA, 601 bp, Human
cctcattactaggggaaaaaaatgtgttctatataaacaaacaaatatgaatcaactgacctcactttctggtagaaaaatcatttggagttgctttccaaatataggtggaacttgacatagtcactcattactttttgttgtgtcttgtgtttcactttgttttgtaatcaccatatgctgcaagatctaggttcttcatacagtacaggacaatgttacaattgaaatctaccatcagaaaatattaactttagatgagtgttttatttcttttaggtgctttcttccactttagtcyctagattatgtaataaatatacactgaacagacccagccttcttctccaggagaaattttagtttcttgagatcatctttactgttatcttaatgtttgatttcctgaaaaacctctaattccctttcacaagaaagaagaatgaaaaaggagagagggagcaggaggcagaaaataatattattttcagcttggcttatcctgcataaatatcatgattatgctattttttgagagataattttaagaaatgaataagtgcatataaaatgttggaaagaactaaaatgacacaaaatt

SEQ ID NO: 156872 - DNA, 601 bp, Human
atgaagtcatttttatcataataaaatgtcatgattagaactgcagtattctagtctaaccattttctaaagaatatgattggggcattttaggtagttaaatattaaaataatctaattgaaaatgagacttttagattattcattttgattgacaaactgcagaaaatgggtttctttcctaagtacatttctatcactcaattttggtagataaaaccagtatttctgagtaaaaggtaaaatataccttgtctttgttttacttaactaataaatgcaattattcttgaatttttgkgttttaaatgcacctgttattttggcatctacatcaatcaaattcctcaagtactgtgcttctgtgtaggaaaggtgttcagttacatggttgtcatagctgcattttccccttgtaactaaacaacaatgttctttggaattaaagaagcacacttttgatttaaattatttatagttataaaaagaacattaaaatggaggagcaattcattgagaagactgatcacaggacctcatggactaactgaaagcttcagaatgcaaaacaatagccacagtcatgaggtgagcattccag

SEQ ID NO: 156873 - DNA, 601 bp, Human
aaatctacatgctgtaaaatagatctaaagccataaatgggaacatctgggataaaaacccaaaacttactatagtgtttgccatctcttataaaattctgttgcaaatacagtatatttattgttgtattatatcctaatgctggatatggaatatcaatgtattctcagcctattcagatattaaaaaatgaattcattggctagaaaatatagttgaatttataacaaagaaacttatacattttcataagaataaaaggattataaagatttatttctggaaaaaaaaaaaaaaaaacccaaacaattcaaatggtcttatactatcttaggctggaaaactttttatatccttattttatgggttgatatatgatcatcaattaatgaagtcatttttatcataataaaatgtcatgattagaactgcagtattctagtctaaccattttctaaagaatatgattggggcattttaggtagttaaatattaaaataatctaattgaaaatgagacttttagattattcattttgattgacaaactgcagaaaatgggtttctttcctaagtacatttctatcactcaattttggta

SEQ ID NO: 156874 - DNA, 601 bp, Human
atgactgtaagctccctgcagcctcagccaaagcaggtgctggcactatgcttcttgtaggatctgcagaaccatgagccaaaataaacctctttcttcgtaaatgacccagccttaggtattcctttatagaaatgcaaattggactcacacataactgtatttaaataagttaatattacagtttatatgctttttagaagcttaaggccctctacaattcaatagtttcctgtaaaggtggaaatgtacaagttaattacttcaattagattcagtaaaatttctttaaatttctatkcaaaaaagttcatctgattgcattagagtttaaacattaatatttattaagaaggcttttataaagcaaaagacattttgcttcagaaatcaacaattgtgtttagatgatgttttacacttcacagttacttttaagttaaaacaaagctctcatgtcatgcttaaatgtactgttttccatcctcagtatagtgaccttttgatatcattttcattatgaagttgtgaatgttctttcaaggatgcagagaataaaggagaaacaagactgatttctttaaaaggtcatatttcaaat

SEQ ID NO: 156875 - DNA, 601 bp, Human
atataagaggaaatctattttggggggcttatgaaactactacctcctaggtaccaactcataaaagccacatgacatttgttaatgttctgcagtaaagattaataactcatttcttcaaatctttctttcctcacagcagtctgtggatatgatatacccataaatctcatcttgactaaaacttaaattatacagtcgagcttgtctgattgagatataactactgaactaaagtagagcccggttcatcaaaagttttacttaggtttctgaataactgtcagcatatttcagctgygtattatataatccaaagctatttaatggataataatataaaatgtgattgtaacatattccttcagtcccaatcatttgaatttggataattccagtggtgtgtctttgagaaaagatccacacttaaaagactaaaaagacatgagtattattaagcagagtttttctaattcaatggtgttctagcagtaaaattcttgcacttgacgaacacttgaatttggtctataaagtctaagcttcccttacaatttcatctacctccatttatacatgcattgatttgtttataatagtt

SEQ ID NO: 156876 - DNA, 601 bp, Human
atttaatgagagtttgtgctttgttaaaaccagtcccaagggaaagtgattcctctccagaaagcagggctgtgacctatatgtcaccacccacctggagaccacttatctaaactgagggcaaagaacctgggaggagataaatccgcttcttgggtactggccttttgaaactcaaaactaaaaagtgatggcaaacatcagacaggcaattatctcaataacaagattttttatcactgttattataatagccaatcaaattaccaaagcaaacatgggtgcctacctaataagcctrtttaaaccatcagcaagaatacgaacagaaatatttacaggcagaattagatttattctaagtaattacctggtgatagtaaataaaaacatatacaacatcaccaaatacatacacacatgcatgcacataggcacatatacatatcaaaaagcaagaccattccattcattataatatgacagcccttatttaattttgttaatttcatactaagcttgaatttaataaatgaactaaaactctgagcttcacaagtgaataataggtaactattaattatgttcttggtatcagagg

SEQ ID NO: 156877 - DNA, 601 bp, Human
ttttaaaatattatctttctatacagaaagcatacaataatggtaaaagccctcagctaattctttcaacattcactcagcaaacatttaatgagagtttgtgctttgttaaaaccagtcccaagggaaagtgattcctctccagaaagcagggctgtgacctatatgtcaccacccacctggagaccacttatctaaactgagggcaaagaacctgggaggagataaatccgcttcttgggtactggccttttgaaactcaaaactaaaaagtgatggcaaacatcagacaggcaattayctcaataacaagattttttatcactgttattataatagccaatcaaattaccaaagcaaacatgggtgcctacctaataagcctgtttaaaccatcagcaagaatacgaacagaaatatttacaggcagaattagatttattctaagtaattacctggtgatagtaaataaaaacatatacaacatcaccaaatacatacacacatgcatgcacataggcacatatacatatcaaaaagcaagaccattccattcattataatatgacagcccttatttaattttgttaatttcatacta

SEQ ID NO: 156878 - DNA, 601 bp, Human
cataactaatgaggagctgaatgttaatcaccaagacgatggggaaaatgtttccagggcatgacagagaccttggaagcagcctctactatcacaagctcagaggtttctgaggaaaaaatggtttcctgggccagtcccagggtccccatgctgtatgcaacctagaaatttggtgtcctgtgtcccagctgctccagctgtgactaaaaggggccaaggtacagctagggctgttgcttcagagggcggaagccccaagccttggcagcttccatgaggtgttgagcctacggtgcasagaagtcaagaattgaggtttgggaacctccacctcaatttcagaggatgtatggaaatgcctgaatgcccaggcagaagtttgctgcagggacagggccctcatagagaacctctgctagggcagtacagaagggaaatgtggggtcagagcctccgcacagagtccctactggaccactgcttagtggagctgtgagaagagggccaccatcttccaaaccccagaatggtagatccaccaacagcttgcaccatgcacctggaaaagcttcagacactcaacaccagcccatgaaag

SEQ ID NO: 156879 - DNA, 601 bp, Human
atctcatcttgaattcccacacttcgtgggagggacctggtgggaggtaactgaatcatgggggcaggtctttcctatgctgttctcatgatagtgagtaagtctcatgagacctgacggtttcataagggggagtttccctgcacaagttctgttctcttgtctgctgccatgtgagacatgcctttcaccttccactatgattgtgaggcctccccagccatgtgaaactgtaagttgattaaacctctttcttttgtaaattgcccagtctgaggtatgtctttatcagcagcatgawaatggactaatacagtgaactggtaccagtaaagtggggcactgctgaaaagatacccaaaaatgtggaagcgactttggaactgggtgacaggtataggtggaacagtttggagggctcagaagaagacaggaaaatgtgggaaagtttggaacttcctagagacttgttgaatggctttgatgaaaagcctgagaatgatatgaacaataaggtccaggatgaggtggtctcagagggagatgaggaacttgttgggaactggagcaaaggcaactcttactatgttttagcaaagag

SEQ ID NO: 156880 - DNA, 601 bp, Human
tctgctcaattttgctatgaatctaaaacttccctaaaaaatacagtccaatattaaaataatgcttagatccattaaccaaagaaccaggggcagtatgcttattgagtaaaccaaaatttttaagaaaaattagaatcacacaaattcatgcaagtacaatgaagagaatagttggtaaggaagagaaaaagccatctcctggttggaaaaaaaaaaaacataatcatagggagatcagtattactgatatgatttggctgtgtccccacccaaatctcatcttgaattcccacacttygtgggagggacctggtgggaggtaactgaatcatgggggcaggtctttcctatgctgttctcatgatagtgagtaagtctcatgagacctgacggtttcataagggggagtttccctgcacaagttctgttctcttgtctgctgccatgtgagacatgcctttcaccttccactatgattgtgaggcctccccagccatgtgaaactgtaagttgattaaacctctttcttttgtaaattgcccagtctgaggtatgtctttatcagcagcatgaaaatggactaatacagtgaactggt

SEQ ID NO: 156881 - DNA, 601 bp, Human
gctgcaatgaaaacagtgcttagagaaaaattaatggcattttatgtacatgttaaaagaaaaatctaaaattaacctgagcttccaacttaggaaacaagaaaaagaagaacaaatcaaatccagagtaagtagaagaaaaggaataataacaattaaagaagaaatcaataaagttgaaaacaggaaatcaataaagaaagttaactaaacctaaatatgattttttgaaaagatcaataaaattaataagcctctagctaactaagaaagttaactaaaaatgagggaggacacaaaytattatcaaaaataaaagaataaatatctatacagatcctatgaacatgaaaggggtaataagtgaatactacgaacaactctatgttcagtataatgaggaatacatatccttatgcatttgtccaaacccatagaatgtacaatgccaagagtgacctctaatgtaaactatggtctttgggtgatagtgaagtgtcaatgtaggttcgtcaatattcacaaatgaaccactctggtgaaggttattgataaaagagaagggtaggcatgtgtcaggcagggtatatgtggaaaatct

SEQ ID NO: 156882 - DNA, 601 bp, Human
aaaaaagagtggaagacaaagataggagcaagaacaagggtaacaaatagaaaatagtaacacatagaatagatattaatccaaatatattaataaccacttttaacatcaatggacatcaatggtttaaatgcatcaactaaaagacagataacaagaaatctactttagatgaaatgacacatatataaattaaaagtagggctaggccaggccagcacccttcagcctcacactcctctctcacattaccatttttaaactttaaatttaaaaaaaaaattaaataattaaaagtaartggatgggaaaagatttattatgctaacagtaatcaaggaaaagcaagaattactatgttaactttagacagagcaggcctcacagcaaggtaagtgattagggataaagagggccattagatgatttaaaaaaagatcaatattctaaaaaacataacaatccttaatatttatatgcccaaaaacagaaggtcaaaacacatgatccaaaaacacagggaacggcaaggagatagaaatgagtccactattacaggtggatacttcagtacacttctgccagaaatgattgaatccga

SEQ ID NO: 156883 - DNA, 601 bp, Human
attaaaaccacaaaaggcgaaaaaagagtggaagacaaagataggagcaagaacaagggtaacaaatagaaaatagtaacacatagaatagatattaatccaaatatattaataaccacttttaacatcaatggacatcaatggtttaaatgcatcaactaaaagacagataacaagaaatctactttagatgaaatgacacatatataaattaaaagtagggctaggccaggccagcacccttcagcctcacactcctctctcacattaccatttttaaactttaaatttaaaaaaaaaattaaataattaaaagtaagtggatgggaaaagatttattatgctaacagtaatcaaggaaaagcaagaattactatgttaactttagacagagcaggcctcacagcaaggtaagtgattagggataaagagggccattagatgatttaaaaaaagatcaatattctaaaaaacataacaatccttaatatttatatgcccaaaaacagaaggtcaaaacacatgatccaaaaacacagggaacggcaaggagatagaaatgagtccactattacaggtggatacttcagtacacttctgc

SEQ ID NO: 156884 - DNA, 601 bp, Human
gttaagaagcttctgcacagcaaaggaaacaatcaacaaagtgaagagacaacccattgaatgggagaaaatatttgcaaactagtcatctgacatgggattaataaacagaatatataaggagctcaaacactctatagaaaaaaatctaataatccaattaaaaatgggcaaatagtccaaatagacatttctcaaaagaagacaaacaggtatataaaaaggtgctcaaaagaagacatacaaaaaggtatataaaaaggtgctcaacatcactgatcatcagagaaatgcaaatccmaaactacaatgagacataatctcaccctagttaaaatggcttttaatccaaaagacaggtaataacaaatgctggtgagaatgtggagaaaaaagaacccttgtaccctcttcgtgggaatgtaagttagtacaaccactatggagaaaagtttggaggcttttcaaccaactaaaaatagagtcaccatatgatccagcaaccccctgcaaggtatatacccaaaagaaaggaaatcagtatatcaaagagatatctgcactcccatgtttactgcagcactaatcacactagctaaga

SEQ ID NO: 156885 - DNA, 601 bp, Human
acaataggttataagatggtatttgcaagcctcgtggtaactcaaatgaaaaaacattcagcagatacacaaaaaagaaaaagcaagaaattaaaacataccaccagagaaaactaccttctctaaaaagaagacagaaataaaggaaagaaggaagagaagaccacataacaaacagaaaaaaataacaaaatgcaagagtactttcttccttattaataataacattgaatgtaaatggactaaactctccaatcaaaaaaacatagaatggctgaatggataagtaaaaaaaaacacrcaacaatctgtagtctataagaaacacacattagctataaagatacacatagaatgaaaagaaagggattgaaaaagatattccatgcaaatggaaaccaaaaatagcaacagtcattatactaataatagataaagtagatttcaagaaaaaaggtgtaagaagagacaaagaaggtcattatataatgataacgtagccaatcagtaagaagatataacaattataaatatatatgtgccccaaaactggagcatccagatatataaaacaaatattattagcgctaagagagagaga

SEQ ID NO: 156886 - DNA, 601 bp, Human
atacatggtcagaggggacaaaaggaaaaagaataaaaaagaattaagcatgcctacaggatccacaaaataacctccagagggaaaatctaagagttattggccttaaagaggaggtagaggaagagagagggatagaaaatttattcaaatgggtaataacacagaacttcccaagcctagagaaagatatcaatattcaagcacaagaaggtactaaaacaccaaatagatctaactcaaagaaggctaccttaagacatttaataatcaaacaccaaaggtcaagaataaagaaagratcctaaaatgagaaaaacaaaattttatgcagtcagtggtaagttgtcatcaacttacctatttaaacaataggttataagatggtatttgcaagcctcgtggtaactcaaatgaaaaaacattcagcagatacacaaaaaagaaaaagcaagaaattaaaacataccaccagagaaaactaccttctctaaaaagaagacagaaataaaggaaagaaggaagagaagaccacataacaaacagaaaaaaataacaaaatgcaagagtactttcttccttattaataataacattgaat

SEQ ID NO: 156887 - DNA, 601 bp, Human
tcctttgtagggacatggatgaagctggaaaccatcattctgagcaaactatttcaaggacagaaaaccaaacaccacatgttctcactcataagtgggaattgaacaatgagaacacttggacacagggtggggaacatcacacactggggcctgtcatggggtggggaggggggagggatagcattaggagatatacctaatgtaaatgatgagttaatgggtgccgcacaccaacatggcacatgtatacatatgtaacaaacctgcacattgtgcacatgtaccctagaacttaaaktatattaaaaaaaacaaaaataaaataataaggcatttgactatgtatgcatatatatatacacacatatatatatgcttacgtatgcttatataataattaaaattaatgacagcaattatacaagtggcaagagggagaaattaggaatattatttggttgttacaagatatttcccagaggagatggggaagatggccgaatagaaacctccagcaatcatcctccatgcaggaacaacaaattgaacaactagccacacataaaaacaccttcataataaccaaaaatcaggtgag

SEQ ID NO: 156888 - DNA, 601 bp, Human
agagaggaattaaatacttaagggattgagggggaaaaaacccaccaacctagaattctgtaggttgtgaaatttcccttaaaaggtaaaggagaaataaagacttttgtagacaagcaaatattgaggaaatttgttttcagtagccctgccttacaagaaatgcttttaaaaattcctaggagggaaagaaaataatgtaggtcaaaaagtcagacctacatagagagacaaagagcatcagaaacagaataaattaaggtaaaataaaattgcttattttcttattcttcattgatckacattaatgtatttaaaataataaggcaatcatgggaggaggttccaagatggccaaataggagcagctccagtctacaactcccagcgtgagtgatgcagaagacaggtgatttctgcatttccaactgaggtaccacgttcatctcactggggcttgtcagacagtgggtgcagcccacggagtgtgagccaaagaagggcggggcatcgcctcacccgggaagcataaggggtcggggaattctctttcctagccaagggaagccatgacagacagtacctggaaaatcaggacact

SEQ ID NO: 156889 - DNA, 601 bp, Human
aaagatgtaacatgtgcacagtgggaaaacccaagggaagagaaagggagaaagaaacagaaacaatatttaaagcaataatgactgagaatttcttcaattaatataatgtaccaaaccacagatccaggaagctcagagaacaccaagcagaacaaatgccaaatgaaaacaaaacaagaacaaaaaacaatctatacctgggcataatatatttgaagtacagaaaatcaaagataaagaaaaaaactctggaaaaaaaatctagaagaaaaagcaccctacccatacagaagcaaarataaaaattacatctgactcttccttacaaaccatgcaagcaagaagagaggaattaaatacttaagggattgagggggaaaaaacccaccaacctagaattctgtaggttgtgaaatttcccttaaaaggtaaaggagaaataaagacttttgtagacaagcaaatattgaggaaatttgttttcagtagccctgccttacaagaaatgcttttaaaaattcctaggagggaaagaaaataatgtaggtcaaaaagtcagacctacatagagagacaaagagcatcagaaacagaataa

SEQ ID NO: 156890 - DNA, 601 bp, Human
acatggtttgaagaagcagaataagcattataaccagactcagatatggcatggaagttaaaattatcagaccaggatgaattttttaaaaactatgattaatatgctaatagataaagtagccatcatgcaagagcagatgggcaatgcaaacagagtgatagaaattccaagaaaaaaaacaaaaaggaatacaaaaatcaaaaacactgtagagaaatgaagaatgcttttgatgagtttattaatacactgaagatgactgagaaaaggatctctgagattaaggatttcacaacargaaactacagaactgaaaagcaaaaagaaaaagcttaaaaacaaaaaaagaaacaaaaaagaatatctaagaactgtgggacaatgacaaaagatgtaacatgtgcacagtgggaaaacccaagggaagagaaagggagaaagaaacagaaacaatatttaaagcaataatgactgagaatttcttcaattaatataatgtaccaaaccacagatccaggaagctcagagaacaccaagcagaacaaatgccaaatgaaaacaaaacaagaacaaaaaacaatctatacctgggcataat

SEQ ID NO: 156891 - DNA, 601 bp, Human
tatatatataaacatataaacacatataaaaatgaaagaatgagtcattagagtaaatcttgggaatccactagaagaccatataaaccataatcaggatatcaaagtatttgctaggaggtcagagcagctacagattgtgatttgtttcattgaattctcaaagagataagaccatcaaaatgaagagaaattttttggtttttaaaacaataagtaaatcatatctttagaactcaaaattatgtttcaatattatcctaacatgctgctattgcaaattaacctatatagagaataytttcctttacccaaaaccttcccaccacattactaacagcttatttataagtttcttttacatccagtacatcctgcctatcaaaaaaaattacaagacatactaaaaggctaaaaaacatggtttgaagaagcagaataagcattataaccagactcagatatggcatggaagttaaaattatcagaccaggatgaattttttaaaaactatgattaatatgctaatagataaagtagccatcatgcaagagcagatgggcaatgcaaacagagtgatagaaattccaagaaaaaaaac

SEQ ID NO: 156892 - DNA, 601 bp, Human
agaagagtataaaaacttggtgtagcatggaaagattcaataaaatgtgattatactgttccctagaaaaaaaatctctgactttactaaccatgaactaatatcagaacaacgggataactcactgtaaaacaccagtttaactatgtaccactaattttaaaataccttaaaaattgcctaggttataaagacataaaattatcttgtgaatttctctaactggatgtgccaatattttgtgggataaagtaaatgaaattataggttgccattgttcatttgttcacttattcaagamacagtgtttgagtatcaagcatgtgtgggcactaagtggtacactgaaggtagaaggcagattaacacagtgtctgccctcaaatagtatacagcatagtcacaatctagacagggtagtaaaaaatgagttcttcatgggcaaggactgtatttatcttgctggctgctcaactgctatgcttcttgtacatagcccagagaatgacagacagcaggcacacaaaaatgtgtttatatgtgctcatataaacacatataaaatgtgttttatatatatataaacatataaacacatata

SEQ ID NO: 156893 - DNA, 601 bp, Human
ataacacatgcaatgaaattaaaaagaagtggttttaaaaaaacatattgaaagagaaagtgattttaagtcagctgttggaaggagagatagtactacacagcaggcaaaggaaagaacatctcaaatattctcagcaaactattgcaaggacaaaaaaatagacaccacatgttctcactcataggtgggaactgaacaatgagaacacttggacacacaagtgtgtgatgaaggggaacatcacacaccagggcctgttgtggggtggggggaggggggagggatagcattaggagawatacctaatgtaaatgacgagttaatgggtgcagcacaccaacatggcacatgtatacatatgtaacaaacctgcacgttgtgcacatgtaccctagaacttaaagtataataagtatatataaaaaaaacataaaaagaaaatctcaaatagaaaagatccagatgaaacaagacaagaagttgtgagacagtcacaaatgttactcatgcaaaagaagtcacagatacttttctcaaagcaagaataccatctcctcttcaggccactctatacagagtcagaataaaatatagtatg

SEQ ID NO: 156894 - DNA, 601 bp, Human
tgttcacaatgcaaagcaaaagctccataacacatgcaatgaaattaaaaagaagtggttttaaaaaaacatattgaaagagaaagtgattttaagtcagctgttggaaggagagatagtactacacagcaggcaaaggaaagaacatctcaaatattctcagcaaactattgcaaggacaaaaaaatagacaccacatgttctcactcataggtgggaactgaacaatgagaacacttggacacacaagtgtgtgatgaaggggaacatcacacaccagggcctgttgtggggtggggggaggggggagggatagcattaggagaaatacctaatgtaaatgacgagttaatgggtgcagcacaccaacatggcacatgtatacatatgtaacaaacctgcacgttgtgcacatgtaccctagaacttaaagtataataagtatatataaaaaaaacataaaaagaaaatctcaaatagaaaagatccagatgaaacaagacaagaagttgtgagacagtcacaaatgttactcatgcaaaagaagtcacagatacttttctcaaagcaagaataccatctcctcttcaggccactctat

SEQ ID NO: 156895 - DNA, 601 bp, Human
gcactatatagatgaagccactaaaatttagagagtttaaatggcatacctattaccattcagctagtgagagaaagaagtggaatacagagcctgtcttcctcagcagtacaatatcggttcctgagcaaataactgaaatgttcacaatgcaaagcaaaagctccataacacatgcaatgaaattaaaaagaagtggttttaaaaaaacatattgaaagagaaagtgattttaagtcagctgttggaaggagagatagtactacacagcaggcaaaggaaagaacatctcaaatattcycagcaaactattgcaaggacaaaaaaatagacaccacatgttctcactcataggtgggaactgaacaatgagaacacttggacacacaagtgtgtgatgaaggggaacatcacacaccagggcctgttgtggggtggggggaggggggagggatagcattaggagaaatacctaatgtaaatgacgagttaatgggtgcagcacaccaacatggcacatgtatacatatgtaacaaacctgcacgttgtgcacatgtaccctagaacttaaagtataataagtatatataaaaaaaacat

SEQ ID NO: 156896 - DNA, 601 bp, Human
actttcaaaattttacaccttcagtctagttatcatagttaatattgtactatcatttgtgtaaggacaactttaagcatttcaaatctgccctttaaaagcctgtgaacgtagttttgcctggcagtagtctttatatttactgtgctattctgtggcttctaatacatttttctcaagtggcctatatataaaccgatttaatatttccctcatgttaaacaatagtaaagattgctgtacagtgcttatttttccttttatttcagttacacaaactactccttaaatcccttaacaygcattagcccagataaatagcctctacaaagtattttgcatttaaattagctggtttggggtacaatattgtagtagttactttagtttaattctgttatgctgacatttttagcattattttaattgtactagcataaaataatttttcagtcatataaaaaagattaagattggtaataaagattacacatattactaattatattgctatgagctttaaagctgtaaaataacatttcattaaaatgccagtggtaatttttttagggtagctatttatattatcctactgttctaa

SEQ ID NO: 156897 - DNA, 601 bp, Human
ttaactactgataaatatttcaactaaatttatcagaaaacatttacaattagggctaaatcttctaaacacataccactattagtgtctattttaattcacattaatacatatttgaagtgcatattaaacaagaatttttataatttattatgcataggaatttatatgcatatagttaataaatagagaataattaattaaaagcacatttcttttgttacatttgcaatcagaatgtttactgtaaaatgttgacttcaattactttaatagaggttttttcaaaaactgatgatayatttttataaccagccattagacatacatgccattgtgcattgtcatcttctttcccaatagctagtaacttggtgagtgggttttctgtgaggccagcatcactgtccagagttgtgtgtgcatgctgcacaagaggcccaccacttggcactgcaggttgtgaccatttaagagttggattgatgatctgatgatcaagggtcatgaaagagtttactttctgtctctgggctttctgtagctgaggccttgcagaactttccaggtgtgctgggacctacaagatcaaaattaaaca

SEQ ID NO: 156898 - DNA, 601 bp, Human
ttgggagatacttttgtatacataatttaaaatatgatggtttaaaaaaatagaaaaaaattgtctatagccattgttcgttcacattgccccaaggccagagcaattcttgggactttcaacccttctgagccatgagattatttgattgagagcacccaaagaccactaaaaacatgtgaattttctttatatatacaaacttaggataaaagcaaaggtaagatgtgtgcttaaagaataaaaaaagtaaataaaaggcagaaagctgatctatgttgcttttccattctcattttttagagtacatattttataaaatatataataaaatcatttctagattttacctagaattaactggcatatgcatatccttcaagatttgtttttctctttagaaatcaacctttcacacaagaaaatgaactttgggagaagtagttgtaggataaactgtactgtgtgtagatctaacatttactgaacagattatttcatctgatatatatttttacaatcttcatagactgaatagagaaactgattctacattcattttttaggaaagttttttatatatccactactgtaaagtttg

SEQ ID NO: 156899 - DNA, 601 bp, Human
gaaaaaaaaaacaaaaaaaaacaaaagatggcaacagacaccatctcctgagctcccactctgcccttgtgttaaaaatttaaaattcaagcatcaaaacaactctacaatgtgtacacacatgggtgagagaaattaaggactgaaaccacacagctatactatactgactatatccaaagactatacactttctgccttgagtcagactccaagaaccagtaaaagtattagactattgcgacaacacagggtatatcctagctatcaaagatagtaagtctgtgaatgatggcagtaygtgaaaatgtataaacataccaaattcaaagagaccacacactgattaaaactattacagactcagtaaaactgtgattaaatggacattaatgatggttgggagatacttttgtatacataatttaaaatatgatggtttaaaaaaatagaaaaaaattgtctatagccattgttcgttcacattgccccaaggccagagcaattcttgggactttcaacccttctgagccatgagattatttgattgagagcacccaaagaccactaaaaacatgtgaattttctttatatatacaaa

SEQ ID NO: 156900 - DNA, 601 bp, Human
cctaatgcagatctaattgatacagtcccccactaccttggaatcatgttctaagttcccagatctgcatttaagtcctgtagccccaccctaatcctcctttctaacctcagtcacttatttgtaccaaattgtatcactctcaaacccacttatgcttgtctactctgcccttagcttacagcattctctactcaaaaaaattatcttccgtcatctttgctgttgatgtatatgtctttcaacacccaactcaagtattaccacttccagaatttcctgagacctcacattgaaaaartttatcttctgagtttctagaataccttgatttcacttttctaatggttcttctcaaattataccatattacttaaagtatcactgtactaataacagcaagtagagaaatattattgaaataagggtactcattattaacttataaatttgccaaaaatatgcactgattattaattggcagaaattcatcttaggagctagatattaaaatgtgaataaggtattgtattttcatcaagcaattaacagactaaaagataagaaaaagaaaaaaggcataattaaaatgtagcatgtg

SEQ ID NO: 156901 - DNA, 601 bp, Human
tttaaaaatggagataataggggctgggcatggtggctcatccctgcaatcccagcactttgggaggccaaggcaggtgaatcacttgaggtcaggagttcaagaccaccctggccaatacggcgaaactccgtctctactaaaaatacaaaaattagctgggcgtggtggcttgtgcctgtagtcccagctacctgggaggctgaggcacgacaatctcttgaacccaggtggtggaagttacagtgagccaagattgtgccactgcactccagcctgggcaacagagggagacttgtckccaaacaaaaacaaaacaaaacaaaaaaaacaaaaaaaaacaaaaacaaaaaaaggagataatagtaaaccatagtgctgtttaaaaaattaatttaaaataccacctgacataaagactaaatgaatactctcttatttttgttgttaatatcactgttaatattctatgttgttaataattataagacataattgcataagattatatgagataatataagattattatgggagaaaaatttgtaactctcatttagttaaatcatgggaagttattttctcttgcatgttcctaatg

SEQ ID NO: 156902 - DNA, 601 bp, Human
ctcattcaagatttcaaagaccatccgtatgctgacaacctcaaatctcttcctccagtccagcagatttggatatctagctgtcaccaacatctccacgtgatgatctcactgataccacagttcaacatgttttaagggagagtctcactttctcacacccacaatagaaatagactcccagctgttccctatccctgactccagacttctccctctatatagctgacaaagtgatctagagtcaaatctgattatgttaccctaggtcccaagtttcaaccctacagtgacttgataytgtttaacatggagtactagcctctctgtaatttgctgattacttacttctttgatgtcatcttttaccaccatctgccttcttttctattcatttcacactgcttcccatctctattctgcgctcatgctatcccatctggctaaatgccctactagtcattttcctctaagtctttttatataatattataattatttgttaattttttctcttgccctcaacctgaagctcctatatggtatagattatataggatgtgcagtttgttccctgagcatgtggcaatgacagctgtct

SEQ ID NO: 156903 - DNA, 601 bp, Human
gaaaggtgggtgacaacaaggagatgagaccatactaaggtagatttttacttaagagtatgtcatatataatgttaaacaaggatatagatgtagaaaaaaaataatgatgactcttaaaatattagaagtaacaaacagaaaagaagataaaaactgaccaatggaagatagaaaaaagagggcaaagaaacggaaagcatagtaacttaaaacataagaaattgtaactgttaaatcctaatagtaaagtaagtacaagaatataaatgagttaacatactgattgagaaactctctyttgaattggatttttaaaaggttttgtaatattttgtctataagagacacacttaaaagtaaacaacagaaaaagctgaaacaaggttaaaaaaggtatcataaatataaccaaaaggaaatccacagtagtggtattcatattaagcaatataaaattcaaggttaaaatctaaaggaaaaataataccaagtgatcatgaacacgtatacacctaaaaatatatacaactgtcagaattctgtggaaaagtacatcaacacttgcagttgaatattttaactcagcactctctaaatc

SEQ ID NO: 156904 - DNA, 601 bp, Human
gacataagattaacatgggaaagggtcatccttgggaaaacaataagaaacacctaaagtaggaacaagttcaacatgtttgagaaagaatgagcactaatgggaatagagcagagtgcgcaaaggcaagagcagttagagatgaagtggaaaagtatgcaagaaactgacatcacagaatcctcaaggccagtggtatccagtagaaatttctgcaatgatgggaatgtcctacatctgaaatgaccaatgtattaatagtaataactaaccacatgccctcatatgactactaaatacrtgaaatgtggttagtgtaactgcgaaaatgaaattttaatttcatttaatttttttaaatgttactgaatttggccgggtgcagtggctcacacctgcaatcccagcactttgggagcctgaggcatgcagatcacttgaggtcaggagttctagaccagcctggccaacatgatgaaaccctgtctctactgaaaaatacaaaaattagccaggcgtggtggtgtgtgcctgtagtcccagctacttgggaggctgaggtgggagaatcatgtgaaccccggaggcagagtctacagtg

SEQ ID NO: 156905 - DNA, 601 bp, Human
gtaccaggcatgcttctaagtgctttacatacatcattcatttaatacttataatcactcaatgaaatgagtactttgctatatagaaaaggaaactgagagaaaaaaattcaataatttgtcccagattatatagtgagtgagtggtggaggaaggactgacatcctagaaatttggctctatagtccaaatcttattggctttctatttcctttctcagttcttttctaaaatagaaactttccttcccttctgtactttagctaggggagatttttaaagtttatatgtttaaaaaaatggttgcttctctctctctctctttctctctctctgctctagctctctttgcttccatcatattccatttagttaaatttttaaatgtgatataaactcaaatatattgtgaatgttttatttatataactacagtactgtgaatttcccatgatatatgcagatacagtcaggagtacactctaatagatatggaaaaatattttataattctattgatgttatcttcaaagcaagatatctaggaacttaagagaattgagtgttcggagaattctactaagatactccaaaaaatat

SEQ ID NO: 156906 - DNA, 601 bp, Human
tgtctttccttttgggtgtttattaatgtagatgcaataaacaaggtctttatagtttcaggacacacaccattaatattcctctaaatttgttttctttgctactaaagcagaggtatacagtttaaatgacatgcactgaatagagaaatcccactgtgttattgctgttattatttttgtcctattatgacacatgtaaatataatgtgttgagctggaataggagatcccctgtccttggtgagctggtttataatatagtggcagattatctggaaatacaatatgtgactatatmcaataatagaagagataaaatataaaacaaagaatgataatttataaatacttttgcatcatgcatattatatacatatgacctatttagtaataaataaaaacaattaatttaatgtaaacactgcaacaattagtttgaaaccctcatcttttgattaaaaagtaataataaacaggagtttgaatattttttactaaatatactgttataattttttactatagtccagagcactaaaaataatcttgtaagtaagcatgcttgtcaatacagcagaatatattttatgcgtttcaa

SEQ ID NO: 156907 - DNA, 601 bp, Human
aaaaaagtcttatatatagtcacatattatatttccagataatttattagtagagataacaaaagaaaaaaataccttatatatatgtgtctgtgcactatgatatatttaatatgagtgtcaagggaaactgaggcagtattttgagttgtttggatcctatattgtgtttttttgtgaaaacattcattgtgaccctaagatggtaaaagattagatagaataattgtagacataaaaggaaaataaacttcatgtataaagaggatcactgtaggagagcctagagtgcacaatgcaygcaaaaaattggcgtttgaaagattattgtctttccttttgggtgtttattaatgtagatgcaataaacaaggtctttatagtttcaggacacacaccattaatattcctctaaatttgttttctttgctactaaagcagaggtatacagtttaaatgacatgcactgaatagagaaatcccactgtgttattgctgttattatttttgtcctattatgacacatgtaaatataatgtgttgagctggaataggagatcccctgtccttggtgagctggtttataatatagtggcagatt

SEQ ID NO: 156908 - DNA, 601 bp, Human
accacggtaatagcttcttaaagggaatttttcctacctcttcaggcttagatattctgattctgttcatcaaatttgttactcttaatctcctactctactactgtgtaaagatgctgatttaattacatgtagaatgattctatacaaaattgtgaaacactgtttaccatatatccttatcctctaaatggaatgcttgtgggtcaaagtttccattacacatttgcttactgttaggataaggaatcgtgtgcatttgtctcacattttatcaaaatagcacccttttttttctttyttttttagttgaagttactaatgtctccaaattgcaattttaagtctggaagaaaagacagtgaaacttttattcaaattcagtgcattggcaacatatttttgagacaatacatgttttcataaccctagaaaaatatagctttgtctttgtttaaaatcagtgctgctctataagaaaataatatctgggtccaaaattattgtagaaacatctaagtaaaattaacctctgaaaatgttcatatatccatctattcttatcaggacaaatacaggacaacataaataacctgacctg

SEQ ID NO: 156909 - DNA, 601 bp, Human
tcctttatatatacaaagttaaaaacaactaagaaaaacaagttgatcatgttttcttagcccaatgcatggtagactagcaaaggagaaagaacagataaggccattgttgtcaagtgtggtaacaactgtagaaatgacagtaacaatttcacaatgctgccagattttctttttaaatgcctaactggagttttctgtatagttttaaattaattaagttttaactgacgttgatatgaaagtaattctacacataaggtatgtgtttcataaacttttttggataagatcagtaaayagtttgacataatatttcttacctacaaaaattctaccacggtaatagcttcttaaagggaatttttcctacctcttcaggcttagatattctgattctgttcatcaaatttgttactcttaatctcctactctactactgtgtaaagatgctgatttaattacatgtagaatgattctatacaaaattgtgaaacactgtttaccatatatccttatcctctaaatggaatgcttgtgggtcaaagtttccattacacatttgcttactgttaggataaggaatcgtgtgcatttgtct

SEQ ID NO: 156910 - DNA, 601 bp, Human
ctgcacccataaacttgtcatttacattaggtatttctcctaatgctatccctcccccagtccccctctccccgaccagccccggtgtttgatattccccaccctgtgtccatgtgatctcattgttcaactcccacttctgagtgagaacatgcagtgtttggttttctgtccttgtgatagtttgcttagaatgatgacaacccaattttcaaaatgggcaaaagacttgaatagacatttctccaattaagatatatacaaatggccaataagcacatgaaaagatgcccaatatcaytagtcattaggaaaatgcaaatcaaagctaccatgtaatacttcaatctcattaggatggctaatatcaaaagaaaaattgaggagtgctggtggtaacgtgaaatggtgcagccattgtggaaagaagtatggaagttcctcaaaaggtaagtatagaattaacatatgatccagtaatttcacttctaagtatgtatccaaaagaattgaaagcagggacttaaacagataattgtacaccagtattcatattagcattatttacaatagtcaaatgtccatcaacagatgaatagat

SEQ ID NO: 156911 - DNA, 601 bp, Human
tctgtgctagtgtgagtctgacaataagatatatagacctagggagtataatagcaagtccagaaataaactctctattttatggtcaaatgatttttgacaaaggtgccaagaccactcagtggggaaaggaattcttttcaacaaatggtgttggaaaaactggctatcatcatgcaaaagaatgaagttagatgtttacctaacaccacatacaaaaattaactcaaaatggatcaaatacataaacataagaaaaaaatctataaaacaaccctcacagggggagaagctactagcmgatcatgtatttcttaagagattaagatccagaatatatacataaaaacaaatcttaaactcaacaacaaaaactaacaacccaatttcatttatttattttattatactttaagttctagggtacatatgcacaacgtgcaggttgttacataggtatacatgtgccatgttggtttgctgcacccataaacttgtcatttacattaggtatttctcctaatgctatccctcccccagtccccctctccccgaccagccccggtgtttgatattccccaccctgtgtccatgtgatctc

SEQ ID NO: 156912 - DNA, 601 bp, Human
aaatgatctctgctaactgttgacacgatctcatattaagaaaaccctccctaagattctacacttacacacacacatgcacacacgcacatacaccatcaaactgtgtgctgattttatgtactgcagcttagctgaactcatttattagctcaaaaatcagttgcatttctacacatgaaccatgaacaaactgaaaaagaaattaagaaaactattccatttaaatagcatcaaaaggaatgaaatacttaggaataaacttaacccgagaagcgaaaggcttatacactgaaaactwaaaaatactgctgaatgaaatgaaagaaatcataaataagtggaaaggcattttgtgttcatggatgaaaagaaataatattgtaacattgcaatactatctaaagcagtctaaaactcaatacaatttttatcaaattccaactgcattttttaaagaaatagaaaaatgcattttaaattcacatgaaatctcaagggaccctgcagaatcaaaacaatcttgtgaaagaacaaagttggagcactcacacttctagatttcaaaacttattacaaagctgcagttatctaaatctgt

SEQ ID NO: 156913 - DNA, 601 bp, Human
acacagtattgtaaatttaggtgagaataaccaggcaagaaaaagtaacaaaagctatccatattggaaaggaataaatgaaatgatctctgctaactgttgacacgatctcatattaagaaaaccctccctaagattctacacttacacacacacatgcacacacgcacatacaccatcaaactgtgtgctgattttatgtactgcagcttagctgaactcatttattagctcaaaaatcagttgcatttctacacatgaaccatgaacaaactgaaaaagaaattaagaaaactattcyatttaaatagcatcaaaaggaatgaaatacttaggaataaacttaacccgagaagcgaaaggcttatacactgaaaactaaaaaatactgctgaatgaaatgaaagaaatcataaataagtggaaaggcattttgtgttcatggatgaaaagaaataatattgtaacattgcaatactatctaaagcagtctaaaactcaatacaatttttatcaaattccaactgcattttttaaagaaatagaaaaatgcattttaaattcacatgaaatctcaagggaccctgcagaatcaaaacaa

SEQ ID NO: 156914 - DNA, 601 bp, Human
aaactgattaaatgaataacatttcaaatgaaaggagaaagtaacaacagtacattagatttaaaaggtaaaaagtttctccactaagcttaggagcaagataaggatgcctgttttcactacttctattcaacacagtattgtaaatttaggtgagaataaccaggcaagaaaaagtaacaaaagctatccatattggaaaggaataaatgaaatgatctctgctaactgttgacacgatctcatattaagaaaaccctccctaagattctacacttacacacacacatgcacacacgcmcatacaccatcaaactgtgtgctgattttatgtactgcagcttagctgaactcatttattagctcaaaaatcagttgcatttctacacatgaaccatgaacaaactgaaaaagaaattaagaaaactattccatttaaatagcatcaaaaggaatgaaatacttaggaataaacttaacccgagaagcgaaaggcttatacactgaaaactaaaaaatactgctgaatgaaatgaaagaaatcataaataagtggaaaggcattttgtgttcatggatgaaaagaaataatattgtaaca

SEQ ID NO: 156915 - DNA, 601 bp, Human
aagtggtaagaatgtattaaggagaaacttaaaaatggggcacaaaaatgaattaagaagagcaagtgaaaacatatcaataataataattgatctaaacaggtcagactccctaggtaaaggattgacagataaagtaagaaaacaggaactagataaaagtatcttacaagagacatatccacacagtaaaaggacacataaagattaaaacttaaagaatggaaaaagacatatccagcagatgatatccatggggaaactgatgtagctatattaatatcagaaaaagggctttcaygcttaaaaaattattagggataatgagtcactattcctaaaaggtataacaattacaagcatgtgtgctcctaataaagtaacctccagatatgtgaaacaaaatgtttagaactacaaggggaaatgaataaatacaccaaaaatagtggaagactttaacacacatctcttcatttttgaaaagtcaagcagacaaaaataatcagtaatgctacagaagactggaacaataaatgttaaatctcagcccaatagacttgtatatagtttcacatgaagaaatagtgaatacagtttt

SEQ ID NO: 156916 - DNA, 601 bp, Human
gaagaaaggacatattatatccaaaattagtttctgagataataatctattacagtatatataataaatgttgtatatacctgaggggaaaaattggaaaatacagttgaaatcacgtcagtttatatgcatatcaataaggacattttagacttatatggctctcagatgtattttttcatattttttcattattaactctattaggactcttcacgtttactttatataaacttaattgtaagagaatttttgctttatgggtcttggaagggagctataaaagccacctattggagtyatcagctatttctcctcaattttctcatctgtaaaatagggacaaagttgagcaaattaggcagacaatgtgtgttagtatcaaataaatacaattattctttggaagaaatccaaaaagcagatgtttttctaagatgtgactcacttagccatactttttaaagtgtaaattttccaaggtcatttttgaaaggcctgttggttatgagctgaggcatcaccagcttgaattgcacatttccactgtgcctttgagaagcataatggacacgttgaacaaaaagggagtgagggggac

SEQ ID NO: 156917 - DNA, 601 bp, Human
gtaaatatgaagaaaggacatattatatccaaaattagtttctgagataataatctattacagtatatataataaatgttgtatatacctgaggggaaaaattggaaaatacagttgaaatcacgtcagtttatatgcatatcaataaggacattttagacttatatggctctcagatgtattttttcatattttttcattattaactctattaggactcttcacgtttactttatataaacttaattgtaagagaatttttgctttatgggtcttggaagggagctataaaagccacctrttggagtcatcagctatttctcctcaattttctcatctgtaaaatagggacaaagttgagcaaattaggcagacaatgtgtgttagtatcaaataaatacaattattctttggaagaaatccaaaaagcagatgtttttctaagatgtgactcacttagccatactttttaaagtgtaaattttccaaggtcatttttgaaaggcctgttggttatgagctgaggcatcaccagcttgaattgcacatttccactgtgcctttgagaagcataatggacacgttgaacaaaaagggagtg

SEQ ID NO: 156918 - DNA, 601 bp, Human
aaactcagggtttattttcaattaagaaaattaaatgtgagtctatcatgaaatccataaaacaagctaaaaagaaaaaaaaatccaatatttgttttttatcaaattctgcatacaaagaatagactaatttctctaatttattatttcactttgtaaccatgttaataaatggcatctatttaatataaaaatgagcctatgttaaatgaagctgtcttttatatatgtatgtatatatgtgtgtatatacatgtatatatgtatgtaaaacatatatgtgcatttgctcaatttccamaataatgaatcaattcagtcaaactataagttattttaacttactgcttgattatcataaaaagaaaagatgaatttactgtctgccttcttttttgtaactgttttgttatacttttaaaatcctagttagcacaatatatgtcactcataacttatgtcattaataaaaataaaaagggtaaaactataaaagcaacattacctgtaatttctcttttcattggtagactacttggacaagaagcacttgtaagccccatgttaattggtgaaattccttgttcaccgctatacacat

SEQ ID NO: 156919 - DNA, 601 bp, Human
ctccaggcaacataattcagaactcctaggtgaaaataaaatattatttgctccaaaacggtacaataatatttttgatgcaaatattcagaaatttggaaaacagtactcttcagtgaaaggcaatggcaaagcttttaggctctgggataataaaaactgaatttattttctggccctccatttaatagccatgtgatctattgccacacttctctgtgtttcaggctcttcatctgtaaaatgactataatacaatacctaccttaaaatcattgtgataaccaaaagaaatatagtrtacagaaaatatagtattcaattattattttcagaattttgagattcagaaattattccaacctaaatattttattagtaattattatttctacatcccaagagttgcaactcactatatttctcaaatatccatatgaaacacttccacactttcttccagtaaatggcacttccctgtatatatggtgtggttgtatttatatgaccatcaacctccaggatggcctacaatgattcttaatttgtagtattcacaccttgtaattccctcccacattaaataaataaggctgacctg

SEQ ID NO: 156920 - DNA, 601 bp, Human
ataacatatcattaagaaaggaggagcaaattgacacagaaaaatgagaacctggagttatgtttcttattatttaaatgttgtacattttcaaaagtcacttttatctctttaaacctttgagtcagtgagtcacaacagaattcaaatgtaaccaaatgcactcatctcagtcacaggcagcctccttggaagtgaatgatcaaggagggaattcgagatgtttcattttgtgaaaatagatagcttttctgagagctcacattgttaatatttcccaaaataaatcaagttatatgtrcaattaattttggccatctgacatgaaaatacttatggagtataataaaagaccacacaccttaacctctatgcatttccttttgcattaattttatatggaaaaatatatactcactgaggttgtggttgtcctttttttgtctctcttttgctaaagctctagtgtcagtttctgatcaaaagaaaaataataaaaaccatgcttagttctaccttaaaacccctccaggcaacataattcagaactcctaggtgaaaataaaatattatttgctccaaaacggtacaataatatttt

SEQ ID NO: 156921 - DNA, 601 bp, Human
atttactaatcccttctctcaaccattagctctccccactcataatctggaccaaagttatctgctctgacactaaagcctttgagaataaaatcatttctcggaggactgttatgaccatgtgccagctcttgtcttacagtcacacactcagcaaacatcactgtgacacaggcaggtgctttatgaacagatgcaggtttcacaagtacgtgtatactcaatttcagctagcgatacataaggaaattagtcattagttttaggaatttgcaatattttatttattttaatttcattytactctgttctcagtttttgatttggcttccagaacgaaaaggcttcacactcaattagtcaagctcacttgagacagttacacatttaagacatgaccaagcattctaaagctcagcctcgctgccaatctacttttcttgcccgatttctccatctcatatgacctgttatcagagtctaattgacccttaggaaggcatgagggctctatttgttccagaggtgaaattcagcactgcaacacagcaatgcctttcagataacatatcattaagaaaggaggagcaaattgacacag

SEQ ID NO: 156922 - DNA, 601 bp, Human
ctggaagtagggggacaagagtgggcaagaatttccatttctaacaagtttcatggtgatgctgatactgtttttgtggggccaatgctttgaaaactgctgatataagctcttattcagagactgttttctctttttgcatttccatacattcattgcttatggcaattttctgaacatcgtaaatgttcaacatacaatatatatctgtcaaatttcctgtattactcttctctaagagcagtcttctactctatattcctaatatcaagaaccataacatatacttatacatggtatstttttcaacagatatgtttaaagcttttggggaagtaaaggtagaaaaggatatgaagaagaaggaaaatatatttttttaaatgttggaaaatacttaaacagttcacatttgagaattatgaactgctactagaaacaaggaaagtcatcaaagactatcaattgccttggtgaacttactctacaaagcaaattacatgaatgaatttgacctttaggaataatacattgtgattcctctaaaatgagaatataattggttctggtaagagtttattttccctcttcaccaatccta

SEQ ID NO: 156923 - DNA, 601 bp, Human
ttcttccctcccattcattttgggggtctttaaattataacattattatagaaatgattgttgaactcacggatcattagactttggaataagagtgccaagctccttgattcggtaattaatattataccttcttcttctttcaactattaaagaagaaatattattgattattctcattaatgcacagttcacttttggtcagctgtaaacatttttaacaatcttttaaaaacaatgggaaaaaaactttccatttagtcaaaagataatacttctcaagaataaaataaaaattctyattctaaaagtaaaggtttcaatattagaattataaatctatgatttacactgttttaaaaacattttgtcacaaaacatttttaaaaattccttaaaatactataatactcataatgaaatgtgtataagtatatattaatatgtataactctttgattatttcacacattggcaatttgtcagtccatcaggattgtaatcattcgaggtcgtgcaacactctttactcttctcatatactgtcctcaaagcctaacgcaatgtttagcacatagtaggtctgtgtatccaattagac

SEQ ID NO: 156924 - DNA, 601 bp, Human
tttaaagttcatatggaaccaaaaaagagcctacatcgccaagtcaatcctaagccaaaagaacaaagctggaggcatcacactaccttacttcaaactatactacaaggctacagtaaccaaaacagcatggtactagtaccaaaacagagatatagatcaatggaacagaacagagccctcagaaataataccgcatatataaaactatctgatctttgacaaacctgagaaaaacaagcaatggggaaaggattccctatttaataaatggtgctgggaaaactggctagccatatgkagaaagctgaaactggatcccttccttacaccttatacaaaaatcaattcaagatggattaaagacttaaacgttagacctaaaaccataaaaaccctagaagaaaacctaggcattaccattcaggacctaggcatgggcaaggacttcatgtctaaaacaccaaaagcaatggcaaccaaaaccaaaattgacaaatgggatctaattaaactaaagagcttctgcacagcaaaggaaactaccatcagaatgaacaggcaacctacaaaatgggagaaaattttcgcaacctactca

SEQ ID NO: 156925 - DNA, 601 bp, Human
cataaaactttataacttgcaaactattcccatacaccttatttgattttatttttataaaaacacaggcatatagggaagacaagtgttttctttagctaacagagtcacatgtttagagactttaaaagatttgaagagtttggagtagagtctaaattaggcctgagctcttcagaccctaaatgtcttcacaatctagtatgtacataaggacaaatattgcattcccttttctaacaaattgttgaattgtccaaataaatgagcaaattcggatttagagaaaaagtgctttaawatctcagaaacataacgtgtgtgtgtgtgtgtgtgtgtgtgtgtgtgtgtgtgtgtgtagggtcttattctaccacccaggctggaatgcagtggtgcgatcatggctcacttaagccttgaaatcctgggttcaagtgatccttgtgtctcagcctcctgagtagcttggagtacaggtgcatgctaccatatcaagcttgctctttccttctttctttctttcttttttctttctttctttctctctctctctctttattttctttttctttctttccttccttccttcttttctttt

SEQ ID NO: 156926 - DNA, 601 bp, Human
tacttttccttctgacctcaccattttgacctgcaaagaaatagaactttctgaatattttgatacatagaaataaaaacttcatagaattcaaagtgtcttcaggtattagcttttatttcctaagccaactccaaaatatattccaatcatgagctggaaaggtactcaaaggccaaccatgccacaattgctgctatatgcccaagagtatatggtgtttaggagataagccccaggtttcctctctcaattcagtactctttctgccaacctgtggctttcccacctttcaaatgcrtctgtcataagaaatacgctttatatagtgacttggcacactcttagtaaataaaactgcaacaaagatttcacagggctttcctattctctttacatgtaatactctcatattttcaatgctattcttccttttttgtttaaaatgctgcatttgtctcatttgagtgattccatgactcgttaatagatatggcacataatttaaaatatctcatactagataattgtatagtctgatatactttttattttttaaaaactgttcttagtcattttaatggttgtagtcacctgttca

SEQ ID NO: 156927 - DNA, 601 bp, Human
tagagtaattaaagatctaataatacttttaactttctactcatgtaatttttgtaaacatggctcacaaaaacacatatggacaaaagtgtttccaagaaagctaaagaggacaactactacatgttgtagaagctcttcactctttctctttgattgttatttttgtttgggttttgttttgttaacaccggtcaagagattgtcattgcctggtcatgtttttttcatgtaattttctcaacctgtacgtctcaattacagctgttctctatattacttttccttctgacctcaccaktttgacctgcaaagaaatagaactttctgaatattttgatacatagaaataaaaacttcatagaattcaaagtgtcttcaggtattagcttttatttcctaagccaactccaaaatatattccaatcatgagctggaaaggtactcaaaggccaaccatgccacaattgctgctatatgcccaagagtatatggtgtttaggagataagccccaggtttcctctctcaattcagtactctttctgccaacctgtggctttcccacctttcaaatgcatctgtcataagaaatacgcttta

SEQ ID NO: 156928 - DNA, 601 bp, Human
gatttttgatgttttgtaagaatattatgtagatattttacatataaattttatcactatatttactaatttaaaaactgacaaaacctttaggttaaattcaagtaaccagtaaagtgaaattttaacgttcttgtcacttgagatatctaaaggttattttcattttgggggaggaggatgtgtccagtatgggatcagaaaacagagaggacttaaaagtgatattttaatattactcgttctactgccttattggtaattttcaaaaataagctcttaagctgggcacggtggtttscacctgtaatgccaactactctggatgccaaggtgtggaggatcgcttgagcccaggagttgtagaccagcctggtaacatagcgagacctcatctctaaaaaaaaatattaagttttgaatacttttaagtttttgaaatttccattctagattgcaaatttaaggaagagaagctgttaagatgtgtctagtaccatactttatatatgcttggctcagttagatacattcattacttaatttgttgttgtaagaggtagttctattaccatttcacagatgagtagagtgaggttca

SEQ ID NO: 156929 - DNA, 601 bp, Human
tttgaaatttccattctagattgcaaatttaaggaagagaagctgttaagatgtgtctagtaccatactttatatatgcttggctcagttagatacattcattacttaatttgttgttgtaagaggtagttctattaccatttcacagatgagtagagtgaggttcaaaagctttaagtagttcacccaaggacggtcaagatgaaggtagtatttaaagtttgtcttagtccaacgttgatgttcttgtgacattatgcgctctcttctttttttttttttttttttttttttttttgakacagagtcccactctgtcacgcaggctggagtgcagtggtgcaatcttggctcactgcaacctctgcctccggggctgaagcgattcttctgcctcagcctcccgagtagctgggataacaggcacatgccaccatgcccagctaatttttgtatttttagtagagacggggtttcgctatgttgcccaggctggtcttgaactcctgacctcaggtgatccacccccctcggcctcccaaagtgctgggattacaggcgtgagccaccatgcccagcagacattatgctttcttaaaca

SEQ ID NO: 156930 - DNA, 601 bp, Human
aggctgaggcaggtggatcacctgaggtccggagtttgagaccagcctggccaacatggtgaaaccctgtctgtactaaaagtacaaaaaattagctgggcgtggtgtcgtgcacctgtagtcccagctactcgggaggccgaggcaggagaatcgcttggacccgggaggtggatgttgcagtgagcggtgatcgcaccactgcattccagcctgggcaatagagcaagactccatctcaaaaagtttaaaaaaaaattcttattattgagaaggtaaactcaagcaaaaagctattaawgtggacaatattcattcctaattctattctatagataaattatgttatttcaccaataaagtgtaaaaacttctgttgcagacaggaacttgatagcagctgtagcattagtggagtttttcagactttgtacattaaagtaaatttgtagtaaattttcagtgcatttgggagccatttttgcatgagtagttgaatagatagaataattgcatgttagtgtgagaatacagatatgaaaacacttagagcagagaatctaaaataatttttaaggttgaaaagcaggatggcaaaact

SEQ ID NO: 156931 - DNA, 601 bp, Human
gcagaaggtgtttttcactgcagtcagagacacttctgatcctaagcagcatctcctgacacttgacaaaaagaaagtagtgcatagtggaaagcagaagacagtttcctgtggggtttatcaaagtgaactgtgcttttacttgatggagaaaacagcattctttcctttctctcctaagggaagggactggggaattctctctaagaataatggaattaggctgggcacggtggctcatgcctgtaatcccagcactttgggaggccaaggtgggtggatcacttgaggtcagcagttygagatcattctggccaacatggagaaaccccgtctctactaaaaatacaaaaattagccaggtatggtggtgctcacctgtaatcccagctacttgggaggctgaggtgggagaatcactcaagcccaggaagtggaggttgcagtgagcggggatggtaccagtatactccaagtctgggcaacagagtgagaccccatccctccccccacaaaaaaagtggaatcaacattatctggttttgaaagatgaatatccttttttttttttctttccttgcctgaactgtttatgactgaa

SEQ ID NO: 156932 - DNA, 601 bp, Human
tataggcagtttctcccgctctgattgatttttttttcttcccagactaagtcagtgctacactttgaggattttgaaagcagagggcctggaaagttggccaatttttttttaaagtaaatgaaggtaaatatatttaaccatagatgccatatcaaaaaagtactcatttgtcttgctttattataaagtctaaactagaacagtttatttttgagtttcaaaaatcatgagttggttcaaataattgtaaacttacattttaattaatcagaactcaagtaattagaatcctctattkaatccagaattatttaacttgattttaaggggatgatggctcattgtgaactgcagcaatgcctactagaatttgtttttgtttttgttttttgagagggagtctcactgtgttgcccaggctggagtgcaatagcgtgatctcggctcactgcaacctctgcctcccggattcaagcaattctcctgcctcagcctcccaagtagctgggattacaggcacctgccaccgtgcccagctaatttttgtattttagtagaaacggttttttaccgtgttgggcaggctggtcttgaactc

SEQ ID NO: 156933 - DNA, 601 bp, Human
gtttcctgataattagattcagcctatgaatttttggcaggagtgtcacagaagtgatatgttctcagtatatactctcagggggcacttgatgtcagtttttcagtttttcttattactgttgataactttgatcatttatttggtaaaggtggtgtatggcgagtttcctcaatgtaaaattactattctttagtaattaagtgtcacctgggaagatacttacaaacaatgtaaatatcctgttgttttattattctgcccaccaactttagcctcccttgatgattttttgcttgcwagaattactgtggtggtcacccaaggtggttttctaattcagtccctccttttacatttattaattggaattctatgatgaagggcttttctttttcctccatttgttagtttatttctttatgccagtatggactcatagattcttgttttattctgtgggttaccattcattactaccattatggaatgggttgcttgaagaattattattattatttttttttacaaaaaagtaagcccataagaaaaacaagatacgaaaaaatattgtttgacagtaatacgtttgtattgtctc

SEQ ID NO: 156934 - DNA, 601 bp, Human
tgtcagtttttcagtttttcttattactgttgataactttgatcatttatttggtaaaggtggtgtatggcgagtttcctcaatgtaaaattactattctttagtaattaagtgtcacctgggaagatacttacaaacaatgtaaatatcctgttgttttattattctgcccaccaactttagcctcccttgatgattttttgcttgcaagaattactgtggtggtcacccaaggtggttttctaattcagtccctccttttacatttattaattggaattctatgatgaagggcttttcwttttcctccatttgttagtttatttctttatgccagtatggactcatagattcttgttttattctgtgggttaccattcattactaccattatggaatgggttgcttgaagaattattattattatttttttttacaaaaaagtaagcccataagaaaaacaagatacgaaaaaatattgtttgacagtaatacgtttgtattgtctcagacagttgatgggcagaaattattttttttctcagggctcacatgtattttggatattttttgaacaccccaattttatcttctgtatagg

SEQ ID NO: 156935 - DNA, 601 bp, Human
tccatgtttgttagataaactttaaggaaatacatttgtaattattttcagaaattctactcttgggacctacctattgttaactggtattttttttttcttttttgcatttagaaatgagctagaataaataatttttaaaattaaagtcagcgaggaggaatgttgagtctgtagcagtggataaaaaatacctggatggttgaacaatatcttcttaggaaaacagtcaaaacttttactgtgagagacatcctttcttttgtctagggcctgagaaatccaaaggtcagattcttascttttgaaaatcagaaagaaccagattaaagtatttcaggcacggctggtttaatccacattgtgtttggggttctcagccagtctgctcccttgacctcccaacccttagtggtacttttgacccaccattcactttggatgttgtggaagtccagtaataccttttgattactgtgtacatttagtgcaacagcaagggcaaataagttcataggataaaaatgcagtacagatcatttttgctttcttggtgaaaacccaaaatagagctgacgaaaattctaaatggtatattgcc

SEQ ID NO: 156936 - DNA, 601 bp, Human
caagccctctttttaaaagaaaaccaaaataatcaaaataagctaaggacagtatgcagaaaaatctgtgttttctgaattacaatgacaatatgttagtctggattttgtaatggctagaatataatgtatttatttatatatgatgattctgttagcaaattaacccttttaaagcctgaaataaattttattcatatcactgactagaatatatcctcattctgggaaaggagagtctttttggtaaatggttttatttaagtaaaactataaacgcatatagtagatatttcttcartagaactcttaaatagtttaaaaagacaacaggccaggtgcagtggctcactcctgtaataccagcactttgggaagatgaggcaggcaggtcacttgagaccaggagttcgagaccagcctgggcagtatggtgaaaccttgtctctaccaaaaaaaaaaaaaaaaaaaaagccaggtgtggtggcatgctcctgttttgagaggctgaggttggggaatcatttgagctcaggaggttgcagagagccgagatcacacccattgcactctagcctgggcaacagagtgagaccctatc

SEQ ID NO: 156937 - DNA, 601 bp, Human
taaggacagtatgcagaaaaatctgtgttttctgaattacaatgacaatatgttagtctggattttgtaatggctagaatataatgtatttatttatatatgatgattctgttagcaaattaacccttttaaagcctgaaataaattttattcatatcactgactagaatatatcctcattctgggaaaggagagtctttttggtaaatggttttatttaagtaaaactataaacgcatatagtagatatttcttcagtagaactcttaaatagtttaaaaagacaacaggccaggtgcartggctcactcctgtaataccagcactttgggaagatgaggcaggcaggtcacttgagaccaggagttcgagaccagcctgggcagtatggtgaaaccttgtctctaccaaaaaaaaaaaaaaaaaaaaagccaggtgtggtggcatgctcctgttttgagaggctgaggttggggaatcatttgagctcaggaggttgcagagagccgagatcacacccattgcactctagcctgggcaacagagtgagaccctatctcaaaaaaacaaaaacaaacaaacaaaaaaaagtttcatcatg

SEQ ID NO: 156938 - DNA, 601 bp, Human
gtgtggtggcatgctcctgttttgagaggctgaggttggggaatcatttgagctcaggaggttgcagagagccgagatcacacccattgcactctagcctgggcaacagagtgagaccctatctcaaaaaaacaaaaacaaacaaacaaaaaaaagtttcatcatgaccatatattttttggaattgtgaaaggaatttttgtatttcttttaaagaaaatcctatgagatcggtatgaatagccaaaagaaaaagggaaaaaacattttcatcctgcatagagcatgatagcacatgtacaaacaatttgttatttaaattatgtcttgtaaatcacttcacagtatgcgttcctttaaacttcactggcagacgtttttataattattcacccatagatctgaaatttaaactgctgtaaagtctcctggttactatagactgtagcaatagctgctcctcagcagtaagaacaacatgcctgaaagaaaaatggcctgtagtgatctctttataaaacttcttaagtagttagaaaaatacattactttcaagtactatctataaatgtgttgttgtttcttcttcatatacatttga

SEQ ID NO: 156939 - DNA, 601 bp, Human
gaggacatcggtaattgtgataaaatatgatgcttatagtatgaccctcagaaaaaactcatcaaaacctttactagaaacttcagattttctttgcatgtagttataatctcagtgaatgtttgcttactagtaaaaaaaaaaaaatagtttgattgacttcagtagtatgcaatttctcaaaactctccatttgagttcatgttgtagacatctctgggtgtctgtgaagtacagaatatatactgtaagtcactgattgacttgactttagaatgctattactctggttcacagtgtsctctctgtgaaataatttctgagcaaaagtagtgttaccctgttcttcatcccacttagttctgaattacttttgtcctcaaaagataataatttgttacctatcattgaggccatccaaaactacgtaacaaaagcttagaaggcattataaaaacatttagaatgtgttccagtggcagtttcactagggtaagtgtatagctatagactgtttctttttcacttgcactttttgatgttgaatttcttttatacaaatacatctttcccacatatatgtatgtttcctcctttcctc

SEQ ID NO: 156940 - DNA, 601 bp, Human
acaattattctttagagtggttgtaatgggacatctttacaaaaagctaccaactcagtatgtttcagagcaaaattagccatactgaagagttggtattgtcaagtcaagaacactttgaaacatccagaaatagctttttattcaacagacattgctagactttgctgtgatgatgagataaataagccttttagggattttccagtggagagtcagacatgtttaatattagaccaagtgaaacgaaatacaatagaggcatgtgaaagggctttataacccaaaggaagaaattttraatttctatttagaggtggtttttgagctgttttaaatgaacaggattttaatagtaagaaaaatgatgtggctaaacttagggaagagcatggagaaaagtataagatacaacttgatggaaagggtataaaaatctaaatacagtaacaggtgacttagaaattgattgggcgacagaattctgcaagagcagggagaacattgtttttaccgtgtctagtagaatgcttagcttatagtaataagagctcagtaagtatttgcatagatggaggggtggatgaaggaatgatgagtg

SEQ ID NO: 156941 - DNA, 601 bp, Human
gaccttactggaaaatgaatccaaaattctaattgacttggttttaaacatacttttgggataaatcatttaaggattaataatgccctggctgtattgagtttattcttaggaaaattacagttttcgtgaattaggaaaatgagaagtgaatagcttcttttttctttctcacccttgtacacttctgtattcaatgtcatcttttttgagcatgtagtatcaagaatttgacagctaataatttaattctactttgctatttttacatttactagtctcctattaactcatcagtaaygctttgttcaaccaggctttcctttctagaggagactcaggagctaatacctgaaaattcagtggacgcctggccatcccgaataatctggaagtttccaagtagattagagatgtatttctgagtttggaaattctcagtatcctttctgttaagtgacagtgatttcccagattttagatttaatttaaaaatacaatttttagataatattttatactcttgagaattttttctatacatatatatggtaatgtattattctttactcttatggagtagatagagagtagctttatt

SEQ ID NO: 156942 - DNA, 601 bp, Human
agcattctttgcagtgcttcattggtaattctcttactatgcttcatactttgtgttatggttatgtttatccattttctcttttattcacctgtaggcctttgatcagagaatgtatctaagtattctttgcatctcttacagcacctagtctgtttcctggtatactaaatatatacttgaacaattggatgcatctcttatcagtaactaacctttattttcaggttcttgaatgaaaaggccagttatatttactgatttaattttattttgctaaacattgaaagctggacatcaytgttcagtttttaaaataggcatgtcattatttgtagttagtataagttcagtaatggagaattacaattttatttattttgcagtgtgcaatgtaggaggagactttattgatgggtgaattttttgaccattgtttttaaaaaacattaaatatataattttaagtaattgccattttcttttttttagtgcatttgcacagtataacttggaccagtttactccagtaaaaattgaaggttatgaagatcaggtatgtttcatataaacactattctttgttttgtttataaccgtt

SEQ ID NO: 156943 - DNA, 601 bp, Human
ttttaaaatgtgaaaagtggctaacattttagaagaaaatctgagtctacatgtgcaatacagggctagggagaccatcttaaataacactggatacccaggaagtataaaagatggacattttactataaatgtttttaactgtagaatgaagcctatcttaaagaactcttataaattgataagaaaaagacaccagataaaaatattttattatatttgctcacagaagagcaaatgacccacaaatgtgaaaagccatacttagttttatcagtagtcagtggaattaaaatgatayattttctaccatcagactaaaaaaagagctatagtgcctatcattggtggtaatatggatggaaacatactctcatatatgtgtagaaatttggattgtcacaggagtatatattaaaaattataatacctgatgtccctaccaccactgcttgggaatttattcaatagaaataaaaggatccaatggaaataaaaacatcagtatgttaaaatatatgtacagcaatactcatttcaccttttttgttgttgttattgagtcagggtcctgctctgtcacccaggctggagtgcagtg

SEQ ID NO: 156944 - DNA, 601 bp, Human
ttaaaggagcaggatatggtgagattctgtaatcttatgttcatgactcgtctcagtttagatcaaagttatttttattaagtcacagaaatcttagaacaaataaaattacttggaagtaaaattatgtgtttctgtattttacagttacatttcttgtgttttttgtgtggttctttcgtaggttcaacctatttttatattttcaagaaatatatggctgggcacagtggctcacgcctgtaatcccagcactttgggaggccgaggcaggtggatcacctgagatcaggagttcgakacctgcctggccagcatggtgaaaccctgtctctacttaaaaaaaaaaaaaaaaaaaacaattagccgggcgtggtagcacgtgcctgtagtcccagctactcgggaggctgaggcagaattgcttgaacccaggaggcagaggttgcagtgagccgagattgcgccactccactccagcccagtcaacagagtgagactctgtctcaaaaaaaaaaaaaagaaaagaaaaaaaagaaatacaaaatatggtagtaggaatacatttcttttttaaaaatttcataatattatttgtacc

SEQ ID NO: 156945 - DNA, 601 bp, Human
agatcaaagttatttttattaagtcacagaaatcttagaacaaataaaattacttggaagtaaaattatgtgtttctgtattttacagttacatttcttgtgttttttgtgtggttctttcgtaggttcaacctatttttatattttcaagaaatatatggctgggcacagtggctcacgcctgtaatcccagcactttgggaggccgaggcaggtggatcacctgagatcaggagttcgagacctgcctggccagcatggtgaaaccctgtctctacttaaaaaaaaaaaaaaaaaaaamaattagccgggcgtggtagcacgtgcctgtagtcccagctactcgggaggctgaggcagaattgcttgaacccaggaggcagaggttgcagtgagccgagattgcgccactccactccagcccagtcaacagagtgagactctgtctcaaaaaaaaaaaaaagaaaagaaaaaaaagaaatacaaaatatggtagtaggaatacatttcttttttaaaaatttcataatattatttgtaccctgacaggcttttttagcacccccagtttgtgcttcagtggccttttccattgccagag

SEQ ID NO: 156946 - DNA, 601 bp, Human
caggcttttgaaggtggcttaaaggccctgtgaccacgtggcctctgcttacccctccaacctaactctaccatatatcctagtttatacctgctttctcaatgtaattattaatatcaccagtagcgtaccccatttctttcttggaagtttcctggttaggacaaaaattcatatggtctgcttaagtatctagctctctgattatttgagaaatattgcaacataacctcaaatatcttatgtattacttgaattataacttgttcatcaggattattttggaggaataacgagagtyaagggagtacttgttagagagtcctcatttgttctagaggattgaaaggcacaaattaattattatttttaaagcagtaggcaagaggtgaaatagcattgtgatacatcacaggcattctcttaacgacctttctcacttataagtaagttaatttattccagtacttttaagtgactaaagaaacagcagcccctaagattgtgaagtgaacaaaggtgataatcacaagctaggtccagttttcacttgcatggaaaaagctagattagcatctgtatgtttaaaataaattatcta

SEQ ID NO: 156947 - DNA, 601 bp, Human
gaccacgtggcctctgcttacccctccaacctaactctaccatatatcctagtttatacctgctttctcaatgtaattattaatatcaccagtagcgtaccccatttctttcttggaagtttcctggttaggacaaaaattcatatggtctgcttaagtatctagctctctgattatttgagaaatattgcaacataacctcaaatatcttatgtattacttgaattataacttgttcatcaggattattttggaggaataacgagagtcaagggagtacttgttagagagtcctcatttrttctagaggattgaaaggcacaaattaattattatttttaaagcagtaggcaagaggtgaaatagcattgtgatacatcacaggcattctcttaacgacctttctcacttataagtaagttaatttattccagtacttttaagtgactaaagaaacagcagcccctaagattgtgaagtgaacaaaggtgataatcacaagctaggtccagttttcacttgcatggaaaaagctagattagcatctgtatgtttaaaataaattatctacttatgaaagtagattatctagaatgttcgt

SEQ ID NO: 156948 - DNA, 601 bp, Human
gctgttacaataagcttactaatttgtctttttaaaatctaattcctttgagctttaacatatataaaatgaagaaaatgtctgtccttgagttttattttctgtttagagacagagtcttgctgtgttgcccaggctggtctcaaattccagggctcaagtgatcctcctgcctccggttcccaagtagctggaactacaggttcacatggtgcccaacttgtcattgaattttctattctcactatttcactttacaagggtaatttttcctaagccatcactatgagcattgtatcayttaacttaatggctttcactttctggaaaaaaatgtattttatatgctttgatatgatttttccatagtgataatatcatggcacaatagtctcagtaaaatctaagtagttaatacaaagaactatacttcaagccaggcatctgtaatcccagcacttttggagaccaaggtaggaggatggccagaggccaggagttcaagaaacctgggcaacatagtacgaccccatctctaggaaaaaaaaaaaaaaattagccaggcatggtggtgcgtgcctatagtcctagctacttggga

SEQ ID NO: 156949 - DNA, 601 bp, Human
gaagaaaatgtctgtccttgagttttattttctgtttagagacagagtcttgctgtgttgcccaggctggtctcaaattccagggctcaagtgatcctcctgcctccggttcccaagtagctggaactacaggttcacatggtgcccaacttgtcattgaattttctattctcactatttcactttacaagggtaatttttcctaagccatcactatgagcattgtatcatttaacttaatggctttcactttctggaaaaaaatgtattttatatgctttgatatgatttttccatagtrataatatcatggcacaatagtctcagtaaaatctaagtagttaatacaaagaactatacttcaagccaggcatctgtaatcccagcacttttggagaccaaggtaggaggatggccagaggccaggagttcaagaaacctgggcaacatagtacgaccccatctctaggaaaaaaaaaaaaaaattagccaggcatggtggtgcgtgcctatagtcctagctacttgggaggctgaggcaagaggatctcttgagcccaagagttcaagcctgcagtgagctataatcacgccactgcac

SEQ ID NO: 156950 - DNA, 601 bp, Human
tctgtccttgagttttattttctgtttagagacagagtcttgctgtgttgcccaggctggtctcaaattccagggctcaagtgatcctcctgcctccggttcccaagtagctggaactacaggttcacatggtgcccaacttgtcattgaattttctattctcactatttcactttacaagggtaatttttcctaagccatcactatgagcattgtatcatttaacttaatggctttcactttctggaaaaaaatgtattttatatgctttgatatgatttttccatagtgataatatcawggcacaatagtctcagtaaaatctaagtagttaatacaaagaactatacttcaagccaggcatctgtaatcccagcacttttggagaccaaggtaggaggatggccagaggccaggagttcaagaaacctgggcaacatagtacgaccccatctctaggaaaaaaaaaaaaaaattagccaggcatggtggtgcgtgcctatagtcctagctacttgggaggctgaggcaagaggatctcttgagcccaagagttcaagcctgcagtgagctataatcacgccactgcacttcagtctgg

SEQ ID NO: 156951 - DNA, 601 bp, Human
ttacaagggtaatttttcctaagccatcactatgagcattgtatcatttaacttaatggctttcactttctggaaaaaaatgtattttatatgctttgatatgatttttccatagtgataatatcatggcacaatagtctcagtaaaatctaagtagttaatacaaagaactatacttcaagccaggcatctgtaatcccagcacttttggagaccaaggtaggaggatggccagaggccaggagttcaagaaacctgggcaacatagtacgaccccatctctaggaaaaaaaaaaaaaaattagccaggcatggtggtgcgtgcctatagtcctagctacttgggaggctgaggcaagaggatctcttgagcccaagagttcaagcctgcagtgagctataatcacgccactgcacttcagtctgggtgacaaagcaagaccctatctctagaagaaaaaaaaaagaaatatacttcagttcatctaaaatataggtagagtaaaaatcagaagcaactagtcttagatgtttcttagatttcagtagagaccttctcttctttgtctctaccatttctccaggatctagcagtattagg

SEQ ID NO: 156952 - DNA, 601 bp, Human
caaaaatcatttcaggagcagagaaggaggatatgccttttatgtggagactttaaacataaaattggaaaactaaaaaaaaaaaaactcatgttaataagtatagtcctttatttccagatatcaaaacctctttaagagtgttgtataacatttactagtcattctttttaaattgtatggtactttgtatcattcagtagatgttaaactacactgagtgtatttataaaagcccctgttaatctaaacatttattccatttattttggaaatataagtgatttgattgaagaagtascttaaaatttatctccacagtagcttatgacttagttttgtattggtttttgttttgttttgttttttttaaggctagtcaagtggagatggaacaaagaaacctgtaactgattgtgatcaattagtggcaaacagcactgcacacacaccagcctgaattgtattttaagccttagctttagaattctggcattaaatccattatgtaagttctttcttatcagtagggtgaaaattaaatatgtatcataactggacttaaccttttgattatttttgactatttcagtgattaaaa

SEQ ID NO: 156953 - DNA, 601 bp, Human
actagtcattctttttaaattgtatggtactttgtatcattcagtagatgttaaactacactgagtgtatttataaaagcccctgttaatctaaacatttattccatttattttggaaatataagtgatttgattgaagaagtaccttaaaatttatctccacagtagcttatgacttagttttgtattggtttttgttttgttttgttttttttaaggctagtcaagtggagatggaacaaagaaacctgtaactgattgtgatcaattagtggcaaacagcactgcacacacaccagcytgaattgtattttaagccttagctttagaattctggcattaaatccattatgtaagttctttcttatcagtagggtgaaaattaaatatgtatcataactggacttaaccttttgattatttttgactatttcagtgattaaaaatttaatgtccagtattcatcccccacactctctcatactgtagcatgaaatataatctgaaacttaaaattgattcaaattattttccctaccttatttacagctgctgtttttatttttaaggaatggtcgttggaggtcagaatggaagttta

SEQ ID NO: 156954 - DNA, 601 bp, Human
gctgggattacaggcgtgagccactgcgcccggccagaaaaatttatttttaactcaagaaagcatttaagaaacatgtatgaatgtgttaagacagatgctacctaagaagataagctatatttacatatacatacatacacacacacacacacacacacacacacacgtatttttttgagacagggtgtcactctgttgcccaggttacagtgcagtgtgtgaatacagctcactgcagcctcgacatcctgggctcaagccatcctcctgcctcagcctctctagtagctgggactayaggcgtgtgccaccatgcccagctaatttattttttgtagagatggggtctcaccatattgtccaggctggtctcaaaccctggccacaaccaacctttctgccttggcctcccagagtgctgggattacaggcatgggccaccacacccagcccctgaagctatcttttaaaaaaatttttactagcacttaggtgatttctgctttgacctaattggtactctccttgcaaaatttgccagtgaaaaaaacttactaatgtctgattttccatgagatgttctccatatagttacata

SEQ ID NO: 156955 - DNA, 601 bp, Human
tgggtggctgaggcatgaaaattgcttgaacctgggaggcggagattacagtgagccaagatcacactgctgcactccagcctgtgctacaggctgagaccctgtctcaaaaaaaaaaaacagatgcttcctaagagaaatttgtccacaagagtacagagggtacggttttgagagatggtcatagtaattaaacttgactaatatgccagtttgtgctcgtttttttaggaatgaccatttttactctatcttaggaggttttcattgttttatatttttacaccatatatataaagtrtaaggtgttagagacttttacattaacactgttttattttttaaatccagattctgttaactttactgttaggaaaaagcaaacaaacccatctattggcatgttaaaaaaaaaatttccagaaaaatacattcttcctgattagtgattttttttttttttttggtatcactgttctgttacgtaatgttcagtaaatatttaacaatattcagataaagagtcatcaattagaaatctttaccaaacttcttacccataaaggttgtctattggaatgcatgtccagtgtttaaaatt

SEQ ID NO: 156956 - DNA, 601 bp, Human; identical to SEQ ID NO: 33703

SEQ ID NO: 156957 - DNA, 601 bp, Human; identical to SEQ ID NO: 33704

SEQ ID NO: 156958 - DNA, 601 bp, Human; identical to SEQ ID NO: 33705

SEQ ID NO: 156959 - DNA, 601 bp, Human; identical to SEQ ID NO: 33706

SEQ ID NO: 156960 - DNA, 601 bp, Human; identical to SEQ ID NO: 31234

SEQ ID NO: 156961 - DNA, 601 bp, Human; identical to SEQ ID NO: 31235

SEQ ID NO: 156962 - DNA, 601 bp, Human; identical to SEQ ID NO: 31236

SEQ ID NO: 156963 - DNA, 601 bp, Human; identical to SEQ ID NO: 31237

SEQ ID NO: 156964 - DNA, 601 bp, Human; identical to SEQ ID NO: 31238

SEQ ID NO: 156965 - DNA, 601 bp, Human; identical to SEQ ID NO: 31239

SEQ ID NO: 156966 - DNA, 601 bp, Human; identical to SEQ ID NO: 31240

SEQ ID NO: 156967 - DNA, 601 bp, Human; identical to SEQ ID NO: 31241

SEQ ID NO: 156968 - DNA, 601 bp, Human; identical to SEQ ID NO: 31242

SEQ ID NO: 156969 - DNA, 601 bp, Human; identical to SEQ ID NO: 31243

SEQ ID NO: 156970 - DNA, 601 bp, Human; identical to SEQ ID NO: 31244

SEQ ID NO: 156971 - DNA, 601 bp, Human; identical to SEQ ID NO: 31245

SEQ ID NO: 156972 - DNA, 601 bp, Human; identical to SEQ ID NO: 31246

SEQ ID NO: 156973 - DNA, 601 bp, Human; identical to SEQ ID NO: 31247

SEQ ID NO: 156974 - DNA, 601 bp, Human; identical to SEQ ID NO: 31248

SEQ ID NO: 156975 - DNA, 601 bp, Human
cctcttccactgctctgcccgcttctccctcttccattgctctgcctcaactccagtcaggagcctctttgccattccggaaacacaccaagcaagcaaaggccagcctcagggccttcgcacctactgttcctgctgcctagagtgcctcccacagaggtctgcacggctttgtccctcagctcctcggggtctttgttcaagtgtcaccttccctgaccacccgatttaagaggcaaagcccccacttccttctcccacccctgctttattttcctccatagcagttagcaccattagycacgctacacattttattcattcgttccagctccctcactagatggtgagtgccacaagggcaaggatccgtgttttctggttttttttttttttttttttttgagacagtctctgtcacctaggctggagtgcagtggtgcgatttcagcttactgcaacctccacctcccaggttcaagcaattctcttgcctcagcctcccgagtagctgggattacaggtgcctgccaccaagcccaattaattttttttcgtatttttagtagagatggggtttcaccatgttggccaggctggt

SEQ ID NO: 156976 - DNA, 601 bp, Human
aatacagccaggcgcagagtaggtgctgaataaatattgctcacaatcttacagccttccagctcaccatgaggtagatactaatatcagtcccattttccacatgagcacactgaggcttagagaagagtttcccaattagcaggtggccaaaccaggattggaactcagccctgcctaagtagttaacccatctcctaaatagcctgaattctaatccctccacctgccttccaaggagcacaaattgaggacatgaaaaagaatgtttttttgtggttctcagttctgtttccagaargacctaaaaaaaaatagtagctgtaatttatcaagtacctactatatgccaaacaccgcatttgccattcccactatggccctaagaaggtgatatatgaaggaggcggctgcagccctattttgtaaggagaaaagcggtccccagggaggtttgtgagttgcctaaaggcacatgtggagaagctgagagttaggcctgagttagacttgacagcacctgatacacttaaccttgaaagcagcccagctggctccagagaaactcccagttcacctcacctctttcgcactggctgct

SEQ ID NO: 156977 - DNA, 601 bp, Human
cctgtgaagacatcttggtattggaaacatcagctctggcagggtgggggcagcagagaagtaggggtctagacttgagcaggaggttccagcctcttctggccggctaccctcagacccctgctgagcttcaccatccttgggggacaggctaggctgaaggtggtggctggggctgtccacctgcccagcctcccggggtcagtatgcagggctgtggcagaacaatgctccacgacgcttaggtgtgcctgggggctccccagaccactggggccagacaaggagggaaagaggcaactcactggccccaacgccagccacactgaagggctgcccagcggggcagggacggcaggcgtgcagggagtgggtaaacctcctctctaccaggggaggctggcagagtcaggcttgcagatagagcaactcaggtggctgaggaggggccgaggaaaaaaaaaaaaaagaaatgaaaaatcagtggctcaagtattctgtgtcatgaggggtgggctggggtacctgggcccagcccaggagatgtcctctccatctggaggggccagctcaaagaggctggaatttggcagatggcttc

SEQ ID NO: 156978 - DNA, 601 bp, Human
cgaccctgcttttccgctgtggttctgtcctgtttgattttcttcacaaatcaccacctgaatttccatgtgcatttatttgtttattgactcttttcccaggaggtcagctccaccaggataggtctttgttggttctttcaccgctgtacctgtgtacaggacagagcctggcacacaccaggtgccagtgaatatttgctgaaggaagtcacaaatagggatcagccatcattactttatcatcatgatcaacaggaaagaccactgtcctcacccaatcccctccaaaaggctttgragcagatgtcaacattaattcactgtctcaggtgacagctctcatcctgaggccagggttggggggagctgggaatggggcgagagtggggcctcacgtcccaggctccttgataccccccaccccacccagccaggaaacaccacgaggcagccaaggttaagtagactcttgctgctttgttataaatatattatgtacatccaaaacatgacattaaaatattactccgtgttacagaaaagatattaaggctttctattatttacattaaacaagcaagcacctttaaaaaaaaac

SEQ ID NO: 156979 - DNA, 601 bp, Human
ccactcatgaggatcgtttgtgtccaggagttcaaggttgctgtgagctattacacctcacctctgcactttagcctgggtgacagagcatgaccctgtctctaaaaacatagtaataaatacaaataaataaaatgaccagcaggtccccactcacctcagcctatgagtctctgtataccaaatccatgttttcccaaccttgtcttccatttttccttagctcactctagtccagccacagtggctgcctcaccatctcttaaaatcccaagcttgttctttttttttttttctaagygaagtctcgctcttatcccccaggtttgagtgcaatggctcgatctcggctcactgcaaccttcacctcccgggttcaaatgattctcctgcctctgcctcccaagtagctgggataaagtcgtctgccaccacgcctggctaatttttgtaaattttagtagagacagggtttcaccatgttggccaggctggtctagaactcctgacctcaggtgatctgtccgcctcagcctcccaaagtgctgggattactggcgtgagccactgtgcgtggccccaagcttgttcttgcctcagg

SEQ ID NO: 156980 - DNA, 601 bp, Human
tggctaatattgcagaaactatctagcctagactagctattgactatgtctgtagcgttcactacagaatcgcagtacctagttcataggagatgccttataattacttattcaacaaataaacaagttactaattggtctataatgtcctgacccggtgcagtggctcatacctaaaattccagcactttggaaggccaaggcggatcacttgaggccaggagttcaagaccaacctggacaacatagtgagaccccatttctttaaaaaaaaaaaaaaatagccaagccaggtgtggcrgcatgtgctagtcccagccactcatgaggatcgtttgtgtccaggagttcaaggttgctgtgagctattacacctcacctctgcactttagcctgggtgacagagcatgaccctgtctctaaaaacatagtaataaatacaaataaataaaatgaccagcaggtccccactcacctcagcctatgagtctctgtataccaaatccatgttttcccaaccttgtcttccatttttccttagctcactctagtccagccacagtggctgcctcaccatctcttaaaatcccaagcttgttct

SEQ ID NO: 156981 - DNA, 601 bp, Human
ccaacaggctttcttttttctggctaatattgcagaaactatctagcctagactagctattgactatgtctgtagcgttcactacagaatcgcagtacctagttcataggagatgccttataattacttattcaacaaataaacaagttactaattggtctataatgtcctgacccggtgcagtggctcatacctaaaattccagcactttggaaggccaaggcggatcacttgaggccaggagttcaagaccaacctggacaacatagtgagaccccatttctttaaaaaaaaaaaaaaatagccaagccaggtgtggcggcatgtgctagtcccagccactcatgaggatcgtttgtgtccaggagttcaaggttgctgtgagctattacacctcacctctgcactttagcctgggtgacagagcatgaccctgtctctaaaaacatagtaataaatacaaataaataaaatgaccagcaggtccccactcacctcagcctatgagtctctgtataccaaatccatgttttcccaaccttgtcttccatttttccttagctcactctagtccagccacagtggctgcctcaccatctct

SEQ ID NO: 156982 - DNA, 601 bp, Human
atacaaaaagaaactagctgggggtggtggcacatgtctgtcgttcccgctattcaagaggctgaaatgggaggattgcttgagcctgggaggttgagtctgcagtgagcgcagatcatgccactgtgttccagcctgggtgacagagcaagaccccgtctccaggaaaaaaaaaaggcggggtgatggagtttcagttgggggcaggcgcccaaaggtatgtgcccaggccccttctaaagaacagtgagcacacaggggtatgcaagttcactacagctcccccggttgagctggaaayccatgtttgccctgcatgccactaccctgtgccaccaccagacagcagcacatgcctacctgaaaccaagccatcccacagcagctgggagggaggctgcaggcagttggcctatgcactcattttgttttgcccacagtacgttttaaacacggagccagcatttttaaagtttagatttctggctcctgtttaaccagctgctgtgagtagcagctgccctttaggcctgatgtctccaggtcatcccagtccccagcgtcagcggccctttctcaggcatgctgcagttgcctcata

SEQ ID NO: 156983 - DNA, 601 bp, Human
tccaagaaaaataggaaaaggacatgaacagatgaggaaatgcaaatgcattttaaactcacagtaagatacccaatctcacaaaacatattgtatttcagtgatttgaagctatacgtttttactttttttttgttttttttttgagacagagtctcgctgtgtcgcccaggctggagttcagtggcgcgatctcagttcactgcaacctccgcctcctgggttcaagcaattctcctgcctcagcctcccaagtagctgggattacaggcacccgccaccacacccagctaattatttyttttgtatttttggtagagacggggtttcactatgttggccaggctggtcttgaattcctgacctcgtgatccgcccaaagtgctgggattacaggcgtgagctaccacacccagccacatttttacatgtgaacttctgaaatcaggatgcatcttagaatcagtgacatcttagaatcaatgaaatacagtaagaggaatgcaaattaaaaccacctatcagattggcaaagaacaaaacatttgataacacgctgtgttggcaagggtgtgaggaaacagggactctgaaaacttgt

SEQ ID NO: 156984 - DNA, 601 bp, Human
aaataactcaaagatgacagttacagcaaatatttattgagcatttgccatattccaggaacatggtattttgcatataataatgtatttaatcttcacacctatcctatgaggtaggtaccattattattcccattttgcaggtgaggaaactgagacacagaacggttaagtaacttgcccaaagtcacaagcttgtaagtggcagaactgggatttgaaccctacactcttaaccaatgctaccctcccttccaagaaaaataggaaaaggacatgaacagatgaggaaatgcaaatrcattttaaactcacagtaagatacccaatctcacaaaacatattgtatttcagtgatttgaagctatacgtttttactttttttttgttttttttttgagacagagtctcgctgtgtcgcccaggctggagttcagtggcgcgatctcagttcactgcaacctccgcctcctgggttcaagcaattctcctgcctcagcctcccaagtagctgggattacaggcacccgccaccacacccagctaattattttttttgtatttttggtagagacggggtttcactatgttggccaggctg

SEQ ID NO: 156985 - DNA, 601 bp, Human
ccgggcatggtggctcacacctgtaatcccagcacttagggaggccaaggccggtggatcacctgaggtcaggaattcgagaccagcctggccaacatggtgaaaccccatctctactgaaaatagaaaaattagccgagcatggtggctcatgcctgtaatcccagctacccgggaggctgaggcaggagaatcacttgaacctgggaggcagaggttgctgcagcattgcactccaggttgggcaacaaagcgaaactccatctaaaaacaaacaaacaaacaaacaaacaaacaaacaggatgtgtgatgcatttgctagtgaaattctatggcatttatgtggagtcatggctccctgaggtgtgtctagccatggcgctgagacatcttatttaatgtctgatgtagtttccgaaatatacagtcaaaaagcggtggggatgggtgggcagggggtcttggtgtacttcattaactcactctatcaatggacatctaagttgtttccattggcttcttctgatacaatttttgtaatgtcttaattttgtattatatgttacttctgtggtcaaggaaaaaggaatgaaaactggg

SEQ ID NO: 156986 - DNA, 601 bp, Human
cagggaagaggaagggacactagaagagctcataattaccaagccgttacatccaacttttaatcctcacaactcgatgcagcaactcctgtgaatatccccatttttagagatgagaaaactgagactcagagctaacaggtggagaggatgaggattaaaacacaagccttttatctatggtgcccgtaaatgtttactcgcatggattccttggctcttgtaggaaacttcttgcaagtaaaattgacaataataattcccgtgccgagctcatcgcaggaagaggttaggcgggacrgcccgaggcatgctggttgttgtagtctagcgttggcgcagtgcctgatgggagttgtagtacgtcccgcgcacacgctccctcgaagagtttctgccccattcctggacgtcacagccggtccccagagcaggattccttccggcgcctgcgcctgatcaccgctctgcgcttgagctgataaactcagctgatgggataagagtcttgttttatcggattttggggaagattaaaatggttaatagaactagagaatttagaagagggcttggcactaagtgcaatataagtattagc

SEQ ID NO: 156987 - DNA, 601 bp, Human
gatgcctggacaccctgtgcaccaggctctgcacccagggcagggacgaggatggggtggtcagatttaacggggctttcactcaggtcctgactccgcacttgcacagcgctgcaggtgagtgactccttaaaatctgcaccctagggcagggcatggtggctcacacctgtaatcccagcactttgggaggccgaggtgggcagatcacctgaggtcaggagttccagaccagcctggtcaacatggtgaaacctcgtctctactaaaaatacaaaaattagcggggcgtggtagcacrcacctgtaatcccagctactcgggaggctgaggcaggaaaatcgagcgaacccgggaggcagaggttgcagtgagctgagattgcaccattgcattccagcctgggcaacagagagagattcagtctcaaaaaaaaaaaaaaaatctgcaccctaggtaccccacttgcctcaccatagccttggcacagcctgcgcctctgagactttctgtacctctgcggcgacactggccctttgcaagccccctggaacacatgccctctcccacttcaggggctttgcctgtgctgttcccact

SEQ ID NO: 156988 - DNA, 601 bp, Human
aaggtcagaattaatgtgaaaaatgcagccgagagagatcaagcgatttatctaaactcagctgttaagtggcagagacaggcagaattttaacctccaggttcaaattttttgaatcatcaccctccaggtcagatgatctggctcctaggattgatgctccccggccagagaaggcttggagtgggtgcagctaaatgatttaggggcattaaggtggcagggaaagcatttgctaaccatctacccaattcattcattcattcattcattcattcgttcattcattcattcaaccaamcaaacaaacattaagcacctactatgtaccagacactgtgctaggcgctggggatggatagacatctctgaagaagcaaatccctgctttcagggacttacattctagtcgtagacagcaagtaaataaacaggaaactataattctgatagggtagagataaaccaagacaagagcagcagaggatggtcaggaagggcctcctaaggtggtcatatttcagcagagaccgtaacaatgaggaggtagagggaacagcttgtgcaaaggcccttgggaaatatttttgcaaataaataa

SEQ ID NO: 156989 - DNA, 601 bp, Human
ccgcaaggtcagaattaatgtgaaaaatgcagccgagagagatcaagcgatttatctaaactcagctgttaagtggcagagacaggcagaattttaacctccaggttcaaattttttgaatcatcaccctccaggtcagatgatctggctcctaggattgatgctccccggccagagaaggcttggagtgggtgcagctaaatgatttaggggcattaaggtggcagggaaagcatttgctaaccatctacccaattcattcattcattcattcattcattcgttcattcattcattcaaycaaacaaacaaacattaagcacctactatgtaccagacactgtgctaggcgctggggatggatagacatctctgaagaagcaaatccctgctttcagggacttacattctagtcgtagacagcaagtaaataaacaggaaactataattctgatagggtagagataaaccaagacaagagcagcagaggatggtcaggaagggcctcctaaggtggtcatatttcagcagagaccgtaacaatgaggaggtagagggaacagcttgtgcaaaggcccttgggaaatatttttgcaaataa

SEQ ID NO: 156990 - DNA, 601 bp, Human
tccgcaaggtcagaattaatgtgaaaaatgcagccgagagagatcaagcgatttatctaaactcagctgttaagtggcagagacaggcagaattttaacctccaggttcaaattttttgaatcatcaccctccaggtcagatgatctggctcctaggattgatgctccccggccagagaaggcttggagtgggtgcagctaaatgatttaggggcattaaggtggcagggaaagcatttgctaaccatctacccaattcattcattcattcattcattcattcgttcattcattcattcawccaaacaaacaaacattaagcacctactatgtaccagacactgtgctaggcgctggggatggatagacatctctgaagaagcaaatccctgctttcagggacttacattctagtcgtagacagcaagtaaataaacaggaaactataattctgatagggtagagataaaccaagacaagagcagcagaggatggtcaggaagggcctcctaaggtggtcatatttcagcagagaccgtaacaatgaggaggtagagggaacagcttgtgcaaaggcccttgggaaatatttttgcaaata

SEQ ID NO: 156991 - DNA, 601 bp, Human
tcctcaccacatctccgcaaggtcagaattaatgtgaaaaatgcagccgagagagatcaagcgatttatctaaactcagctgttaagtggcagagacaggcagaattttaacctccaggttcaaattttttgaatcatcaccctccaggtcagatgatctggctcctaggattgatgctccccggccagagaaggcttggagtgggtgcagctaaatgatttaggggcattaaggtggcagggaaagcatttgctaaccatctacccaattcattcattcattcattcattcattcgttcrttcattcattcaaccaaacaaacaaacattaagcacctactatgtaccagacactgtgctaggcgctggggatggatagacatctctgaagaagcaaatccctgctttcagggacttacattctagtcgtagacagcaagtaaataaacaggaaactataattctgatagggtagagataaaccaagacaagagcagcagaggatggtcaggaagggcctcctaaggtggtcatatttcagcagagaccgtaacaatgaggaggtagagggaacagcttgtgcaaaggcccttgggaaat

SEQ ID NO: 156992 - DNA, 601 bp, Human
tagatcctcaccacatctccgcaaggtcagaattaatgtgaaaaatgcagccgagagagatcaagcgatttatctaaactcagctgttaagtggcagagacaggcagaattttaacctccaggttcaaattttttgaatcatcaccctccaggtcagatgatctggctcctaggattgatgctccccggccagagaaggcttggagtgggtgcagctaaatgatttaggggcattaaggtggcagggaaagcatttgctaaccatctacccaattcattcattcattcattcattcattcrttcattcattcattcaaccaaacaaacaaacattaagcacctactatgtaccagacactgtgctaggcgctggggatggatagacatctctgaagaagcaaatccctgctttcagggacttacattctagtcgtagacagcaagtaaataaacaggaaactataattctgatagggtagagataaaccaagacaagagcagcagaggatggtcaggaagggcctcctaaggtggtcatatttcagcagagaccgtaacaatgaggaggtagagggaacagcttgtgcaaaggcccttggg

SEQ ID NO: 156993 - DNA, 601 bp, Human
ccgcgccggtggctgccgcggagcccagcagacagaggcggcgcggggaccctggctccgctgcaggaggctttgagggtccccggcccccggcccaagcccatgccccctcggccggccgggcccggcgcccccgctcacccgagcccgtggtggctgccatcttgcgtcgctgttgcttgaaggccggccccttcttcaccccccccttacccgtcccccggccctgatgcgcaggcgcgcgcgcacgcacatacgccgccgctgacgcccgccccggagacctgcacgacccgtggcmtggaaggctcttttccttcccttttagagaaaggaaatatctgcgtgctcgagggcccagcaacctgcaagtccccacacatcgggtgcgagggaggttgtgatgtgcttagtgagaagggcaggggtgactaggcttgggaaggcgcgattgtgaaagaaaaagaaaatatagcttcaaacaaaagcgccgaattcgcttggggctttttcctgtctagttcctatctagatcctcaccacatctccgcaaggtcagaattaatgtgaaaaatgcagccgagagagatcaagcgattta

SEQ ID NO: 156994 - DNA, 601 bp, Human
tctccaactcatctccttaacaagccttgcttgcacatgaaggccttttatcctgttatttcaacatgccaagcagagtcccaccacagggcctttgcactaacagcccactctctctcctgcctgtgacactgtagggttagctctttccattatttgactcagctgaaatgtcactttcctgaccacctctccagacactatcacatcacacaatttcctccatagcacttactgctatctgaaattgtcttatttactccttaacagccttctctccctgacttgaatggaagctccygaaggatacagactatgtccattttgtttgctatccacgatgggacataataggccctcagtaaatatctgttgaataaacagacaaaagaattttgggaagtccattttagggcacctcaaagcctgtcctatgttatctaaaccatgccaagtgctcttgtattccactagacagcagctgacattttatctgatcaccatagccatttatgaagcactcactttttaactgtcagggtctggagaagttagaaccgggcagctgttaacccagattgtaggtagccaaccgagtgac

SEQ ID NO: 156995 - DNA, 601 bp, Human
gcagcccggcacggtgacttacgcctgtaatcccaggactttgggaggctgagacgggcggatcatgaggtcaggagtttgagaccagactgaccaacatggtgaaaccctgtctctactaaaaatacaaaaattagccaggcgtggtggcgcgtgcctgtgatcccagctactcaggaggctgaggcaggagaatcgcttgaacctgggaagcagaggttacagtgagccaagatcacgccactgcactccagccaggtgacagggcgaaactccgtctcaaaaaaaaaaaaaaaaaaaagcttgcactagcccaacaaagccagtttcccctccatcactggagcaggctgctatttctttggctgagcacaatatgaagctgttctttgaatgtagggcccatgttgtacaaaaggcacttaattacaattggcataagatgctcacacagtgagacatacaggaactgagaagaactaagggactgtgagttttcatccatttccagctctctctggggaagactcctgaatggaagggaagactaatctctgctgcccacatggttaagtttttataagctgaatgtgcatatgag

SEQ ID NO: 156996 - DNA, 601 bp, Human
taatcccttaagaaaataatagcttgcagcccggcacggtgacttacgcctgtaatcccaggactttgggaggctgagacgggcggatcatgaggtcaggagtttgagaccagactgaccaacatggtgaaaccctgtctctactaaaaatacaaaaattagccaggcgtggtggcgcgtgcctgtgatcccagctactcaggaggctgaggcaggagaatcgcttgaacctgggaagcagaggttacagtgagccaagatcacgccactgcactccagccaggtgacagggcgaaactcygtctcaaaaaaaaaaaaaaaaaaaagcttgcactagcccaacaaagccagtttcccctccatcactggagcaggctgctatttctttggctgagcacaatatgaagctgttctttgaatgtagggcccatgttgtacaaaaggcacttaattacaattggcataagatgctcacacagtgagacatacaggaactgagaagaactaagggactgtgagttttcatccatttccagctctctctggggaagactcctgaatggaagggaagactaatctctgctgcccacatggttaagtt

SEQ ID NO: 156997 - DNA, 601 bp, Human
cccaacactttgggaggcagagatgggtggatcacctgaggtcgggagttcgagaacagcctgaccaagatggagaaaccccgtctccactaaaaatacaaaattagctgggtgtggtggcgcatgcctgtaatccgagctactcagggggctgaggcaggagaatcacttgaacctgaacctgggaggcagaggttgcggtgagccaagatagcaccattgcactccagcctgggcaacaagagtgaaactctgtttcaaaaccaaaaaccacaacaacaacaacaacaacaacaacaamaaaaaaaacaaaaaaaaggtagaacctcagaggtttctcctgaaaagaaagctgctagttaaaaatggtttggttgcccattcagggaagacagtgaactgagctaggaatctgatgctgctcccacttcagaaaatgaggaggtatggaaggtgatgcactgggattcaacgtccctgaaaactggacatagagccataagcaagtaacttttatttctgagcaaccgcccaagtgtagtctggctgtctagttagcctgcccaggagatctgttcttctccttctctagagcaatggt

SEQ ID NO: 156998 - DNA, 601 bp, Human
aaaaaaaaacttcatcaaggtgctaaaatatcacagtaatccaagactttttgaagaaaatatttgttcctattatttcagaattattctttccagaaggctttttcctggacctgtgtcagtatcaaaagtcagccggttattctcttagctaaatataaactgaaaagacagcagttgcaggatattacaaagaaaatatggcaaccaggttgaaaaagcatgaatatttgatagagctttacaccatgccacagtaaaacatttaatgcagtaatctgaaacacagcaacatattaawatatttgtggtacaaaaaggattctgaagtcgtttaaaacatcttttgggaaaatcatggccaccaagcagcagctaccacagcatgtcaatcttggaaaaccctggcctaggtcttgaattaaaatggtagagctggctgggcgtggtggctcacacctgtaatcccaacactttgggaggcagagatgggtggatcacctgaggtcgggagttcgagaacagcctgaccaagatggagaaaccccgtctccactaaaaatacaaaattagctgggtgtggtggcgcatgcctgtaatc

SEQ ID NO: 156999 - DNA, 601 bp, Human
caatcccagctaattgggaggctgaggcatgacaatcacttgaacccgggaggtggaggtttcagtgagctgcgatcatgccactgcagcccagcctgggcaacagagactcgtcaaaaaaaacaaaaaacaaaaaaacaaaaaaacaaaaaacaaacaaacaaaaggactcttataatcttgcaaaaccaagagaactacaggctctataatagctaggaagtacactaggaaaatctatagctaatgataagtataatcaaatagactatgactattaaaaagtgaattatgaaaatgytaaaaaaaaaaacttcatcaaggtgctaaaatatcacagtaatccaagactttttgaagaaaatatttgttcctattatttcagaattattctttccagaaggctttttcctggacctgtgtcagtatcaaaagtcagccggttattctcttagctaaatataaactgaaaagacagcagttgcaggatattacaaagaaaatatggcaaccaggttgaaaaagcatgaatatttgatagagctttacaccatgccacagtaaaacatttaatgcagtaatctgaaacacagcaacatat

SEQ ID NO: 157000 - DNA, 601 bp, Human
atcaggccaggcgtggtggctcatgcctgtaatcccagcactttggaaggctgagacaggcggatcacgaggtcaggagatcgagatcatcctggccaacgtggtgaaaccctgtctctactaaaaatacaaaaattagctgggcgtggtggcgcgcgcctgtaatcccagctactcgagaggctgaggcaggagaattgcttgaacctgggaggcggaggttacagtgagccgagatcgcgccactgcactccagcctggcaatagggccagactccgtctcaaaaaaaaaaaaaaaaaaggcagtatttcctattgtaaactctaatctactgggtccaaaatattggacactgttgccatataattaacataccttggctgggcgcggtggctcacgcctataatcccagcactttgggaggccgaggcgggcggatcacgaggtcaggagatcgagaccatcctggctaacacggtgaaaccccgtctctactaaaaatacaaaaaattagccgggcaaggtggcggctgcctgtagtcccagctactcgggaggctgaggcaagagaatggcgtgaaccccagggggcggagcctg

SEQ ID NO: 157001 - DNA, 601 bp, Human
gcatataatgatactcaatatcaataaatgtttgctggttgaagaaatggcagtatcaggccaggcgtggtggctcatgcctgtaatcccagcactttggaaggctgagacaggcggatcacgaggtcaggagatcgagatcatcctggccaacgtggtgaaaccctgtctctactaaaaatacaaaaattagctgggcgtggtggcgcgcgcctgtaatcccagctactcgagaggctgaggcaggagaattgcttgaacctgggaggcggaggttacagtgagccgagatcgcgccackgcactccagcctggcaatagggccagactccgtctcaaaaaaaaaaaaaaaaaaggcagtatttcctattgtaaactctaatctactgggtccaaaatattggacactgttgccatataattaacataccttggctgggcgcggtggctcacgcctataatcccagcactttgggaggccgaggcgggcggatcacgaggtcaggagatcgagaccatcctggctaacacggtgaaaccccgtctctactaaaaatacaaaaaattagccgggcaaggtggcggctgcctgtagtcccag

SEQ ID NO: 157002 - DNA, 601 bp, Human
ttccttttttattgtctgactcactctctaagtttctcaagtcagagctgtgactcattcaatcccgcctccccagaatctggtatgctgtctggcatataatgatactcaatatcaataaatgtttgctggttgaagaaatggcagtatcaggccaggcgtggtggctcatgcctgtaatcccagcactttggaaggctgagacaggcggatcacgaggtcaggagatcgagatcatcctggccaacgtggtgaaaccctgtctctactaaaaatacaaaaattagctgggcgtggtggygcgcgcctgtaatcccagctactcgagaggctgaggcaggagaattgcttgaacctgggaggcggaggttacagtgagccgagatcgcgccactgcactccagcctggcaatagggccagactccgtctcaaaaaaaaaaaaaaaaaaggcagtatttcctattgtaaactctaatctactgggtccaaaatattggacactgttgccatataattaacataccttggctgggcgcggtggctcacgcctataatcccagcactttgggaggccgaggcgggcggatcacgaggtcagga

SEQ ID NO: 157003 - DNA, 601 bp, Human
gcatatccaagtctcctaggtaatgatcagctttggggtgtgctactgctaacgtctcaggatatagagccagaagcatttgcctagagcaaacactgtgaccgaacatgtggcatcaaacttcttataggcctgcgtgatgggaagtagaagagatgtagaagatagggtaattaattcaacagctcatattcatttgcatgactgtggtggtagttcaaaaaacaacaacaacaaaaaacaaaaaaactggcctgtacccagtacttcagataaatacctgttgaaaattttttaaatsgagtaaaaaaggacaaaaggtctgcaaacctcattttctaaaaaacaaacacaaaagcaaccttgtatgcatccttgcatgttcattgtactctcaccaatgatcttggggtgtcatgacccagaatcactaacgtaaggatacctggtctaccactctgtttttaaaagacaggtcagagtaatggatatattacctcccacatgcgctaccatgcctgactaattttgtatttttagtagagacggggtttttccatgttggtcaggctggtctcgaactcccgacctcaggtgatcc

SEQ ID NO: 157004 - DNA, 601 bp, Human
gtgttagtttcttatgtcaggtatttaaatgtcagctggactatttatagtaggactattcctcttgcaaacttaagcaaagaacttctctatggctgaaaggttaccttttcacctaacaatcagatctgattaggaaatcctaacattcaaatatcacaagcttgttgctattagtttcaaaacagtgaattcaagttataattttctgatatttaatttttacttgtgaagtagggcaaaatatattagtaattaatcctatacttccaacatacatttctattggattagatattcrattacttaaaaacaagtgtgcaaagcccacacatacaactgaaccaaagaaataagtcaggtcaatttattttaggctaggatttggaacaggaattgagacccacagagggaaaggtcagctttcttttgttcctgcattataggacaatttgattctgactcaagttgtaaagccagcaccagaaacagtttaataaatgaaaaactttggactggccaatatctatctgtattgcaactaggagttgtgatatacatataaatatctataactgctatctactgaacaattacaata

SEQ ID NO: 157005 - DNA, 601 bp, Human
tctatggtattttgttatgacagcactagcaaactcatatagatgataagtgacatcttaaggagctttatagagttggtaaggatacagaacaagatgttaacagctgttatctctgggtaaaagaattatggatgattccccctactttctctatttcctgatttttttacaacaatcccatgttatttgcataacaaaaaaccaattaggaaccatttcaactgcacccccacgcaaggacctacccagggcctgtgcgactgtcattcctgctgtccagaaggctccttcccctagraatccataagccaagctccctcagcttctttagggctttggttgtccagcacttcatctcaataaggatcaagggttcttctctgagtaggaatctcacttaacggcattccttaagtgactaacttttaatggacaatgattttaatgttactaaaacttggtcagctgggtatggcagctcacacctgtaatcccagcactttgagaggccaagacaatcgtctgaggccaggagttcgagatcagcctgggcaacatggagaaatctcatgtctacaaaaaaatacaagaattagct

SEQ ID NO: 157006 - DNA, 601 bp, Human
actaaagacctaaagaaggtgagagggcatgatttatggatagctgaggagaaagtctttgagacagagcaaacaagtgcaaaggccctaaaatagaggctgcttagggtgtcaaaggacagcaaggaggccaatttagctcaaaccaagtgaggaagatgagagagcaagaggagattaaggatgccaactgttactgagtgacatgatctgtcttgtttttaataggatccctcagactgctgtgtgaggatgagagtgaagggagcaagggcagaagcagctaggaggctactgcaayaatcctagcaaaagataatacccgtttggaccagggtgatagcaggaaagtagtgaggagtggcgtaattctaggcatttcagaggtctgagctgtggagatttgctatcaggttgcctgtgaggtgtgagagacaagagtcaactacagctcccaggtttttggtccaagcaactgaaggacagagttggtagtggtatgttagaggactttcggtggtatgtgattgaacacttcgttttacagtcacgtatttatgtttaagaataacttatttagggtaagtaatatactaacttc

SEQ ID NO: 157007 - DNA, 601 bp, Human
tatgaagactgggaactctcacaaatcaggaaggtctgaaagaggccacttttccccatcctcattgtcttcgtcttctttgcaaaggcctctgggtctagtagtgcctggaatagaccaggagctgacaggcttgccagggacctttgctgaatggcccaaggaactaggatacaggtgcacggcagacctgggagacagtgaagaaaaaccacaactgggaaggctttccagagttaatttggagactggcttcaggaatgctggctatacctagggcctagttatttggttagcccaragattgttctgaacgacatctgatggtgcaatgacttcacacctcactgtctacattgtcatataaattcacactatgagtctaaacaggtttttgcttaccatttagaggggttaaacagcatcagaggaggttcaaatatataaactgaaactggtcaaaaaagaatagccacatttcagaaaatataccattggtgagctttttttccgtgataaggctaatattttttaaaaggaggcacagtgaatttaagacattgacatttatagccgtagctcgacgcttactcttggaggc

SEQ ID NO: 157008 - DNA, 601 bp, Human
tggaaatcaatttcttgactcctacatcaagttactacttgattagtatcttctataatggtaacagatgaaaactcaaaatgtaaacaaaagggagacaccacagcacagtggttaagagcacaggctctggagtcagatctggtttgggggttaccagctatgtgactttgggcaagagatctgactcctctgagtctgtctcctcatctgtgaaatggaatgcaattgcacctaacaatggggtcttgtgagagttaagagacatttcttgagggtttactatgtgtcctcaaaaaayggttggctggcattatgaagactgggaactctcacaaatcaggaaggtctgaaagaggccacttttccccatcctcattgtcttcgtcttctttgcaaaggcctctgggtctagtagtgcctggaatagaccaggagctgacaggcttgccagggacctttgctgaatggcccaaggaactaggatacaggtgcacggcagacctgggagacagtgaagaaaaaccacaactgggaaggctttccagagttaatttggagactggcttcaggaatgctggctatacctagggcctagtta

SEQ ID NO: 157009 - DNA, 601 bp, Human
tgggagggagaatggggggtgcctaccgatgggtatgggttcctttttgaggtgatgaaaacgttctgaaattagtgacggatgcacaactctgaatgtaagaccaccgaactgtacatttaaaagggtgaattctatcccaataaagctgttactaaaaacaaatacatggaggactcctggcataccgtagctacgcattacaacttccaaagcctcttttggaaagagataaactgaaattcagggtagcccaagctgttttaggcagacagaatattttcagcagaatttactgatkcattgttttgtgtgtttttttgaaagtgtacaattcagtggtatttagtgtatcgcaatgttgtacattggttcaattctcagtattttagaacctgtaaatcagtaagttgattaacaaatctactgagtaccccattctgagtcatttctaggtattctgggaagtaaggagggaagcacagttctcatcctcaagaaaccgaaatcattcttaggaagagaagacatgcagtgaagaagatgtcagcatatgatggaccttcagagacagcaaagaaaattatctccatggagaaac

SEQ ID NO: 157010 - DNA, 601 bp, Human
cttgaaaaaattatgctgagtaaaggaagccagtcacaaaaggccacatactgtagaattccatttataatagatgttcagaaaaagcaaattcattgagctagaaagtagactgatgattgtcaaagatgggaaatgggggatgtgggagggagaatggggggtgcctaccgatgggtatgggttcctttttgaggtgatgaaaacgttctgaaattagtgacggatgcacaactctgaatgtaagaccaccgaactgtacatttaaaagggtgaattctatcccaataaagctgttacyaaaaacaaatacatggaggactcctggcataccgtagctacgcattacaacttccaaagcctcttttggaaagagataaactgaaattcagggtagcccaagctgttttaggcagacagaatattttcagcagaatttactgatgcattgttttgtgtgtttttttgaaagtgtacaattcagtggtatttagtgtatcgcaatgttgtacattggttcaattctcagtattttagaacctgtaaatcagtaagttgattaacaaatctactgagtaccccattctgagtcatttctagg

SEQ ID NO: 157011 - DNA, 601 bp, Human
agaataaaagtattgatagatgctacaatatgcttgaaccttgaaaaaattatgctgagtaaaggaagccagtcacaaaaggccacatactgtagaattccatttataatagatgttcagaaaaagcaaattcattgagctagaaagtagactgatgattgtcaaagatgggaaatgggggatgtgggagggagaatggggggtgcctaccgatgggtatgggttcctttttgaggtgatgaaaacgttctgaaattagtgacggatgcacaactctgaatgtaagaccaccgaactgtayatttaaaagggtgaattctatcccaataaagctgttactaaaaacaaatacatggaggactcctggcataccgtagctacgcattacaacttccaaagcctcttttggaaagagataaactgaaattcagggtagcccaagctgttttaggcagacagaatattttcagcagaatttactgatgcattgttttgtgtgtttttttgaaagtgtacaattcagtggtatttagtgtatcgcaatgttgtacattggttcaattctcagtattttagaacctgtaaatcagtaagttgatta

SEQ ID NO: 157012 - DNA, 601 bp, Human
tcagagaaaggatcacttttcttttacttcctacacccctgtaattatgttcagttcctctgaagcatgggtaccagtactccagggtataaacacacatccaggctctaatccacacataaaacacttggccgggtgtggtgggctcatgcctgtaatcccagcactttgagagaccaaggtgggcggatcacctgaggtcaggagtctgagaccagcctggccaacacggcaaaaacctgtctctactaaaaatataaaaattagccgggtgtggtggtatgtgcctataaccccagcractagggaggctgaggcaggagaatcgcttgaacccgggagacagagactgccgtgagctgaaatcacgccactgcactccaccctgggcaacagaataagactccatctcaaaaaaacagaaaaaacactattttggagaaccccagaggctcaacagtgctcctcgatgagggccatttttgcccctctgctgggaaggggaagggaggatcaagcgttgcctagacacatttatggttgctgcaatggagacgggggtactgctggcttctagtgagtagaggccagggatgctgct

SEQ ID NO: 157013 - DNA, 601 bp, Human
gcttttgtcattaaaaatttttacaagaatatattcatattcattaatcagtcatataacttaaggcttttttttttttttttttgagatggagtctcgctcttgttgcaagcagtggcgcgatctcggcttactgcaacctctacctcccaggttcaagtgattctcctgcctcagcctcctgagtcaggcatctgccaccgcgcccagctaatttttatacttttttagtagcgaccgggtttcgccatattggccaggctggtcttgaactcctgacctcaggtgatctgcccgcctyggcctcccaaagtgctggaattacaggcgtgagttaccacgccccgcctcaaagcttttaaaaaagagatcagtcaatatgcactgatatagaaagatgtccaccatctattaggtgaaaaaaaattaagttgtaaaacattatgcataggaagatcccatttttcttaaaaagatatatatttacgtttgcatacccacagcaaaagtgggtagaaccacaccacacaccaacttaagtttcattcgatggtgagcataatgaatcagagaaaggatcacttttcttttacttcctaca

SEQ ID NO: 157014 - DNA, 601 bp, Human
ttgagtagctgggactacaggcgtgcatcactacgcccagctaatttttgtatttttagtagagatggggtttcaacatgttggccaggctggtctcgactcctgacctcaagtgattcacctgcctcggcctcccaaagcgctgggattacaggcgtgaatcaccacacctgggcttttgtcattaaaaatttttacaagaatatattcatattcattaatcagtcatataacttaaggcttttttttttttttttttgagatggagtctcgctcttgttgcaagcagtggcgcgatctyggcttactgcaacctctacctcccaggttcaagtgattctcctgcctcagcctcctgagtcaggcatctgccaccgcgcccagctaatttttatacttttttagtagcgaccgggtttcgccatattggccaggctggtcttgaactcctgacctcaggtgatctgcccgccttggcctcccaaagtgctggaattacaggcgtgagttaccacgccccgcctcaaagcttttaaaaaagagatcagtcaatatgcactgatatagaaagatgtccaccatctattaggtgaaaaaaaat

SEQ ID NO: 157015 - DNA, 601 bp, Human
cagcctcttgagtagctgggactacaggcgtgcatcactacgcccagctaatttttgtatttttagtagagatggggtttcaacatgttggccaggctggtctcgactcctgacctcaagtgattcacctgcctcggcctcccaaagcgctgggattacaggcgtgaatcaccacacctgggcttttgtcattaaaaatttttacaagaatatattcatattcattaatcagtcatataacttaaggcttttttttttttttttttgagatggagtctcgctcttgttgcaagcagtggcrcgatctcggcttactgcaacctctacctcccaggttcaagtgattctcctgcctcagcctcctgagtcaggcatctgccaccgcgcccagctaatttttatacttttttagtagcgaccgggtttcgccatattggccaggctggtcttgaactcctgacctcaggtgatctgcccgccttggcctcccaaagtgctggaattacaggcgtgagttaccacgccccgcctcaaagcttttaaaaaagagatcagtcaatatgcactgatatagaaagatgtccaccatctattaggtgaa

SEQ ID NO: 157016 - DNA, 601 bp, Human
gttaaagcgggactaagttaacctcttattctatatactctgtattgttggaaaaaaaattttttttgagacaagagtctcactctgtcacccaggttggagtccagtggtatgatcttggcccactgaaacctctgcctcctgggttcaagcgattctccctcctcagcctcttgagtagctgggactacaggcgtgcatcactacgcccagctaatttttgtatttttagtagagatggggtttcaacatgttggccaggctggtctcgactcctgacctcaagtgattcacctgcctyggcctcccaaagcgctgggattacaggcgtgaatcaccacacctgggcttttgtcattaaaaatttttacaagaatatattcatattcattaatcagtcatataacttaaggcttttttttttttttttttgagatggagtctcgctcttgttgcaagcagtggcgcgatctcggcttactgcaacctctacctcccaggttcaagtgattctcctgcctcagcctcctgagtcaggcatctgccaccgcgcccagctaatttttatacttttttagtagcgaccgggtttcgccatatt

SEQ ID NO: 157017 - DNA, 601 bp, Human
actgtataccttggatatatacagcttttatttatcaattacatctcaataaagctgggaaaaaaattagctggtatgatttctcttttcctgactgacacagagttaaagcgggactaagttaacctcttattctatatactctgtattgttggaaaaaaaattttttttgagacaagagtctcactctgtcacccaggttggagtccagtggtatgatcttggcccactgaaacctctgcctcctgggttcaagcgattctccctcctcagcctcttgagtagctgggactacaggcgygcatcactacgcccagctaatttttgtatttttagtagagatggggtttcaacatgttggccaggctggtctcgactcctgacctcaagtgattcacctgcctcggcctcccaaagcgctgggattacaggcgtgaatcaccacacctgggcttttgtcattaaaaatttttacaagaatatattcatattcattaatcagtcatataacttaaggcttttttttttttttttttgagatggagtctcgctcttgttgcaagcagtggcgcgatctcggcttactgcaacctctacctcc

SEQ ID NO: 157018 - DNA, 601 bp, Human
aatgtaaagcatggtgactacagttaataatactggattgtttacttgaaatttggtaaaagagtagatcttaagtgtccttaccacagacacacaaggtagctacacgtggtgatggatgcgttgattaatttggttgtggtaatcattacacaatgtatatcaaatcatcacactgtataccttggatatatacagcttttatttatcaattacatctcaataaagctgggaaaaaaattagctggtatgatttctcttttcctgactgacacagagttaaagcgggactaagttaacytcttattctatatactctgtattgttggaaaaaaaattttttttgagacaagagtctcactctgtcacccaggttggagtccagtggtatgatcttggcccactgaaacctctgcctcctgggttcaagcgattctccctcctcagcctcttgagtagctgggactacaggcgtgcatcactacgcccagctaatttttgtatttttagtagagatggggtttcaacatgttggccaggctggtctcgactcctgacctcaagtgattcacctgcctcggcctcccaaagcgctgggatt

SEQ ID NO: 157019 - DNA, 601 bp, Human
gcgggatgtgatgaggctggttttgtgaatgtccccagaaagctggaggttgaaacacactgctgatgccaggatgaagggctgttaccagggtggtacagacagaacaaacaggcaaactggatacagcaaatcccttttcccttccccatgcctttcaggctctctcttgtgtccctgactggtggaaccttcagaggaagccagctgacaaaggaaaagtgtagtgtgcagagtcccagccccagcatccaaagcagagtggagagaagtgggcttggagtttcctagccagcagcarcaggcacctctctgcacagcgacgagacacaattatcctttgtacagagactctccctcttcccaccattcatggtatctttctgagtgagcacggggcccatctctaggcaatagtaagttttcacttctctagttaggttgtagaatatttgggtggcactcaaatattcttaaggactgaatggtcaaattaaccacatgatcctaatagaaaataaaaagtaggaggcatttgacccttcacatttgcttgctgttcctttaggtatcaccccagtatgagccccttacctcggca

SEQ ID NO: 157020 - DNA, 601 bp, Human
ctgctttagagaacctcaaaattaagacaagacgagggaggggtgcagactcagagctgcttcccccttctccatcactccggggttaggcactgggtaagggatttcaactggggtgttccatccctccctgcagtctttttttttttttttggtagtctgacctgagagattactggcattcaatgggtgaggcagcacagggaaaagcagtctttttttttgagacagagttttgctcttgttgcccaggctggagtgcaatggtgcgatctcggctcaccgcaacctccgcctcccrggttcaagtgactctcctgtctcctgagtagctgggattacaggcatgtgccaccatggccgggtaattttgtatttttagtagagacagggtttctccatgttggtcaggctggtctcgaactcctgacctcagctgatctgccctcttcggcctcccaaagtgctgggattacaggcatgagccaccgtacccagccaaaaaccgtccttctttaaaaggctaactgtgcctttgttgagaaacactgaaaagtccaaccccctatgccaataacctcttcactgtaccatctacccc

SEQ ID NO: 157021 - DNA, 601 bp, Human; identical to SEQ ID NO: 156975

SEQ ID NO: 157022 - DNA, 601 bp, Human; identical to SEQ ID NO: 156976

SEQ ID NO: 157023 - DNA, 601 bp, Human; identical to SEQ ID NO: 156977

SEQ ID NO: 157024 - DNA, 601 bp, Human; identical to SEQ ID NO: 156978

SEQ ID NO: 157025 - DNA, 601 bp, Human; identical to SEQ ID NO: 156979

SEQ ID NO: 157026 - DNA, 601 bp, Human; identical to SEQ ID NO: 156980

SEQ ID NO: 157027 - DNA, 601 bp, Human; identical to SEQ ID NO: 156981

SEQ ID NO: 157028 - DNA, 601 bp, Human; identical to SEQ ID NO: 156982

SEQ ID NO: 157029 - DNA, 601 bp, Human; identical to SEQ ID NO: 156983

SEQ ID NO: 157030 - DNA, 601 bp, Human; identical to SEQ ID NO: 156984

SEQ ID NO: 157031 - DNA, 601 bp, Human; identical to SEQ ID NO: 156985

SEQ ID NO: 157032 - DNA, 601 bp, Human; identical to SEQ ID NO: 156986

SEQ ID NO: 157033 - DNA, 601 bp, Human; identical to SEQ ID NO: 156987

SEQ ID NO: 157034 - DNA, 601 bp, Human; identical to SEQ ID NO: 156988

SEQ ID NO: 157035 - DNA, 601 bp, Human; identical to SEQ ID NO: 156989

SEQ ID NO: 157036 - DNA, 601 bp, Human; identical to SEQ ID NO: 156990

SEQ ID NO: 157037 - DNA, 601 bp, Human; identical to SEQ ID NO: 156991

SEQ ID NO: 157038 - DNA, 601 bp, Human; identical to SEQ ID NO: 156992

SEQ ID NO: 157039 - DNA, 601 bp, Human; identical to SEQ ID NO: 156993

SEQ ID NO: 157040 - DNA, 601 bp, Human; identical to SEQ ID NO: 156994

SEQ ID NO: 157041 - DNA, 601 bp, Human; identical to SEQ ID NO: 156995

SEQ ID NO: 157042 - DNA, 601 bp, Human; identical to SEQ ID NO: 156996

SEQ ID NO: 157043 - DNA, 601 bp, Human; identical to SEQ ID NO: 156997

SEQ ID NO: 157044 - DNA, 601 bp, Human; identical to SEQ ID NO: 156998

SEQ ID NO: 157045 - DNA, 601 bp, Human; identical to SEQ ID NO: 156999

SEQ ID NO: 157046 - DNA, 601 bp, Human; identical to SEQ ID NO: 157000

SEQ ID NO: 157047 - DNA, 601 bp, Human; identical to SEQ ID NO: 157001

SEQ ID NO: 157048 - DNA, 601 bp, Human; identical to SEQ ID NO: 157002

SEQ ID NO: 157049 - DNA, 601 bp, Human; identical to SEQ ID NO: 157003

SEQ ID NO: 157050 - DNA, 601 bp, Human; identical to SEQ ID NO: 157004

SEQ ID NO: 157051 - DNA, 601 bp, Human; identical to SEQ ID NO: 157005

SEQ ID NO: 157052 - DNA, 601 bp, Human; identical to SEQ ID NO: 157006

SEQ ID NO: 157053 - DNA, 601 bp, Human; identical to SEQ ID NO: 157007

SEQ ID NO: 157054 - DNA, 601 bp, Human; identical to SEQ ID NO: 157008

SEQ ID NO: 157055 - DNA, 601 bp, Human; identical to SEQ ID NO: 157009

SEQ ID NO: 157056 - DNA, 601 bp, Human; identical to SEQ ID NO: 157010

SEQ ID NO: 157057 - DNA, 601 bp, Human; identical to SEQ ID NO: 157011

SEQ ID NO: 157058 - DNA, 601 bp, Human; identical to SEQ ID NO: 157012

SEQ ID NO: 157059 - DNA, 601 bp, Human; identical to SEQ ID NO: 157013

SEQ ID NO: 157060 - DNA, 601 bp, Human; identical to SEQ ID NO: 157014

SEQ ID NO: 157061 - DNA, 601 bp, Human; identical to SEQ ID NO: 157015

SEQ ID NO: 157062 - DNA, 601 bp, Human; identical to SEQ ID NO: 157016

SEQ ID NO: 157063 - DNA, 601 bp, Human; identical to SEQ ID NO: 157017

SEQ ID NO: 157064 - DNA, 601 bp, Human; identical to SEQ ID NO: 157018

SEQ ID NO: 157065 - DNA, 601 bp, Human; identical to SEQ ID NO: 157019

SEQ ID NO: 157066 - DNA, 601 bp, Human; identical to SEQ ID NO: 157020

SEQ ID NO: 157067 - DNA, 601 bp, Human; identical to SEQ ID NO: 35276

SEQ ID NO: 157068 - DNA, 601 bp, Human; identical to SEQ ID NO: 35277

SEQ ID NO: 157069 - DNA, 601 bp, Human; identical to SEQ ID NO: 35278

SEQ ID NO: 157070 - DNA, 601 bp, Human
agctattgtacaaagacctggtgtaaagaaatagcctgagtgatgtctacatgttaagaagatgccgtaacatgtacatgtaggatctattcttagaggggagcagtggaatgggtggtggaatccttatgcaatgatttttaaaatatataataaacatgcacagatactaagtgttcaacccaatgagtgcctttttggtttttttgggggtttttttttgtttttttttttttttaaggaaagcgtctccttctgtcgcccaggctggagtgctgtgattacagacataaaccaccaygcctggtctattcatgtttttaatttttaaatttttattcaattttttttaaaatttagcgatggggtctcactgtattgcccaggctggtctcaaacttctgggctcaagcagtcctccagtctcagcctcccaaagcattgggaatacatacgtaagccactgcacccagcctgttcattttcttaatggtgtcttttgatgggcagaaaactttaattttcgtgaagtctaacttagcagtcttaaaaattttatggtttgtgcttttttgcttaccaccaggtcataaggatattc

SEQ ID NO: 157071 - DNA, 601 bp, Human
gtgtgtgtctgtgtgtttgtcgtctttgttgttgttttgttttgtttgaatcctggggaaccagaggtgttagcctatgttttaaaactcacatttggcaatggtatcaacagctgtcacactgaataattgtcatgtcattataagggtttctgttgctcactaatctgtaggtataaatctggattttaaccacatgtgattggtaaaaattagttcttgtgagagattctatgctgtgtaggccatctgttccctattctcaaacccagaatgaaaagttagccttagaatttgcaartcagtgaactaagaggtatgttataataggaagatgggctgactgaagtctctggagctaagctgggacctgtatgtgggcactgctggcagaaacataagtgtgtgtggataaactcttcattagtggaaaggaatcttagttttcggctgattttcagtggtgggcatgaccccaaacagaatctgagatgatgtaataatcatctgtgatttgattgtacttataagattcagctaaatcttcccttttttgtcccagtctacttgagatgtaccttccttgaacccttattgccca

SEQ ID NO: 157072 - DNA, 601 bp, Human
gcatgaccccaaacagaatctgagatgatgtaataatcatctgtgatttgattgtacttataagattcagctaaatcttcccttttttgtcccagtctacttgagatgtaccttccttgaacccttattgcccagctacatcatgaactccttgaaggttggaatatcagcttcaagtttgtgtcccaaacacttagtacagtgcttgggtcatgttagccttttgatgatgttgatcaaatgaatcagcagccgggcgcggtggctcacgcctgtaatctcagcactttgggaggctgargtgggtggatcgtctgaggtcaggcgagaccagcctggccaacatggtgagaccccatctctactaaaaatacaaaattagctgggtgtggtggcacattcctgtaatcccagctacttgggaggctgaggcaggataatcacttgaacctgggaggcagaggttgcagtgagccgagaccacgccattgcactccagcctgggcaacaagagcgaaactctatctcaaaaaaaatgaatcagcaaggtaacttcttgcattaggaatgacagcacaggccgggcgcggtggcgtacacc

SEQ ID NO: 157073 - DNA, 601 bp, Human
actttgggaggctgaggtgggtggatcgtctgaggtcaggcgagaccagcctggccaacatggtgagaccccatctctactaaaaatacaaaattagctgggtgtggtggcacattcctgtaatcccagctacttgggaggctgaggcaggataatcacttgaacctgggaggcagaggttgcagtgagccgagaccacgccattgcactccagcctgggcaacaagagcgaaactctatctcaaaaaaaatgaatcagcaaggtaacttcttgcattaggaatgacagcacaggccgggmgcggtggcgtacacctgtaatcccagcactttgggaggctgaggcaggaagatcacttgaggccaggagttcaagaccagcttggccagcatggcaaaaccccatctctactatgccgggtgcggtgactcacacctgtaatcccagcattttgggaagccaaggcaggcggatcacttgaggtcaggaattcgagactagcctggccaacatggcaaaaccccatctctactaaaaatacaaacattagccaggtgtggtagcacgtgcctgtaatcccagctactcaggagcctgagg

SEQ ID NO: 157074 - DNA, 601 bp, Human
cttggccagcatggcaaaaccccatctctactatgccgggtgcggtgactcacacctgtaatcccagcattttgggaagccaaggcaggcggatcacttgaggtcaggaattcgagactagcctggccaacatggcaaaaccccatctctactaaaaatacaaacattagccaggtgtggtagcacgtgcctgtaatcccagctactcaggagcctgaggcaggagaatcacttgaacccaggaggtggatgttgcagtgaacgaagatcgcaccactgcactccagcctggatgacagarcaagacagtctaaaaaaaaaaaaagaggaaagacagcactaccttttattaaacaacttctttctttccccatattcccttctagttttttcttatacatgtgcatactctttccattttattttcgtgagtatacattatatccagctctttccttttacattatatcaagaccttttctgtgttgctatatatttatctgtcattatttcagtggagaagtagacccagaatgtgcattgtttttattaatatcacatgccattgtttccattagattgtgttaccatctaactatcc

SEQ ID NO: 157075 - DNA, 601 bp, Human
agacagtctaaaaaaaaaaaaagaggaaagacagcactaccttttattaaacaacttctttctttccccatattcccttctagttttttcttatacatgtgcatactctttccattttattttcgtgagtatacattatatccagctctttccttttacattatatcaagaccttttctgtgttgctatatatttatctgtcattatttcagtggagaagtagacccagaatgtgcattgtttttattaatatcacatgccattgtttccattagattgtgttaccatctaactatccttygtacaagaacactattgtatcgatttgaaaaatcaactgaaaaatcagttgttttagtagtcattactacaaagttgtaggtacatgataattgaccttttcccagggccaaaggccaagtcccaagccataaccttgcctggatttcattttctttatctgggtagactgagtatatgactttatagtttaaagttctttgactaatcgttaaccttatttggggagatgaaatgatttttatgaaccagtaatttgaatataatgtatgatgaagttttggggctttttttcccttta

SEQ ID NO: 157076 - DNA, 601 bp, Human
ccctatgttgtccaggctgttctcaaactcctgagctcaggcaatcctcctgccttggcctcccaaagtgctgggattacaggcgtgagccacggcacccaggtttgttttttatttttttgttttgttttgttttgttttgttttgagatggagtcctgctctgtcgccaggctggagtgcagtggcacgatctcggctcactgcaacctgtgcctcctgggttcaagtgattctcctgcctcagcctcccgagtagctgggactacaggcgcctgccacaacgcccggctaatttttcrtgtttttggtagagacaggctttcaccgtgttagccaggatggtcttgatcttctgacctcgtgatccgccccccttggcctcccaaagggctgggattacaggcgtgagccaccgcgtctggccaatttttgtacttttagtagagacagggtttcaccatgttggccaggatggtctcaatctcctgacctcatgatccgcctgcctcagcctcccaaagtgctgggattacaggcatgagccactgcgtccagccccgtacccagttttaattatattttcttaactggacctatgt

SEQ ID NO: 157077 - DNA, 601 bp, Human
ttgtccaggctgttctcaaactcctgagctcaggcaatcctcctgccttggcctcccaaagtgctgggattacaggcgtgagccacggcacccaggtttgttttttatttttttgttttgttttgttttgttttgttttgagatggagtcctgctctgtcgccaggctggagtgcagtggcacgatctcggctcactgcaacctgtgcctcctgggttcaagtgattctcctgcctcagcctcccgagtagctgggactacaggcgcctgccacaacgcccggctaatttttcgtgttttyggtagagacaggctttcaccgtgttagccaggatggtcttgatcttctgacctcgtgatccgccccccttggcctcccaaagggctgggattacaggcgtgagccaccgcgtctggccaatttttgtacttttagtagagacagggtttcaccatgttggccaggatggtctcaatctcctgacctcatgatccgcctgcctcagcctcccaaagtgctgggattacaggcatgagccactgcgtccagccccgtacccagttttaattatattttcttaactggacctatgtggaaaag

SEQ ID NO: 157078 - DNA, 601 bp, Human
ctcctgagctcaggcaatcctcctgccttggcctcccaaagtgctgggattacaggcgtgagccacggcacccaggtttgttttttatttttttgttttgttttgttttgttttgttttgagatggagtcctgctctgtcgccaggctggagtgcagtggcacgatctcggctcactgcaacctgtgcctcctgggttcaagtgattctcctgcctcagcctcccgagtagctgggactacaggcgcctgccacaacgcccggctaatttttcgtgtttttggtagagacaggctttcacygtgttagccaggatggtcttgatcttctgacctcgtgatccgccccccttggcctcccaaagggctgggattacaggcgtgagccaccgcgtctggccaatttttgtacttttagtagagacagggtttcaccatgttggccaggatggtctcaatctcctgacctcatgatccgcctgcctcagcctcccaaagtgctgggattacaggcatgagccactgcgtccagccccgtacccagttttaattatattttcttaactggacctatgtggaaaagaggttgtatgcttccaagac

SEQ ID NO: 157079 - DNA, 601 bp, Human
tgaaaggaggaaaaaaaacccatttccataaatacatcccttcccctaaaaaaatgcatttgattaagctgaagacctatttctaataaaaacaagtaaaaagcaagtttgtggtaagtagaaacttcaaggttatacatgcaaaatgtggcttaaactagagctgcaacataaaagtggtgaagaacagcagaggacagttggagctgtgggagatgcacaaatgaatgcctctggcatggagcttcagggttgaaaatcaaacactagaagtccagccaggcacagagagcagccagtygcagaggggacatctccctttgtctttatctgttgtggagatgtttggtagtcccttacccccaatgcattgtaataaagcactccatttgtatatgcatcttaatagtcctcaatgatttaggcccacaaaatgatcagttaagagagttacctttattttgtttactttcaaaaaaataagaataaacccaaactcaattcttaatttctcagcctgaacagtgtgaggtcatagttgtccagatttctctggaaacgagtaaagatgaattcgtttctttgtcatgggtctgtacta

SEQ ID NO: 157080 - DNA, 601 bp, Human
cattataataacctaaacagctagcatgtattcctatgctctttgtatatttattcttgaaattcacagtgcttacagcccggtagattatactctttacttggcttctggtttttccccttatttccttggcttttctttttcagtctctttttttagtttcttgtctttcatgatctctaagagtggaaatacctgcagatctgtacccacttccagtaagatacctgttctcaggctttccgtagaatctatatgccattatttgaaaatatttcatcacaacttcagactttcccascccaggcctcagctccacacttttatatccagctgcttatccagcatttctgttagaatatctactgagcattttaaaggtaatcctgatcttcagttgctctttccccattttcctttaccagttcctccttcttagtaaatggtaacttcatccttccagttgcttaggctaaaaacctcaaaattgtttcttgacctctgttttttttttttttttttctttctttttttcagtctcatctgtcaaccaggctagagtacagtggcacaatcacagctcactgcagcctgaaactcc

SEQ ID NO: 157081 - DNA, 601 bp, Human
agatacctgttctcaggctttccgtagaatctatatgccattatttgaaaatatttcatcacaacttcagactttcccaccccaggcctcagctccacacttttatatccagctgcttatccagcatttctgttagaatatctactgagcattttaaaggtaatcctgatcttcagttgctctttccccattttcctttaccagttcctccttcttagtaaatggtaacttcatccttccagttgcttaggctaaaaacctcaaaattgtttcttgacctctgttttttttttttttttttctttctttttttcagtctcatctgtcaaccaggctagagtacagtggcacaatcacagctcactgcagcctgaaactccagggctgaaggaatcctcctgtctgagcctccaaagcagctggaattataggcaagcactctcacacctggctaatttttttttggttttaattttgtggagccggggtcttgccatcttgtccaggctggtctcaaactctggactcaagccatcctcccaccctcagcctcacaaagtgctgggattagagatatgagccactgtacccggccttttga

SEQ ID NO: 157082 - DNA, 601 bp, Human
tttcccagggatgttccatgctgagaaaaagaattcagtgatatttctcccatttgcttttgaaaggagagaaatatggctctgttctgcctggctcatcagcggtcagagtttaaggttatctctcttattccctgaacaattgctgttatcctgttcttttttcaaggtgcccacatttcgtattgctcaaacacacctgctgtacaatttgtgcagttaatgcaattattacagagtcctgaggcgatatacatcctcctcagctgacaggattaagagattaaagtaaagacaggcrtaggaaatcacaagagtattgattggggaagtgataagtgtccataaaatctttacaatttatgtttagagattgcagtaaagacaggcataagaaataaaagtattaatttggggaactaataaatgtccatgaaatcttcacaatccaccttcttctgccatggcttcagccggtccctccgtttggggtccctgacttcccgcagcagtctcacttcattgcccaggctggttttccagctttttaatcagttatagcagaagtcagtaaactgtggcccactgtcggccaggcatg

SEQ ID NO: 157083 - DNA, 601 bp, Human; identical to SEQ ID NO: 31856

SEQ ID NO: 157084 - DNA, 601 bp, Human; identical to SEQ ID NO: 31855

SEQ ID NO: 157085 - DNA, 601 bp, Human; identical to SEQ ID NO: 31854

SEQ ID NO: 157086 - DNA, 601 bp, Human; identical to SEQ ID NO: 31853

SEQ ID NO: 157087 - DNA, 601 bp, Human; identical to SEQ ID NO: 31852

SEQ ID NO: 157088 - DNA, 601 bp, Human; identical to SEQ ID NO: 31851

SEQ ID NO: 157089 - DNA, 601 bp, Human; identical to SEQ ID NO: 31850

SEQ ID NO: 157090 - DNA, 601 bp, Human; identical to SEQ ID NO: 31849

SEQ ID NO: 157091 - DNA, 601 bp, Human; identical to SEQ ID NO: 31848

SEQ ID NO: 157092 - DNA, 601 bp, Human; identical to SEQ ID NO: 31847

SEQ ID NO: 157093 - DNA, 601 bp, Human; identical to SEQ ID NO: 31846

SEQ ID NO: 157094 - DNA, 601 bp, Human; identical to SEQ ID NO: 31845

SEQ ID NO: 157095 - DNA, 601 bp, Human; identical to SEQ ID NO: 31844

SEQ ID NO: 157096 - DNA, 601 bp, Human; identical to SEQ ID NO: 31843

SEQ ID NO: 157097 - DNA, 601 bp, Human; identical to SEQ ID NO: 31842

SEQ ID NO: 157098 - DNA, 601 bp, Human
cgatatatttatatgatcccttttggattaaaaagctcatgaaacttttctctggttcagtttatattattatagaatacatttcggggcagcctctggaaggactgtgggagaccagtgccatatctgaatggtgtgaatgatacaggaaaaactacaatttttaaaactttaaaaaacaaaaactgtcacaaccaccacaaacaaaaatagccttagggaaaaaaaggaaaaaaatgaatagggctgggatcctgccgtcaactttctagtttcttaagagttaagtttttggccaggygcagtggctcacgcctgtaatcctggcactttgggaggccgaggcgggcagatcacttgaggtcaggagttcaagaccagcctgaccaatatggtgaaacctcatctctaccaaaaatacaaaaattagccgggtatggtggtgcacgtctgtagtcccagctactcgggaggctgaggcagaagaatcgcttgaacccaggaggtagaggttgcggtgagccgagatggcgccactgtactccaacctaggtgacagagcgagacttcatctcaaaaaaaaaaaaaaaaaaaagagtta

SEQ ID NO: 157099 - DNA, 601 bp, Human
agtggatgccatttctgccacttctccctagataaacactggcagaggggccccgaaacgcaggggtgaagacattcactgctgaaaaaatctggatgactcgaacacccatccatgaagggggtcacgaaagctgtgctttgtttagccccttgaacaccacgcagctgtcaaggaccgaggcaggttgacaagaatcccctcacacatacagacaagcaaaacactgtcacagggcgatatatttatatgatcccttttggattaaaaagctcatgaaacttttctctggttcagtttmtattattatagaatacatttcggggcagcctctggaaggactgtgggagaccagtgccatatctgaatggtgtgaatgatacaggaaaaactacaatttttaaaactttaaaaaacaaaaactgtcacaaccaccacaaacaaaaatagccttagggaaaaaaaggaaaaaaatgaatagggctgggatcctgccgtcaactttctagtttcttaagagttaagtttttggccaggcgcagtggctcacgcctgtaatcctggcactttgggaggccgaggcgggcagatcacttgaggt

SEQ ID NO: 157100 - DNA, 601 bp, Human
ggtaataatggctaccgggaacgattccatgtaaaatgttcaacacaactccaggcctggtgctgggaatttattttttagaggcagggtctcgctatgtcacccaggctggagtgatgtggctcaaccagagctcactgcagcctcaaactcctgggctcaagtgatcctcccacctcagcctcttgaagcactaggattacaggcatgaaccaccgcacctagccacttttcttttttaatctgtacaatttcagaattggatattattattccccttttatagataaaactgaggccragaggttaagcaatttatccagtgtcacaacagtgagaaaatgctgagccaggacttgcaaccaaaatcagagctctctcttaaatccaagcctctctagtcccacttgggtggagcccctgcctgctaagcctgccttccacaccctacggccaatccaaggatatcgctggctgtcagtgtcctcggagagcaggcgcagctgcgtagtacagatattcatcaggtggtccagctgctgctcgctctcctgcagctgtcggaggtcctgggtcaacccctcaagccgtccgccgacgc

SEQ ID NO: 157101 - DNA, 601 bp, Human
cggagttcccagatctcacctccgaagagtccacggcttggagctgggtctcaggaggggctttgatcaccataaccatctgctctgcagggtctgcaatgctacgaaggtcctgacacgtcacgtaggccagggttggcagagtcaaggaccacatgacctttgacttctagggggtcactcactccaacagctcacaaggcagggctcacacctgcctagtcactcctgtcctcccaacctcctacccactcaaaacctacctcacgcctgagtttcaagttccacatctgtataatgraatcactctacccattgaatcccaaggtaataatggctaccgggaacgattccatgtaaaatgttcaacacaactccaggcctggtgctgggaatttattttttagaggcagggtctcgctatgtcacccaggctggagtgatgtggctcaaccagagctcactgcagcctcaaactcctgggctcaagtgatcctcccacctcagcctcttgaagcactaggattacaggcatgaaccaccgcacctagccacttttcttttttaatctgtacaatttcagaattggatattattattc

SEQ ID NO: 157102 - DNA, 601 bp, Human
tctgttgcacctactcttattccatctactctatggaggattcagcaaaataattatgttatacctccttgacagaaggaacaaattactattgcagaactagagaggaacattactgccaaaatatcccattgagtgttgtgttctagattttccacagcacttttgggccacttctaaatgaaggtcaaggtttaatctgaccttaagagaatgagatgacatttgggaagtggctttgttctctctagatgccaatctacctgcatccagataaaagtgccatcaacaccagatgtamgtacttgataagtgctgagagtattttataagcaaaaatttggaactggcatgaaagatctctgtcatcatgttaaaaaactggtcatcttaaagcattctctatgtttcctttttaaaaacattgttttacttttattcggctaatattttcccccagacaaatagaagtgttcatgcacaatcagaattggtatatatattttaaagcaaatgccaagtcattttcatcaagatttaatatccaaagttatagttaccatgaacaactcaggctattatcttaatgccttgaacgcca

SEQ ID NO: 157103 - DNA, 601 bp, Human
ttcagaaagtcaatgttaagagtggtctttgaatatgggtagaaaagactgatcccaactcaaggatctccatattgttactcctgttcatcttcaatttactaagtatttgcctagttatatcccaggcattgttctatgtgctttacatgttttaattaatttaatattcaggtaacctcatgagtacgtatcactatccttattttagagacaaagttagaaatctgcccaatattctatagctatttagtgaagagctgggacttaaatgcagacaatctggctgcaaaaccagtgyttcctgactagagataatcaaataactcaaactcaagttttaagaaacaggttcaagggaacaatcctctagtcctctctgttgcacctactcttattccatctactctatggaggattcagcaaaataattatgttatacctccttgacagaaggaacaaattactattgcagaactagagaggaacattactgccaaaatatcccattgagtgttgtgttctagattttccacagcacttttgggccacttctaaatgaaggtcaaggtttaatctgaccttaagagaatgagatgac

SEQ ID NO: 157104 - DNA, 601 bp, Human
cagtgatataaaattaacaaaccaaatataaatctaacgccattctgcatttccagaactttttttatatttgtgcagtgttcttggtcaaccactcaccaattttctgcgtctatctgaagtacttttaaagttattaaaactgctcttttgaccataagtcacatagaattgtgattaggaaatcaatttacttattactctgtgcagggcacttgctagggtggtgagtgtaaaggaactaaaaatggaagtctctcacttctaaactggacacaggagttctcaaattaaaataataaaaaaaaaaaagggagagaggtgcttactggcaacattaatactagacaccagacaagacagtgaaacggtttggtcagaactgaggaacaccatttccttgaaaagtcttaaaaatagctaaccaagcactgccttaagtccagtgagtacaatgttccatacgtttccacaaaaatattgtaactggcattcactcattatgatccacgtcatctcagtctccactttccaggcaaagtgtccctgtcccaccgcctctagctacaggctatcgtctccagctgctgttctgcttccg

SEQ ID NO: 157105 - DNA, 601 bp, Human
tttttttttttttttcttttttggagacagggtctctgtcatcctctgacaagctggagattgcagtggtgcaatcacagctcactgaagtaaagaccttttatatattgcaggaattgctgtaagggaaaaactaataggaggctaaggtggaagtatcacttgagcccagaagttggagaccagcctgggcaacatagtgagacaatttgaaaaaatcagctggggctggtggcatgtgcctgtaatccaagttactcaggagcctgaggcaggaggatcacttgagcccaggagttaygattgtgcccctgtactccagcctgggcaacagagagagaccctgtaattaataaacaagcaaataaatttgtatacaagtactataagccatcccctcctgccacctttcctattcccacagtcttgttatcctccagttcaccccagatcagaatctcaaaaccatctttgatgccctcttcctttcccttcacaccaatgtcaccaaatccttcccacctgccctggcacgttctctgcatcctgcccttcctttctctttccatcttattgcagcctcatgccctccttgtcatag

SEQ ID NO: 157106 - DNA, 601 bp, Human
ggccttctacctggccagtggtttaacctttcaaccccatttcttctgctagacactgtgagtgataaagacctttttttttttttttcttttttggagacagggtctctgtcatcctctgacaagctggagattgcagtggtgcaatcacagctcactgaagtaaagaccttttatatattgcaggaattgctgtaagggaaaaactaataggaggctaaggtggaagtatcacttgagcccagaagttggagaccagcctgggcaacatagtgagacaatttgaaaaaatcagctgggsctggtggcatgtgcctgtaatccaagttactcaggagcctgaggcaggaggatcacttgagcccaggagttacgattgtgcccctgtactccagcctgggcaacagagagagaccctgtaattaataaacaagcaaataaatttgtatacaagtactataagccatcccctcctgccacctttcctattcccacagtcttgttatcctccagttcaccccagatcagaatctcaaaaccatctttgatgccctcttcctttcccttcacaccaatgtcaccaaatccttcccacctgccc

SEQ ID NO: 157107 - DNA, 601 bp, Human
ggtggccccagagtgacagcagctcaggaaatatggtgacagaggataagttggcatgggaggaggcagagcttggccagtttgctttgaggaaaaggacctaggagtcccagctcccccacgtcagaatccccccagttctgctgatttcctcattctccccagcacagcccagctctcctattttgggaaacacctggctatagtacccaaggctgcggtactaaggatgtactcaggtgctgtcgcatcctgccaggagaatctcagggcagctccagaactcagaaaatgttctggytccttcccagaactctcccctgcccaggcacctgaaagagaaggctcccaggagagacagaagttagtcattaggtatgggggcttccctgggaggtgtttctcttcctggattttctttttttgagatggagtcttccccctgtcgcccaggctggagtgcagtggcatgatgttggctcactgcaacctccgcctcctgggttcaagcgattctcctgcctcagcctcctgattagctgggattacaggcacgtgccaccatgcccagctaatttttgtatttttggtagagacaggg

SEQ ID NO: 157108 - DNA, 601 bp, Human
taaccctcctatgtaaacagttttcctttgctattaaaaacgtaaagctggccgggtgcggtggctcacgcctgtaatcccagcactttgggaggctgaggcggttggatcacctgaggtcaggagttccagaccagcctgggcaacatggtgaaaccccatctctacaaaaatacaaaaattagctgggtgtggtggcaggcacctgtaatcccagcgactcggaaggctgaggcaggagaatcgtttgaacctggaaggtggagattgcagtgagatgagatggcgccactgcactccmgtctgggcaacagagcaagattctgtctcaaaaacaaaacaaaacaaaacaaaacaaaaccaaccaaaaaacccataaagctctgctgccagccacactgacctcagatatctcagttccccacaccagccatggtccctctcgcaaaggctgttgtatcagcttcactctgcctggaccatcctcctctccacttgcaggtttatctacttatcccctacacatcctgccatctgagctcaagggacttccttagggagagagaccaggttatattttcttacttaaatgcttccaggc

SEQ ID NO: 157109 - DNA, 601 bp, Human
gtccctaggccaagctatcatcagctcaccctggaatatcacagtagtttcccagctgcttttggcacatcttctcttgacctgtccaatctgttttgtgcactgcagccagagtgatcttttcaaagtgcaaatttgactgttaaccctcctatgtaaacagttttcctttgctattaaaaacgtaaagctggccgggtgcggtggctcacgcctgtaatcccagcactttgggaggctgaggcggttggatcacctgaggtcaggagttccagaccagcctgggcaacatggtgaaacmccatctctacaaaaatacaaaaattagctgggtgtggtggcaggcacctgtaatcccagcgactcggaaggctgaggcaggagaatcgtttgaacctggaaggtggagattgcagtgagatgagatggcgccactgcactcccgtctgggcaacagagcaagattctgtctcaaaaacaaaacaaaacaaaacaaaacaaaaccaaccaaaaaacccataaagctctgctgccagccacactgacctcagatatctcagttccccacaccagccatggtccctctcgcaaaggctgttgt

SEQ ID NO: 157110 - DNA, 601 bp, Human
tccaattaagctccttacaagtctcttgaatgtattcattccttatttcttttgctgtccctaggccaagctatcatcagctcaccctggaatatcacagtagtttcccagctgcttttggcacatcttctcttgacctgtccaatctgttttgtgcactgcagccagagtgatcttttcaaagtgcaaatttgactgttaaccctcctatgtaaacagttttcctttgctattaaaaacgtaaagctggccgggtgcggtggctcacgcctgtaatcccagcactttgggaggctgaggyggttggatcacctgaggtcaggagttccagaccagcctgggcaacatggtgaaaccccatctctacaaaaatacaaaaattagctgggtgtggtggcaggcacctgtaatcccagcgactcggaaggctgaggcaggagaatcgtttgaacctggaaggtggagattgcagtgagatgagatggcgccactgcactcccgtctgggcaacagagcaagattctgtctcaaaaacaaaacaaaacaaaacaaaacaaaaccaaccaaaaaacccataaagctctgctgccagccacactga

SEQ ID NO: 157111 - DNA, 601 bp, Human
caaatgtcgacccgtctgccctctgcggtgtgctcccgcccgagagaagtaattctggtcctgtccttcagcgcttcgaatgggagccctggccagtcccggcagccttttccccacccctgctccattccaagcggggggatggggggggctcttaacaggacgggcccgaggcaaggctgaggcactgcttgctcattatgaaacagggcagttcagggcggcctgggcagaggcagcggtggaggggctgcagccgccgaaccccagcagctgggttcccctctcgggtcactgaacygggccaggggatgagactgccctcatctcccacagccaaccacaccaacctgcctgcggctgccccttccaggctcctcatgagctgccacctgtgctggggagtcaagtccctcctcccttcccaggcacccacctcttccttggcccttttccctcacatagatacagccaccccaccctggccccatctccaccaaatctgaattcttcctgttgacatttacagatgctcatctcttcattaaaacaaaaacaaaacaaaaaacttccttaatctcacatccgcctccagtcccct

SEQ ID NO: 157112 - DNA, 601 bp, Human
gaggcaggtggatcacctgaggtgaggagtttgagaccagcctggccaacaggacgaaactctgtctctactaaaaatacaaaaattagctggacatggtggcacatgcctgtagtcccagctactcaggaggctgaggcatgagactcacttgaccctgggaggtggaggttgcagtgaactgagaccatgccactgcactccagcctgggcgacagagaccctgtctcaacaacaaaaaaaaaagggacttggactttggcaaaaatagttatgggagggataaacggaggccaggccwgtaaaagtggtctttttatatgaatgaaacctcataggtaacacccctcagagaaaacaggtgatgtatgtgtctttcagacctttaaacatgtcagactttcagttaatctttcctagatttggaccagggagggcctcagagaaagccaggttgcatcaatgcagattctctgcagatgcaaatctccctcaaaagccagatttgcagggccacttctgtgtgctggccctctgacagccgactcaaaatacgtcaaagtagtatattctggggtaaaatatcttggtttcctttggc

SEQ ID NO: 157113 - DNA, 601 bp, Human; identical to SEQ ID NO: 36424

SEQ ID NO: 157114 - DNA, 601 bp, Human; identical to SEQ ID NO: 36425

SEQ ID NO: 157115 - DNA, 601 bp, Human; identical to SEQ ID NO: 36426

SEQ ID NO: 157116 - DNA, 601 bp, Human; identical to SEQ ID NO: 36427

SEQ ID NO: 157117 - DNA, 601 bp, Human; identical to SEQ ID NO: 36428

SEQ ID NO: 157118 - DNA, 601 bp, Human
ttcattttaagcactgtaaatggaggttttaatgaagcaaatgaaaagagggttaagttggggcatgggagacagaaaatgaatgggttgttgatgaggtgactaaggatgctagtgggaagactggttaaagaaatgggtttgcaaacaatttcagaatattttggggttctcagaaatagtcataagcagcccacatttgtacttcctacgtgtatgaatgctaccagagttatgctcacccgctctaatgctgttcctctctccaaggctgagataccagaaaaaagcctacctcacrggggccatgctgccaaagcagttttaaatatgtacagtactcaagtgcttactcctcctggtcccttctgcctgctcttcctgactcacccccaccacccgctcatccctatatgggctgtagtgatgttatcataggttctgtgtccacccaaaacctggtcacaaagctttcaaagggaatatgtccaagggtgtggctgcactatgacaggtagccttggtggtcagctgtgggcttggccagcgatttttcacattctgtagccactgctaagcccatccctaccccaattttcca

SEQ ID NO: 157119 - DNA, 601 bp, Human
aaattagccaggcgtggtggcgggcacctgtaatcccagctactcaggaggctgaggcaggagaatcacttgaacccaggaggcagaggttgcagtgagccaagatcatgccactgcactccagcctaggcaacagagcaaaactaggtctcaaaaaaaagctatattcttgaggcaagcataagattctcattcaaaattttttttaaaaattggaggttttttacaatgcaatatgtaatatatttcatattacttttgtacaccatactagccatgtgataatgggcaagttaattgmacctttctgttccatcctttcatcatcattaacatgcaggtaataatgataatcacctcacaggcttgttgtgagaatgaaattaaggcatccatataagctcctagcataggccctagcatatgaaatgtgttaattaaatactattatcatgatgattcgtctaggcgggggaagacgccaagggtactgaaaggtgtgctctttatcctaaccttgttttgcttccctcttatctgccatcctgagctacatggatgaagaggatagaggaacataaagatggaaacaaattgagac

SEQ ID NO: 157120 - DNA, 601 bp, Human
tgtccaagttcatgtactgatagtacagctacaatgacaagaaagtgtaaaggctttacatcaagctctttctgaaaatcttgagattcaaataatatttattcagagaaaaagttcatcatataaaggtttgcctgtgaatctgcattccacaaaaaggttgttatttttaaaaagtgactccaataacattcaaacctgtataactccttctctttatagcttttggtgaagaaatgggttcaggagacctctccctgctctttcatcctaaagtgggttaactgcgcaagaattttamagagtttattagctaaaaactagatttaaaactatgctatgaattatgcttactttgaaaatattttgagggatcattattggcttcaaaaaaggctagatcttgctaaacacctacttgaatgtacttaattgaaaattgcaagggctacgtgaaatatataatgtactaacaaagtttatacatttaaaaacaaaaattcaaccttaaaaagaggttaaaatgattcactagcaattttattaaattttaagaatgattattaagatcagtagagcaatatctgtgtattcctaagga

SEQ ID NO: 157121 - DNA, 601 bp, Human
tacatgatagcttttttgattattcttgctcaagatccctcccaactgtaatacaactaattaggataaacattcttcaagtttagattatgttacttggattatagagcactcttctggatcataggcttgaagactgggccatgtctacagaagtggttcatcatatacatgaactgaatgcaatctcatcccaccacgtcccttccctgcttcagctcactgacttcctcttgtttttcgcagaacacttgcttgaactaatcacagaggagttcccattctacttcccatcctgacrcagtagaaggggaagtatgcaaccccaggaagggagaggataccccctaaggaaaaaggaagcagtggctcagtgggctggcacactctgggcccacacgtttcccatctcagtgtataagaagataatggtgggtcatcacttttccttggatgttttcataaatatccttacatcctctgacttagtcatctttgtactcatcttaaatccaatagtgatttagtgatataattcttaacccttctagagaaagaggcaagggaggatggttaatgttgctaaaagaaaagaaagagt

SEQ ID NO: 157122 - DNA, 601 bp, Human
attagaaccaaatggtccatcagaaccatatgtcagtaatggattcagtttcggcttctctgttcctccctttctctactaatatcctatccaatcctcccacttcctgggcctagatgattgctttcttatgaacaatggtgctcatagctggctaactattactgaatgcttcctgtgtgccaaaaaccagctaggcagtttgcatatattgcttctttctctggagtaaagtaggacagagcattgactttgaagtcaggctggtctgagattatagcaagcttctcaattcagtaaytacatgatcatgaaaaaatcacttaatctttcagcacctcagtttcatcctctgtagaatgaggatactaattcctcccttatgggagtgttgaaaggatgaagtgagaaaatccatgttaacttcttagcacacactctggcacaaagagacttcttagcacagactctggcacataaaaatttttttgaatttattattttttatatttttattttttgagagaggatctcactccattgcccaggttggagtacaatggtatgatcacagctcactgcagcttcaacctcctgggct

SEQ ID NO: 157123 - DNA, 601 bp, Human
tgtgatttaaaaaagaaagtgatttttcgtctcattgttcactcagacagagagaggaacaggtcagtgggcggggacatgggattttaagaactgatatttttcaggctgtgaggtgcagcagagtggaaccatccttggccctctgacactttcttgttctaactgcttcttcagagaggttgggccttcgtgtggcttgatttaggattagtattaatagatcagtactggtcctaaacctccacaccctttaaaattccttgggtggcttttgaaaatgcagattcccagacactgscacaaccctaaaaaattaaaatttccagggctggggcccagagaccaatggttttaaaagcttgttggaggatactaatatggatagtggttgggaactactgactgacaaatttacatcagcagccatgacatctcaccctctttacagtcttgcaactcatatgatgtatttattggtttgtttacttttgaactttctgtctttccatcttctctttcccacaataaactttaaattctaaagggcaggaatctgctttgctcaatgttgtgtccctggcactaagaagagtgcctg

SEQ ID NO: 157124 - DNA, 601 bp, Human
cactgatccaagaattataaagtcttttacaaacaatgggtcagagggcacagggtcagctcattcccagggcaagatgccatttccttcctcacagatagccaccactccagagagcccacagcaggcctggaatgagaaacctgagggggaaaacaggaaatctcggattttgtaggttaaaactgcctttgttttatcatctggtgtatacattgaaagtcctttagggatatttaggggagcagacaggatctatattttgctcatagtttcatttctttctgaatattggcaaatrgtgctggacatattaatatttgctcctccaagtactgccttcctgaaggaactaggactgtccaggtgagggggatcacagtactgcaggtccaatgaacacactcgtgtacatgccaggtagggtggagggacaagccagtgagtccactaccatgttccatattcccatatcttccctccctcaagagcaggggtcaaaaaactacagctggtgggacaaatccagccagggcctcctgttttcctaaataaacttttactggtacacagccacacccatttgtttatacatgatcca

SEQ ID NO: 157125 - DNA, 601 bp, Human
gataagacccttttaatatctttgaaaggtttaaatgttaggaaagtttgtttctattgtgctgagttgttattaaatagtccgctcctctggactggattatttaccctttggtatcttgtgaaatgtttgctctaccttcaaacatccaagtaagttacagaccagtaaaacagtgtcaagttgctccctggttctgttcatccatcacttcaaagaattaaacagataaatacttccgtgttaattcctttctcctccttcccagccctcacaccaaatggccccttgtggggacatrgtcactctggggaggcattctgcagagaacaccaggtttggctccagatggcttatatttaagttccaagaactaatggtttttagttatgtgtcttttagtgattaatctgtatgagcgtcagtttctgactatgtcaaacggggctaaaatagtatttggtttttgtttgtttgtttggggagacagagtcttgctgtgttgcccaggctggagtgcagtggcattatcatgtctcactgaagtctcaagctgctgtgctcaaacaatcctcccacctcaacttcccaaggagctggg

SEQ ID NO: 157126 - DNA, 601 bp, Human
agtgctgggactatagacatgagccaccttgcctggccaaaaagactttgaagttcattaactggtcactttccacaaccacatctgtggtttaagttgctgtggccacgtggcccacagggatggcactctttagagcagtgacctgctagggggcccaggtagaggagggggtatggaaagtggctcctcagaggtcctttggatggactgatttctgtttctccctttcaaggaaacaaagatgacactggagaggcctgtcctgccttccccctagttggagacttgaatgaggggmtgactaggtctggttagggttcctgggtaagacatgaggctgttccagaacggggagggaaggaataaaccatttcagttgcccttttctctgcctggttaaattcaatacgctgctctcttccccaagttaagaacaattcaatatgcaataatgtggaaaatatgagccatcaccattattttatattatagcaaaaggctgtattttatcttattcattaaatgaaaagaaaggagagaatgagttccaatgaaaccagacactgaacttcctttctgaacatctgcctctaatgtg

SEQ ID NO: 157127 - DNA, 601 bp, Human
tcaatagttgttttagtcctagctggctttcccatcttatttaaatatttctcaatgtctcgggaagtagatgtctggggaagtggatgttgaagataaagacctttctttttctttcgaaacagggtttcactctgttgcccaggttggagtgcagtggcacatctcagctcactgcagcctctgcctcccaggctcaaaggatgctcctgcctcagcctctcaagcagctgggactattggcacacaccaccacacccagctaatttttgtattttttgcagagatggagtttcgctaygttgcccaggctgctctcgaattccttgactcaaacgatctgcccacctcagcctcccaaagtgctgggactatagacatgagccaccttgcctggccaaaaagactttgaagttcattaactggtcactttccacaaccacatctgtggtttaagttgctgtggccacgtggcccacagggatggcactctttagagcagtgacctgctagggggcccaggtagaggagggggtatggaaagtggctcctcagaggtcctttggatggactgatttctgtttctccctttcaaggaaac

SEQ ID NO: 157128 - DNA, 601 bp, Human
aacaacatatattaccacttaatattttactcagtttccttccagtctctgttgaatgtttgttctcatgttgaatgaagagatgcaaagaaaaatgcggttaaaataagcaggcttcctatttaaggtgcaatggagtgacctagatgcttgtctgggggtctctgaccccatcttgaaagtattttgttgttgcaatatagggaggcttcttttagaagaaattgctgactctccttccctgtgggcagttccccaggactccagcgggccacttggctagatggagggtgaggtctcsagggggaatgacagatcagcactgggtctctttttgccctgcctcagcttgacattctttgagtatttaaaataaataaatagctttccaatgtacacacagcaaatattaccaggcaccagtttctttagtaatcatatgtgatgtgttttctatggcctgcatcttaaaaacctgcacaattagagtgagagaaagatcaatagttgttttagtcctagctggctttcccatcttatttaaatatttctcaatgtctcgggaagtagatgtctggggaagtggatgttgaagataaag

SEQ ID NO: 157129 - DNA, 601 bp, Human
aaacgaactcatacttaatgggcgaccaccagggggtgcccaatatcttgcagttgcattgtggatgggatgtgagagaagagaaaggtgagggctggcaaaggtgagaaatcagttcttgctagagctgtaaaagagcaggttgaaggtttcctacctggatcactcttctctgcaaaggccacaatgtggatcccattcaaatcatcttcctgtatgagaaaagtatcaaaagttacacttccagctggagggatgcaaaggactgagccagggacagggactcagaagctggaatggraataggagaggtagggagaggtgtggaagcggggatgaacacagaagcacagaggagtacagcggggctcacattaaggaaggaatgctgaggagcaactgccaggaatgcatagggtttggatcagggactcagataaatgagtttgcaagacaggaaaataccaaccacacgcaagacattagcactaaatgagcctcactcctgtggtctggtggttccaggagtgcagcagtaaaaggcaaaatgagaaagaacatgagtctggtttatcaggagatctgagagcaacaatggctc

SEQ ID NO: 157130 - DNA, 601 bp, Human
tagtctataacattctgatttgttcacaccttttcttctcttagccgtgtgcacaattgaaaacgaactcatacttaatgggcgaccaccagggggtgcccaatatcttgcagttgcattgtggatgggatgtgagagaagagaaaggtgagggctggcaaaggtgagaaatcagttcttgctagagctgtaaaagagcaggttgaaggtttcctacctggatcactcttctctgcaaaggccacaatgtggatcccattcaaatcatcttcctgtatgagaaaagtatcaaaagttacayttccagctggagggatgcaaaggactgagccagggacagggactcagaagctggaatggaaataggagaggtagggagaggtgtggaagcggggatgaacacagaagcacagaggagtacagcggggctcacattaaggaaggaatgctgaggagcaactgccaggaatgcatagggtttggatcagggactcagataaatgagtttgcaagacaggaaaataccaaccacacgcaagacattagcactaaatgagcctcactcctgtggtctggtggttccaggagtgcagcagtaaaa

SEQ ID NO: 157131 - DNA, 601 bp, Human
gtaggaacctggtagtctataacattctgatttgttcacaccttttcttctcttagccgtgtgcacaattgaaaacgaactcatacttaatgggcgaccaccagggggtgcccaatatcttgcagttgcattgtggatgggatgtgagagaagagaaaggtgagggctggcaaaggtgagaaatcagttcttgctagagctgtaaaagagcaggttgaaggtttcctacctggatcactcttctctgcaaaggccacaatgtggatcccattcaaatcatcttcctgtatgagaaaagtawcaaaagttacacttccagctggagggatgcaaaggactgagccagggacagggactcagaagctggaatggaaataggagaggtagggagaggtgtggaagcggggatgaacacagaagcacagaggagtacagcggggctcacattaaggaaggaatgctgaggagcaactgccaggaatgcatagggtttggatcagggactcagataaatgagtttgcaagacaggaaaataccaaccacacgcaagacattagcactaaatgagcctcactcctgtggtctggtggttccaggagt

SEQ ID NO: 157132 - DNA, 601 bp, Human
taaataaacttttaatgtgaacagaagttcacacgtgcacacacacacaagcacacacacaccctgtaaagctggtatgttttaatatctcccccagtgcccagtgtacctttctatgtttgggcagcaaagcagaatgtttgaggttcttgaaagcatctccaaaaacactttataaaatcaactggagaaaaaaataaaatcccgctagacttcccacaccatcggcagcaatcgtgaagctggcttgccctctggcccacttctcttcactgtgtactaccccaggataatgtagccmttgtcacaagacttgttgtcccttctctgttctatagacaaaatttaagacatggtgagattaaaagtgatatggtttggatctgtgtcccctacccaaatctcctgttgaaatgtaatccccaatgctggaggtggggcctggtgggagatgattggatcgtgggggtgatttcttatgatttaacaccattccccacttggtatgagttctcacaagatctggttatataaaagtgtgtggcacctccccaccaccttggtcctgctcctgccatgtgagatatctgctcccgctttg

SEQ ID NO: 157133 - DNA, 601 bp, Human
aaaatgtgggtttcactctgtaagaaactatggaggctattagtgtattgccaaaaaagggaaggaaaagctggtctgccagtgaagattttggggctctgtcttggttggtcatctaactctctaatcatctgccagacaaatatttattgggcgcctaccacgagtcaagacattgtgcaagaatcagctatatattgatgaaaaaggcgatctgttcacccttcatgatctgccactaactgtgttctcttgggcagtttgtttaacttctccaaaccgctgtttcctgatctgtctmgtggaaccatctctagatctctccctatgagtatacaagagactgaggtccccagcaaataccatgaaagtctacattcccttgacttctctggttacattctgggttgtcccagggtttccaaaatgcacttcagaatctgtgcttccactttctcttggggactctctgtctcacagagcactgccatagggaattgctacctgcaaaatcaattttcctgcacttcactctccactggtgttgaaaagagtgaaaccagagaaaagttgtccaagttccaaaaacaaagttacccat

SEQ ID NO: 157134 - DNA, 601 bp, Human
tccgctttcttgtctttcaaatgttggaggtggaggagatggtgaagggcaatagagaggcaggaaggaggatcgaatgatcacttagcataaggccctgctacagacgtatatgccactcagagttgctaacctgacgacttcatataactctatggcagggccttgtggttaagggtgtgggctgggaagccagacatcctcagcgtcattccaacttcatgcttcccagtgaggtaagctctctcagcctcagcttcctcagttgtaataaaaataatgccttcctcatggggttctkgtgtacatataagtacacagtaagtgacaatcatcatcatcttcctcatagtcatgatgtatttagaggtcaagatagcctgcttgaatttgaatcttggcttaggtatagtgagtgatttgggcaacttatttaacctctaaaactcacgttcctcatctgacactagaataataatcatcatgcacgtattacagagtggctttaggtgctaaataaggtcatctacataaagctcctagcacagttcctcaatactgttagttctttaagaagaactgtattattttcctggaggta

SEQ ID NO: 157135 - DNA, 601 bp, Human
cttgcatttccagcttgttagcgctaatattcccagtgccctttgaggatatccatctagcatgcactcatgtagaaacgctgctttgcaaacctttcatcacatgttataaagaagatgtcagcctgacacagacacatctaggggtggtgaggaagacagtcattcattttcaaacctgtcagacgagcggctctggcgggcactttgagcgcaggagctggaggaagactggcagcaccaccaggcaatgggcaagagcacagggctaggaaatgtccttcccagccaggcctgcctragggcatgggatgagtacagcaggagagatctggcgattaggctcgagggccaggagagcagactctgcctcctggcaggtggaggtgggagtacagggttgctgccttccctcagcttcctaccctgggtgaactcaagctcttggccatgaggatcatgtcagaactgctgggggaagaaagtggttggggcagctggatcactgggacatgtggttgttgctgctgtgtaatcttagatcccaaacctggacagacagtgggaggaagcctgacttttcttccctaactaggctctc

SEQ ID NO: 157136 - DNA, 601 bp, Human
aatttttgtatttttagtagagacggggtttcactatgttggccagactggtctcgaactcctgaccttgtgattcacccgcctgtaatcccaaagtgctgggattacaggcttaagggttttgtttgtttgtttgtttgttttcagcaggcaggtataatttgagttcccacaacatcttaagcccagagcctgaggctgagacacaagggtgaataggacaggtcctctctcagaaagaccttgttggtctctaggccagagctcactcagtaaatatggaattctcaaaaagcagccyagcatctgaactggatcctttgggaaacctcagagggacagacaaggctgggagctctcctctcacaagatggaattgccaagaagtcacccgtgagagtcagacatccgcgtaggacaggggacattgtctgggccccacagctatgagacggcacttgagacatgtgaatacgctaccactccttaccacaccctctttctctgcctgtcttctcctggcgctaagatcccagaattggtgaaaaagtcaaatgatatggtgttgtgatgaagagaagcttaagctgatggttacaga

SEQ ID NO: 157137 - DNA, 601 bp, Human
cctgagtagctgggactacaggtgcatgctaccacgcccagctaatttttgtatttttagtagagacggggtttcactatgttggccagactggtctcgaactcctgaccttgtgattcacccgcctgtaatcccaaagtgctgggattacaggcttaagggttttgtttgtttgtttgtttgttttcagcaggcaggtataatttgagttcccacaacatcttaagcccagagcctgaggctgagacacaagggtgaataggacaggtcctctctcagaaagaccttgttggtctctagrccagagctcactcagtaaatatggaattctcaaaaagcagcctagcatctgaactggatcctttgggaaacctcagagggacagacaaggctgggagctctcctctcacaagatggaattgccaagaagtcacccgtgagagtcagacatccgcgtaggacaggggacattgtctgggccccacagctatgagacggcacttgagacatgtgaatacgctaccactccttaccacaccctctttctctgcctgtcttctcctggcgctaagatcccagaattggtgaaaaagtcaaatga

SEQ ID NO: 157138 - DNA, 601 bp, Human
gaagggtttttgtttgtttgttttgctttgtttttgtttttgagatggagtctcactctgtcaccgaggctggagtgcaatggtgtggtctcggctcactgcaacctctgcctcccgggttcaagtgattctcctgcatcagcctcctgagtagctgggactacaggtgcatgctaccacgcccagctaatttttgtatttttagtagagacggggtttcactatgttggccagactggtctcgaactcctgaccttgtgattcacccgcctgtaatcccaaagtgctgggattacaggcktaagggttttgtttgtttgtttgtttgttttcagcaggcaggtataatttgagttcccacaacatcttaagcccagagcctgaggctgagacacaagggtgaataggacaggtcctctctcagaaagaccttgttggtctctaggccagagctcactcagtaaatatggaattctcaaaaagcagcctagcatctgaactggatcctttgggaaacctcagagggacagacaaggctgggagctctcctctcacaagatggaattgccaagaagtcacccgtgagagtcagacatccgcg

SEQ ID NO: 157139 - DNA, 601 bp, Human
ttagaggttgtgtctaaagagggcactgggtctggagtttaaagaccttgcacaggttgcttaaccgctcccctttcatctcctcctctgaaagtggagagaacagctgccacatgacttctcaggcatgttgatataacgagatgctatcagcatgtgggttgggcaaagtgtgtagggagacacatgcagaaggtcctcataaagactttgtctgtcttcttcctttctctcctccacccccatcaaactcttactcattttaaggtttttttttttttttcactactttgatccttcrttgatgggaagggtttttgtttgtttgttttgctttgtttttgtttttgagatggagtctcactctgtcaccgaggctggagtgcaatggtgtggtctcggctcactgcaacctctgcctcccgggttcaagtgattctcctgcatcagcctcctgagtagctgggactacaggtgcatgctaccacgcccagctaatttttgtatttttagtagagacggggtttcactatgttggccagactggtctcgaactcctgaccttgtgattcacccgcctgtaatcccaaagtgctgggat

SEQ ID NO: 157140 - DNA, 601 bp, Human
agataaacggccggggctggaaccacacagcttagaggttgtgtctaaagagggcactgggtctggagtttaaagaccttgcacaggttgcttaaccgctcccctttcatctcctcctctgaaagtggagagaacagctgccacatgacttctcaggcatgttgatataacgagatgctatcagcatgtgggttgggcaaagtgtgtagggagacacatgcagaaggtcctcataaagactttgtctgtcttcttcctttctctcctccacccccatcaaactcttactcattttaaggtttttttttttttttcactactttgatccttcattgatgggaagggtttttgtttgtttgttttgctttgtttttgtttttgagatggagtctcactctgtcaccgaggctggagtgcaatggtgtggtctcggctcactgcaacctctgcctcccgggttcaagtgattctcctgcatcagcctcctgagtagctgggactacaggtgcatgctaccacgcccagctaatttttgtatttttagtagagacggggtttcactatgttggccagactggtctcgaactcctgaccttgtgat

SEQ ID NO: 157141 - DNA, 601 bp, Human
cagataaacggccggggctggaaccacacagcttagaggttgtgtctaaagagggcactgggtctggagtttaaagaccttgcacaggttgcttaaccgctcccctttcatctcctcctctgaaagtggagagaacagctgccacatgacttctcaggcatgttgatataacgagatgctatcagcatgtgggttgggcaaagtgtgtagggagacacatgcagaaggtcctcataaagactttgtctgtcttcttcctttctctcctccacccccatcaaactcttactcattttaaggwttttttttttttttcactactttgatccttcattgatgggaagggtttttgtttgtttgttttgctttgtttttgtttttgagatggagtctcactctgtcaccgaggctggagtgcaatggtgtggtctcggctcactgcaacctctgcctcccgggttcaagtgattctcctgcatcagcctcctgagtagctgggactacaggtgcatgctaccacgcccagctaatttttgtatttttagtagagacggggtttcactatgttggccagactggtctcgaactcctgaccttgtga

SEQ ID NO: 157142 - DNA, 601 bp, Human
gacagataaacggccggggctggaaccacacagcttagaggttgtgtctaaagagggcactgggtctggagtttaaagaccttgcacaggttgcttaaccgctcccctttcatctcctcctctgaaagtggagagaacagctgccacatgacttctcaggcatgttgatataacgagatgctatcagcatgtgggttgggcaaagtgtgtagggagacacatgcagaaggtcctcataaagactttgtctgtcttcttcctttctctcctccacccccatcaaactcttactcattttaaggtttttttttttttttcactactttgatccttcattgatgggaagggtttttgtttgtttgttttgctttgtttttgtttttgagatggagtctcactctgtcaccgaggctggagtgcaatggtgtggtctcggctcactgcaacctctgcctcccgggttcaagtgattctcctgcatcagcctcctgagtagctgggactacaggtgcatgctaccacgcccagctaatttttgtatttttagtagagacggggtttcactatgttggccagactggtctcgaactcctgaccttgt

SEQ ID NO: 157143 - DNA, 601 bp, Human
accttgctaaaaggctgactacagagttgatcattctaacagccaagaatcttatccttgcatccaattgaaatctcctttttttcacatgacgtttactccccaatttcttcctttatggacactggacattgttcttttttgttttgttttgagatggagtcttgctctgttccccaggctgaaatgcagtggtgcaatcacggctcactgcagtcttgacttcccaggctcaagtgattctcctatttcagcctcctaagtagctgggaccagaggcacacaccaccatgcagttaatttttttattactatttgtaaagatgaagtctctctgtgttgtccaggctcatcttgaactcctgggctcaagcgatcctcccacctcagcctcccagagtactgggattataggcgaaagccaccatgcccagccaggacacagaacattgttctccatatgcagaaagtctataatcacgctgctccaacctttattttctgagtgtctattgaacacttactgggtactgagtacttttacatttgatttttacaactagtcttgatggaggttaggaagattttatcatctccattt

SEQ ID NO: 157144 - DNA, 601 bp, Human
aaatgtttcctttatcagtggtagacatggcttggagccctttcaagactatggtcatgtatgtttcagaagtaatatagcctatacttcaaaaaactgtatagagaaaagggggaagtactattcagagatgtgtaggctaatagttatctagacaaagcaagtagaggactattctctgcagttatcagaaaagcatcagttctcaaaatcagaagagacccccgcaacccagacattccaaactccaggtagatgaatagccctcactcagaacatttgtctctgttgaatatttccwggactgagaccgtttgaccttgctaaaaggctgactacagagttgatcattctaacagccaagaatcttatccttgcatccaattgaaatctcctttttttcacatgacgtttactccccaatttcttcctttatggacactggacattgttcttttttgttttgttttgagatggagtcttgctctgttccccaggctgaaatgcagtggtgcaatcacggctcactgcagtcttgacttcccaggctcaagtgattctcctatttcagcctcctaagtagctgggaccagaggcacac

SEQ ID NO: 157145 - DNA, 601 bp, Human
gtattcagttgctaaaattgtaagttacaagttcaattttttccaaagagagcctctgtttctttgtaaaactggcaagttccctggaaaagagaaacgtgctctgtggatcctccctttttgaccaggaaggcaggtgtaggaagccgcatttcactttagtaattcaatgttaagcaaggactagtccactgttaaaattacatggatgaatgactgagtttaaaatgagtaaatgtttcctttatcagtggtagacatggcttggagccctttcaagactatggtcatgtatgtttcrgaagtaatatagcctatacttcaaaaaactgtatagagaaaagggggaagtactattcagagatgtgtaggctaatagttatctagacaaagcaagtagaggactattctctgcagttatcagaaaagcatcagttctcaaaatcagaagagacccccgcaacccagacattccaaactccaggtagatgaatagccctcactcagaacatttgtctctgttgaatatttccaggactgagaccgtttgaccttgctaaaaggctgactacagagttgatcattctaacagccaagaatc

SEQ ID NO: 157146 - DNA, 601 bp, Human
ttttaaggcattagcttgtgtggatattcctgatcaaaggcttaaaagcctccaaggctctcccctcttcagacaccagccttgagtgcagacctgttaaaatggattgtcaatctgtgaaagtgagttaaggcagctaacctggtctcacatgtattcagttgctaaaattgtaagttacaagttcaattttttccaaagagagcctctgtttctttgtaaaactggcaagttccctggaaaagagaaacgtgctctgtggatcctccctttttgaccaggaaggcaggtgtaggaagcmgcatttcactttagtaattcaatgttaagcaaggactagtccactgttaaaattacatggatgaatgactgagtttaaaatgagtaaatgtttcctttatcagtggtagacatggcttggagccctttcaagactatggtcatgtatgtttcagaagtaatatagcctatacttcaaaaaactgtatagagaaaagggggaagtactattcagagatgtgtaggctaatagttatctagacaaagcaagtagaggactattctctgcagttatcagaaaagcatcagttctcaaaatcag

SEQ ID NO: 157147 - DNA, 601 bp, Human
gaaccgtgccttgataactgggtcagggaaaggtttaattcctttgcttttaaggcattagcttgtgtggatattcctgatcaaaggcttaaaagcctccaaggctctcccctcttcagacaccagccttgagtgcagacctgttaaaatggattgtcaatctgtgaaagtgagttaaggcagctaacctggtctcacatgtattcagttgctaaaattgtaagttacaagttcaattttttccaaagagagcctctgtttctttgtaaaactggcaagttccctggaaaagagaaacgtkctctgtggatcctccctttttgaccaggaaggcaggtgtaggaagccgcatttcactttagtaattcaatgttaagcaaggactagtccactgttaaaattacatggatgaatgactgagtttaaaatgagtaaatgtttcctttatcagtggtagacatggcttggagccctttcaagactatggtcatgtatgtttcagaagtaatatagcctatacttcaaaaaactgtatagagaaaagggggaagtactattcagagatgtgtaggctaatagttatctagacaaagcaagtaga

SEQ ID NO: 157148 - DNA, 601 bp, Human
gccagctggtgagaccacgagaaccgtgccttgataactgggtcagggaaaggtttaattcctttgcttttaaggcattagcttgtgtggatattcctgatcaaaggcttaaaagcctccaaggctctcccctcttcagacaccagccttgagtgcagacctgttaaaatggattgtcaatctgtgaaagtgagttaaggcagctaacctggtctcacatgtattcagttgctaaaattgtaagttacaagttcaattttttccaaagagagcctctgtttctttgtaaaactggcaagtyccctggaaaagagaaacgtgctctgtggatcctccctttttgaccaggaaggcaggtgtaggaagccgcatttcactttagtaattcaatgttaagcaaggactagtccactgttaaaattacatggatgaatgactgagtttaaaatgagtaaatgtttcctttatcagtggtagacatggcttggagccctttcaagactatggtcatgtatgtttcagaagtaatatagcctatacttcaaaaaactgtatagagaaaagggggaagtactattcagagatgtgtaggctaatagtt

SEQ ID NO: 157149 - DNA, 601 bp, Human
ctcctgttgccgattctgtgaccaaaggcttcagggatggctgtgccagctggtgagaccacgagaaccgtgccttgataactgggtcagggaaaggtttaattcctttgcttttaaggcattagcttgtgtggatattcctgatcaaaggcttaaaagcctccaaggctctcccctcttcagacaccagccttgagtgcagacctgttaaaatggattgtcaatctgtgaaagtgagttaaggcagctaacctggtctcacatgtattcagttgctaaaattgtaagttacaagttcaattttttccaaagagagcctctgtttctttgtaaaactggcaagttccctggaaaagagaaacgtgctctgtggatcctccctttttgaccaggaaggcaggtgtaggaagccgcatttcactttagtaattcaatgttaagcaaggactagtccactgttaaaattacatggatgaatgactgagtttaaaatgagtaaatgtttcctttatcagtggtagacatggcttggagccctttcaagactatggtcatgtatgtttcagaagtaatatagcctatacttcaaaaaactgtatag

SEQ ID NO: 157150 - DNA, 601 bp, Human
ctgtaatggacaatgtctctgaccccagatactttcaatgacagaacagagcccattcttcagggagtcagcccagcatggcccttaaacacacagactctggggccaaatgaccttggccaaggtcgtggatgtacccttagagtgtgacttagagcaagttatttaatgtttctctcctcatctttaaaacagagatgatgaaaatgatagcatctacttcgtcgggtagttgtgagttaaatgaatcagtatctctgaagcacttggacagtgcctggcatatagtaaggtttagccrttattttacttaaattacctgacattctatattcaaaggcaaggaagctggctggaactccctaagcctggccattcctctgctcatttaccacatcggtattacgttcagtgatctgggcactgggagtggggtagaggcagtcttggatccacgtggtacatgctgacagaaaactatatcacaaaagtgtacagcgtggggcagctccttccagctcctgttgccgattctgtgaccaaaggcttcagggatggctgtgccagctggtgagaccacgagaaccgtgccttgataact

SEQ ID NO: 157151 - DNA, 601 bp, Human
agagaatattctttgtgtctatggagaagcaaagaaatcccaaaaaccattcccagaataaattaataaataaggttgacattaaagctgaaaaagtttcctctagatccaagggcaggtttctgatgttcagggtgatgaattctgtaatggacaatgtctctgaccccagatactttcaatgacagaacagagcccattcttcagggagtcagcccagcatggcccttaaacacacagactctggggccaaatgaccttggccaaggtcgtggatgtacccttagagtgtgacttagarcaagttatttaatgtttctctcctcatctttaaaacagagatgatgaaaatgatagcatctacttcgtcgggtagttgtgagttaaatgaatcagtatctctgaagcacttggacagtgcctggcatatagtaaggtttagccattattttacttaaattacctgacattctatattcaaaggcaaggaagctggctggaactccctaagcctggccattcctctgctcatttaccacatcggtattacgttcagtgatctgggcactgggagtggggtagaggcagtcttggatccacg

SEQ ID NO: 157152 - DNA, 601 bp, Human
aaagagaatattctttgtgtctatggagaagcaaagaaatcccaaaaaccattcccagaataaattaataaataaggttgacattaaagctgaaaaagtttcctctagatccaagggcaggtttctgatgttcagggtgatgaattctgtaatggacaatgtctctgaccccagatactttcaatgacagaacagagcccattcttcagggagtcagcccagcatggcccttaaacacacagactctggggccaaatgaccttggccaaggtcgtggatgtacccttagagtgtgacttasagcaagttatttaatgtttctctcctcatctttaaaacagagatgatgaaaatgatagcatctacttcgtcgggtagttgtgagttaaatgaatcagtatctctgaagcacttggacagtgcctggcatatagtaaggtttagccattattttacttaaattacctgacattctatattcaaaggcaaggaagctggctggaactccctaagcctggccattcctctgctcatttaccacatcggtattacgttcagtgatctgggcactgggagtggggtagaggcagtcttggatcca

SEQ ID NO: 157153 - DNA, 601 bp, Human
aggttaagagatgaaaagaaaaactgaactgtgcaagaaaaatcaaatgggttgtagtttttttgtaaacgagtgaagtcaaaagtgtggcttaatgcccattttcaagaaaataaaaggtttttgtaaagagaatattctttgtgtctatggagaagcaaagaaatcccaaaaaccattcccagaataaattaataaataaggttgacattaaagctgaaaaagtttcctctagatccaagggcaggtttctgatgttcagggtgatgaattctgtaatggacaatgtctctgaccccaratactttcaatgacagaacagagcccattcttcagggagtcagcccagcatggcccttaaacacacagactctggggccaaatgaccttggccaaggtcgtggatgtacccttagagtgtgacttagagcaagttatttaatgtttctctcctcatctttaaaacagagatgatgaaaatgatagcatctacttcgtcgggtagttgtgagttaaatgaatcagtatctctgaagcacttggacagtgcctggcatatagtaaggtttagccattattttacttaaattacctgacattc

SEQ ID NO: 157154 - DNA, 601 bp, Human
aggaattcctccaaaacaacttcagttactgtttttagctgcagaaaataaagaaatgataatcaatgaggtgacactgccagtactttggaagatgagagagagtcaaatgtaaaagggacatgacaaaactgaaattcacagagaggatgaaatgcaaaaacacagactcaaatgaaagtagaaagtaaacttgtggtgcaagagactgattcacataaaggaaaggagagtctaggcaggcacaagtgttgtggagggacaggatctgtgacccagaactataagctgaatacacaayggagcactgttgttttcttatgggaaaaactctcttaacattgagattcatcaaaaggaatgtggtatacaagaacttacctactacgttcctatttgacattctagagcaggttaagagatgaaaagaaaaactgaactgtgcaagaaaaatcaaatgggttgtagtttttttgtaaacgagtgaagtcaaaagtgtggcttaatgcccattttcaagaaaataaaaggtttttgtaaagagaatattctttgtgtctatggagaagcaaagaaatcccaaaaaccattcccagaataa

SEQ ID NO: 157155 - DNA, 601 bp, Human
tgggctcaagtgatcctgcctcagctttccaaagtgcaggattacagatgtgagtcactgtgtcaggcctagaaggggtctttatggccggtggccacttcttgcagaaatacagagtggacctcggtgatcttttaatccgtgctcataaccatattgcaaatgagattatgacaaacaccggagactgacagggccctaagcattagacttcatttatctgtcattgcagggctgggggtgaggtggggtaggggcattactcctgctgcctgtaggtggaactgagaaggtcctgccyctccagtgtatcactgactgacgtgtggacactatgggtcgtcctttggccatgtgtctgtcacaggagagggaaatatggtgccaccttggttatctgtagagatagaaatcatagtacaaagaccacaaggaggaattcctccaaaacaacttcagttactgtttttagctgcagaaaataaagaaatgataatcaatgaggtgacactgccagtactttggaagatgagagagagtcaaatgtaaaagggacatgacaaaactgaaattcacagagaggatgaaatgcaaaaacaca

SEQ ID NO: 157156 - DNA, 601 bp, Human
ttgtttggctcttttggactcttggtaaaagtttttttctacacttctttatctctaatgcattccaggcaaaacgcatactattcttagcaactctactttgagtttttgagttggtgtagtcactgttgctagctcacactgaagattcaggctgagcccccttaggccttattacctgggaagcacagcgacctctagtggagaaatagttccttttttttttttttgtctgttgcccaggctggagtgcgtggtgggatcatagctcacagcagcctcgacctcccaggctccagtsatcctcctgtgtcagcctcacaagtagctaaaactacaggtgtgtgccactatgcccagctagtcttttaaattttattgttttattttgtgcagacaggggtctcacattgttgcccaggttggttttgaactcctgggctcaagtgatcctgcctcagctttccaaagtgcaggattacagatgtgagtcactgtgtcaggcctagaaggggtctttatggccggtggccacttcttgcagaaatacagagtggacctcggtgatcttttaatccgtgctcataaccatattgcaaat

SEQ ID NO: 157157 - DNA, 601 bp, Human
ctctcctctctccaggaatgctagcttttgtttggctcttttggactcttggtaaaagtttttttctacacttctttatctctaatgcattccaggcaaaacgcatactattcttagcaactctactttgagtttttgagttggtgtagtcactgttgctagctcacactgaagattcaggctgagcccccttaggccttattacctgggaagcacagcgacctctagtggagaaatagttccttttttttttttttgtctgttgcccaggctggagtgcgtggtgggatcatagctcacwgcagcctcgacctcccaggctccagtgatcctcctgtgtcagcctcacaagtagctaaaactacaggtgtgtgccactatgcccagctagtcttttaaattttattgttttattttgtgcagacaggggtctcacattgttgcccaggttggttttgaactcctgggctcaagtgatcctgcctcagctttccaaagtgcaggattacagatgtgagtcactgtgtcaggcctagaaggggtctttatggccggtggccacttcttgcagaaatacagagtggacctcggtgatctttta

SEQ ID NO: 157158 - DNA, 601 bp, Human
gtatgtgtgtgtgcgtgtgtgtgtgcacgcgtgcatgtgcagaaacacaagccatgtgtgcatgtgtgtccacgtacagaatctccattgtttcagggaatcccagagtatagaagacccatgatttgtttcagaattaaactcaggcaaatgaaaagatcccagaatcccttagagaaccccctagtataggagcactagggcagaaaagcctgtcagaaggccccatggagttgtcttgtcattctgaggaacttgaacaggtaacgatgacccataccagatgtgcaccccactcagmtatgcctgggaaccagagagaccctggatcccttgggatagtggggttggggtggaggaccttaattatcagccccagcttccaccactcagtggtatacactcaaaattgaaatttaggttcagttctaaataataaagttacatttcttgcatagctgaatttgtggcttgaaatttatacgttgaatacaagtaactcaccagctacttgggaattcaattaactgtgctttctttgcacagtttttcttcttttgtctggagtctcagcaaacttgagctcctccctatggcctct

SEQ ID NO: 157159 - DNA, 601 bp, Human
tatttccttgtatactgggccctccctctgttcagtcagcagcagtcattgccccaggggtgggatgattcctaagaaaagcagagaggagctttataagcttcaagaacacaaacttgttagctttaaaagcctaaatcttgaaggactaggagcatacaatttttgccataaacaaaaattttaggagaacgtttagtaagagatagcatactctcaaccctcagcaccactccccagcccccagctagaaacagaaaaaatagtttagattctggaaggtccctgagaataataaacygtgcctgtgtgtgtgtgcgtgcgtgtgtgtatgtgtgtgcgtgcgtgtgtgtatgtgtgtgtgcgtgtgtgtgtgcacgcgtgcatgtgcagaaacacaagccatgtgtgcatgtgtgtccacgtacagaatctccattgtttcagggaatcccagagtatagaagacccatgatttgtttcagaattaaactcaggcaaatgaaaagatcccagaatcccttagagaaccccctagtataggagcactagggcagaaaagcctgtcagaaggccccatggagttgtcttgtcattctga

SEQ ID NO: 157160 - DNA, 601 bp, Human
aagtagttctggggactgggaatggagtgatgaggggcagctctgcagctgctgccgaaggagtttagcctgctcacttgggtgggaccccgagggtcaagggttttcaactcctggactccagggagtaagccgaatcctttcagggtcagcaccaggccccaagttcaatactgccccaagggccaagacctcccacactgggtgaggaccgccactgggtttcttcaagtgcccctgcctatttcacctcctcagatgctgaacgcaatcatgaggttgtgacagcaactgagggtgrggcgctggctggagccactcaccagaggaaagtcgtccgggtcgatccacaggatgctcagatcggggttgtcagtattgtcccgggcaacctgtttcaggatctccaggaattcgtagccatctgaaacaggattcaagagagttgagtaacccctgcacatacacagcttctaatgtggagagcagagtgtgatttttccacgaggacttcttaggacatttggtgctcaccctcaattataggattattctatagaatgagtcagatgagagctccaggcacagagcagattataca

SEQ ID NO: 157161 - DNA, 601 bp, Human
aaagtttcgggccattgatcatgcacactagcaaaagtgtggacttgaagtttctttcacattcatcgtaggctagacactatgctaggtcctggggagaacacgatgaacatgacaggcacgctcgctttctctccacaaagttctgaactcgctgaaaaatgttcatctctgatttttattacttagtaattcaggtggcctcagaatgatggtccccacccagaaaataaaagtagttctggggactgggaatggagtgatgaggggcagctctgcagctgctgccgaaggagtttarcctgctcacttgggtgggaccccgagggtcaagggttttcaactcctggactccagggagtaagccgaatcctttcagggtcagcaccaggccccaagttcaatactgccccaagggccaagacctcccacactgggtgaggaccgccactgggtttcttcaagtgcccctgcctatttcacctcctcagatgctgaacgcaatcatgaggttgtgacagcaactgagggtggggcgctggctggagccactcaccagaggaaagtcgtccgggtcgatccacaggatgctcagatcggg

SEQ ID NO: 157162 - DNA, 601 bp, Human
ttttaaaaactaagtataatcaaaagtttcgggccattgatcatgcacactagcaaaagtgtggacttgaagtttctttcacattcatcgtaggctagacactatgctaggtcctggggagaacacgatgaacatgacaggcacgctcgctttctctccacaaagttctgaactcgctgaaaaatgttcatctctgatttttattacttagtaattcaggtggcctcagaatgatggtccccacccagaaaataaaagtagttctggggactgggaatggagtgatgaggggcagctctgsagctgctgccgaaggagtttagcctgctcacttgggtgggaccccgagggtcaagggttttcaactcctggactccagggagtaagccgaatcctttcagggtcagcaccaggccccaagttcaatactgccccaagggccaagacctcccacactgggtgaggaccgccactgggtttcttcaagtgcccctgcctatttcacctcctcagatgctgaacgcaatcatgaggttgtgacagcaactgagggtggggcgctggctggagccactcaccagaggaaagtcgtccgggtcga

SEQ ID NO: 157163 - DNA, 601 bp, Human
ccctcctctacatagggctgattttcaggacccttgagatccctctcaattttctctatttaatcacagtatcatcagtcatgacctatgcaactaatgataattcctggaagataaagtcatcattcataacctaatgataactaaacttgtactgattacttcaataagcatttacctaaagcagtcggtagaccaggctttagcatcatgtagacctagattggaatatcacatctatcactcactagctttaacctccccagctatcattctctccaccttgtgacagggattatawtagtacctacttcacagggttgttgagaggattcgctgtgatgaggcatgtaaagtattactctagttccaggcatacagtagaatatatcagctatgcttattatcagtaccagtacttattatcagcaccagaaccagtaccagggttcaatacatgtagtgtacaaatgctgtttattcttttttaaaaactaagtataatcaaaagtttcgggccattgatcatgcacactagcaaaagtgtggacttgaagtttctttcacattcatcgtaggctagacactatgctaggtcctg

SEQ ID NO: 157164 - DNA, 601 bp, Human
ttaaaaataccttatcttgtgctacatgagatagctgggaaagccatgatgggtcataagttgccaagtaagaagaaggcttcttcattcaaccaggcttggactccatgtggacaaatctctgactggggcaaaaataaaggagcaaggggccacaggatttttttttttaatggagatgtccagtggtaggaaatctcccacgcaaatatatggcctagtggggactagggatattcaggaatctggaaatcagaatagtctgaagatttcttctttgcaaaaaccaaggcaaacacawagaactggccagaagagagtctgggcatggtggctcatgcttgtagtcccagcactttgggactggagtccaggagtttgaaaccagcctgagcaacatagtaagaccttgtctctacaagaaattttaaaaattagctgggcgtggtggcacatttctatagtcccaactgctcaggaggctgaggcaggaggattgcttgagcctgggagcttaaggctgcagtaaattgagattatgccactgcactccagcctgggtgacacagtgagaccctgtctcaaaaaaaaaacaaaaaaa

SEQ ID NO: 157165 - DNA, 601 bp, Human
ggaaacatgtgtctgcagctgtaagagagaaaattatagaggtggtctaatgttgctttccaaattacttgtggctgttttatagtttatagagccatttccctccacctctttttaatgtcccagttttaaaaataccttatcttgtgctacatgagatagctgggaaagccatgatgggtcataagttgccaagtaagaagaaggcttcttcattcaaccaggcttggactccatgtggacaaatctctgactggggcaaaaataaaggagcaaggggccacaggatttttttttttartggagatgtccagtggtaggaaatctcccacgcaaatatatggcctagtggggactagggatattcaggaatctggaaatcagaatagtctgaagatttcttctttgcaaaaaccaaggcaaacacatagaactggccagaagagagtctgggcatggtggctcatgcttgtagtcccagcactttgggactggagtccaggagtttgaaaccagcctgagcaacatagtaagaccttgtctctacaagaaattttaaaaattagctgggcgtggtggcacatttctatagtcccaactg

SEQ ID NO: 157166 - DNA, 601 bp, Human
acttcaaataagcattaaataaaagatgacacagcataaattatggaaacatgtgtctgcagctgtaagagagaaaattatagaggtggtctaatgttgctttccaaattacttgtggctgttttatagtttatagagccatttccctccacctctttttaatgtcccagttttaaaaataccttatcttgtgctacatgagatagctgggaaagccatgatgggtcataagttgccaagtaagaagaaggcttcttcattcaaccaggcttggactccatgtggacaaatctctgactgrggcaaaaataaaggagcaaggggccacaggatttttttttttaatggagatgtccagtggtaggaaatctcccacgcaaatatatggcctagtggggactagggatattcaggaatctggaaatcagaatagtctgaagatttcttctttgcaaaaaccaaggcaaacacatagaactggccagaagagagtctgggcatggtggctcatgcttgtagtcccagcactttgggactggagtccaggagtttgaaaccagcctgagcaacatagtaagaccttgtctctacaagaaatttt

SEQ ID NO: 157167 - DNA, 601 bp, Human
ttactcgcatatgattttcttccttcccttctgcaggcctggtctcctgcctgtagagtagttgcctgcctgggattctaggccacaacggccccatcacccattgtgcagtgatggctcctggtgtgggttcccttttgtaaagagacctttttgtttgctgtttgactttgggggtaaatacaggagagtttacttgaagggaaagttccaaatcagtgattcaggaaaggctggccccataggcaagaaaatgtgcccatggaagagagccatggaaccacagattgggactggctckgagaccaggcgtggaacacactggcaagtttccttgagcaggacccctgccctcttctgaaaaggctgggctactatagatgctctcacaatctaagctgtgtagcagaagacagggcaggccaagggtgcctgagcaagccttcacaggggatactcacatctgtgacattcaccaccccaatctgtggcctgaataggtcaatcttgaaagtcttctcccagtaggcaacgagctgcagcaacaaaaaaataagattagacagcaggcagacggcattctctgttaaggacccacccg

SEQ ID NO: 157168 - DNA, 601 bp, Human
gcagttggaagatcgtcatcatctggaatctccatccagacactgtcagcctgcagtgagggacaaaatgaatgagtgggtaaatgcatgagggctgaaccagaccagggatagccgtgctgaatagctatgctgagtgccccccgactctcttacacttattaggaacgtgcacattgttaaatggaaatgccaaacggcaaaacggtatgtgtagtatactgtttgtgttgcataaaaggaaatgtgtattccattgcccagtggaatatatatgacatttctggtaatatacccatgmaacaaccaccagtggttccctccaggaatgagactaggggttgggtcaggggagtaggaaatactttttactttgaccttctaatctactgttctgttttaaaatgttttcacttgagcatgttttaaaagtaatgtattattattaattttaaagtagcttacaaaataaatgaatgtagagttccctaggtgattgaacacctatcaacaggggagaaagacattgctaactggcccccattcttttttattttttttttgagatggagttttgctcttgttgcccaggctggagtgc

SEQ ID NO: 157169 - DNA, 601 bp, Human
catgacccttgatggtccagcaaagaacaagatctgttccgtgacagtcaagacagtcaacatgggaataatttttctcctgtccctgctaagtgggattgctgcatttgaaaaggcatttgctgaatgatgctgctcctgacgcaaagggagtgggaaaagagatgatggaaaagggaaaggagctggctgggtgtggggcagaattgcttgctgccaccttgtgctgtctgtatggtagtgggtgctgtgattttgttttcatcagaattgtttggagttgggctattcatcatcatcrtcatcactgtcatcattatcctcttcatcagaattatcatcatcatcatcatcttcatcatcatcttcagtgtttatctttccagaaagcacatcctcaatccagtcctccagctcctcagcagttggaagatcgtcatcatctggaatctccatccagacactgtcagcctgcagtgagggacaaaatgaatgagtgggtaaatgcatgagggctgaaccagaccagggatagccgtgctgaatagctatgctgagtgccccccgactctcttacacttattaggaacgtgcacattgt

SEQ ID NO: 157170 - DNA, 601 bp, Human
aaaggaaaatagagaagaaataaggaggtaggactggagccagatgagaatgagcagagtcagaaaaatcaagataggattttcaacattgtctgaatattttcaaaatatgagtttaatgacagaattagttagctagtattccacaaaaagtattgctctattttcaaaaaatttgcacagtgtcttacacatgtgctaaaagattgagaaaataaattagaaaattatactgcacacttaacactaaatctaccaagcacaatgtaacttttagacagctcagaaggcactttgggatttttttttttttcagtgcctcagggcatcagtatgaactccaattattgttgccctggccaattgtgggagtactgataactggagagttaattgactgctggataaagcaatctttaatctaaatgggaaggctcactagcagctacagagaaggggtattcagatcccagcttaggctaggaagccagctgacccaatcagagacatgaacccatcagaaaaatgtaaaagttttcatctttctagttttcccccaccctccactcctgctgatgaatatgtgagacttgccaactag

SEQ ID NO: 157171 - DNA, 601 bp, Human
taaactagtcataggccccagttgagacaattattgccgggaaagaagctgaaatgcttgactagcactgatgctgtgggggattttccctctttcttcaaaaaaacagaaaagacccagtggaaaaaaaaaaaaaagtgatgagttgtgaggcaggtcgcggccctactgcctcaggagacgatgcgcagctcatttgcttaaatttgcagctgacggctgccacctctctagaggcacctggcggggagcctctcaacataagacagtgaccagtctggtgactcacagccggcacagscatgaactacccgctaacgctggaaatggacctcgagaacctggaggacctggtgagtagacacgggtagcttcctgtcgccgaggccctgtctggaattctaacatcctttgccagagtccgagggagaggggacagtgtgggaatcctctcccactgtggatctgtaaaatctagacaggtcagtcagctcccgccctttaagagtttattttccattctgtggaagaagcagataaggagagctgctgtccttaggagacatcctttagaggaagctggaagacacgggttcaggcc

SEQ ID NO: 157172 - DNA, 601 bp, Human
tgtccctcagtgtcacagtacaaaaacctcgggcgtagtggtacaggcaggagaatcttgcatgtagcagcttctcaataagtatttattgatttgtgatgcagtaaaggtcttagctcaccattttcctctggagttagtctgggtccttctattccttctgcttcctattctcctccttgtccttgcccataccaggtattggttcacattccttgaacgctgggttttacactctcatgttgagctaagaactggggccttttggttacacaaacttgccagaaaaaaaaaaaaaaaagaactgggggctcctggccataagccaggttcgtcattctgtattccatttgtcctcttgaactcgaagaccaactcgagccgcttaaaatgtccacttctttaaggcaggggctggagggtggggaggggctgctaattctcatgaatgaaaggtccaaatagaacaaaaattagatggctaagaaccaggaacaagaagattccaggtcctggggtgggtatgccagggacccatcctgctggaaaggccgatcctggcagacctagagcagaccctgtctatgcgaccctcgatctg

SEQ ID NO: 157173 - DNA, 601 bp, Human
caccattttcctctggagttagtctgggtccttctattccttctgcttcctattctcctccttgtccttgcccataccaggtattggttcacattccttgaacgctgggttttacactctcatgttgagctaagaactggggccttttggttacacaaacttgccagaaaaaaaaaaaaaaaggaactgggggctcctggccataagccaggttcgtcattctgtattccatttgtcctcttgaactcgaagaccaactcgagccgcttaaaatgtccacttctttaaggcaggggctggrgggtggggaggggctgctaattctcatgaatgaaaggtccaaatagaacaaaaattagatggctaagaaccaggaacaagaagattccaggtcctggggtgggtatgccagggacccatcctgctggaaaggccgatcctggcagacctagagcagaccctgtctatgcgaccctcgatctgagagcctccttccaacagaaccagggcctgggctggggcatccacagaggctggtcataaactatacctccagccccaccctgcacaccagccgggaggggaagctgctatagcgcac

SEQ ID NO: 157174 - DNA, 601 bp, Human
atgagggagagccccaaggccaagctgaggatgggtcagggtcaaagtgaatatgggttcgggcatacaaactgcagagtctccgtcaggaactcttgctttccccagggacgcaggctgcagctgatcccactcctctagcagaacggcagaaacagtggccgcatatgtggacctaagaatcaggacacaagaatgagcattctttcaagagtggtggggaaaaatatttccaacccaggagatggtttcaagaggctgccacacacacctgggaggcctgtctgcctgcatcttggaytgtgtgactctgtatccaaagggcaaagagacgctggggtgccaggtggggctcccttaagcctaaagacttgctgcagaggcttggagtagcttaaactctccccctaacaccacatccagcacagtacctgcttctgatggccaaaacccgtgggtagagatgaaagaggagtctcacagacttgtccctgaaggctgtgggtgcggcaagggagatgtgacaaatggcaagccagagtctcagatggtctttaggggctgtgggcctcctgaagaaagacggggtaaggggtacaga

SEQ ID NO: 157175 - DNA, 601 bp, Human
tctgccctgtgctccctctgggcatgggattggagggcttccttcagcagcacatgccccatggtattcaggattcctgattcctcaatttcccatgaggccggagccaaccttgctttattgcctctctccatagtttgggggagattgggggagctagaactcctatgtgtgggaagtggctttaacatgtgccactcccgaacccccaaaacgtctgtttgacacctcctgctgagatgtgctgtcaattcccagcacccctcaaaccagcttcctcccatcttaccctctctgaacrctgccagacaaatacctcttggcaaggaggaagacacaggcccctcccaagccccctctaaatctggttctcaggagatgggagccctagggagatgtcccactgcattgactttagatgagcaataactcagtcagtctggaatctttgaagggcaagaacttgtgtggaggacaagcccagaaacccagggctttctgggtcagacaggctggctggacctaagccctcacccaggcacggccaaggtaggtggagtccagccctgctgaccgccccaggccctgcttctctcctccc

SEQ ID NO: 157176 - DNA, 601 bp, Human
gtgcatattgaaccagatgggaggctattactgccatttcagtgataacagagacagtcaggaacaggaagacccatgaggagggagcccacaggccaagtcagcacccgcccgcccctagtccccagcacaatgctaagttgcagtgcccgactgttctgctcagaactggaacagatgggtccttgtaccaagcaggtccattccccaaattgaagtcctgtgactccagccgccaaggctgcaggcttccgtacatgaggacccaaaaacacaagctgacttatggggtccagccctycagcacttacaaagctcagccacccgcacgcctcccttcatcagcaccaccactctaaggaatgcggtccctttgacaggcgaaaaactgaagttggaaaagacaaagtgatttgttcaaaattgaaatttgaaacttgacatttggtcagtgggccctatgtaggaaaaaacctccaagagagctagggttcctctcagagaggaaagacaggtccttaggtcctcaccctcccgtctccttgcccttgcagttctgggaactggacagattggacaactataacgacacctccctggt

SEQ ID NO: 157177 - DNA, 601 bp, Human
attcctgctgcccatgctggtgatgggctggtgctacgtgggggtagtgcacaggttgcgccaggcccagcggcgccctcagcggcagaaggcagtcagggtggccatcctggtgacaagcatcttcttcctctgctggtcaccctaccacatcgtcatcttcctggacaccctggcgaggctgaaggccgtggacaatacctgcaagctgaatggctctctccccgtggccatcaccatgtgtgagttcctgggcctggcccactgctgcctcaaccccatgctctacactttcgccggygtgaagttccgcagtgacctgtcgcggctcctgacgaagctgggctgtaccggccctgcctccctgtgccagctcttccctagctggcgcaggagcagtctctctgagtcagagaatgccacctctctcaccacgttctaggtcccagtgtccccttttattgctgcttttccttggggcaggcagtgatgctggatgctccttccaacaggagctgggatcctaagggctcaccgtggctaagagtgtcctaggagtatcctcatttggggtagctagaggaaccaacccccatttcta

SEQ ID NO: 157178 - DNA, 601 bp, Human
tggaagtggggcatgggcttccaggtcataggtggatttaaagattttctgattggcaattgattaaaagagtttatctacagacctcaaatccatagaagggagtgcctgggttaagataaggggttgtggaggccaaggttcttactatgcaaatgaagcttccaggtagcagcgtttggagagaatagattgtaaatgtttcttatgagacttgaaaaggtgccagactctgttaattctctcctggatcagagaaaagacctggcaagggaaagggattttctacagaatgtagackttccccacaagagacaactttgcaggaccatttcaaaatatgacaaagaaatatattttagggtaaaatacttcaatttctttcaaggcctgctatctgtcatgtgatgctatactagagtcaggctggaatttggtgtcttatttctacaaaaagtcttaagtgttagattttttaaagggaaggtggggttaaagaaagacacagagagagagagagagagaggagggggagggggtagagggggagagggagagagagagaggctttacaacaacacaggtttattacaaaaacctg

SEQ ID NO: 157179 - DNA, 601 bp, Human
gtgggggaccagcttaatgccagagcccgccattgcttacaggctggggtatgtacaggtatgggcaggagggttttgggcagtatggcttgctgccctggaggatattgataagatgttcttatgttcaggtggtttggccagggatgttccttgggctctgtcaggatttgatagggatatttcttcagttgggtctttgcttggcagggtatgataaagatgttcctgtgtcttgtggtcaggtggctaggcaggatttctcagggcccgaacccccatggaatgtttcactttgacmaaggtctgtgaaatggcagggggcttacaaaatggtgtagtttggactaacattaaggtctgtttcagtgttaatgctggtcagttatgcctgaattccaaagggcggaggatataatgaggcacatctgacaccttttccccatcatggcctgaactcgttttttaggttaactttggaatgcccttggctgagaggaggactccatttagatggttggggggcttagaattttatttttggtttacaaaggagagagagagtgtgtaagagggagacagagagaggaagacacaactg

SEQ ID NO: 157180 - DNA, 601 bp, Human
ggaccagcttaatgccagagcccgccattgcttacaggctggggtatgtacaggtatgggcaggagggttttgggcagtatggcttgctgccctggaggatattgataagatgttcttatgttcaggtggtttggccagggatgttccttgggctctgtcaggatttgatagggatatttcttcagttgggtctttgcttggcagggtatgataaagatgttcctgtgtcttgtggtcaggtggctaggcaggatttctcagggcccgaacccccatggaatgtttcactttgaccaaggyctgtgaaatggcagggggcttacaaaatggtgtagtttggactaacattaaggtctgtttcagtgttaatgctggtcagttatgcctgaattccaaagggcggaggatataatgaggcacatctgacaccttttccccatcatggcctgaactcgttttttaggttaactttggaatgcccttggctgagaggaggactccatttagatggttggggggcttagaattttatttttggtttacaaaggagagagagagtgtgtaagagggagacagagagaggaagacacaactgtttag

SEQ ID NO: 157181 - DNA, 601 bp, Human
gagggttttgggcagtatggcttgctgccctggaggatattgataagatgttcttatgttcaggtggtttggccagggatgttccttgggctctgtcaggatttgatagggatatttcttcagttgggtctttgcttggcagggtatgataaagatgttcctgtgtcttgtggtcaggtggctaggcaggatttctcagggcccgaacccccatggaatgtttcactttgaccaaggtctgtgaaatggcagggggcttacaaaatggtgtagtttggactaacattaaggtctgtttcartgttaatgctggtcagttatgcctgaattccaaagggcggaggatataatgaggcacatctgacaccttttccccatcatggcctgaactcgttttttaggttaactttggaatgcccttggctgagaggaggactccatttagatggttggggggcttagaattttatttttggtttacaaaggagagagagagtgtgtaagagggagacagagagaggaagacacaactgtttagctggcattaggaaccagaatttgctccttttgcaagtctgatgttcatggagtcgggacacca

SEQ ID NO: 157182 - DNA, 601 bp, Human
tcatggcctgaactcgttttttaggttaactttggaatgcccttggctgagaggaggactccatttagatggttggggggcttagaattttatttttggtttacaaaggagagagagagtgtgtaagagggagacagagagaggaagacacaactgtttagctggcattaggaaccagaatttgctccttttgcaagtctgatgttcatggagtcgggacaccatgtgccatggttgaagcagcttaggttttgaagacagacagagctgtatctgttggtctagccacttcccagctggktgtccccgttcaggatacactgcccttcaatgttaccatcaaagagggtttaatgggacgctggggaggaaatcccaccatagttcctggccccatgtaggcgctcagcactgtcagttcccatcctaaggtccttcttcgaagagagaagtttctgctgcatggagaggtagagacagggtgaaggtacccagctgtggctgggtgggcatcacagggggtaaggggcagagaaagcttccccttcaccctctgaaggttcactgaacgtcaactgacaaaaggcagattaacaggaga

SEQ ID NO: 157183 - DNA, 601 bp, Human
caaaggagagagagagtgtgtaagagggagacagagagaggaagacacaactgtttagctggcattaggaaccagaatttgctccttttgcaagtctgatgttcatggagtcgggacaccatgtgccatggttgaagcagcttaggttttgaagacagacagagctgtatctgttggtctagccacttcccagctgggtgtccccgttcaggatacactgcccttcaatgttaccatcaaagagggtttaatgggacgctggggaggaaatcccaccatagttcctggccccatgtaggcrctcagcactgtcagttcccatcctaaggtccttcttcgaagagagaagtttctgctgcatggagaggtagagacagggtgaaggtacccagctgtggctgggtgggcatcacagggggtaaggggcagagaaagcttccccttcaccctctgaaggttcactgaacgtcaactgacaaaaggcagattaacaggagaaaggctgtgacaatttattttaatatgcacagcatgagagaatggttgcccaataatccaaaggggtacagcagtttgtataccattcttcacaggggaggga

SEQ ID NO: 157184 - DNA, 601 bp, Human
acctcccttcccctcacggcagggaattcagtttttcaggtctctctggggttccctcggccaagagtgggtctgttcagttgtttgggggttaggatttcatttttggtttctcctcagcacatgtgtatctctggagaaagctagggaaagaggaaagacaggcaaagcaaaaggagattattatctagaggttttaatcaactcataagggaaataaagttgaaactctacagaaaaggaggtgaaatagcaccccactgtcatcatatattcatcatatatacgtatatatattttmagacctactgctctgtcgcccgggctggagtgcagtggtgtgatctcagctcaactgcagcctctgcctcccaaggtcaagcaattctcctgcctcagcctcccgagtagctgggactacaggtgcgccaccatgcccggctaatttttgttgttgttctttttgtttttttgagagggagtctcactctgtggcccaggctggagtgcagtggtgtgatctcggctcactgcaacctctgcctcccaggttcaagtgattctcccggctcagcctcctgagtatctgggactacaggca

SEQ ID NO: 157185 - DNA, 601 bp, Human
tgctacaccaggatcaatattgacttcttgtgagagggggagatcatatcctgttccagtaggaaacacattgcctctaatactcttaacacagggagagacccaaactatacacttggtgtggaattttaaaaggaaacatttttaaaatattagcaggtaggaaacagatattgaggtactaaaacaagtcagacaaggagatagtgggggagacaactggtaaggagctaaaactgaaataaataatgtgaagcgaaataatagttactgtaacccaactgaacgtgggtccattcayccagcatacagaaacaaacacaagcaccaggatttgcagtgacagaaagggaagcattgattgcagggtgccaagcaaggagaactgggcagctaatgcttaagaccctaactccccaatggctttcaggcaagggttttaaaattttatttattttattgttatttgaaacagggtcttgctctgtcacccaggctggagtgcattgatcctggctcactgcagccttgtcctcccaggctcaagcgatcctgcctactcagcctcctaagtagctggaactacaggcgtgcaccatca

SEQ ID NO: 157186 - DNA, 601 bp, Human
tttattgagcacttctgtgtaccgggcattgttataatagcttggcctagatccatgaacaaatcccacaaaaatccttgccctcttggagtttgctgaggaagccagaaaataaacaataagcagatgatattataagaaaataatataagctgggcatagtagctcacacctgtaatcccagggactcagtaggcccaggcgggagaactgcttgagaccagaagttcaagagcagcctgggcaacatagcaagagccccctctctctattaaaaaaaaattaaaaaattagccacatrtgggtacatacctgcagtcctagctacttgggaggctgaggttggaggattggttgagcccaggagttcaaggcttcagtgagctatgatcatgccactatactccagcctgggcaacagcgaaagaccccaactcaaaatgaaagagaaaatcatatattatgttagaaggtaattggtgctaaaaaaaaaaaaaacaaaaacagaaaggatagcgttgtaagagggtatgggatgggttcctggggggtaagttgggtggtctgtgatatacaataaagctatgggtgtaggtcccgc

SEQ ID NO: 157187 - DNA, 601 bp, Human
agctatttggattgtttatgattgcatcataaactgacaaatacattgttggttacacctccaagtagagaggcagctggataaacaaatctgcattttaggagagagagctgagctggaaatataaattcaggggtcattggcacaggaagatgatttacagccatgagactggataaaatcacttaggggagtgtgtgtaggtgtattagtccgttttcacactgctgataaagacatacccgagactgagcaatttacaaaacaaagaggtttaattggacttacagttccatgtggytggggaagcctcacagtcatggagaaaggcaagtcacattttacatggatggcagcaggcaaaaaatgagagagcttgtgcaggggaatgcctcttttaaaaaccatcagttttgtgttttttttttttttttttttttgagatggagtctcaccctgtcacccaggctggagtgcagtggccacaatcttggctcactgcaacctccgcctcccaggttcaagcaattcttgtgcctcagcctcctgcgtactgggactacaggtgcctgccaccatgcctagctaattttttgtattt

SEQ ID NO: 157188 - DNA, 601 bp, Human
tggagaaaggcaagtcacattttacatggatggcagcaggcaaaaaatgagagagcttgtgcaggggaatgcctcttttaaaaaccatcagttttgtgttttttttttttttttttttttgagatggagtctcaccctgtcacccaggctggagtgcagtggccacaatcttggctcactgcaacctccgcctcccaggttcaagcaattcttgtgcctcagcctcctgcgtactgggactacaggtgcctgccaccatgcctagctaattttttgtatttttaatggagacagggtttcmccatgttgactgggctggtcttgaatgcctaaactcaggtgatctgactgccttggcctcccaaagtgctgggattacaggtatgaaccaccgtacccggcctaaaaccatcagatcttgtgagacatattcactgtcacaagaatagcatgggaaagacttgcctccatgattcaattacctcccaccaggtccctcctacaacacgtgggaattcaagatgagactggggtggggacacagccaaaccatatcagtaggtaaagaacaaaagaggactgagccctgatggcatcagga

SEQ ID NO: 157189 - DNA, 601 bp, Human
tattcaacagagaaagaatctcatggtcagagccgtcagcaatcattagtatctaactagaatttagtaactttttgctttcattggatttatttttatacttaacctttatttagaaagctacactctttctgctcttgtaatgatgtaaaatttattttttcttaatttaagcaaaaaagctgatttgtagaaagatagtgatacattaaaaggctaaaactttcacagtgttagattaatgcttgaagtttgggagacactatgctatttataaaaatcatcacgggaggaaattccrgatcttcccactttgtctttcatgatctgaaaacttgttgggaactactgggtatcaaggaggctaagtccctgggccacttcttggttctatttttattctcatagtttccacaaatttgactttctttgaagttattttgctctccctcctcttctatatctggaatcctcttgtcccaggaataaaactgaacaccatttccaagtatttctctcaagttactatttataaagtaagtactgtatacaaacccagtttccttgttagagatgttttgctttgttggattaatcatgg

SEQ ID NO: 157190 - DNA, 601 bp, Human
ctttgttggattaatcatggtagaacagagagtagttaaaaaatgacgatcaataatcaggacagatttggagccaggaaatactttgagcaacaacacagtagttgttcccctggtttctcactgaagagtgaatggggatggctccactccatactttgaatttcttcttgaattttcccagccctagcccaatttttgccttagattctaaggcgtaggataaatcgggccaaaccaaatcaagagtcattgcttgcaaagccatttagactttatctgaagtagttagagcagaatyccctgggataaccagttcagtccaaagcctacttggttatctgtttttttccctggaggaggaatgcactgtcttttctggctctcctggaccagaagcactggtttccctttgcctctttggaaggacttagagcttagaggtccagccttttccctacccttttctcctgctgattttgccctcagcatagccaagaagcccaaagttatgactaattctatctttaggtggacctggacatctcatcagcgtcacttcaaggttcactgatcctaaaggactgtttcttgttggaag

SEQ ID NO: 157191 - DNA, 601 bp, Human
tctagatgtatatctagtatactaataatggtttctttggtgctggttaagacagaagaattgcttcttagttcttgtgaatgcactcctatttgcttaatgctgaattattcagttcctgttccaaaattaacctgccacaaggcacaggtaagcctgatcatcgtgaatctcggtaccctttagaaatattagcctcttctcattctactgtgattctgtattttttttttttacattttattaactttttaatgtcattttgaattctgattctgaaatttggaaattaaaactagtraccttaatgcatgtctaaaaactatggagaaaaagaaaatttacaagaatagtgatttttcaggtattgtgcaactataagattacagtaatgtgggcaactggcttttgtaataagtggaaaaaaaagagacagtaaacatattcctgttttcttacaagtgtaaccatcatggacaatagcagaaagcactagatgcccttatccactgaattattataaagggctgggggctgggcgcagtggcccgtgcctgtaatcacagcactttgggaggccaaggtgggtggatcacttgag

SEQ ID NO: 157192 - DNA, 601 bp, Human
caaaaaagttcatataaaatttcagtgagtgggctgggcgcggtggctcacgcctgtaatcccagcactttgggaggccgaggtgggcggatcacgaggtcaggagatcgagaccacgatgaaaccccgtctctactaaaaatacaaaaaattagccgggcgcggtggcaggtgcctgtagtcccagctactcgggaggctggggcaggagaatggcgtgaacccaggaggcggagcttgtagtgagccgagatcgtgccactgcactccagcctgggcgacagagcaagactacgtctcaaaaaaaaaaaaaaaaaaaagaaattttcagtgagtgtggaaggactagagccttcctctgctactactacattttacctcgtgggaaacaggcctatggatttagccaaggaaaaagaaacgtgggaatgctgtttattccttgcatagccgtaatataaagtatgaattttatcaagtatcttttcactcaacctatcatagccactcaaaaagatgttaatggaaagacaaccatcagaagcaaaatcatgccaagaacgagaagcagcaggaggaaaaactttggttacttctgtga

SEQ ID NO: 157193 - DNA, 601 bp, Human
gccctgctctgaggtttaaacaatgttcaaccttgaaagattgattttaaatgtaaaggtcatttaaactcttttgtaagttcttatattttgttaaaataggctgaacatttacctctagatgaaaaatcaatgcttcagtgtatacttttctcataaaataacctatgtctttatttttttctgcagacaaaactgtgtggagttttatcctatattcataattacattgtggatggctgggtggtatttcaaccaaggtaatgttaaaatacagtcaactgtgttctaatgatgactrtgatgcttaaacgattaaggagtagatatatggccaggcacggtggctcacacctatattcccagcactttgggaggcccaggtgggtggatcacctgaggtcaggagttcgagaccagcctggccaaaatggtgaaaccctgtctctactaaaaatacaaaaattagctaagtgtggtggcgcatgcctgtaatcccagctacttgggaggctgagacaggagaatcacttgaacccaggaggtggaggctgcagtgagctgagatcgtgccactacactccagtctgggtgacagaga

SEQ ID NO: 157194 - DNA, 601 bp, Human
atatatttatttgaaaatatccatgcataaatggacctgtgcagttcaaacccatgttgttcaagggtcacctataattctaattaactgaaggaggaggacacagaatgaaaaattcacattaataattatagctggcgaggcccagaagcttatgcctgtaatcccagcaatttgggaggctaaggtggagggattgcttgaggccagaaattcacgaccagcctgggcaacaaaggagaccctgtgtctacaaaattttttttaaaaaactatctgggcacacatgtagtcccagctrcttgggaggctgaggtgagaggagctctcaagcccaagagtttcaggctgcagtgaatcatgacagtgccactgcactccagcatgggtgacagagtgagaccctgtctcaaaaagaaaataataataattatcattatagctattatttattgagcccttactatgtgccaggtactgtttttgttttttggtctttggttttgctttttttttttttttttttttttgagatggagtctcgctttgttgcccaggctggagtgcagtggtgcgatctcggctcactgcaagctccgcc

SEQ ID NO: 157195 - DNA, 601 bp, Human
ctcgtgatccgccagtctcggcctcccaaagtgctgggattacaggcgtgagccaccacgcccggccaccaggtactgtttttaagttttatgcatacattgtcccatgtgtaagatttacaggatttaaagccttcatatgagggagggtctataattaatttatactttacagatgaggaagctgaggtacagagatgttaagtaatttttccaacttgacattcaccaatgtggggaaatttttcctttcaagtgcagagccgggtctgtaagtatttgtaccaacaacccatgcacsttttcttaaaggtctccaagtatgtagtgctgccgtttgtatgtagcgactctacaaacatccactttctatttgactggggtatccttggtgagctgagggctttctccaaacttggcttatgcgtttaacagtgagtcagaccagcccctgctaccttcgttggagaaattcaatctcctttttctggtaactttcactgtctcattttggtctatacttgattgccaagatttaaataaaccaaaatccagctgctttcaaaggcaaccccatcactctctttcttttagtttttac

SEQ ID NO: 157196 - DNA, 601 bp, Human
ctccctcgcccggcccgccttctctgggttaggggggcgatgcggccgggtggcaacgcacgcgcctcctgcgcccctcccttccctggggggaggggcgcaccccttttatccccggagcgctagggcccgcccctccgctggggcccacccccttcgtgcgcatgcttaatgcttctggggaggagggggctggtcccagcggagccgcactcttcgcccgctccgggcaaaagcgggggcgagtgtagagcgatcctgggaaatcctttgatccgggagccctaggtttcctctccasccaacggggcgtcgctgccttaatgggaggagcactcggaagggttggtttgggcctgaaactctcccaagtggcatagccccttttccggtatggggtctcctacacccacgcgcaccacctctccggtcgcgtggctgcctctacagcctacctatacgtccctttttccccccaactgggaattgagaggtaaggtctttctctggaaatccagcagtagaggaagggaccacccaagaaaactaaaaaccaaggcaccttaccagtctgtctggggacaggatccctgctgcacct

SEQ ID NO: 157197 - DNA, 601 bp, Human
ctcgcccggcccgccttctctgggttaggggggcgatgcggccgggtggcaacgcacgcgcctcctgcgcccctcccttccctggggggaggggcgcaccccttttatccccggagcgctagggcccgcccctccgctggggcccacccccttcgtgcgcatgcttaatgcttctggggaggagggggctggtcccagcggagccgcactcttcgcccgctccgggcaaaagcgggggcgagtgtagagcgatcctgggaaatcctttgatccgggagccctaggtttcctctccacccarcggggcgtcgctgccttaatgggaggagcactcggaagggttggtttgggcctgaaactctcccaagtggcatagccccttttccggtatggggtctcctacacccacgcgcaccacctctccggtcgcgtggctgcctctacagcctacctatacgtccctttttccccccaactgggaattgagaggtaaggtctttctctggaaatccagcagtagaggaagggaccacccaagaaaactaaaaaccaaggcaccttaccagtctgtctggggacaggatccctgctgcaccttccc

SEQ ID NO: 157198 - DNA, 601 bp, Human
tcttcgcccgctccgggcaaaagcgggggcgagtgtagagcgatcctgggaaatcctttgatccgggagccctaggtttcctctccacccaacggggcgtcgctgccttaatgggaggagcactcggaagggttggtttgggcctgaaactctcccaagtggcatagccccttttccggtatggggtctcctacacccacgcgcaccacctctccggtcgcgtggctgcctctacagcctacctatacgtccctttttccccccaactgggaattgagaggtaaggtctttctctggaaawccagcagtagaggaagggaccacccaagaaaactaaaaaccaaggcaccttaccagtctgtctggggacaggatccctgctgcaccttccccaccccctcctgggaagtgccccctcacctcagggcacccgcaacctgggctcctccctgagcgcaccggcccttcctgtcacccaggtccaccctcagtactcaagctgcagtatacagcgggaaaaactgaggcactttggtgctaggggtttgggactgaggcgtggagagcagatgtgatggcaggaagactctcgcttttaaac

SEQ ID NO: 157199 - DNA, 601 bp, Human
cttcgcccgctccgggcaaaagcgggggcgagtgtagagcgatcctgggaaatcctttgatccgggagccctaggtttcctctccacccaacggggcgtcgctgccttaatgggaggagcactcggaagggttggtttgggcctgaaactctcccaagtggcatagccccttttccggtatggggtctcctacacccacgcgcaccacctctccggtcgcgtggctgcctctacagcctacctatacgtccctttttccccccaactgggaattgagaggtaaggtctttctctggaaatmcagcagtagaggaagggaccacccaagaaaactaaaaaccaaggcaccttaccagtctgtctggggacaggatccctgctgcaccttccccaccccctcctgggaagtgccccctcacctcagggcacccgcaacctgggctcctccctgagcgcaccggcccttcctgtcacccaggtccaccctcagtactcaagctgcagtatacagcgggaaaaactgaggcactttggtgctaggggtttgggactgaggcgtggagagcagatgtgatggcaggaagactctcgcttttaaaca

SEQ ID NO: 157200 - DNA, 601 bp, Human
ctgaggcactttggtgctaggggtttgggactgaggcgtggagagcagatgtgatggcaggaagactctcgcttttaaacatctggtttgggagagaccatcgacttggccagtgagactgagaatggattccgagtagtgatgggccgtttgcacctcggtttttccacgtgagaaatggggagaacgctgctgttaggaggaagttgtgtccagttcagggtgccctcgggagccctgtccctgttgctgtggcccctctcacgccgccatctctctgccccgccccgcccctccggcmtccccacaccccccttgccctcactacctgtatctcaccggcgtgtgttcaccctcccgggtggctcacacactctcattcacacacacaaatctcaggaacaaacggtcccagagtcctccggacccctgcccagggtctctgcaggtctctgccccacgcgttcccgtcgctgacaaagccaccagctgcctcctttaagcttggtgctccggctctgggcctttcttgcgctctattttttttttttttttttttaagaaaaacaacaacaacaaaaaaagacaatgaaaaaaaaaa

SEQ ID NO: 157201 - DNA, 601 bp, Human; identical to SEQ ID NO: 26873

SEQ ID NO: 157202 - DNA, 601 bp, Human; identical to SEQ ID NO: 26874

SEQ ID NO: 157203 - DNA, 601 bp, Human; identical to SEQ ID NO: 26875

SEQ ID NO: 157204 - DNA, 601 bp, Human; identical to SEQ ID NO: 26876

SEQ ID NO: 157205 - DNA, 601 bp, Human; identical to SEQ ID NO: 26877

SEQ ID NO: 157206 - DNA, 601 bp, Human; identical to SEQ ID NO: 26878

SEQ ID NO: 157207 - DNA, 601 bp, Human; identical to SEQ ID NO: 26879

SEQ ID NO: 157208 - DNA, 601 bp, Human; identical to SEQ ID NO: 26880

SEQ ID NO: 157209 - DNA, 601 bp, Human; identical to SEQ ID NO: 26881

SEQ ID NO: 157210 - DNA, 601 bp, Human; identical to SEQ ID NO: 26882

SEQ ID NO: 157211 - DNA, 601 bp, Human; identical to SEQ ID NO: 26883

SEQ ID NO: 157212 - DNA, 601 bp, Human; identical to SEQ ID NO: 26884

SEQ ID NO: 157213 - DNA, 601 bp, Human; identical to SEQ ID NO: 26885

SEQ ID NO: 157214 - DNA, 601 bp, Human; identical to SEQ ID NO: 26886

SEQ ID NO: 157215 - DNA, 601 bp, Human; identical to SEQ ID NO: 26887

SEQ ID NO: 157216 - DNA, 601 bp, Human; identical to SEQ ID NO: 26888

SEQ ID NO: 157217 - DNA, 601 bp, Human; identical to SEQ ID NO: 26889

SEQ ID NO: 157218 - DNA, 601 bp, Human; identical to SEQ ID NO: 26890

SEQ ID NO: 157219 - DNA, 601 bp, Human; identical to SEQ ID NO: 26891

SEQ ID NO: 157220 - DNA, 601 bp, Human; identical to SEQ ID NO: 26892

SEQ ID NO: 157221 - DNA, 601 bp, Human; identical to SEQ ID NO: 26893

SEQ ID NO: 157222 - DNA, 601 bp, Human; identical to SEQ ID NO: 26894

SEQ ID NO: 157223 - DNA, 601 bp, Human; identical to SEQ ID NO: 26895

SEQ ID NO: 157224 - DNA, 601 bp, Human; identical to SEQ ID NO: 26896

SEQ ID NO: 157225 - DNA, 601 bp, Human
ccttggatagggctctctcggcctctgtgggagccccagatagtcaagctgtctcagggattcagcccaaagagacggaggaaatgcagagctaggtggagtggtgatgtgaaagacaggaggagaaagcatggagaaagcacacaccttggcacagtggctggtggggaaaatgacacctgacaaaccgaaaggtccttttgagcttaggccaggtttcttgagctgaggtttggggagggggtaggtagctgctcccaatcttgttcccctaacctcaggtggtgctgcgggttcctgmcacttccagacctttccgcaggccattcttcctaagggtaggtacctctggagaagaaacccagcgatttggcccggtaggcgccccattcccaagacagtcccacagagctgactactcacttcctttctggagaaaggaggctacgccccagtacttcatcttgaacttggcagggtcctcggtgtctgtgaaggtgcccaccatgtctgcgcacacgtcccagttactgcaaaagccaaggggatcctcagccaagccgggcaaagggcttcctccctccctccacccattcggtgc

SEQ ID NO: 157226 - DNA, 601 bp, Human
agcatcagcaggccaggcacttgggaggcatccacccctatgcacagtgttccctccgtccttggatagggctctctcggcctctgtgggagccccagatagtcaagctgtctcagggattcagcccaaagagacggaggaaatgcagagctaggtggagtggtgatgtgaaagacaggaggagaaagcatggagaaagcacacaccttggcacagtggctggtggggaaaatgacacctgacaaaccgaaaggtccttttgagcttaggccaggtttcttgagctgaggtttggggaggsggtaggtagctgctcccaatcttgttcccctaacctcaggtggtgctgcgggttcctgacacttccagacctttccgcaggccattcttcctaagggtaggtacctctggagaagaaacccagcgatttggcccggtaggcgccccattcccaagacagtcccacagagctgactactcacttcctttctggagaaaggaggctacgccccagtacttcatcttgaacttggcagggtcctcggtgtctgtgaaggtgcccaccatgtctgcgcacacgtcccagttactgcaaaagcca

SEQ ID NO: 157227 - DNA, 601 bp, Human
tctacaagtcctcaacatcactcccctccacatctgattttcacagcttagtggaaagggaagaggccacagccacagcacactgtgcctggctcagaatctcagcatcagcaggccaggcacttgggaggcatccacccctatgcacagtgttccctccgtccttggatagggctctctcggcctctgtgggagccccagatagtcaagctgtctcagggattcagcccaaagagacggaggaaatgcagagctaggtggagtggtgatgtgaaagacaggaggagaaagcatggagaargcacacaccttggcacagtggctggtggggaaaatgacacctgacaaaccgaaaggtccttttgagcttaggccaggtttcttgagctgaggtttggggagggggtaggtagctgctcccaatcttgttcccctaacctcaggtggtgctgcgggttcctgacacttccagacctttccgcaggccattcttcctaagggtaggtacctctggagaagaaacccagcgatttggcccggtaggcgccccattcccaagacagtcccacagagctgactactcacttcctttctggagaaa

SEQ ID NO: 157228 - DNA, 601 bp, Human
ttacaataaaggacacttctaccctggatcaccgagcagagagagtctccctgaacaacccttggtcctatctcacagaagagctcaaacaatactttgcaaaagctggtctggattaggagtccctgcagttcagggccacctgatcctggcctgagatttggaagcctggcttctgacattggctctaacaaacttgttgcatgtccttgggcaaagttctcttggcctcagtttattcatctacatattgaaccccctccaaaaggttaactctccctctctaagattccatgatatrtgtcccctggcctgcattattctctagctaccaagtagattcctgatttgaaacttaggataaatggggaaaaaaatgggaaaaagagcatgtagacactgttttctcatgattaggccaaattttaggatgttcttctacaagtcctcaacatcactcccctccacatctgattttcacagcttagtggaaagggaagaggccacagccacagcacactgtgcctggctcagaatctcagcatcagcaggccaggcacttgggaggcatccacccctatgcacagtgttccctccgtcc

SEQ ID NO: 157229 - DNA, 601 bp, Human
aataataataaattaaaattaaaaattaaataaaatttaaaaatgcaatttcatccaacacacaactttagaggaagtccaagagggtggtgtgccatatatggagagcaaagggttacaataaaggacacttctaccctggatcaccgagcagagagagtctccctgaacaacccttggtcctatctcacagaagagctcaaacaatactttgcaaaagctggtctggattaggagtccctgcagttcagggccacctgatcctggcctgagatttggaagcctggcttctgacattggmtctaacaaacttgttgcatgtccttgggcaaagttctcttggcctcagtttattcatctacatattgaaccccctccaaaaggttaactctccctctctaagattccatgatatgtgtcccctggcctgcattattctctagctaccaagtagattcctgatttgaaacttaggataaatggggaaaaaaatgggaaaaagagcatgtagacactgttttctcatgattaggccaaattttaggatgttcttctacaagtcctcaacatcactcccctccacatctgattttcacagctt

SEQ ID NO: 157230 - DNA, 601 bp, Human
atgatggcgccactgcactccagcctgggtgacagtgagaccctgtctctaaaaaaaaaataataataaattaaaattaaaaattaaataaaatttaaaaatgcaatttcatccaacacacaactttagaggaagtccaagagggtggtgtgccatatatggagagcaaagggttacaataaaggacacttctaccctggatcaccgagcagagagagtctccctgaacaacccttggtcctatctcacagaagagctcaaacaatactttgcaaaagctggtctggattaggagtccctrcagttcagggccacctgatcctggcctgagatttggaagcctggcttctgacattggctctaacaaacttgttgcatgtccttgggcaaagttctcttggcctcagtttattcatctacatattgaaccccctccaaaaggttaactctccctctctaagattccatgatatgtgtcccctggcctgcattattctctagctaccaagtagattcctgatttgaaacttaggataaatggggaaaaaaatgggaaaaagagcatgtagacactgttttctcatgattaggccaaatttta

SEQ ID NO: 157231 - DNA, 601 bp, Human
ccaggcatgctggcccatgcctgtagttccagctactcaggaggctgaggtggtaggatggcttgagcccaggaggttgaggctgcagtgagccatgatggcgccactgcactccagcctgggtgacagtgagaccctgtctctaaaaaaaaaataataataaattaaaattaaaaattaaataaaatttaaaaatgcaatttcatccaacacacaactttagaggaagtccaagagggtggtgtgccatatatggagagcaaagggttacaataaaggacacttctaccctggatcaccragcagagagagtctccctgaacaacccttggtcctatctcacagaagagctcaaacaatactttgcaaaagctggtctggattaggagtccctgcagttcagggccacctgatcctggcctgagatttggaagcctggcttctgacattggctctaacaaacttgttgcatgtccttgggcaaagttctcttggcctcagtttattcatctacatattgaaccccctccaaaaggttaactctccctctctaagattccatgatatgtgtcccctggcctgcattattctctagctacca

SEQ ID NO: 157232 - DNA, 601 bp, Human
gagatcaagaccagcttgggcaagctggggagaccctgactccacaaaaaatacaaaaattagccaggcatgctggcccatgcctgtagttccagctactcaggaggctgaggtggtaggatggcttgagcccaggaggttgaggctgcagtgagccatgatggcgccactgcactccagcctgggtgacagtgagaccctgtctctaaaaaaaaaataataataaattaaaattaaaaattaaataaaatttaaaaatgcaatttcatccaacacacaactttagaggaagtccaagagkgtggtgtgccatatatggagagcaaagggttacaataaaggacacttctaccctggatcaccgagcagagagagtctccctgaacaacccttggtcctatctcacagaagagctcaaacaatactttgcaaaagctggtctggattaggagtccctgcagttcagggccacctgatcctggcctgagatttggaagcctggcttctgacattggctctaacaaacttgttgcatgtccttgggcaaagttctcttggcctcagtttattcatctacatattgaaccccctccaaaaggtt

SEQ ID NO: 157233 - DNA, 601 bp, Human
ggaatttatccttaagccttccatattatagtcatctcacttaatatctatagcaatcactttcaagatggcagtactttttcgccctccaaatgaaatcctgataaaataccaatatacaagagacaaaagcaaactaatctggtttgatagggggaggaggcaagaaacaaaatgctcccttctcattgggtcctctctgaccctgtgcctaaaggcattgccaacagaatcctagtccattaaggagcacatctcaaaatgctatagaacatatgtgtttcctctttctaaaaattartaatcttgtacctctggtattgatttttgtaatccattatcagaaaagtatattttactctaaataaatcactttgggatgttttgctgcactatttgaaataatttttattatttccaaggataataaataaaaataaagcttctaagctttttctctaccaggtatggtggctcatacttgtaatcccagcactttggaaggccgagatgggaggatggcttgagcccaggagatcaagaccagcttgggcaagctggggagaccctgactccacaaaaaatacaaaaattagccagg

SEQ ID NO: 157234 - DNA, 601 bp, Human
aagttccacaagtagtggtggagttgggatttgaacttaggaggtctaattttaaccgggcgggcttaactacaacactgcacagcttcttttttgaaatgtaacctaagaaggaatttatccttaagccttccatattatagtcatctcacttaatatctatagcaatcactttcaagatggcagtactttttcgccctccaaatgaaatcctgataaaataccaatatacaagagacaaaagcaaactaatctggtttgatagggggaggaggcaagaaacaaaatgctcccttctcaytgggtcctctctgaccctgtgcctaaaggcattgccaacagaatcctagtccattaaggagcacatctcaaaatgctatagaacatatgtgtttcctctttctaaaaattaataatcttgtacctctggtattgatttttgtaatccattatcagaaaagtatattttactctaaataaatcactttgggatgttttgctgcactatttgaaataatttttattatttccaaggataataaataaaaataaagcttctaagctttttctctaccaggtatggtggctcatacttgtaatc

SEQ ID NO: 157235 - DNA, 601 bp, Human
tcacttctctatgggccccagtttcttcacttctaaaacaagagacttgaacccagtggtctccatgggtcctcccattctagacccagaatctaaagctatgatttcacgaccagggagataactaagcagccatcatatcaaacacttacaaagaactcatgtctcaggcactgttctgagtgctttctgcctgttgactcattgcatcttgtaacacaactctatgaggtaggttctatgatcgtttcactttgcagatgacgaaataggcacagagaagtgaaggaacatatctaargttccacaagtagtggtggagttgggatttgaacttaggaggtctaattttaaccgggcgggcttaactacaacactgcacagcttcttttttgaaatgtaacctaagaaggaatttatccttaagccttccatattatagtcatctcacttaatatctatagcaatcactttcaagatggcagtactttttcgccctccaaatgaaatcctgataaaataccaatatacaagagacaaaagcaaactaatctggtttgatagggggaggaggcaagaaacaaaatgctcccttctcatt

SEQ ID NO: 157236 - DNA, 601 bp, Human
cctctaccatcctaggaagtggggtcatgctgcagctgtgtgtatactgtacctacacagactggtttagcggtttggactgccagtcccaaaaccaaagaaaatgcttggtagagggcgctgtctcaggcaacctggttccattggtctgttctgttgctcactgctgtgggcctggcatgtgtcctttcagctccctaaacctgcatgctccaatcatctaaagcagcaagaccaggtgggaagctccctgtggttctcaggcctaacagtccagctgagccagccaggcaacagattyaatgctatttctgatgcattgtcaaaataccccaacaggccccagaaaagtgagtggagtctgaggccttgatacctgagtaagccaagctcttcagattgaattatctagaccagtggttctcaaacttcattgtgcagaaacagcatacccaaggagcatacttaaaatgcagattccagggccgtgcccttagaatttctgactccataattctgggtttgagtccagaaatgtgcatttgttaacaagcaccctagtgtatttagatatagatggagcaggaaccctgactttgac

SEQ ID NO: 157237 - DNA, 601 bp, Human
ctttccctggttacgaggatcacagtgtctgtcacaggcaccctcagacacaaaaacacttgcctttgaaatgttacctcgactcatgatccaggcagctattagcttggccgatcggcagcttaactttttttttttttttttcctccaaaatggtcgccatcatttaaattttgacagaggaattaagtaactttcaatacttggatttagtaaaattggctactgttcttgactttaaaagaaggcctaagttggtttggttaatctccaggctcttttggctgaataattcaaagaygaggaatttaaatcatagtgaccttgaccaggctctcccttttaagagtatttgcaagagatgaactgccagagcactgcgagaatgaggttggttctctaacctcctcacacccggcagctgggcagggctcctctggagaaccagacacccccagccatttccagactccagctaaccgcatgcagtggagctagggacagagagcgttggaggcagtggctgtgtggctgggagcccctgcctcccctctaccatcctaggaagtggggtcatgctgcagctgtgtgtatactgtac

SEQ ID NO: 157238 - DNA, 601 bp, Human
gctggtcctaagttgcctctgggtgtgcctctctgagaacccctggagtgccagcctaggatggggttcagcccaaacccaggctctgcaggggggctgtcacaggagtgggtgtggagcccctctcttcaactcaccctaggcctgccaggagaatgagccactcctgtgccttgaggctgttccagggtaacagtgtcagaggtggggctgaggagatgttccagaaccatgactgctcagcaggaaccataaagttattcagcagaaaggctgggaacagaagccacagggctgcctsctgggcctcaccctaaccactgactcccctcacaggctccagagtatctgggtggtcttcctcatccttggatgaagtcattctttccctggttacgaggatcacagtgtctgtcacaggcaccctcagacacaaaaacacttgcctttgaaatgttacctcgactcatgatccaggcagctattagcttggccgatcggcagcttaactttttttttttttttttcctccaaaatggtcgccatcatttaaattttgacagaggaattaagtaactttcaatacttggatttagtaaaa

SEQ ID NO: 157239 - DNA, 601 bp, Human
aaaggctttgtgtctccatctcaggctcaggtgttggagcaaggggtgatgctccctctgcagtgttccagttggagaagcgcagagggaactggatcccccagcgttagagggtgtaaggccacctggaatgctggtcctaagttgcctctgggtgtgcctctctgagaacccctggagtgccagcctaggatggggttcagcccaaacccaggctctgcaggggggctgtcacaggagtgggtgtggagcccctctcttcaactcaccctaggcctgccaggagaatgagccactcctrtgccttgaggctgttccagggtaacagtgtcagaggtggggctgaggagatgttccagaaccatgactgctcagcaggaaccataaagttattcagcagaaaggctgggaacagaagccacagggctgcctgctgggcctcaccctaaccactgactcccctcacaggctccagagtatctgggtggtcttcctcatccttggatgaagtcattctttccctggttacgaggatcacagtgtctgtcacaggcaccctcagacacaaaaacacttgcctttgaaatgttacctcgactca

SEQ ID NO: 157240 - DNA, 601 bp, Human
acctctcacattgatccaaaactgcacactatcatcctctactttacaggtgaggaaactgaggcacagagatacttaataattcacctagggtcacaaagagcagggcagaactgggattcaagcaagggagtgtgatcccagagcccacatgcttcacctctacaccacactgtctccagacaatcagtacactgacgggagaggggcaagaaacaaaaaggctttgtgtctccatctcaggctcaggtgttggagcaaggggtgatgctccctctgcagtgttccagttggagaagcrcagagggaactggatcccccagcgttagagggtgtaaggccacctggaatgctggtcctaagttgcctctgggtgtgcctctctgagaacccctggagtgccagcctaggatggggttcagcccaaacccaggctctgcaggggggctgtcacaggagtgggtgtggagcccctctcttcaactcaccctaggcctgccaggagaatgagccactcctgtgccttgaggctgttccagggtaacagtgtcagaggtggggctgaggagatgttccagaaccatgactgctcagcaggaac

SEQ ID NO: 157241 - DNA, 601 bp, Human
ggtcacggcttctctggctccatcctaattctgcttattaatgctactcacttctttgtgccggcaaagagtaggttttgccttgaggacacaagaggcccaccatctggcatcagatattccttctcagaccttgtcctcttcacaactcacagaggcagagctgagccactgaatttagattatatgtattcctcaaggctgaaatgtaagccatgaagaataagagtaaatgaaagtggtaaaaatatcaacgaaggcaggagaggaaagaatgttaattagagtatatgtgtggccrggcaccatggctcgtgcttgtaatcccagcactttgggaggctgaggtgggagggtaacttgaggccaggagtttgagaccaacctgggcaacatagtgagacctggtatctatgaaaaatgaaaataattagccaggtggggtgacatgcgtctgtggtctccactacttgcggctgaggcggcaggatcgttttgagcccaggaggtcaaggctacaatgagctaggtttgcaccactgtactccagcctgagtgagagtgagattctgtcttaaaaaaataaaaaagaaagaaaaaa

SEQ ID NO: 157242 - DNA, 601 bp, Human
gcagtgtagccaggggtgaccacagaaatggcccgaggaagcagaataaaaagaaaagagagcccacggcagtgttagtgccagtgaactggacaaaggcctttacccacacctgcatgagccctatgagaaggccagtgaaaaatctggccaagcaggatctggatttggcctcagaaaggggctcccaagaacccctgttttctctggggtacggacaaaatgaatttcactagcacgtgggccccttagtccaaacccactgccctgcaggaagagccagaaggcaccctgctcctgactcaccgttgtggacgatcagcctgtactgcctggccaggcacagctcctcctgccgctgccttacaatcttctgcgcttctgggggcaggccgttggggtcccgggaaaacacgaaggagtagctgtcagcacaggtgccatcgaggttcaggaggcggcaggagtactgcacggcatacgtgtcgtagtctgtgtcgacgatccagtggtcatcatctgcaagccagaaagccaccatgccgatcaatgcctttccctcatgggctcagatgtcggagaaactcacgaccaggcctga

SEQ ID NO: 157243 - DNA, 601 bp, Human
acgtcaatggccacatgaactgcccacctctttactgggctgctcaatcccaaacaatcttaattcagtcacaatggttttttggggcagtgtagccaggggtgaccacagaaatggcccgaggaagcagaataaaaagaaaagagagcccacggcagtgttagtgccagtgaactggacaaaggcctttacccacacctgcatgagccctatgagaaggccagtgaaaaatctggccaagcaggatctggatttggcctcagaaaggggctcccaagaacccctgttttctctggggtayggacaaaatgaatttcactagcacgtgggccccttagtccaaacccactgccctgcaggaagagccagaaggcaccctgctcctgactcaccgttgtggacgatcagcctgtactgcctggccaggcacagctcctcctgccgctgccttacaatcttctgcgcttctgggggcaggccgttggggtcccgggaaaacacgaaggagtagctgtcagcacaggtgccatcgaggttcaggaggcggcaggagtactgcacggcatacgtgtcgtagtctgtgtcgacgatccagtggtca

SEQ ID NO: 157244 - DNA, 601 bp, Human
acaagggtaatatctcctaaaagatcctatggttgttccagagaatctcaaaacccccaactgaggaaacccagctagacaatgtcatggctatttggtttcatatagaaaaaagaaggtgcgttgaaatcattctctttggagcttactacattgatgccccctgtggagtttttacgtcaatggccacatgaactgcccacctctttactgggctgctcaatcccaaacaatcttaattcagtcacaatggttttttggggcagtgtagccaggggtgaccacagaaatggcccgaggragcagaataaaaagaaaagagagcccacggcagtgttagtgccagtgaactggacaaaggcctttacccacacctgcatgagccctatgagaaggccagtgaaaaatctggccaagcaggatctggatttggcctcagaaaggggctcccaagaacccctgttttctctggggtacggacaaaatgaatttcactagcacgtgggccccttagtccaaacccactgccctgcaggaagagccagaaggcaccctgctcctgactcaccgttgtggacgatcagcctgtactgcctggcca

SEQ ID NO: 157245 - DNA, 601 bp, Human
tcctgcctcaacctcgtgagcagctgggattacaggcgcatgccaccacgcctggctaatttttgtatttttagtagagatggggttttgccatgttggccaggccaatcttgaactcctgacctcatgtgatcagcccacctcggcctccaaaagtgctgggatttcaggtgtgagccaccatgcctggcccattttgtttctctacattttagcattactgtatttggattttgaaacccagtatcccatagcaatgagtgagtgtccactcaaactaaatggagctctttcctgcacmatgttcctggctttaaaatcaagatcagacaagggtaatatctcctaaaagatcctatggttgttccagagaatctcaaaacccccaactgaggaaacccagctagacaatgtcatggctatttggtttcatatagaaaaaagaaggtgcgttgaaatcattctctttggagcttactacattgatgccccctgtggagtttttacgtcaatggccacatgaactgcccacctctttactgggctgctcaatcccaaacaatcttaattcagtcacaatggttttttggggcagtgtagc

SEQ ID NO: 157246 - DNA, 601 bp, Human
tggcacaagggacttcagagtcacaaaactctaggtttgcatccaactcagctacctattaaagatttagggcaactttcttcctcattgtcagcctctgttttctcatctgtacaatgtgcataatctgcttcctacggtgccctgctgtggtggaatccttgctggccctacatttaattttgaagggtgaagcttcaaaatcaatttgattttggtctaagttcccatctgtttggtgtagtgggtcagttcgtgaccaacagaaatgctccattttgtttgattattattattattwtttttttgaggcagaatcttgctctgttgcccaggctggaatgcagtggtgcaacctcaactcactgcagcctccgcctcccgggctcaagtaattctcctgcctcaacctcgtgagcagctgggattacaggcgcatgccaccacgcctggctaatttttgtatttttagtagagatggggttttgccatgttggccaggccaatcttgaactcctgacctcatgtgatcagcccacctcggcctccaaaagtgctgggatttcaggtgtgagccaccatgcctggcccattttgtttc

SEQ ID NO: 157247 - DNA, 601 bp, Human
gtgtggcacaagggacttcagagtcacaaaactctaggtttgcatccaactcagctacctattaaagatttagggcaactttcttcctcattgtcagcctctgttttctcatctgtacaatgtgcataatctgcttcctacggtgccctgctgtggtggaatccttgctggccctacatttaattttgaagggtgaagcttcaaaatcaatttgattttggtctaagttcccatctgtttggtgtagtgggtcagttcgtgaccaacagaaatgctccattttgtttgattattattattwttatttttttgaggcagaatcttgctctgttgcccaggctggaatgcagtggtgcaacctcaactcactgcagcctccgcctcccgggctcaagtaattctcctgcctcaacctcgtgagcagctgggattacaggcgcatgccaccacgcctggctaatttttgtatttttagtagagatggggttttgccatgttggccaggccaatcttgaactcctgacctcatgtgatcagcccacctcggcctccaaaagtgctgggatttcaggtgtgagccaccatgcctggcccattttgt

SEQ ID NO: 157248 - DNA, 601 bp, Human
gcctgatacttggacttgatgtgaggggcagtaagggataggtgtttctattaattaatgaattaactaggacttagtaaaaggccagtgataaggagaatgagtttcagttagaaatagcatccgtttgataggtgtacatgttttaaggcctggctttggaattttcacatttaaaaatgtaaaattgagttagtagcaggagaacatgacattcatttcttaagacaaaagcaacaagagagatatttgacattctcataggaacattttgaaattttgtgagcggactaaaaatctratttcaagccaagccttgtaattttgttgagtggacatggattttaagtacagtggaagtgcagtcttgtagagacctctgattagttttgtttaaacagctcctggaacagatgtgataaaacatattaaaatggctactctggttaaaggttaaagccagatggagggaggaggctggttttcagccctagaacttagctgccttacaagttgtccttgaacaagtaacttaacctttctgtgactgcctcagttttccctctgtaaaaataaggaaatattttgtgtcactcttatt

SEQ ID NO: 157249 - DNA, 601 bp, Human
aatttctgtctctggcaggctcttacatcgtcgactaggcagcatacctgtgctaatcaaagacagtctggagggagtgacctgctttaggctttattggtttggcaacgttttaattcttacgcaactctgggtatgtttatggcactatgtaaatgttacataagaacatggaggctgagaagtggccagaatggtgactgtgaacacaggaaggttagactgaggactttatccaaaaggaccttgggaatctgcaatcagtacaggaagaacctgcacttattttcctctaagaacstttttagatgattatgtctttcaggtggactgctgtgttataaataggtttattctccaccggtgagctaattgtaaccttgctaccaaaatatgaatcagtaaacgatgagacgtgctgcttcttccagcatgtcctgttgaagctgcttgttgcattttggaacatgagttgaattgggttgcagtctgttctcataatagctgaggagcacagggtgttgaggtggaatggaattatcagttcgtggtgctttaggtcatcttaatttttgaaggttaaattagaatactgaagtgg

SEQ ID NO: 157250 - DNA, 601 bp, Human
ggctcttacatcgtcgactaggcagcatacctgtgctaatcaaagacagtctggagggagtgacctgctttaggctttattggtttggcaacgttttaattcttacgcaactctgggtatgtttatggcactatgtaaatgttacataagaacatggaggctgagaagtggccagaatggtgactgtgaacacaggaaggttagactgaggactttatccaaaaggaccttgggaatctgcaatcagtacaggaagaacctgcacttattttcctctaagaacctttttagatgattatgyctttcaggtggactgctgtgttataaataggtttattctccaccggtgagctaattgtaaccttgctaccaaaatatgaatcagtaaacgatgagacgtgctgcttcttccagcatgtcctgttgaagctgcttgttgcattttggaacatgagttgaattgggttgcagtctgttctcataatagctgaggagcacagggtgttgaggtggaatggaattatcagttcgtggtgctttaggtcatcttaatttttgaaggttaaattagaatactgaagtggctctttataattttgaa

SEQ ID NO: 157251 - DNA, 601 bp, Human
tgggatgaaactgttccacctcagatcatcaagcacatcaggccgaggtgggtggatcacctgaggttgggagttcaagaccagcctggccaacatggtgaaaccccatctctactgaaaataaaaaattagccgggcatggtagtggcagcgcatgcctgtaatctcagctactcaggaggctgaggcaggagaatagcttgaatccgggaggcggaggttgcagtcagccgagatcacgccactgcactccagcctggggaacagagtgagactcctcaaaaaaaaaaaaaaagaaaaraaagatcatcaggcacatcaagcatgttagattctcataaggtgcatgcaagctagatgcctcgcatgcgcggttcaccgtaggtttcccactcctatgagaatctaatgccgccgctgatgtgacaggaggcagagctcaggtacccgcctgccacttacctcctgctgtgtggcctggttcctaacaggccgtggaccagtaccggtctgtggccccaggggttggggacccctgatccaaagggtcccttgacacatatttattgagcacctgtcatatactaggcattgttacagg

SEQ ID NO: 157252 - DNA, 601 bp, Human
tgggatgtttgagttgaggaatctgggaattgaagtattttctgggttttttttttttttgtggtagaggactcaccttgccccacatccttgtatattgctttggtatatgtttgcatattaccttttatacctgtagaagataagattgaattgtaatcagtcagtgttcatttctgatatccaggatgtgcctagcaccaagctgaatgctgagagggatcctgaggaaagagtctgtccttgccctttggaagtttacacacagagaccggccacagtggctcatgcctgtaatccmaacactttggagaatgaggtacaggggatcgcttcagtccaggagtttgagactagcctgggcaatatagtgagacctcgtctctacaaaacatttttaaaaattacaagggcttggtggcgtgtgcctgtggtcccagctacttgggaggctgaggtgggaggatagcttgagaccaggagattgaggctacagcaaaccatgattgcaccactgcactccaccctgggtgacagagtgagatcctgtctcaaaaaaaaaagtttacacacaaatggactttttttctgcttgttggaa

SEQ ID NO: 157253 - DNA, 601 bp, Human
accaagcttatcaagtgtcttattgttaaatctgtgtttctccccaccccccaccatacaaatagcttcctttattaagtcagttatattttttttcataagtactttttaccagtacatttgttgttgttgttgttgtttttctgtataccaccattggcacctgtaaaatttgactttattatggcttgtgggtacttgaaagctttttgttttaatgtatttttaaaatctaattttgatgattgtaaaaggtgaaaatgtaacttgggtctttttttcttttaaccaaatagcatgkgattgctttactgctgcaagatttttctatttaggctagttagaactttgctagtacagtatcagttcctagttattgccttcctgccccccaagaaagccacacattgcctctattttgtgaacagtttagtgccagacattttttaacctgattcagattttcataaacattttggcagttgtctagatcagtagctattaacaattgtctttctttttaagacagtggaactcttaaaaatgaaaatgtagaaatgtatataaagtgagtaaaagctgagcaactctggcagaggcc

SEQ ID NO: 157254 - DNA, 601 bp, Human
ttccagtttctctaaatcttcaccaacacttattaaatttctttttcatattgttatggccttcctagtggatataaagtagtatctcattatggttttgatttgcatttgaatttgcaatacattagagatgatgttgaacatcttttcatgtgtttgcaggccatttgtatatcttcggagaaatgtctgttcaggtctttttccagttttgttggttttttaaaaattatgttttttagagaagggttcttgctctgtcacccaggctggagtgcagtggtgtattcttagctcatcrcagccttgaactcctgggcttaagagatcttcttgcctcagactcctgaatagttgggaccgcaggcatgcaccaccttgcgtggctcctgttcagtttttaattgggttgttgttgagtttgaaaagttttttatatattctggattctagaccattttcagatgtatgatttgcgtatattttctcctgttcattgtcttttcattcttttgatattgccctttgatacacaaaggtttttaattttgatgaagtccagtttatccattttacttttgttgcttgtgctttggtgtca

SEQ ID NO: 157255 - DNA, 601 bp, Human
tttgtatatcttcggagaaatgtctgttcaggtctttttccagttttgttggttttttaaaaattatgttttttagagaagggttcttgctctgtcacccaggctggagtgcagtggtgtattcttagctcatcgcagccttgaactcctgggcttaagagatcttcttgcctcagactcctgaatagttgggaccgcaggcatgcaccaccttgcgtggctcctgttcagtttttaattgggttgttgttgagtttgaaaagttttttatatattctggattctagaccattttcagatrtatgatttgcgtatattttctcctgttcattgtcttttcattcttttgatattgccctttgatacacaaaggtttttaattttgatgaagtccagtttatccattttacttttgttgcttgtgctttggtgtcatatctgacagaccattgccaaatccaagttcatgaagttttacccctcttctgagagttttagaagtttaagttttagttgatatatttaggtctttgatctattttgagttaatttttgcacatggtgttaggtaagggtctgacttcattctttcgcatgtggt

SEQ ID NO: 157256 - DNA, 601 bp, Human
tcaggtctttttccagttttgttggttttttaaaaattatgttttttagagaagggttcttgctctgtcacccaggctggagtgcagtggtgtattcttagctcatcgcagccttgaactcctgggcttaagagatcttcttgcctcagactcctgaatagttgggaccgcaggcatgcaccaccttgcgtggctcctgttcagtttttaattgggttgttgttgagtttgaaaagttttttatatattctggattctagaccattttcagatgtatgatttgcgtatattttctcctgtycattgtcttttcattcttttgatattgccctttgatacacaaaggtttttaattttgatgaagtccagtttatccattttacttttgttgcttgtgctttggtgtcatatctgacagaccattgccaaatccaagttcatgaagttttacccctcttctgagagttttagaagtttaagttttagttgatatatttaggtctttgatctattttgagttaatttttgcacatggtgttaggtaagggtctgacttcattctttcgcatgtggttatccatttgttcatcaccatattttg

SEQ ID NO: 157257 - DNA, 601 bp, Human
tctggagaagggcagctgtcatgctatgaggagcctaagctaacctaagctaacccacacaaagggactacaggttgaacatccctaatccaaaatgctgcaaaatccaaaatttttttagcaccaacgtgctcaaaggaaatgctcattggagcatcttgatttcagattttcagattagggttgcccagtcagatatatatgaaaatattctaaaatcccccaaaatcagaaatctgcaatgctttctggtccgaacattttggataaagaatgcttatcctgtagttggagaggaccrcatcaagaagaacgaaggtccccagccaacagccagcatcatgcgccaaatgtaagcgtgagtaagccttcagatgattccagccccagccttggagtcttccacctgaagccccagatgttgtggagtagagataagctgtccctgctgccctgcccaagttcctggctcatagaatccatgcatagattaaatggttgttctatgccacaagtttttggagtaatttgttatatggccatagtaactgggacaatgttatttttcttcccatctcaaaggactttaatgttgtcgtcg

SEQ ID NO: 157258 - DNA, 601 bp, Human
caaaagatctcaccattgatgtcaatgtctgctccccaatttcctgcagctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtgagtgcatgyccttgttgggctagtggctcagcttggagatagggtaccccgtcatttcatttttttctactcttgcccactcacttggtttgacgataaagatgccttttggatgttcccgaaggtgacaaaggctggggtttctcagcagttgcttttgtagattagagggtgaggaagcagattttcaagttagtcccagaggtgcccgcagtgtttagagtagtggcttagcagccataggcagcggtgaggagtggaagaaccaggcagggattcccacgggaggatgtgggactgatccagaaa

SEQ ID NO: 157259 - DNA, 601 bp, Human
gtgaggagggaccagaataggaaaaggccagtgaccaaagccgagaaacaccacataccatccttttgcaagcctaccattcaggaggcattactgtggagcccacaggaaaaggagagaaactaaagcagagcttagaggagctgtgggaagttaaagggcagaaacaggcatctgtgtaggggcctgaggcggggatagtaccacgaaatgcgtgaggtgacaaagtgggttgtgggtttgactgtggaaagaggtgccttaactaaagaagttgggcatttgagagcatctaggcagacaagactagcccagaagattagagagatcaagggagcctgaacacatcgacagggaaaggggtctttttcactcttcactttgaggggggtgtttttactctttcccttgtttttacttctcattctttccctctcctctctcacttgactcaggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgc

SEQ ID NO: 157260 - DNA, 601 bp, Human
tgactcaggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcaggtaccaagttcttcagggcatcatgtctgtggttggctttcatcagtttcccagcaggatagagtgcttgtagagaaggctggaggccctgcatttgtttctaccagcattgagtcatttggtttcctagttccccttcttttggagtctgacgtgtaataagataagataatgggttcacagaaaatctctcattccgtgggattcccaaggtctagtacacaattatccactacagaagtcctgcctctctaagctttgcaactgtacgtacatctattaaaattcagctggtcccacctgagcagtggagtgctcaatttcagggccccttttgagaaaca

SEQ ID NO: 157261 - DNA, 601 bp, Human
atgtgaacatgaatgcaaaagaatttttttacttacttatttatgtatttatttatttagaaacagagtcttgctctgtttcccaggcaggagtgcagtggcgcaatttccgctctctgaaacctccacctgcctggttcaagtgattctcctgcctcagcctcctgagtagctgggattacaggaatgcgccaccacagcgactaatttttgtatttttagtagagacaaggtttcgccacatcagtcaggctggtcttgtgttcttgacctcaagtgatccgcctgcctcgtaaagaawttttttaatgaagataaaccattatttttgtgacaatggtattgcattcctttttttttttttttttttttgttttaagatatggtctcgctctgttgttgcccaggctgcagtgccattgtgcaatcacagctgactgcagccttaacctcctgggctcaagagatcctccaccttagtctcctgagtagctgagatgtcaggcatgtgccaccaagcctggcaatttttttttttttttttttttttgtggaaggtttcactttgttgcccaggctggtctcaaattcttggcttcaa

SEQ ID NO: 157262 - DNA, 601 bp, Human
tggctgactgtgggaattgatttgctgctagaggagggtagattgggttttccaaagtctttttaagacccagaccagctgaaacaagggaagggccatggtagttgtttagtcgtctgtggtaaaatggttaataactatttccctctgagtggtttagtatattcttcattcagaatatgcagagcttccaaggtgttaggtttctaataatgtggtttttaaagtagtaagtccatgctgctcatatgactttcaattcatttaaataagtatatactgaataccttctgggtgatayggttttaaacagattagaaagagcctgacccggccaggcgcggtggctcacgcctgtaatcccagcactttgggaggctgaggtgggtggatcatgaggtcagaggagatccagaccatcctggctaacatggtgaaaccctgtctctactaaaaatacaaaaaattagccgggcgtggtggcgggcgcctgtagtcccaggtactcaagaggctgaggcaggagaatggtgtgaacctgggaggcggagcttgcagtgagccgagatcacgccactgcactccagcctgggcaacagag

SEQ ID NO: 157263 - DNA, 601 bp, Human
cccaggatagagatttggggcacccttcaagattatgggcctgcttcccacttcatgcagaagtgaggtaagaagtaaggagctgtgattgcaaattgacttcatgagttggaaatgggactgccttttaatagagtggaagaggtggaaatctgctgaatctaaatgaatttaattaagattatcccctgatttattgtgggggctggggtggctggaatcatagtaattactcataattactactcagagtcattaagggtgccgctgaccacctctagaattaattttgacatatctrtagtcaggtaagataacaaaagcagttcggaatgaaacttaagctcaacccatcactgtgactacattcaataaagtgaaggaccctggtgtcaaccaaatattaggtactgttactgcccctgtgacccacattacaagtacttctgccaagaagtcaaaacatgcttcaaataaacaaatctttactctctctttgtttttttgatatggagtttcgctcttgttgcccaagctggagtgcaatggcacagtcatggctcactgcagcctccgcctcccgggttcaagtgattctcct

SEQ ID NO: 157264 - DNA, 601 bp, Human
ggtacctttcttttttgcctttgctcctacctcccattccaggatgctggatcacccaaagctgttttactgccccctttctttttacaacctgttggatgcctgttgccagagcctgaatcatcgtttaaggttgccatcaaaggtgtggaggtagctgtgcttagggtgcgtttattcttcagggatcagtttgttgaatagcgttgtgtgttatggtaaccattctgaaggctcgtttggctttataaacaaacaaacattgttttattagtccgtggcggggagtgccccggtgcgmatagcacgggattcatgcagtggtctccttcacatcagaagcagtatattctaacgcggtggctcccaagccacattcatgggaaaccctgctgtttcattgttaaaataatagtgctaatttctaaatttataaaagtgcatagatttttcttaaaagtgagttttttctcccatagttaaaaatcgttggcatttgcagctgcttattcatgacagaatccagtaagaaatagtatcagatttagcagaaacactttttattgtcaacttagtatatcagtattttatgataatttcc

SEQ ID NO: 157265 - DNA, 601 bp, Human
cgttgtgtgttatggtaaccattctgaaggctcgtttggctttataaacaaacaaacattgttttattagtccgtggcggggagtgccccggtgcgcatagcacgggattcatgcagtggtctccttcacatcagaagcagtatattctaacgcggtggctcccaagccacattcatgggaaaccctgctgtttcattgttaaaataatagtgctaatttctaaatttataaaagtgcatagatttttcttaaaagtgagttttttctcccatagttaaaaatcgttggcatttgcagctkcttattcatgacagaatccagtaagaaatagtatcagatttagcagaaacactttttattgtcaacttagtatatcagtattttatgataatttccatatattctgccacatgatcaagttccaggacctctagagccctactctcagccatttatctgtgatataagagattccagggcagtgaaagtgattgaaaaaaagaactggtggtgctcacttcgccagcacatatactaaaattggaacaatacagagaaggttagcatggcccctgcacaaggatgacatgcaaattcctg

SEQ ID NO: 157266 - DNA, 601 bp, Human
ctactcaggaggttgaggtaggagagactccatctctacttaaaagaaaaaaaattgtctcattagctcaagacagcagggtttttttgttttgttttgtttttctttttctggaaaagggcttgagaaaaattaattggctttttatttttatttttttgagagagggtttctctttgtcacccaggctgtattgccatggcacaatcttagctcactgcaacctccgcctcctgggttcaagccagtctcctgcctcagcctcccgagtagctgggattacaggtgcccaccaccactsccggctgatttttctgtttttagtagtgatggggcttcattgtgttggccaggctggtctcgaactcctgacctcaggtggtccacctgccttagcctcccaaagtgctaggattataagcgtgagccactgtgcctggcctaaattggctttttaaaactatctttttattatggaaaatctttctaagtttgtagttcttaaagatgaggacttaaaaaaatgcagtgctattaccacactttaaaaaatgaacattaggccgggcgcggtggctcatgcctgtaatctcagcacttt

SEQ ID NO: 157267 - DNA, 601 bp, Human
actcaggaggttgaggtaggagagactccatctctacttaaaagaaaaaaaattgtctcattagctcaagacagcagggtttttttgttttgttttgtttttctttttctggaaaagggcttgagaaaaattaattggctttttatttttatttttttgagagagggtttctctttgtcacccaggctgtattgccatggcacaatcttagctcactgcaacctccgcctcctgggttcaagccagtctcctgcctcagcctcccgagtagctgggattacaggtgcccaccaccactccsggctgatttttctgtttttagtagtgatggggcttcattgtgttggccaggctggtctcgaactcctgacctcaggtggtccacctgccttagcctcccaaagtgctaggattataagcgtgagccactgtgcctggcctaaattggctttttaaaactatctttttattatggaaaatctttctaagtttgtagttcttaaagatgaggacttaaaaaaatgcagtgctattaccacactttaaaaaatgaacattaggccgggcgcggtggctcatgcctgtaatctcagcacttttg

SEQ ID NO: 157268 - DNA, 601 bp, Human
ttataagcgtgagccactgtgcctggcctaaattggctttttaaaactatctttttattatggaaaatctttctaagtttgtagttcttaaagatgaggacttaaaaaaatgcagtgctattaccacactttaaaaaatgaacattaggccgggcgcggtggctcatgcctgtaatctcagcacttttggaggccgaggtgggctgatcacaaggtcaggagtttgcaaccagtctggccaacatagtgaaaccccgtctgtactaaaaatacaaaaaaattgccaggtatggtagcgtaygcctgtagtcccagctacttgggaggctgaggaaggagaatcacgtgaaccaaggaagtggaagttgcagcaagccgagatcgtgccactgcactccagcctgggcaacagtggagactccgtctcaaaaaaggaaaaaaaaatgaacattaggggtcaggtgcggtggctcgcacctgtaatcccagcactttgggaggctgaggcgggcagatcacccgaggtcaggagttcaagaccagcttggccaacatggtgaaaccccgaatctactaaaaatacaaaaattagccgggcatg

SEQ ID NO: 157269 - DNA, 601 bp, Human
gtggcaagagtgaaactcacacacacacacacaaatttagtgctttttttttttttttttttttttgagacagagtctcactgtcacccaggctggagtgcagtggcgtgatcacagctcactgtagcctccacctctccaggctcaggggaacctttcactccagcctcctgagtagcttgggactacaggtgcaccaccatgccctactaatttttgtattttttgtggagacaagggttttgccatgttgcccaggctggtcttgaactcctgtgttcaagcaatccttccacctcgrcctcccaaagtgctagaattagaggtgtgagccattgtgcctggcaaacattaatgtcacttaacatctagtcagtgttgagatttccccagtctcctaaatttttaaagcagtttgttcaaatcggggttccaataagttttatcccctgcagttgatgaatacacctcctacatttcttgtctacatgttccccctcattttttcttcccactctgttttttcggagaatccaggtcatttgtcctgtagaatttcccaggctagattttgcagattgcttaggtagagttcacatat

SEQ ID NO: 157270 - DNA, 601 bp, Human; identical to SEQ ID NO: 157248

SEQ ID NO: 157271 - DNA, 601 bp, Human; identical to SEQ ID NO: 157249

SEQ ID NO: 157272 - DNA, 601 bp, Human; identical to SEQ ID NO: 157250

SEQ ID NO: 157273 - DNA, 601 bp, Human; identical to SEQ ID NO: 157251

SEQ ID NO: 157274 - DNA, 601 bp, Human; identical to SEQ ID NO: 157252

SEQ ID NO: 157275 - DNA, 601 bp, Human; identical to SEQ ID NO: 157253

SEQ ID NO: 157276 - DNA, 601 bp, Human; identical to SEQ ID NO: 157254

SEQ ID NO: 157277 - DNA, 601 bp, Human; identical to SEQ ID NO: 157255

SEQ ID NO: 157278 - DNA, 601 bp, Human; identical to SEQ ID NO: 157256

SEQ ID NO: 157279 - DNA, 601 bp, Human; identical to SEQ ID NO: 157257

SEQ ID NO: 157280 - DNA, 601 bp, Human; identical to SEQ ID NO: 157258

SEQ ID NO: 157281 - DNA, 601 bp, Human; identical to SEQ ID NO: 157259

SEQ ID NO: 157282 - DNA, 601 bp, Human; identical to SEQ ID NO: 157260

SEQ ID NO: 157283 - DNA, 601 bp, Human; identical to SEQ ID NO: 157261

SEQ ID NO: 157284 - DNA, 601 bp, Human; identical to SEQ ID NO: 157262

SEQ ID NO: 157285 - DNA, 601 bp, Human; identical to SEQ ID NO: 157263

SEQ ID NO: 157286 - DNA, 601 bp, Human; identical to SEQ ID NO: 157264

SEQ ID NO: 157287 - DNA, 601 bp, Human; identical to SEQ ID NO: 157265

SEQ ID NO: 157288 - DNA, 601 bp, Human; identical to SEQ ID NO: 157266

SEQ ID NO: 157289 - DNA, 601 bp, Human; identical to SEQ ID NO: 157267

SEQ ID NO: 157290 - DNA, 601 bp, Human; identical to SEQ ID NO: 157268

SEQ ID NO: 157291 - DNA, 601 bp, Human; identical to SEQ ID NO: 157269

SEQ ID NO: 157292 - DNA, 601 bp, Human; identical to SEQ ID NO: 157248

SEQ ID NO: 157293 - DNA, 601 bp, Human; identical to SEQ ID NO: 157249

SEQ ID NO: 157294 - DNA, 601 bp, Human; identical to SEQ ID NO: 157250

SEQ ID NO: 157295 - DNA, 601 bp, Human; identical to SEQ ID NO: 157251

SEQ ID NO: 157296 - DNA, 601 bp, Human; identical to SEQ ID NO: 157252

SEQ ID NO: 157297 - DNA, 601 bp, Human; identical to SEQ ID NO: 157253

SEQ ID NO: 157298 - DNA, 601 bp, Human; identical to SEQ ID NO: 157254

SEQ ID NO: 157299 - DNA, 601 bp, Human; identical to SEQ ID NO: 157255

SEQ ID NO: 157300 - DNA, 601 bp, Human; identical to SEQ ID NO: 157256

SEQ ID NO: 157301 - DNA, 601 bp, Human; identical to SEQ ID NO: 157257

SEQ ID NO: 157302 - DNA, 601 bp, Human; identical to SEQ ID NO: 157258

SEQ ID NO: 157303 - DNA, 601 bp, Human; identical to SEQ ID NO: 157259

SEQ ID NO: 157304 - DNA, 601 bp, Human; identical to SEQ ID NO: 157260

SEQ ID NO: 157305 - DNA, 601 bp, Human; identical to SEQ ID NO: 157261

SEQ ID NO: 157306 - DNA, 601 bp, Human; identical to SEQ ID NO: 157262

SEQ ID NO: 157307 - DNA, 601 bp, Human; identical to SEQ ID NO: 157263

SEQ ID NO: 157308 - DNA, 601 bp, Human; identical to SEQ ID NO: 157264

SEQ ID NO: 157309 - DNA, 601 bp, Human; identical to SEQ ID NO: 157265

SEQ ID NO: 157310 - DNA, 601 bp, Human; identical to SEQ ID NO: 157266

SEQ ID NO: 157311 - DNA, 601 bp, Human; identical to SEQ ID NO: 157267

SEQ ID NO: 157312 - DNA, 601 bp, Human; identical to SEQ ID NO: 157268

SEQ ID NO: 157313 - DNA, 601 bp, Human; identical to SEQ ID NO: 157269

SEQ ID NO: 157314 - DNA, 601 bp, Human
ttgggatctgctgcctttgctcagtgtgcagggttggggtggaaatgggggacaggctagggcctctgcattaggctgccttcttaggcaggtgggctttcacttccagctcctcttccattttcacgatgtccttcttcctaggcactgcgaggggaggagaaaaggggctttgcagaggcctgggagtattcccaggaagtgcctggttggcgaaacaaccagggagctgctcctgggagctgggctgaggctttgctgggctgcctctcccactcacccttctcccggcccccaccaygccttccccatgggggaggggcagggggctggaggaacacagcttccccctgttctagcagagaaatgctggctgtatgcctcccctagggttcccaggctgactagggtgtggctggccttctgatggagcccactcatgctgggccgctgcccaggggctttgtggcacctaggtcgagatggtactcaggccaggggtcaggattcctgggtgctctggtcccggtgcctctgtctcatctttaggctgggattcctgccaccttgctgctctggggcccaaatactttgagacaag

SEQ ID NO: 157315 - DNA, 601 bp, Human
cctcccctaagttcccccctccccaccccacactctgacagcttgttccgtgttgcccccccacccagcgcacagtgcagaaaaacgccaagtacatctgcctggctaacaaggactgccctgtggacaagaggcggcgaaaccgctgccagttctgccgcttccagaagtgcctggcggtgggcatggtgaaggaaggtgtgtggctggggtgcggcccagcggggcaagggtaggcttgagtggagtgggaccagcagggcccccaggcttctgccctggaggacccagaggagggcaygtcttatttccaccccacctctgaaccccaggccttggagggaggcagcctacacctgcctggattgtgagggtggtggcagggggaggttcctatagggtaccttggatctcagggactctgggtcctagggactcggtggggcgcgtctcagcagtggtgtgcacggcttgggctgagaggcccttcctcagatcccttccttcctcacccctacccattcctttgcagttgtccgaacagacagcctgaaggggcggcggggccggctaccttcaaaacccaagcagcccccagatg

SEQ ID NO: 157316 - DNA, 601 bp, Human
ttctgacagtgcagatcagattggttgtgcctgttttggactttatgtaaatgtagttctgcaggatggaatctggtgttgaatgcagaggttttcagatttctctgttttttaaaggaaagaatccaccctcgttcattttttcacttaaattgcacaggggacccaacgatatagaacacaatcagaggtactctgggctgagggagtgctgagttctgaggctgggtttctcagaacagtctagattttaaaaacccaatgatctagccagaaaacgtaggttaggattttatttccygtttgtgaccctgggcaagtcattagcctcctgggcctcgggttctcacttggagtatgaggataatgagggttactgcttctcagacttgtgacgatgcttactaatggccaacatgtgaatgcgcttttgtgaagtgccagcagagcatgaggggtggtcaggggcagcagttttaggggcctgggggaggctggggctttgggggcctggttctcagatgtacagctaatcctgtacccttcccgcagaccggcatgggctgcaggagccgcggcgggtggaggagctgcagaaccg

SEQ ID NO: 157317 - DNA, 601 bp, Human
attttttcacttaaattgcacaggggacccaacgatatagaacacaatcagaggtactctgggctgagggagtgctgagttctgaggctgggtttctcagaacagtctagattttaaaaacccaatgatctagccagaaaacgtaggttaggattttatttcccgtttgtgaccctgggcaagtcattagcctcctgggcctcgggttctcacttggagtatgaggataatgagggttactgcttctcagacttgtgacgatgcttactaatggccaacatgtgaatgcgcttttgtgaartgccagcagagcatgaggggtggtcaggggcagcagttttaggggcctgggggaggctggggctttgggggcctggttctcagatgtacagctaatcctgtacccttcccgcagaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacc

SEQ ID NO: 157318 - DNA, 601 bp, Human
ttgataacatttcagtgcttactgtgtactacttatactctgctaaataattgtactacattttacctatgagataacactattattattcccactttacatatgatgggaagcctaagcctcagaaagtttaagtaacgtctcaaatttcatacctctaagtggcaaaggcaggatttgaacccaggtctccatgctccagagcccacaccctaacctctgtgctacactgtgctgcctccatggtctgcctgagacctgaaaatccaggcatcacctggatgttccactgcatcacccygctgtgaagggctaataaatcacatggatgaatcgtaagggcaacccaatatgaacagctgggtctgctcctctgctgttggggtaaggcctactgaagtgcagagtgagtccagaaggttgtgcttgatatggcgcttctccagccctgtgaagatcactgctgtgctgagccactgccgttgatgggagtaggttttatcaatccttcaggtgtgctagggagaaaaacattgataagcacctttcgggcataccactactctggctctccccacctgaggctcagactttgactaag

SEQ ID NO: 157319 - DNA, 601 bp, Human
ggccctgtacagcaaaatgaaagcagaggaaccagacttagcgttgtgcccacacaaactgatcagaactccctggggaacttttaaaaaatgcatgtttcttgctgattccaggactgaatcagagtctggagtgagggtgaaaccagtgaatatgcttttctcagtgagcacttcaggtgattctgatgcgtgataaagtagaaggagggtggactggggcacggccagagaagtagaggtacggacagaggatcctagaggaatgccggattttagccttattgttagccactttttyctttccacctcaaaccctctcctttgcagctttctgggctagcaaaggctgccaaggatggcttcctgctagtaccccagtgggcagattcagctcctctagggtgctctctccatcccatcccaccgtcagtcctgccgcacagtgctagccagagtcctcactggctgcgggaggggcaagaggcaggaggtcaggcagaggctggggacacagctgcagcagcccagggctctgtttcctcccccagcctgggcctctggggcagaggaagcccaggcaggaaggccaggcctgcca

SEQ ID NO: 157320 - DNA, 601 bp, Human
gcgaagagagcacttgattaggagtctggaaacctgggatgtacgcctgctggtgccagtgagtcctgtctgacccgggacaagtcttcttccctgtatgagccttactcctctcttctgtaaaacaaggagctggattttgtgattcacaggatgtccacctagaattctgtcatgtgggtgtcccaggcacaaggaactaagggtagcaaggaactaagggcatatttaaaaagcccctccagaccttgtggctgctgcagcccaccctgaaaatatgccctcagttccctgctgtgcrtgactcctgcctgttctatccagaccccaatctaaacaatcttgattcctgttcctggcttggcaggaccctgaatggcaggaagtgaggacaggagcctgtttatgtttgaggcagccagggctgggggggcattgagaaagggtaggcaggggtggaagctgtgagggagtgggaaagagacacagaacagaaggggagctgctggagagatgctccttctaccccaattgggtgctccctgcggctctcccaacctgcctgcagtctgagctcagcagcaggagtgcagagctaggg

SEQ ID NO: 157321 - DNA, 601 bp, Human
agctctgcctggggctgaacttgagaagctggggagaatgtaggagcttgactggagagtggaggacagtgaggctccattagactcagtccccagctaccccagccctcctttgctctcctcttgatccagacctgcaggctggagctctgtcagactagggtggaagcctatatgtggggtggagggagagcaggtgttggcaggccaagcctgggagagcactcagggctggggctgggggcccagcccagcctagaactgggaggggaggacctaggagccaggaggggacaaaagsctgcttttcagagtgtcagctgctctgaggggagggttctgagggaaggatgactgaggatgaaagtaagagaccaaagcttcaaggtgtttgtctgaggggtcagacgagagggacagtaggacagaaatgggtgtcgggctcagcctgggggagctgggaccacagtggctgagcttccggtgtgtcttccaggagaccctgtgaagccgtctcggggcccgctggtgacctgcacgtgtgagagcccacattgcaaggggcctacctgccggggggcctggtgcacagtagtgctgg

SEQ ID NO: 157322 - DNA, 601 bp, Human
gatcttctcctcgagggatgaacagtcctggttccgggagactgagatctataacacagtgttgctcagacacgacaacatcctaggcaaggggagaggccagctgtgccaggcctggggctttgcccccctgcactcagggctcaagtttgcagacctccagacattaacagaaccctgaaggactctcagcccacctgcagcatcaacctctttttttaatttaatttaatttaatttaatttaatttaatttaatttaatttaatttttgagacagggcctcgctctgtcacccaggmtgggatgcagtggtgcaatctcactggagcctcaatctcttgagctcaagtgatcctcccacttcagcctcttgagtagctgggaccacaggcatgtgccaccatgcccagctaacttttttattttttgtagagacgaggtctccctatgtttcccagactggtctcaaattcctaggctcaagcagtgctcttgccttggcctcccaaagtgttgggattacaggtgcaagccactaagccaggcccagacccaacctctgactccagctctgtctctgacctaagccacatcaaccc

SEQ ID NO: 157323 - DNA, 601 bp, Human
cctgaggtcaggaattcaagaccagcctggccaacatggcgaaaccctgtctgtactaaaaatacaaaaattagctggctgtggtggcacacacctgtaatcccagctactcgggaggctgaggcaggagaatcacttgaatctaggaggcagaggttgcggtgagccaagatcatgccactgcactccagtctgggcgacagagtgagaccctgtctcaaaaaaagaaaatttattaaaataaataaataaaatgagaataaaaatagcttccagttgttgagataatctaagtatttaraacagtatctagagctaaatattagtggctgttattgttgtagatagaatgagtgcctgacatcatattgtccccattttacagttgaggagacgggggcacagaatgacagtgggcttgaggcagcatcagggtccgaaaccgggcagtctgccccggggccagtgctcatcatcactgtgtgcacttaaacctctctggcccttgatttcctcatgcacgcaatgcatgtgagtgcctgcactgcctgcttattgctgcctggttgttactgtgggttgccacaggggactctgattt

SEQ ID NO: 157324 - DNA, 601 bp, Human
aggggtagcgtgtccaggccactggtttctggcccttggatagagggtagaaaaggctctcctctgggtggtattgggcctccttagagtcccaagtgattgtcctgtccattctccatttccaggcatcgtggaggactatagaccacccttctatgatgtggtgcccaatgaccccagctttgaggacatgaagaaggtggtgtgtgtggatcagcagacccccaccatccctaaccggctggctgcagacccggtgaggcctctgctgggactaggatggcgtggggtggtggctcayggctgggatttctgggcccgggaacttgtgtctgaggcctctgcttcatctcatagatactgagtgtcctggttagggcacctctctaggtactccctctttcaaccctggcccatgctccctgcccccagggccatctggtcattctgggattttaagaaccttcaccttccctgtgaaaagtcagaggctatctgtggctctgtgtgtgtgtgtgtgtgtgtgtgtgtgtgtgtgtgtgtgtttgagagtcagggttttgtttgctcttgtcacccaggctggggtgcagtggcacag

SEQ ID NO: 157325 - DNA, 601 bp, Human
actggtttctggcccttggatagagggtagaaaaggctctcctctgggtggtattgggcctccttagagtcccaagtgattgtcctgtccattctccatttccaggcatcgtggaggactatagaccacccttctatgatgtggtgcccaatgaccccagctttgaggacatgaagaaggtggtgtgtgtggatcagcagacccccaccatccctaaccggctggctgcagacccggtgaggcctctgctgggactaggatggcgtggggtggtggctcacggctgggatttctgggcccrggaacttgtgtctgaggcctctgcttcatctcatagatactgagtgtcctggttagggcacctctctaggtactccctctttcaaccctggcccatgctccctgcccccagggccatctggtcattctgggattttaagaaccttcaccttccctgtgaaaagtcagaggctatctgtggctctgtgtgtgtgtgtgtgtgtgtgtgtgtgtgtgtgtgtgtgtttgagagtcagggttttgtttgctcttgtcacccaggctggggtgcagtggcacagtcatagctcactgtaacctc

SEQ ID NO: 157326 - DNA, 601 bp, Human
ctggctgcagacccggtgaggcctctgctgggactaggatggcgtggggtggtggctcacggctgggatttctgggcccgggaacttgtgtctgaggcctctgcttcatctcatagatactgagtgtcctggttagggcacctctctaggtactccctctttcaaccctggcccatgctccctgcccccagggccatctggtcattctgggattttaagaaccttcaccttccctgtgaaaagtcagaggctatctgtggctctgtgtgtgtgtgtgtgtgtgtgtgtgtgtgtgtgtgtgtgtttgagagtcagggttttgtttgctcttgtcacccaggctggggtgcagtggcacagtcatagctcactgtaacctcaaactcctcggctcaactgatcctactgcctcagcctccccagtagctaggtgtagtgcacaccaccacacctggctaatttttaaaattttttgtagagacaaggtcttttatgttgctcaggcttatctcaaactcttgggctcaagtgatcctcctgcctcagcctcccaaagtgttgggattataggtgtgagcctccacacctgaccactgtggta

SEQ ID NO: 157327 - DNA, 601 bp, Human
ggcgtggggtggtggctcacggctgggatttctgggcccgggaacttgtgtctgaggcctctgcttcatctcatagatactgagtgtcctggttagggcacctctctaggtactccctctttcaaccctggcccatgctccctgcccccagggccatctggtcattctgggattttaagaaccttcaccttccctgtgaaaagtcagaggctatctgtggctctgtgtgtgtgtgtgtgtgtgtgtgtgtgtgtgtgtgtgtgtttgagagtcagggttttgtttgctcttgtcacccagkctggggtgcagtggcacagtcatagctcactgtaacctcaaactcctcggctcaactgatcctactgcctcagcctccccagtagctaggtgtagtgcacaccaccacacctggctaatttttaaaattttttgtagagacaaggtcttttatgttgctcaggcttatctcaaactcttgggctcaagtgatcctcctgcctcagcctcccaaagtgttgggattataggtgtgagcctccacacctgaccactgtggtatttttgttgctatttgtctttgtttgttgctgttttgttg

SEQ ID NO: 157328 - DNA, 601 bp, Human
tgtatacatctatgtgtacatagacatacatttctgtacaacatatccgcaaaaagccacatgtatgcattcctgtacacacacacatacactcactttcaggagccagaagtggggccagctcatttcaggccctgggatgggttgatgagcttcctgggatgggttgatgagctttttgggatgggttgctccctggacacttgcatttttagggcagttcccacttccacagtcccctgggcccagccatggctgatggaggggctggaagacactgccctctgcactggggtcttargctgtggatggggatgtgggagcccccaggcttgaagaatcggccccttcctatggatcttggcaaaggtggggatgggggtaaggtgtttcacagacactgcttgcccaagggggcttgagtgctcctgaagatctgagttctctctttctgtccgccctgtctttctccatccctttctcactctactctcttcctcttccattttttatttttttgtcatcctctgttctctctctcaccacttgtctttcctctcgctctcctttccaatgctctcatctccctcctctcatcctt

SEQ ID NO: 157329 - DNA, 601 bp, Human
aggatgtgcccttaatcactgtgcattactgtggctgtgtctttgttgcctataacagtacctgtctctgaataagcactcactaagtgtttgggaaggcaggatgggaagagactgcaatgagggaggccagctaggaggccattggtataattcaggatgagttaatgaagacctacattagtcatcattttgatgagatctctgaaggtgtttatggaatttttatttatttttgagacagggtctcactctgttgcccaggctggagtgcagtggtgtgatctcagctcactgcagygtcgacctcctgggctcaagtgatccttccacttcagcctccctagtagctggaactacagacatgaaccactatgtccagctatttttttttattttaatttttatagagacagagtctcactatgttgcctgggctggtcttgaatccctggtctcaagcgatcctcacccctcggcctcctgaagtgctgggattataggcatgaccaccacgcccagccggttattgaaattttaagagtcaatgagcttttcatagggggtagtaatagaggaaggaagtcagaaagctttaagg

SEQ ID NO: 157330 - DNA, 601 bp, Human
tggtagtaataatatataattttaaatgtctataaagctaatttaatacataaaaatcctaagtagatattagactattttatttacttccctaaaagtttgtttattccagttggcctcaaaaactttatttcaatcttcccattgggaaaatgaattgccttatgttcagagttgtcttatttgggagcatagatgataactacaaaatagtaactttggaacagtaagctggaaacttgagcaggatctagaaggaaggtgatatcgtttggctatttgtccccaccaaatatgttgraatgtaatccccaatgttggagatggggtctggtgggagatgtttgggtcatggaggcagatgcctcatgaatgtcttggtgccatcctcacagtaatgagtgagttcttgctctgagttcacccaagatctggttgtttaaaagagtctgggccctcccctctctcttgcccccatcttgccatattatacaccagcttcccttttgccttctgccatgattgtgagcttcctgactctcttaccagaagcagatgctagcaccacacttcctgtacagcctgcagaactgtgagccaa

SEQ ID NO: 157331 - DNA, 601 bp, Human
tcaggtattccattatagcaatgcaaatggactaatacaggagacgtggggatttaatgtgctggagagtttggggaaatggcatgttagatgactagatgacctgacaatatgagcaaagacataaaggtgggaatgtgcacagtgctctcgggatcagtcagcttggctggagttgcaggtttgagaagggaaatagattgccagggaaatcagctaagagtttttttgaaataattcagggtcttgtgattcagggtattgataggataggtgccattatattcattcttttaaaacrtttaatttttattttgaaattgacaagtaatatttaagtaatattgtacatattcattggggtgcatagtgatgtttcaatacatgtaatgtatagtgatcagatcagagtaattagcatatctatcatttaaaacatttattatttctttgtgttgagattactcaatatcttccttctagctgtttgaaactctatattatagtcatcctactatagtatagaacactagaacttattcttcctatatagttgtaattttttatcctttagcaaatctctccctacacttctccccct

SEQ ID NO: 157332 - DNA, 601 bp, Human
gtttggggaaatggcatgttagatgactagatgacctgacaatatgagcaaagacataaaggtgggaatgtgcacagtgctctcgggatcagtcagcttggctggagttgcaggtttgagaagggaaatagattgccagggaaatcagctaagagtttttttgaaataattcagggtcttgtgattcagggtattgataggataggtgccattatattcattcttttaaaacgtttaatttttattttgaaattgacaagtaatatttaagtaatattgtacatattcattggggtgcatrgtgatgtttcaatacatgtaatgtatagtgatcagatcagagtaattagcatatctatcatttaaaacatttattatttctttgtgttgagattactcaatatcttccttctagctgtttgaaactctatattatagtcatcctactatagtatagaacactagaacttattcttcctatatagttgtaattttttatcctttagcaaatctctccctacacttctcccccttgccttcctagcctctaatattctctcttatacttcttacttctctgagatcaactttttttagcttc

SEQ ID NO: 157333 - DNA, 601 bp, Human
ctaagagtttttttgaaataattcagggtcttgtgattcagggtattgataggataggtgccattatattcattcttttaaaacgtttaatttttattttgaaattgacaagtaatatttaagtaatattgtacatattcattggggtgcatagtgatgtttcaatacatgtaatgtatagtgatcagatcagagtaattagcatatctatcatttaaaacatttattatttctttgtgttgagattactcaatatcttccttctagctgtttgaaactctatattatagtcatcctactrtagtatagaacactagaacttattcttcctatatagttgtaattttttatcctttagcaaatctctccctacacttctcccccttgccttcctagcctctaatattctctcttatacttcttacttctctgagatcaactttttttagcttccacatatgagtgagaacatgcagtgtttaactttctgttcctggcttatttcacttaacataatgtccttcagttccatccatattgccacaaatgacaagatttcatactttttatggctgaatagtattctgctgtgtatatatgc

SEQ ID NO: 157334 - DNA, 601 bp, Human
gcatcctagtggcttatcaattactgaaccacagtttcagactgcagttgaaattgtaagtcttaagtgaggaaaacaaagagtagagagctctttcttggaaattatggttagaggaagaaaaagactaaggatgagacagaggaggcctgataagaggagcaggatggaaaatttcaaggacagcgtgtggtaaacaggcccaaatgctgcaaagaggccaaggagaccaatctacaccaaatgggacaacttgcttcacagcacttgcaaaatgccaaaatgttatacagaggtataratggagtggggaggtggaaaaggcatgagatttacagccacaagacctgggctcatgacacgtcctagtaatcccagctgctctggaggctgaggtaggagaattgtttgagcccaggagttcaaggctgcagtgagctatgattgtatcactgcaatatagcctgggtgacccattctctctctgtttttttttttttttaaaagacctaggctcagtcctagctccgccttttatgacatttgtgaccctgggccatcattacttaatgttctctgagtgtcagtctgctcatttata

SEQ ID NO: 157335 - DNA, 601 bp, Human
gtgtggtaaacaggcccaaatgctgcaaagaggccaaggagaccaatctacaccaaatgggacaacttgcttcacagcacttgcaaaatgccaaaatgttatacagaggtatagatggagtggggaggtggaaaaggcatgagatttacagccacaagacctgggctcatgacacgtcctagtaatcccagctgctctggaggctgaggtaggagaattgtttgagcccaggagttcaaggctgcagtgagctatgattgtatcactgcaatatagcctgggtgacccattctctctctgtttttttttttttttaaaagacctaggctcagtcctagctccgccttttatgacatttgtgaccctgggccatcattacttaatgttctctgagtgtcagtctgctcatttataaaatgagaaagataatggctaccatatttgcatctaaaaggtattgtgaagttcacatgtaaaaatacaggtaaacaattgtgtttcccccgtaagtatctcaaaaggatctggcatacacaaggtttgtatatttgaacgaggtatgtgtattactgtgactacttatttgtgtttaaacagagac

SEQ ID NO: 157336 - DNA, 601 bp, Human
ttttcattctgccacacagcctgcaagagaggacagtaactgtcattaaccacccaacctcaatatcttgctccatcaaataaaatttttgtatgttgctcttgcctcttcttctgttctgataatcatgtggtctctctaccctctcattgcatcctgggggcatgttgctgtcagtttagttgttctatagcaagcaccactggacctttgccctcagcaaggaggtaaccatttatgaacactcttgtctacttgggagtagaataagaaacctgagcaagctctcttgaatcttaayaactggttccgtccacggagatcagctgagtaactggcggtgggagcagcttctccagatgacatcatctgttctttatgcatgttctactttgctaaaaaagaatgctgtctgtgatgacagccttactagtgcatagtgtgttgggagatggtcctttgtacatagacttttttgaaaactagaatcttatttatgttaacacttaaaaaaaaagcattacacgcaaatggtggacaaactagaaccagatctcaggcctgatgtggtttctagaccagctctggagaagagaagaga

SEQ ID NO: 157337 - DNA, 601 bp, Human
cagatgacatcatctgttctttatgcatgttctactttgctaaaaaagaatgctgtctgtgatgacagccttactagtgcatagtgtgttgggagatggtcctttgtacatagacttttttgaaaactagaatcttatttatgttaacacttaaaaaaaaagcattacacgcaaatggtggacaaactagaaccagatctcaggcctgatgtggtttctagaccagctctggagaagagaagagagagttgggatttgctatagggttggctgtgctgtgggttccactcagactcactcygaagggcagccctaggactcaatgaggctgtactcagggtagtgttatctcttgaaggcatagaataaaacgagtaccattttgatggaacacagaagcaaattgtgttcagattcaatatgcatgccatgatatcaggttctgtggctgcaaaaaaaatctccaggtcttttttcccctttatgtcataacttctgcccacatgacataaactataaatcattgccttaccacattttatttatttatattaaacaacaacctctagtccaagaatatgagttttttgtttttgtttga

SEQ ID NO: 157338 - DNA, 601 bp, Human
catcatctgttctttatgcatgttctactttgctaaaaaagaatgctgtctgtgatgacagccttactagtgcatagtgtgttgggagatggtcctttgtacatagacttttttgaaaactagaatcttatttatgttaacacttaaaaaaaaagcattacacgcaaatggtggacaaactagaaccagatctcaggcctgatgtggtttctagaccagctctggagaagagaagagagagttgggatttgctatagggttggctgtgctgtgggttccactcagactcactccgaagggyagccctaggactcaatgaggctgtactcagggtagtgttatctcttgaaggcatagaataaaacgagtaccattttgatggaacacagaagcaaattgtgttcagattcaatatgcatgccatgatatcaggttctgtggctgcaaaaaaaatctccaggtcttttttcccctttatgtcataacttctgcccacatgacataaactataaatcattgccttaccacattttatttatttatattaaacaacaacctctagtccaagaatatgagttttttgtttttgtttgattgtttt

SEQ ID NO: 157339 - DNA, 601 bp, Human
cttacatctgctcgacatgtgagattcacctctgcagttattgactttgagttaacctgtaagcccagaggagccgagcaccctgttgtatgtgctaatgagctctgtgtgagtgctgggtaagcagtgtgcgtgtactgcattgtaccttagtaggcccaatctccatctgcagggtacgtcaaacctatggttcctgtcctgcttcacatgattcattgccagttcactaaagattgctctctgcatgtgtatatgtacttattttttaaactatagactaaaattacatctttcccayaatttttactaaattagaatactttatttgcacacagatagttccaaaagactaggtttgaccttttttggaaaaaagaatgacgagttagatgggaaaaaaatgggatttgtgcgagttggtaggtagaagacgggggcaaagagcggttgaatggccaacaaagtgaccacagaattagtttaatgaagtcactgggtggccagaatccagttagatggactggattttattggtgctatattcatttcctagtgtctgtttgtcatcttttctgccaatttttctcagaaaatccaa

SEQ ID NO: 157340 - DNA, 601 bp, Human
aggtttgaccttttttggaaaaaagaatgacgagttagatgggaaaaaaatgggatttgtgcgagttggtaggtagaagacgggggcaaagagcggttgaatggccaacaaagtgaccacagaattagtttaatgaagtcactgggtggccagaatccagttagatggactggattttattggtgctatattcatttcctagtgtctgtttgtcatcttttctgccaatttttctcagaaaatccaaatccttgctttagaactcccagactagaaactgatgcctgattttctgacagcygcttggtccttcttagctctgaccccctgccgaacttgatttcatttctgcctgtctctctgatattttcaaaagacaggcattgcgattggctaatgttcgtgataattgattgtactaaagtaagatttaccttacttcctacagaaccattcaaggcatctataggatgtcttcaccattatgcctcaaacctacatagtgggaatttagataccaagcaaaaccatatattattcactcagcaaacatttactaagccccttctgtagtccctttctgcagtaataagtcaggaca

SEQ ID NO: 157341 - DNA, 601 bp, Human
catctcctttccttcccttttctaccctgccctggccctactggccatccttttgccccagaaccagctctgcacattcccaccttaggacctgtgcacttgatcttcccccttcttggaatactcttctcccaggtcttctcatggcctctccttcttatcacttagatgtcccctctaatcatcttaaagtctcccttctccatcctaccccttaccctagacacgctagcattttaccttatttggttcatagtaataatcaatatttaaatgatatatttttgttttcatttctgaccccccccaagcagaatatgtgtcctgaagactttgttctgttcactattgtatccccagcccttgggacaggatctggcacaattacttgactctagtctgctgctaatgccacctgggttggtctcagtagtgtgctacagggatttcattaacatactataatggaacataatgagttaacaaattgtattttattaagatggtattcaatttagtattttcacgctatatgctttttatagtttatactgataatgtcagggtctggaatcccacatcttagcagatgacctcctct

SEQ ID NO: 157342 - DNA, 601 bp, Human
catcttaaagtctcccttctccatcctaccccttaccctagacacgctagcattttaccttatttggttcatagtaataatcaatatttaaatgatatatttttgttttcatttctgaccccccccaagcagaatatgtgtcctgaagactttgttctgttcactattgtatccccagcccttgggacaggatctggcacaattacttgactctagtctgctgctaatgccacctgggttggtctcagtagtgtgctacagggatttcattaacatactataatggaacataatgagttarcaaattgtattttattaagatggtattcaatttagtattttcacgctatatgctttttatagtttatactgataatgtcagggtctggaatcccacatcttagcagatgacctcctctggctctatatttctgtttctatgaagttgcaagatgactacattatgttcagagatctgcctgttaaaaatgacctgagatatacacgaggcaacagagaactctcctgagacaggagggtaagaagtgcgattccaccagatactaaacattttatcctcctgcctcttaacattctagca

SEQ ID NO: 157343 - DNA, 601 bp, Human
gtactcctgaggaggtcctaagggcttatgctcttcagggaggtacttaggaggtattttatttgctgaacatttatggaacaatgaccatgtgtgaaacactgtgcttgattatgtaggcattctgagagaaacgtctaacttgggacaccaaggagattgcaagagaagagtgcagaataagagagatagctgcttaactttaacgcaaaatagaaaaataagtacatgagaacagcactaaccaagggtgctgggaatctgcctgcctgcctgtctgtctgtctgtctatctatctgactatctatctatctatctatctatctatctatctagagatagggtctcattctgtcacccaggctggagtgcagtggtaatgatcatagctcataagctcatgcagctttgaactcctgggctcaggcaatcctaccacttcagccttccaaatagctaggactataggtgcacaccaccacacctgtctaattttttttttttttacaccttttgtggagatgaggtctcactaagttgcccaagctggtctcaaactcctggccttaaacagtcttcctgccttggcctcccaaagtg

SEQ ID NO: 157344 - DNA, 601 bp, Human
gaggtcctaagggcttatgctcttcagggaggtacttaggaggtattttatttgctgaacatttatggaacaatgaccatgtgtgaaacactgtgcttgattatgtaggcattctgagagaaacgtctaacttgggacaccaaggagattgcaagagaagagtgcagaataagagagatagctgcttaactttaacgcaaaatagaaaaataagtacatgagaacagcactaaccaagggtgctgggaatctgcctgcctgcctgtctgtctgtctgtctatctatctgtctatctatctrtctatctatctatctatctatctagagatagggtctcattctgtcacccaggctggagtgcagtggtaatgatcatagctcataagctcatgcagctttgaactcctgggctcaggcaatcctaccacttcagccttccaaatagctaggactataggtgcacaccaccacacctgtctaattttttttttttttacaccttttgtggagatgaggtctcactaagttgcccaagctggtctcaaactcctggccttaaacagtcttcctgccttggcctcccaaagtgttgggattaca

SEQ ID NO: 157345 - DNA, 601 bp, Human
tgtattttttttagtggagacggggtttcaccatgttagccaggattgtcttgatctcctgaccttgtgatccgcctgcctcggcctcccaaagtgctgggactacaggcgtgagccaccacgtccggctgggatttccactttttatttctcttgaacttgttattcagttcttgagaggtctttcattttattttcccactgaatgtataattggtattaaaagaagaaaagattaaaaaggagattgagtactgagcatgaaggtcctgaattcatatgggtgagccatgatcagagmtgtaactaggaggatttgtttgcagggttaatttaatgtgagaggcaggaaggggcccctgctttgttaaagtgggagttttgatggccctaatctatagaaagtacggtgagggagaaagggaatggagttgaaaatctaaggtaacgctcggtttcaagcctaggaaattgagagaatgacaaggccatgaacagaaacatggaatgagtataagaccgatttgagatggaggatggtgagtttgctttgtgacatgttcaatcattgtagatagagatttgaaggtcatttgtagaa

SEQ ID NO: 157346 - DNA, 601 bp, Human
aaatatatattagtctaaagacaaactttaggtgtaagaaaattatggaataagtgtgtgtgtgtgagtatgagtttgtacctattttcagaagaaaagaacaatatgggaatgaaaatcattttaataaggtggctactataaaaccaaaaacctaaaaactgaaagcaaatgtaaaaaaaaaaaagaaaagaaaacttcacagttctgaccccctaaaatcaatactataataggtaaaaccccttgctagagaattagccaatctttttgatcaaattcatcagttttccagtttctygtgggttttcttcaagtggtcttcattcataaatttttcctcccatgaaactacttctacagagtagctttttctctgagaataaagaaatctttttcttctgcattcgtggttgtctatatatatttctaaagttgttaggtaaggaagaatgctatttctgttctaagtgtgaggctagagcagacctttctctttggttgatttcctagacacaccatctcagcgtgttcagttcattcttggcaccgaggaagatgaagagcatgtgcctcatgagctgtttacagagctggatga

SEQ ID NO: 157347 - DNA, 601 bp, Human
tttcttctgcattcgtggttgtctatatatatttctaaagttgttaggtaaggaagaatgctatttctgttctaagtgtgaggctagagcagacctttctctttggttgatttcctagacacaccatctcagcgtgttcagttcattcttggcaccgaggaagatgaagagcatgtgcctcatgagctgtttacagagctggatgagatctgtatgaaagagggagaagatgctgagtggaaggaaacagccaggtgaggccctaaaatggcctgcatcaagatctgcttgggtaggcaartgtgtacccttcagcaagtgacaggcctgcctgccttatttcttcttgggagaagctgtgactgacatggggactgacattccagtgtctcctgtggagaattttggtgttggcatctttatgatgtctttggtgttacctatgccagttgacctggagcatgggattggtgaaataacatgggatattcaggggggcccctctcatttgtttggggctcagagtaagtttatgggctatcttggtattattataggtctgacttagaagatgtagacagggccaccttggtggggacct

SEQ ID NO: 157348 - DNA, 601 bp, Human
tctacaaaaaatacaaaaattagccaggcatggtggctcatacctgtagtcccaattattcaagaggctcaggcacgaggatcacttgagcctggcaggtcaaggctgcggtgagtcaagattgtgccactgcactccagcctaggtagcagagtgagtgtaggggtgggttgcccctacacacctgtgggtgtttctcataaggtgggacgagagatttggaaaagaaaaagacacagagacaaagtatagagaaagaaataaggggacccggggaaccagcgttcagcatatggaggakcccgccagcctctgagttcccttagtatttattgatcatctgtgggtgtttctcaaagagggggatgtgtcagggtcacaagacaattgtggggagagggtcagcagacaaacacgtgaacaaaggtctttgcatcatagacaatgtaaaggattaagtgctgtgcttttagatatgcatacacataaacatctcaatgctttacaaagcagttttgctgcccgcaggtcccacctccagccctaaggcggtttttccctatctcagtagatggagcatacaatcgggttttataccgag

SEQ ID NO: 157349 - DNA, 601 bp, Human
ctacctcttcagtaagatgtgaaggggagatatctgattgttcttcctgatgtgattgagtgttaagttattatgtttggggcctgaatggagaaacacctggatgcatgggggagttttctcttgaattggttctgtttggctggacaggttaagaaatatttctccaaatctttctctatttcaagtatccaagtcattctgtctctctgggatcataggaggacccaggggaggggtaagcactgatgggacattgggcccccctctttttcagggaggtaccccagaagtatcactytgactgcctgggaaaaatgaaattctcatgttcatcattggagtcacattttgctaacttttgactatttgtctgaaatcccatgaatgttccttaaaaggttgtttgttagggagaagaatccctgggagctattgaagctgtttaaaactctttgtaaacaacagcagtcacgggagagttttggacagggtaatgatcaatcagattttgcatattagaaagataatgatggcagcaatatggagggtgagttgatgggagaaatgcattaggctattgcagtagttcaggtgagat

SEQ ID NO: 157350 - DNA, 601 bp, Human
gctcaagatcacacagctaaaaagtggtagaacagggaaacaatgtgggcctttaactccagaactcatactgataactgctatgtttactgccacttaacactaggtattgagatttttttcctcctcaaatctgttgggcttgataggtttaaatgtgatgcttggtggtaattgtctggggtgagtggttagttaacttaatttttcttatagatttctcttctaaatagccctttggagttctacagttatagttcttcttgacaattacagcaatgttaaaatcttggaggaaggraatgtaggggaaatttggcagatgacagaacaaagcaggtaataatgtgagctttcaaattatacagtcctcaatttgaatcccagctgtgcaaactgctagatgtaagaccttggagaattttctagcatttgggccttaatttcctcatttgtaaaaattgttgtactagtgctcaatagtttctatgcccaataagaataatttgttacatgaataaagtataacttttcacagtcactatcatcaaatggcactttcagacaggaagctgaaattgcacctcaatgaccctagtgg

SEQ ID NO: 157351 - DNA, 601 bp, Human
cttcgtagtcatcttaacctcttttctagataggctttgcaggagaaggcagaaccaactgatgatgggtgggatgtgtcagaaggggaaaagggcagggactcaggattttgttttattttctccaaataggtcaaaccgtgtctcctcagtctgttccaactacaaatcttgaagtaaaaaatggagtgaattgtgaacatagtcctgtggatttaagcaaggtgagcagagtggtgggaagttggcttcaaggcctaaggttccttttagtggaatccagagtttaattgctggaatytgggtaaggtttagtgtttcaagactctttccctaagactagagccctttctgcataaaagggggcccatctctgcatgtcttttcccttctccttcagcctggatgaagctgactcaacagtttctttctccagattcaacatactgaaaactgggactagctgcttagaatcttccctaaaacagatctcttgatttttcaattatttttttggtacctgctctccagcagttccttctcacccccaggggttttgccaaaacaatattttggatatctatttagagacagatgtctc

SEQ ID NO: 157352 - DNA, 601 bp, Human
ctgcagcttatggtccaagccttggtctccctgcctccagcctctccttgctctggtctatctttgacactgtgtttctaaaacacagatagtgtcatatcacttcctctgctcataaggcttcccattttatttggaaaacctgaaacccccgacaaaacatttgagtgtttaaaaagggaaagaatgtgacccagagcttcagaaacatttctcttggaggaagcttgggggaatgggattgaaatcagaatacctgattttaaaatccgaacctataccttaaaagctctgtggtccygggcaagtcaacttcacctctctgggtttcagatacttcattttttttttttctttaagtgggacgaatacaatctgtcatatcctccttctggggtttttgtaaggatcaaataaaataagaaaacatttgctaaccataaaatgacatatgagtgtaagatatattttaggtgatggggccaggtgcagtggctaacgcctgtaatctcagcacttttggaggctgaggcgggtggatcacatgaggccaggagtttgagactagactggcgaaaatggcaagaccccatctctacta

SEQ ID NO: 157353 - DNA, 601 bp, Human
cactcctgttccactaaatgagaccagtttgtataaggtcatgggtgtgacctcaggcagtgtagtgtgaatgtcttgactagtctgtaccaaaacaaccagatattttgacattttgacattgaacccacagtgcatactctggtaaggactgcactgctcggtaagctgcaaagtagggctttcaaggcatatgccttaggcggcagagggaggtgtggcctgttttttatcagctttctttgattgagaggcttaattcaggaaggaccttcattagtaattccatccagtgtttccracctttaagatcaagaaaatttccctctcaacgtgggaaagctgattaaaattttttttttcatatatcttgcctttccttccatcctttgtggagataacataattgtacaactttagactcatgtcttatctcttcttatactagcagacatgtatttagttcttttaatgcatctcatttccacgcttgttttttaaatccttttatccttgcacttctctaagtgctaaagttttctgcatctcagatccccgtgacagagataaaaatcaacaggttgtattcatttttcaccat

SEQ ID NO: 157354 - DNA, 601 bp, Human
gacctcaggcagtgtagtgtgaatgtcttgactagtctgtaccaaaacaaccagatattttgacattttgacattgaacccacagtgcatactctggtaaggactgcactgctcggtaagctgcaaagtagggctttcaaggcatatgccttaggcggcagagggaggtgtggcctgttttttatcagctttctttgattgagaggcttaattcaggaaggaccttcattagtaattccatccagtgtttccaacctttaagatcaagaaaatttccctctcaacgtgggaaagctgattaaaattttttttttcatatatcttgcctttccttccatcctttgtggagataacataattgtacaactttagactcatgtcttatctcttcttatactagcagacatgtatttagttcttttaatgcatctcatttccacgcttgttttttaaatccttttatccttgcacttctctaagtgctaaagttttctgcatctcagatccccgtgacagagataaaaatcaacaggttgtattcatttttcaccatatccattggtgattgtttcatgtaaagttacttttaactttcctgagg

SEQ ID NO: 157355 - DNA, 601 bp, Human
aattcaggaaggaccttcattagtaattccatccagtgtttccaacctttaagatcaagaaaatttccctctcaacgtgggaaagctgattaaaattttttttttcatatatcttgcctttccttccatcctttgtggagataacataattgtacaactttagactcatgtcttatctcttcttatactagcagacatgtatttagttcttttaatgcatctcatttccacgcttgttttttaaatccttttatccttgcacttctctaagtgctaaagttttctgcatctcagatccccrtgacagagataaaaatcaacaggttgtattcatttttcaccatatccattggtgattgtttcatgtaaagttacttttaactttcctgagggttttctcttctctgtagatttttcatgacgtagcatataaggcaaaagagcgagatgatctcctggcggggattgatgagttcctagaccaggtgacggtgctccctccaggagagtgggatccctccattagaattgagccacccaaaaatgtcccttcccaggtaatgtatgcacatcagccaatgtggctattgtcacttactga

SEQ ID NO: 157356 - DNA, 601 bp, Human
tctcttcttatactagcagacatgtatttagttcttttaatgcatctcatttccacgcttgttttttaaatccttttatccttgcacttctctaagtgctaaagttttctgcatctcagatccccgtgacagagataaaaatcaacaggttgtattcatttttcaccatatccattggtgattgtttcatgtaaagttacttttaactttcctgagggttttctcttctctgtagatttttcatgacgtagcatataaggcaaaagagcgagatgatctcctggcggggattgatgagttyctagaccaggtgacggtgctccctccaggagagtgggatccctccattagaattgagccacccaaaaatgtcccttcccaggtaatgtatgcacatcagccaatgtggctattgtcacttactgactgcccaccatggacaaagcaaagaccatgtgggtatatgctaaatatatcaagatgcagctctgttttggtgcacctagaatatcaaaacaataataaaaatgaatctgggctgggtgtggtggctcacacctgtaatctcagcactttgggacgccgaggcaggtagatcacc

SEQ ID NO: 157357 - DNA, 601 bp, Human
tccctccaggagagtgggatccctccattagaattgagccacccaaaaatgtcccttcccaggtaatgtatgcacatcagccaatgtggctattgtcacttactgactgcccaccatggacaaagcaaagaccatgtgggtatatgctaaatatatcaagatgcagctctgttttggtgcacctagaatatcaaaacaataataaaaatgaatctgggctgggtgtggtggctcacacctgtaatctcagcactttgggacgccgaggcaggtagatcacctgaggtcaggagtttgagamcagcctggccaacatggtgaaaccccatctctactaaaaatacaaaaattagctgggcgtggtggtgggtgcctataatcccagctacttgggaggctgaggcaggagaatcgcttgaacccgggaggcggaggatgtagtaagctgagatggtgtcactgcattccagcttgggtgacagagcgagactccacctcaaaaaaaaaaaaaaaaagaatttgcatagcataaattggctcaggtgtgatggggtcagtcaggattacctgggaatgaattttaagccaaattttgaaggaa

SEQ ID NO: 157358 - DNA, 601 bp, Human
caagatgcagctctgttttggtgcacctagaatatcaaaacaataataaaaatgaatctgggctgggtgtggtggctcacacctgtaatctcagcactttgggacgccgaggcaggtagatcacctgaggtcaggagtttgagaccagcctggccaacatggtgaaaccccatctctactaaaaatacaaaaattagctgggcgtggtggtgggtgcctataatcccagctacttgggaggctgaggcaggagaatcgcttgaacccgggaggcggaggatgtagtaagctgagatggtgycactgcattccagcttgggtgacagagcgagactccacctcaaaaaaaaaaaaaaaaagaatttgcatagcataaattggctcaggtgtgatggggtcagtcaggattacctgggaatgaattttaagccaaattttgaaggaataatgtgaaatagaagagagaagggagaacatttcttgtgactacattgtatacaagtcatcaaatgaaaaaagcaagttatatagagagagcagatagaatgtctgatatttttctgacatattagagatgggaaaggaactcctactgtgtatt

SEQ ID NO: 157359 - DNA, 601 bp, Human
ccagctacttgggaggctgaggcaggagaatcgcttgaacccgggaggcggaggatgtagtaagctgagatggtgtcactgcattccagcttgggtgacagagcgagactccacctcaaaaaaaaaaaaaaaaagaatttgcatagcataaattggctcaggtgtgatggggtcagtcaggattacctgggaatgaattttaagccaaattttgaaggaataatgtgaaatagaagagagaagggagaacatttcttgtgactacattgtatacaagtcatcaaatgaaaaaagcaagttrtatagagagagcagatagaatgtctgatatttttctgacatattagagatgggaaaggaactcctactgtgtattagacagcagccaggtgctttatatatgcaaattcagccttcccaggaacatccctcaaaagatattgttatctctagttttacaaaatgaggaataaaactgtcttctagggcaagattttaaggtaaagtaagattacacagaggcagatatgaaactggaacttaggtcatatctaatgccaaagccccatttttctctttctaggcaaggcttagttaggag

SEQ ID NO: 157360 - DNA, 601 bp, Human
acacgggcatttttggttgcttttgggttatcccattcccactccctgctgatagcaggacgaaaagatagatgttacctttactaattttgtggtcttctgttaaaaggagaaaaggaaaatgcctggagttccaaatggaaatgtttgccacatagaacaggaaccacatgggggtcacagtgggccagaacttcagcgcactgggcggtaagtcctgggacgtttcacagcgatgctgcttattgggtagaagttatgcaaaggaatgaggcatcttctttctttcagcctacttctytgtggtgggaatttattggctgaagaatgacttttcaaatggaaccactgactagaagtattatgaatatatcaaatatcgtattcattcattcaagtttctcaaatcacctaccatgttttgtctcacctccagtccttcctaccattgttccctctgatttgaacactcttccctttcctcatctcctggctaactcctacgtacccttagtctcggttcttgtgtcacttcctttggaaagccttctaggactctctctggatgaggttaggtgttcctgctatgtaatatcacagt

SEQ ID NO: 157361 - DNA, 601 bp, Human
ttattggctgaagaatgacttttcaaatggaaccactgactagaagtattatgaatatatcaaatatcgtattcattcattcaagtttctcaaatcacctaccatgttttgtctcacctccagtccttcctaccattgttccctctgatttgaacactcttccctttcctcatctcctggctaactcctacgtacccttagtctcggttcttgtgtcacttcctttggaaagccttctaggactctctctggatgaggttaggtgttcctgctatgtaatatcacagtattgagctctgaccctcccttccccacattacagcctttatcatacttcattattattggttgatctattgtcttttctgctaggctgtttattccaaaagggcagaggctctattatattcctaggacccagcacagtgccctgaacagagtaggctctcaatgtctgccaaatgaatgaatatttttagaataatgtctgttctgtagcatggaatggactaggtatgataaatgttgagtgatcattttaggttaagaaactcccttagggtaggaagataggtactattttaggtgtgtgtgcctcaga

SEQ ID NO: 157362 - DNA, 601 bp, Human
tatcctcagcactctacccagtggaaactcagagttgttttggaattgtggaaagcattttatttttccaatcttggaaattcagggagaaaccaggagaggagacagaaacaggagagaatggcacttgactagcagtgtcctgcagagaagcatgttttctggtaggaagaatgtattggagggtaggggaagatagctgtgctctgggagggagcattggtggaaagaaggagtccttgcaatggaagggccactgaaaaggggaagcagccttccctttttaaaaaacattttcttyaaagttgggagagatctgaattgggtggggaggcctggtattgagaggcagttcaagggaagcatatgtcctcagaaggggttccaggattgagactgtcctagaggaggtggtaatttttttcaggaaaaggttttgagtatggatttgatatttcaaaattataatttatcttttggatataaagggtgtccacactttaggaacttagaatttgaaagtagtagaatttagggcaacaaggttttcctcaaaccaatatctgtgcagagatgagattttaggttgctctttgtgcca

SEQ ID NO: 157363 - DNA, 601 bp, Human
gaaaaggttttgagtatggatttgatatttcaaaattataatttatcttttggatataaagggtgtccacactttaggaacttagaatttgaaagtagtagaatttagggcaacaaggttttcctcaaaccaatatctgtgcagagatgagattttaggttgctctttgtgccaaagaaaacaaatagattagcatcccaggctttgtgagaggtggtcacttataatcaattccacctgagggtttgggagaccattatattggatctcaacagttataagatcttggtaatggtgtctratgtccccaagaaaatcccatattgccaggatcatcatattcttattcacaaaccgcaagtatcttaactcacaaattcaaatggagtttgaaggagttctcccataatgtcatgtcaggaacttctggaattgacaaagctaaaaggaagctctgggctcagagcttagctctgcttgatatgggagatgcttcctctttctgagcttctgtcatttttcttagagcccttagtaaagggcctcaagccatatgaccttcctcccattgtagccccttaggcaaggtgacataatggct

SEQ ID NO: 157364 - DNA, 601 bp, Human
cccttaggcaaggtgacataatggctgcatagagaatcacatttccaggccagctctggcctctttctcagtctcaaattatgtgggaggtaaatgtgagtcttttttgtatatggacatcctataagtttctgtactttcctggactgcacaaactaaaaccacattagtctgggttttataatttttcggactattagttgtgtttcttggagatgcaaaactgctttatgcttgtcatgttgcacaaccttggagcaagacttggataacatcttacggaatgttatccttgttggakggagaagtatttgaaggcagggtgaagtagactctaagaagatgggaaaggagacaaaattgaaatggtactctgagttctgtatgatctgaccctccaagccagggttaagacagatcttaaacctccctgatattgactaaggcagggatgccataagtaacaaagaaggaaatatgactagagtgttcctaggccggaagctccacagcaaggagggtgctctggaaaggggtttttcagggtatatttctgtcccttattggggatgccacttttgggaagggttaatggaaaaaa

SEQ ID NO: 157365 - DNA, 601 bp, Human
tgtatatggacatcctataagtttctgtactttcctggactgcacaaactaaaaccacattagtctgggttttataatttttcggactattagttgtgtttcttggagatgcaaaactgctttatgcttgtcatgttgcacaaccttggagcaagacttggataacatcttacggaatgttatccttgttggatggagaagtatttgaaggcagggtgaagtagactctaagaagatgggaaaggagacaaaattgaaatggtactctgagttctgtatgatctgaccctccaagccaggkttaagacagatcttaaacctccctgatattgactaaggcagggatgccataagtaacaaagaaggaaatatgactagagtgttcctaggccggaagctccacagcaaggagggtgctctggaaaggggtttttcagggtatatttctgtcccttattggggatgccacttttgggaagggttaatggaaaaaagaatcaggagctgctatctcgatgatccccccacacttcaaacaggtttcttccaaagtataccagacaaatggatggctggcctgtttctaaagccctccagggaa

SEQ ID NO: 157366 - DNA, 601 bp, Human
tctacgcgggtaagtcctctcttgcatcaaacttattaaactcatatccctgtgtgcctcctgccccagaaaacttgaatgtgaagggcagtgttgaaagggaaaggaaatcccaagtacagaaagaagcatccatgcctgatgaatatctgttgtagatgtgcaatcatagtctgattttatgcatgaatgaggtatgaggctgactccataaagtgttcagaaattattttattaatttatagttataccatccatatgagcctcagatctttccccgccttttaataactgctagacwgacagatgtcttccctttctatggcttcttagaaatccatttcacataaatcttttgtctgttgctcacagacactcctgtcctcctgtgtctaggggctgagtattcattgcagcatctcaggtagcctcagagtatgtgtgtgtgtgtgtgtgtgtgtatgtgtgtatgtgtgtgtagggggtcactattatgcagggatattttctcacagaattatgctttccagaggaaggtgactggtaatgaagaggtaataatcgcatggtaataagatgctatgttagctaagaacccagg

SEQ ID NO: 157367 - DNA, 601 bp, Human
ggtgaaaccccgactctactaaaactacaaaaaaattagccgggcatggtggcaggtgcctgcagtcccagctactcgggaggctgaggcaggagaatggtgtgaacccaggaggcggagcttgcagtgaccagagatggcgccactgcactccaacctgggcaacagagtgagactccgtctcaaaaaaatatataaaaataatgaataaaaccattttttaaggcctttttgacttagcttctccagccttgtctattggcattcacccttcacactgtattatccactcatatctctyagcaccttgatccaccaagcactctcacctctaagtgtcacccatgttggcccctctgcctcatctgcttaactcccagtccctgcctgaagtcatggctgaaatgcccctccctgctctatgccaccatagcaccctcacaatactgcctgtctcctgcactagacttggtcctggagagcagggctgttcatgtcttgctcattgccgcatctccagtacctggcacagtgcttggcaccaagtatctgctgctacttgtcaattgcatgaatgaattattatatacatttctcacaa

SEQ ID NO: 157368 - DNA, 601 bp, Human
ggattaaatgtcagggttctactcagtacagacaggcaatatcattttggattgtaagaaacctgaaaggagaccatcatttggtctgttgtcctgcccccgggtagcaccatacccaaaatagcagatctcctattgttaaagagcttgattaatattcctcagccattattgaagtcttgactttttatctttaaaaagactttccctagctaattcaaacttctccatttccattgtgagtcaatttttaatttggcctaatatcctccccctgctgtttttttttgttttgttttgtttttttgctattgatagtggggcacaagagtgctctggtttccctaattttcctatacaatcttttcttttttccttttatatttcaagtagcagctcatgggactatggccagcccctttttttcttaactgcaagaataagatcataattacattaggtagtaatggcaggaatgtatatgagacaatttctttttttagttttcgtatccttgcgcatatcctgtgaggcaaatctgtatcataactgtgccagagcactatttagaaggaaaatacaatcagaattagggataaac

SEQ ID NO: 157369 - DNA, 601 bp, Human
tagtggggcacaagagtgctctggtttccctaattttcctatacaatcttttcttttttccttttatatttcaagtagcagctcatgggactatggccagcccctttttttcttaactgcaagaataagatcataattacattaggtagtaatggcaggaatgtatatgagacaatttctttttttagttttcgtatccttgcgcatatcctgtgaggcaaatctgtatcataactgtgccagagcactatttagaaggaaaatacaatcagaattagggataaactgggttccagtgctygtttagatgaaatgaattaaccacatttctgactccttgtctcttaatgccatccatccatgcgttctgatgaactttggtcttgtttcagagactatgctctttcatacctctccctgcgagcttgtattggactgtggaccgctttcctgtgtattgtccttgtggcaactgatgccagttcccttgtctgctacattacccgtttcactgaagaagcatttgcctccctaatttgcattattttcatctatgaagcaatagaaaaactgattcacctggcagagacctaccccatcc

SEQ ID NO: 157370 - DNA, 601 bp, Human
tgaaacccatctctactaaaaaaacaaaagttagttgggcatggtagcacatgcctgtaatcccagctactcgggaggctgaggcatgagaatcaattgaacccagaaggtggaggttgtagtgagctgtgattgcaccactgcactccagcctgggcgacagagtgagactctgtctcaaaaataaaaaagttaaaaaaaaaaagagcacagtcatttgatgccttctgatatagaactgagaagaaattcatattagtgatgatacactattgtagatagttttaataaatgtttaagkagaagataatataaaaaagggtgttcattttgctggcgagagatctaccatcagtacatcaaaaatggggatgtgctcccagtcctctattgggggataggtgctagtggccttcagagaaacctatttatgtggccagtggtgtggccttacctgcagtaaataaaaaaccttcttggtgtttcatatagaaaatcagccattgggcggggcattatttacggcatttttttttcattgcacacaataatttctgacctatacatgtataatacagcattttcttgtttttctttttct

SEQ ID NO: 157371 - DNA, 601 bp, Human
agtcccagctactcgggaggctgaggcaggagaatggcatgaacctgagaggcggaggttgcagtgagccaagatcgtgccactgcactccagcctgggggacagagcgaaactccgtctcaaaaaaaaaaaaaaaattagctgggcatgctggcaggtgcctgtaatcccatctactttggaggctgaggcaggagaatcacttgaactcgggaggtggaggttacagtgagccgagatcactctactgcactccagcctgggcaacagagcgagactccatcttaaaaaaaaaaaattwcagacgcaaagaaactttatatgatattataaaagacagtcctttccattttggtttatttcagtattttagttgcaacctgggattaaattggagtttcaaatgtgatgaaaagtagaatgataacattctgtaattttcctactgctctgcaccaaattccagagtctctggagtttgtatttcaaattactcagtcgaatgaaacaggatttattgctgtctgcttaacatatatttgtttggttgaaaggatttttccagaaactgtaggaaaatgaagcagaatcaactgggtga

SEQ ID NO: 157372 - DNA, 601 bp, Human
tgaacctgagaggcggaggttgcagtgagccaagatcgtgccactgcactccagcctgggggacagagcgaaactccgtctcaaaaaaaaaaaaaaaattagctgggcatgctggcaggtgcctgtaatcccatctactttggaggctgaggcaggagaatcacttgaactcgggaggtggaggttacagtgagccgagatcactctactgcactccagcctgggcaacagagcgagactccatcttaaaaaaaaaaaatttcagacgcaaagaaactttatatgatattataaaagacartcctttccattttggtttatttcagtattttagttgcaacctgggattaaattggagtttcaaatgtgatgaaaagtagaatgataacattctgtaattttcctactgctctgcaccaaattccagagtctctggagtttgtatttcaaattactcagtcgaatgaaacaggatttattgctgtctgcttaacatatatttgtttggttgaaaggatttttccagaaactgtaggaaaatgaagcagaatcaactgggtgaaatatagtacaaacattggattaggatgtggtgaattgt

SEQ ID NO: 157373 - DNA, 601 bp, Human
ggagaatcacttgaactcgggaggtggaggttacagtgagccgagatcactctactgcactccagcctgggcaacagagcgagactccatcttaaaaaaaaaaaatttcagacgcaaagaaactttatatgatattataaaagacagtcctttccattttggtttatttcagtattttagttgcaacctgggattaaattggagtttcaaatgtgatgaaaagtagaatgataacattctgtaattttcctactgctctgcaccaaattccagagtctctggagtttgtatttcaaattaytcagtcgaatgaaacaggatttattgctgtctgcttaacatatatttgtttggttgaaaggatttttccagaaactgtaggaaaatgaagcagaatcaactgggtgaaatatagtacaaacattggattaggatgtggtgaattgtgaacaatcaggattctggttgtgactggggcccctgtctcataggagcttaataccatgtgagccagggacgcagtgtccaaggcccatggcctggagacctggatgctggctgtggaccttgggcaagtccctcatcttccctgtgcctcacc

SEQ ID NO: 157374 - DNA, 601 bp, Human
aaagaaactttatatgatattataaaagacagtcctttccattttggtttatttcagtattttagttgcaacctgggattaaattggagtttcaaatgtgatgaaaagtagaatgataacattctgtaattttcctactgctctgcaccaaattccagagtctctggagtttgtatttcaaattactcagtcgaatgaaacaggatttattgctgtctgcttaacatatatttgtttggttgaaaggatttttccagaaactgtaggaaaatgaagcagaatcaactgggtgaaatatagyacaaacattggattaggatgtggtgaattgtgaacaatcaggattctggttgtgactggggcccctgtctcataggagcttaataccatgtgagccagggacgcagtgtccaaggcccatggcctggagacctggatgctggctgtggaccttgggcaagtccctcatcttccctgtgcctcacctcatctgcacaatgatgtgatgacacctgccatctctttccaattatgcttcaaggatgcagtgagatttgatatgatgacccaagagtagaaggtggtgtgccatggtgtgtcc

SEQ ID NO: 157375 - DNA, 601 bp, Human
ctttccattttggtttatttcagtattttagttgcaacctgggattaaattggagtttcaaatgtgatgaaaagtagaatgataacattctgtaattttcctactgctctgcaccaaattccagagtctctggagtttgtatttcaaattactcagtcgaatgaaacaggatttattgctgtctgcttaacatatatttgtttggttgaaaggatttttccagaaactgtaggaaaatgaagcagaatcaactgggtgaaatatagtacaaacattggattaggatgtggtgaattgtgarcaatcaggattctggttgtgactggggcccctgtctcataggagcttaataccatgtgagccagggacgcagtgtccaaggcccatggcctggagacctggatgctggctgtggaccttgggcaagtccctcatcttccctgtgcctcacctcatctgcacaatgatgtgatgacacctgccatctctttccaattatgcttcaaggatgcagtgagatttgatatgatgacccaagagtagaaggtggtgtgccatggtgtgtcctagtttagcatgctccctgccttctcttctctga

SEQ ID NO: 157376 - DNA, 601 bp, Human
tttttttttttttttttttcagatggagtcttgctctgtcgcctggctggagtgcggtggtgtgatcttggctcactgcaacctccgcctcctcccgagtagctgggactacaggcacgcaccaccacagccagctaatttttgtatttttagtagagacggggtttccccatgttggccaggatggtctcaatctcttgacctcgtgatctgcctgcctcggcctcccaaaatgctgggattacaagcatgagcctggccaagtgctattctttatttcagattgagagttgggaaaaaytggagcaaataatggatttctttcttgcttaaaatgtatttatatgtatgtcttattatatacaaggcagatttccctggaataaaagtctagaatgtactgcttaattttacacatgtgtgcaggcaatattatctgtgagtgaaaagtggaataatacgtggattgggtcaactgattatcagcttgttaggagtcctctgtgtgagacatggtggtataattgtgaagttctcactgtatgtggatgttcatgtgaaagatagtactttcttcccgtaaatatcttttgatttccat

SEQ ID NO: 157377 - DNA, 601 bp, Human
ctgggactacaggcacgcaccaccacagccagctaatttttgtatttttagtagagacggggtttccccatgttggccaggatggtctcaatctcttgacctcgtgatctgcctgcctcggcctcccaaaatgctgggattacaagcatgagcctggccaagtgctattctttatttcagattgagagttgggaaaaactggagcaaataatggatttctttcttgcttaaaatgtatttatatgtatgtcttattatatacaaggcagatttccctggaataaaagtctagaatgtactkcttaattttacacatgtgtgcaggcaatattatctgtgagtgaaaagtggaataatacgtggattgggtcaactgattatcagcttgttaggagtcctctgtgtgagacatggtggtataattgtgaagttctcactgtatgtggatgttcatgtgaaagatagtactttcttcccgtaaatatcttttgatttccatttgtatggaatcccaatgaatgtatctttggaaaacataatgtgtcaaaatttgtattttgttcattgatctaaatgcccgtgtaactaatcagaaatccaa

SEQ ID NO: 157378 - DNA, 601 bp, Human
caaaatttgtattttgttcattgatctaaatgcccgtgtaactaatcagaaatccaatttggctcagattgggaattttcttttaaaggaaaaaaatttacagaaaagactactggaagaatcatgttcaaatgacatttcacatcaatgtttcttcaatattttggagttgacttggttgttttctcctacctacaatagaatgtgcctgctgtttctctgtcgctcactttgggcttgcaggaagtacaacgggaatagcctgagcttcttgctccctgtataatttattcactttacytgaactgccttacctgcagttcatagtgagaacacctgggcttgtaacttgcctccacttttaagtgtgatagggccaagttgctttacctctctgggcgtttttctttaaaacgaatgggttaaactagatgagctcagaagtcccttcctgccctaacattatcttctatttttattttcctgtggttactactattagggtcagacatgtgaaatgtgagggaccatttagagatttagatgttatatttttggattattacagagtatacacccaagtttaggacctgtgtcattt

SEQ ID NO: 157379 - DNA, 601 bp, Human
catttttagtgtccccaccccgtttctatttctgttccatttgtctttactttctttgtaatcatctcattttttttccactcttgaaactcacaactttccagtccatgagcaactttgctaccatccccctcaaaaacaaatctatttaaaacaccctcctagaaaagcctctgaaccaccttcagctaaatctgtaacgtttatagaatattttaaaatcttaattcagctagagttatgatccccaaacaagtgctgacgaagctatcacagaaatgatgtctttttcaccttgtargtatcattgttgctaaatcacatcagtacaggccttctgtggggagacagcagggggcaggggcaggactaggggatgggagtagataaaactgtgattctatcctttactttaggtaaaaaatcctaggttatgaaacaaggttctgggccaagcacagtggctcaggcctgtaatcccagcactttgggaagttgaggcgggcagatcgcttgagcccaggaatttgagaccagcctgggcaacatggcaaaaccctatctctacaaagtatatataaaaaaaaaaaattagccaggc

SEQ ID NO: 157380 - DNA, 601 bp, Human
aaaatcttaattcagctagagttatgatccccaaacaagtgctgacgaagctatcacagaaatgatgtctttttcaccttgtaggtatcattgttgctaaatcacatcagtacaggccttctgtggggagacagcagggggcaggggcaggactaggggatgggagtagataaaactgtgattctatcctttactttaggtaaaaaatcctaggttatgaaacaaggttctgggccaagcacagtggctcaggcctgtaatcccagcactttgggaagttgaggcgggcagatcgcttgarcccaggaatttgagaccagcctgggcaacatggcaaaaccctatctctacaaagtatatataaaaaaaaaaaattagccaggcgtggtggtgtgtgatagtagtcccagctactcaggaaggctgaggtggaaggatcacttgaggccagggaggtcaaagctgtagtgagctgtgatgatgttactgcactccagcctgggcaacagagtgacacctgctcaaaaacaaaacaaaaccaaaaaaaacaaagttctctactcttaagttggtatataagatgacctgcacagtgtcacag

SEQ ID NO: 157381 - DNA, 601 bp, Human
aaactacatcaaatttggggggagaatatttgcctgtgatggaaagagagatagatgagttattgcttcaagtgttttaaaataaaagctattctcacacacaaaaaaaaaaaaagaaagaaaaagaaaagaaagggagctcaaatcaggaggaaatggtggtttttcctgtaagtgaggtttcagccagacacattttctttttctttttttcttttttctttttttttttaagtcagtagtggtttattaaatggttgtatcacatctggaaaacattattcaaaacatttattcagcrtacttcctgttcatattttagaagatgtaaagcaatgaaatttgctctaaataaatggcattttttttgccattatttggcatcttgccaggttactttttacatccaagttcaagtgatattttgttctcaaaataaaataattttcaaggtttggaagtataatgcgaaaattttaacagggattcttttttttttaattatactttaagttctagggtacatgtgcacaatgtgcaggtttgttacatatgtatacatgtgccatgttggtgtgctgcacccattacctcatcattt

SEQ ID NO: 157382 - DNA, 601 bp, Human
attgcttcaagtgttttaaaataaaagctattctcacacacaaaaaaaaaaaaagaaagaaaaagaaaagaaagggagctcaaatcaggaggaaatggtggtttttcctgtaagtgaggtttcagccagacacattttctttttctttttttcttttttctttttttttttaagtcagtagtggtttattaaatggttgtatcacatctggaaaacattattcaaaacatttattcagcgtacttcctgttcatattttagaagatgtaaagcaatgaaatttgctctaaataaatggcattttttttgccattatttggcatcttgccaggttactttttacatccaagttcaagtgatattttgttctcaaaataaaataattttcaaggtttggaagtataatgcgaaaattttaacagggattcttttttttttaattatactttaagttctagggtacatgtgcacaatgtgcaggtttgttacatatgtatacatgtgccatgttggtgtgctgcacccattacctcatcatttacattaggtatatctcctaatgttatccctccctgctccccccaccccacaacaggccccg

SEQ ID NO: 157383 - DNA, 601 bp, Human
aatggaatgtgcacatttacataaatatattcaagacactgtggaaacatgggtctctggaacaagcctcgttaacagcactttcattgagcatcagctgtataagggcactgggaagaatgaaaaaggtaaaggacttggcctgaaccttcaaggatggtgccccttccttgaagggggagaatggaactgagaggagcctcatcaggagtctagggcccctgccggagtaatcatgacatctctttcgaaatcatctcaatctgatttcattgtttgtataactctctctaatatatgrtatttttcaagaaactatacaaaaagtcaaacaaatgatcaatacatggggactccaaatagatttcagtttgggagcactgactaagtagacaaagaagatagaaaagctgagctcagttctatagagccccatagggtgaggggagagaaaatctgtgcgtactcagtgacttaagaagaattatgaaggaggaaagtgggagaagttggtgaggagaaggccgacaggaataaaggcagtccctgacttgcaaatgctcccttcagttgtccctttcctttctcttttttctctcta

SEQ ID NO: 157384 - DNA, 601 bp, Human
ggggagaatggaactgagaggagcctcatcaggagtctagggcccctgccggagtaatcatgacatctctttcgaaatcatctcaatctgatttcattgtttgtataactctctctaatatatggtatttttcaagaaactatacaaaaagtcaaacaaatgatcaatacatggggactccaaatagatttcagtttgggagcactgactaagtagacaaagaagatagaaaagctgagctcagttctatagagccccatagggtgaggggagagaaaatctgtgcgtactcagtgacttwagaagaattatgaaggaggaaagtgggagaagttggtgaggagaaggccgacaggaataaaggcagtccctgacttgcaaatgctcccttcagttgtccctttcctttctcttttttctctctacccatgaagtaggcctgttgaaataccttcttccatattgtctgaaaatttttaattttgttgaatttgctgaaatgccaccagttggaagtttatggactaaccaatccctcttgtaagtataataccttctagaatatggcattcttgcctttgtgtgaatgagcacaatcagc

SEQ ID NO: 157385 - DNA, 601 bp, Human
catctcaatctgatttcattgtttgtataactctctctaatatatggtatttttcaagaaactatacaaaaagtcaaacaaatgatcaatacatggggactccaaatagatttcagtttgggagcactgactaagtagacaaagaagatagaaaagctgagctcagttctatagagccccatagggtgaggggagagaaaatctgtgcgtactcagtgacttaagaagaattatgaaggaggaaagtgggagaagttggtgaggagaaggccgacaggaataaaggcagtccctgacttgyaaatgctcccttcagttgtccctttcctttctcttttttctctctacccatgaagtaggcctgttgaaataccttcttccatattgtctgaaaatttttaattttgttgaatttgctgaaatgccaccagttggaagtttatggactaaccaatccctcttgtaagtataataccttctagaatatggcattcttgcctttgtgtgaatgagcacaatcagctttctctctaatacctagctgagatcagtgctgcaggaggaatggattttgtctaaaaataggtaatatgggaacatt

SEQ ID NO: 157386 - DNA, 601 bp, Human
tgctcccttcagttgtccctttcctttctcttttttctctctacccatgaagtaggcctgttgaaataccttcttccatattgtctgaaaatttttaattttgttgaatttgctgaaatgccaccagttggaagtttatggactaaccaatccctcttgtaagtataataccttctagaatatggcattcttgcctttgtgtgaatgagcacaatcagctttctctctaatacctagctgagatcagtgctgcaggaggaatggattttgtctaaaaataggtaatatgggaacattaagyggtccttggaaaggttccaaagggataggcctaagatagtcagaaggcactgaatttctgggacatctgtgaagaacgcctctgggaggtaggacaggggagaaagggaaacgggagaatgtcaaagaaaatgttgctcatgacaggctccattttcaggaggcagagaagaagttttcttctttttgtctctccctattgtatcacatggcactcaactcccaagacccaatctgaaggctagtactattactaggggtatcacgtcattaagggtttatttaataagtttttgtgttg

SEQ ID NO: 157387 - DNA, 601 bp, Human
ctaggtgagtttagatatgttgtgaacaccccagtaagatttataaacagttgtattacaggggcattggagaggatcctaggtcaaacaaacccccaactttagccgtcttaggctccttctcaagtctctgatggctggacccctgtttcactattgatgggagaagccccttggagcaatccagtccattcaaagcccaagagattccatgcagatggctccactttgcctttatttatgctgtagacacacattatgtggctctggagagaagtcgtaggagaatagtctaagttayttatatttgtctttagaagtcattaaatttttttgacaacagatacagttgttaattatattttacttgggttaatgttgagatacacttgttttctctctacacagaggtttggaaagtaagtggaaggaagtgcaagattaatgaatatttcacaagaaattaataattgaagattgactgtttcaaaggggattcggaactattactgagcaaaaggggcttgctgcccaatgtgctagaagccaatactatgataccaggtttttgagagaagaaaagttttttatttcaagttta

SEQ ID NO: 157388 - DNA, 601 bp, Human
ctagaagccaatactatgataccaggtttttgagagaagaaaagttttttatttcaagtttactaacaaggagacaggaattcagctcaaatctgtctccctgcactggctttactgcaataattagaaaatgtttagggggtggattctgggatagtaggttattggtagaaggaaaggggaggtctggaaagtcctcaggcattcatagttatctcttcatgctacctctgggtcccctgtgccaagggggtttcagcaagttgtttcttttcttatctaccatcctgcaaacccaagaatttctgttagtcattggtgtctttaactctttgggaaatggtttcagaacaaggtcatagatttcctaaggagttgctgtatttcatgccttttttttttttttttaagaacctcactcaagaataaaaagaaatatggatattgtgatccagtttgatatgttttaccccaatgactataacttaaaatacaaaaataatatattttcccccttagccaacaagggatgatcgcggatggattattaatcccattggccccaatccctggtggactgtgatagctgcaattatcccag

SEQ ID NO: 157389 - DNA, 601 bp, Human
catgataactacagaatgtgaatagtgatataaaggaaatacacagtgctttctggcactatagagaactgagaggggtctattttagtaggatggtcagagaaggcttctctgaggagatgctatttaagatgaggtggaggccaggcgcggtggctcacacctgtaatcccagcactttgggaggctgaggtgggtggatcatgaggttcggagatcgagaccatcctggctaacacagtgaaacctcgtctctactaaaaatacaaaaacaaaattagccgggtgtggtggcaggtgsctgtagtcccagctactcaggcaggaggctgaggcgggagaatggcgtgaacccaggaggcggagcttgcagtgagccgagatcatgccactgcactccagccagggcaacagagcgagactccatctcaaaaaaaaaaaaaaaaaaaaaagatgaggtggagccatgccatggatggtgggacatggcatggaaggaggggagaaaagcagtctagtcaggcccttaggtgggaaagagtgatatgtgttctacgaaatatcagggccatgtggctcatgggcattgagtcaagacaag

SEQ ID NO: 157390 - DNA, 601 bp, Human
agcacagtgcaatgagaaggaaagagaggcaggggcagatcatgtagggccttgtcgacagtgggcaaggtaacctttgaagggttttaacaggagagggacatgatccagctagtttaaaaagatcactctggctgaggtctagggaagaatagaagcagacagaccagtgaagctgttgcaggtgacagatgatggtggcttggataaggaagctggtagcagggacagataaaaacgcatggcttctgtatagcttggaggcagacccaaaggtctcaattgttgactggatgtggartggggtgaggaaaatagaaaaatcgaagaaacctgttaggtttctgacttgaccatctggtggagtgtgatggcatttattaagatggaaaagattgtatgatttttgtgaggggtggggctgtgatcagatttggagtgagatgtctgggagtcatctaagtgaagaggctagaggagggttctggactaaaatataaatttgggtataaatttgggagtcaacagcacataggtggtattgaaagccgagggaatagatgagagaactcagggaaaagagacgacgtaaaagagaagt

SEQ ID NO: 157391 - DNA, 601 bp, Human
acagtgcaatgagaaggaaagagaggcaggggcagatcatgtagggccttgtcgacagtgggcaaggtaacctttgaagggttttaacaggagagggacatgatccagctagtttaaaaagatcactctggctgaggtctagggaagaatagaagcagacagaccagtgaagctgttgcaggtgacagatgatggtggcttggataaggaagctggtagcagggacagataaaaacgcatggcttctgtatagcttggaggcagacccaaaggtctcaattgttgactggatgtggaatgrggtgaggaaaatagaaaaatcgaagaaacctgttaggtttctgacttgaccatctggtggagtgtgatggcatttattaagatggaaaagattgtatgatttttgtgaggggtggggctgtgatcagatttggagtgagatgtctgggagtcatctaagtgaagaggctagaggagggttctggactaaaatataaatttgggtataaatttgggagtcaacagcacataggtggtattgaaagccgagggaatagatgagagaactcagggaaaagagacgacgtaaaagagaagtggg

SEQ ID NO: 157392 - DNA, 601 bp, Human
ccccccaccccccaacaggccctggtgtgtgatgttcccctctctgtgtccatgtgttctcattgttcagctcccacttatgagtgagaacatgcagtgtttggttttctgttcatgtgttagtttggagggattttctaattccacaaattagatttgagaatatttatatagtcccaaaaaaactaaattatagtccaatttagttttcagctctgagactttccttgccttgattctataggcccaatttccctacctcagagtcaatctgaagattacctaggttgatagacatgaygtgatcagaaagtcatgttcaaatactgtgtggatgttcaagtgcagtataataatgtcggtgtttccccccagaccattacctctttgataagatacgtccccactcttgccctcaagccactggtcagtaaaaaaggaagcttttttggttcacgttaaaatacatcaaatccctgaggagatgattgtgagattacagaagatttaaaaggcattatttctataagagaggggtgcgtttgtgtgtgtgtgtgtgtgtgtttgtgtgtgtgtgtgtatgtgtgcccatccccatgga

SEQ ID NO: 157393 - DNA, 601 bp, Human
ctgaaaataaatgccagttccttcctttcagttctttgatcgtctaaagctctttgggatgcccgcaaagcaccagccagatttcatctacctgcggcatgtgccgctgcgcaaagtgcacctcttcaccctcatccagttgacctgtctcgtcctgctctgggtcatcaaggcatctccagctgccattgttttcccaatgatggtgaggtggtttttaaaaaataaattcttattatcattgttattttttagtggtaaaatattataactttaaaatttaccatttttaagtgtacakttgagtggcattaagtacattcacattgctgtggagctattaccaccctccagctctggaactttttacatcttgcaaagctgaaactctgcacctattaaacactaaatttccattctcccataccctcagcccctggcaaccaccattctactttctgtctctatgtattgattattctaggtacgtcatataagtgaatcacagaatttgtccttttgtgactggctaatttcttttctttctttctttcttcttttttttttttttttttttttgagatggagtttcactcttgtt

SEQ ID NO: 157394 - DNA, 601 bp, Human
gctgtggagctattaccaccctccagctctggaactttttacatcttgcaaagctgaaactctgcacctattaaacactaaatttccattctcccataccctcagcccctggcaaccaccattctactttctgtctctatgtattgattattctaggtacgtcatataagtgaatcacagaatttgtccttttgtgactggctaatttcttttctttctttctttcttcttttttttttttttttttttttgagatggagtttcactcttgttacccaggctggagtgcaatggcatgatstcggctcactgtgacctccacctcccaggttcaagcgattctcctgcctcagcctccctaatagctgggattacaggtgcctgccaccacacccagctaattttttttgtattttttttagtagagacggggtttcactgtgttggccaggctggtctcaaacttctgacctcaggtgatccacccgtctcaacctcccaaagtgctgggattacagacatgagccactgcgcccagcttgtgactggctaatttcatttagcctaatgtcttcaaggttcatccatgttgtagcatgtg

SEQ ID NO: 157395 - DNA, 601 bp, Human
attctcccataccctcagcccctggcaaccaccattctactttctgtctctatgtattgattattctaggtacgtcatataagtgaatcacagaatttgtccttttgtgactggctaatttcttttctttctttctttcttcttttttttttttttttttttttgagatggagtttcactcttgttacccaggctggagtgcaatggcatgatctcggctcactgtgacctccacctcccaggttcaagcgattctcctgcctcagcctccctaatagctgggattacaggtgcctgccascacacccagctaattttttttgtattttttttagtagagacggggtttcactgtgttggccaggctggtctcaaacttctgacctcaggtgatccacccgtctcaacctcccaaagtgctgggattacagacatgagccactgcgcccagcttgtgactggctaatttcatttagcctaatgtcttcaaggttcatccatgttgtagcatgtgtcagaatttccttcctttttaagattgaatagtatcccactgtatgtaaatactacattttgtttatccattcacctgtcaatgata

SEQ ID NO: 157396 - DNA, 601 bp, Human
tacgttcatgggttaaataaatagcagattactgggaactcctagaagggatcctatcaattccagatgtattaggaaagtagtcactaaattagagagaaatgtacttgaatttaataagcctgatttgcctcattccttgtccagtcaccaattatagctgatgaacagcagtccacccaggcaggattaattctttgttttcctttggctaaaatggccctcatggaaagaaagtggagcagcagttgagatgccctggacatacctttatcggggaaatcagctgtcagattttagrcgagtcactttctctctctgggcctcagtttcctcatttataaagcgagtgtcaggccaggccagagggcaaagacaaaaaccactagagacaaatgatgcaggcccaaagcaaggatttgggtaggggaatgtataggcaaaggatcagagggaataaagatgatcttctaagagaacccatcatcccactgtgaggaatgcttgggtggctgtggctggtcccaccatggcccagctccagcagaggctttctacccacctgctgtcctgtagccttcctgctgacccctagccatct

SEQ ID NO: 157397 - DNA, 601 bp, Human
agggctgtgttccacaatttaagaaggtaaattcctctgatgcacagaacgacctgctaatttttggttttgtaaactatacatgatacggaagggaaagaaattacgtttctctatactccctacagcatgggaactccttttggtggggggtgaggtgaactcgtaatgtgggaaataaggagaatatatgagaagaaagttctagaagaatatgattaacccagagttcttaaatatatagtcatgcatcacttaatgactgggatacatacagagaaatgcatcattaggcaactgygtcgctgtatgaacatcatagaatgtacttagagaaacctggatgatatagcctaccacatacctaggccatgtggtgtacctgtacctcatgttactgtactgaatgctgcagacaattgtaacacaatattaagtctttatgtatctaaacatgaaggtacagtaaaaacatattataaaagattaaaaagtggtacacctgtatagggcactcaccatgaatggagcttgcaggattagaaattgctttgggtgagtcattgagtgagtagtgaggaatgtgaagtcctgggacatt

SEQ ID NO: 157398 - DNA, 601 bp, Human
tgcttatgcatattctctaaaggttgctcacacgttctggttccatgcccattgtctctgtattagtgacaactgcatcactctcaacagtgtcccagggtggatgataaattatatttaagcttattatacagaaacatcatttatcagtgtaaaaagattttctagactagtgctgtctagtagaaatatatgagccatgtaagtaattttaaaacatttttggcagccacattgaagaaactaaaaatagcaggtgacattttaataagtacattttatttaactcaatatatccaamatattgtttcaaaatataattagcataaaaatgtgaacaggatagtttatatttcctttttaatattgtctttgaaatccagtgtgtatattagacttacagcatatctccttagactagccatatttcaagtgggtattggctattgtattcactagtgcagctctagactttgatttcagtttactttatttgtgaatatgttgattgaatttggagcaaattcaagagtcagcagttttttttttgtaaaggatcagatgatgagtattttaccatttttaggccatacagtttgtt

SEQ ID NO: 157399 - DNA, 601 bp, Human
tgtgatgcagtaaactttatttactaaaacaggcggctgtaatttgccaacctctgagttaaaccatgaagttgaggctcttgtagaagaacgtttaaaacaggaaacatgcgcatgaaaagattaaacattaaaactactaatggtatataaatgaatgtagtggttatttcaataagcaaattggcaaatttggttggggttatggtgggatataggcatagagaagactagagatttggaaatacgcgtaggcagattaggatgaaaatctgctcacgtgtattctccatttttttttgccctgtgggcttctgccttataaaccacttataagcaaacacttcagattggatgagtggcagctgaaggaatctgacgtatttgactccacctgtttctttgaaagaacaagcttctggtcaggcatggtggctcatgcctgtaatcccaacactttgggagacctatgtgagaggatcgcctgagcccaggagtttgagaccagccttggcaacagtaagaccttgtcgctacaaaaaaaaaaaaaaaaattagccaggcatggtggtgcatgcttgtgttcccagctatgtgggag

SEQ ID NO: 157400 - DNA, 601 bp, Human
ggcagattaggatgaaaatctgctcacgtgtattctccatttttttttgccctgtgggcttctgccttataaaccacttataagcaaacacttcagattggatgagtggcagctgaaggaatctgacgtatttgactccacctgtttctttgaaagaacaagcttctggtcaggcatggtggctcatgcctgtaatcccaacactttgggagacctatgtgagaggatcgcctgagcccaggagtttgagaccagccttggcaacagtaagaccttgtcgctacaaaaaaaaaaaaaaaaattagccaggcatggtggtgcatgcttgtgttcccagctatgtgggaggctgagggtgggaagattgcctgggcccaggagattgagactgcagtgagctgagattgcaccaaacaaacaaacaaacaaagagctcctatttgttttagtctgtatagtgaaaaaatatagttatatggaatattttgattccaggggtttgttcacaaaggctgcttctcttgtttctcagggtcagtttaaattcagttcctgttctatgctgagactttgatattcatcatgatgttctttgaactgc

SEQ ID NO: 157401 - DNA, 601 bp, Human
ggagtttgagaccagccttggcaacagtaagaccttgtcgctacaaaaaaaaaaaaaaaaattagccaggcatggtggtgcatgcttgtgttcccagctatgtgggaggctgagggtgggaagattgcctgggcccaggagattgagactgcagtgagctgagattgcaccaaacaaacaaacaaacaaagagctcctatttgttttagtctgtatagtgaaaaaatatagttatatggaatattttgattccaggggtttgttcacaaaggctgcttctcttgtttctcagggtcagttwaaattcagttcctgttctatgctgagactttgatattcatcatgatgttctttgaactgctctttcagagttttttttcagtcatcacggataatcatgttctttctagcattattgaatattttgttggtatatttctttagaacatatatatatatttaacattttattttgaagaaactttgacttacaggaatgttgcaaaattagtacagaggctagaatgtggctctgtatactcttcacccagcttcctttaatgctaatgtgttatataaccacagtacagtgatcaaagcc

SEQ ID NO: 157402 - DNA, 601 bp, Human
tttgattccaggggtttgttcacaaaggctgcttctcttgtttctcagggtcagtttaaattcagttcctgttctatgctgagactttgatattcatcatgatgttctttgaactgctctttcagagttttttttcagtcatcacggataatcatgttctttctagcattattgaatattttgttggtatatttctttagaacatatatatatatttaacattttattttgaagaaactttgacttacaggaatgttgcaaaattagtacagaggctagaatgtggctctgtatactcttsacccagcttcctttaatgctaatgtgttatataaccacagtacagtgatcaaagccagggaattaacattagtacaatgctattaactaaactacagcccttatttaaattttagcagttttttgtctttttgtgttccaggatccaatacagaatcccaaattgtatttagttgtgtatccttggtttcctttaacctctgaatgttcctcagtttttccttgtatttcaagacttttgacacttctgatgaatattagttattttgtagagtatcttttaatttgggtttgtttgatg

SEQ ID NO: 157403 - DNA, 601 bp, Human
ttggtatcttgtttgaattctacctaatttgaacacattgggaagtaaactttttctatggcctagtctcatttcttataaataactcatttaaattatgaaaaaatacaggcataagaagttgatttaatttctaatggcctaaaatcttttaagtttatcatgcttagaaccctcaagcgtgtaacactgtaaaataatattttactgtatcttatactatatctaatctttctagagtatcaatagaaataaggatatcatgaagattggttgctcactgtctgaagtttgcccccasgccagttcagttttggggaatcttgacccaaacaaggtgagccatattcttgaatataattatttcattcctcctgtcagctttcctgtgtcttagatatttagtttttggagttcctggtatatttgaaaagaagaggctgatttttggaatttgtataaactactgttatggtatatttattaattcaaaaatacttatggactgaatattactcagtcttgaaatttgacgtaagctacaacatggatgaatcttcaggacattagctaaataagccagtcacaagaggacaaatac

SEQ ID NO: 157404 - DNA, 601 bp, Human
accaccatccagatcaacatatggttctatcatttcagaaaattccttcgggccccttctcagtcaattcttagtcagtagtttctccatcagaggtataaccctcattttgatactatcaccatagattcgtatgtctgttcttaaatcatggagtatgtagtttattgtatgtatctggcttcttttgttcaacataatttctgagattcatttatattgttgtgtgtattagtgtattggtagtctgttcttttttaagctatttaacattcattgtataaatataacacaatttatygatctgttctcctttgatgggcatttggattttttgcagtttttaactactctgaatgaaactgccgtgaaatccttatataagtcttctgctggatgtattgactcatttcttttgcacatatatctagagtagaattgctaaattgtagggtagacatgtttctgccaaagtagatactgccaaacagctttgcaaaagtgttgaaccaatttacattcttatcagcaatttatgagagttatagttcctcgatatcctcaccagccccctgctttgctagtgtactgaggttgtgtt

SEQ ID NO: 157405 - DNA, 601 bp, Human
tgctttatatagtgaactacaggaaaaacaattctaaatacacttttaaaatgctagagagttaagataacctcattaaagaaaaaatactgaaaatgtaaagggtccatacaaactaagagctgtattaagtgtatactttctattttaataattcacttggctgtgctcttaaaatgagagaagcagatattttacccatgtcttctggcaagagattcaaaagcagaagtagcaggactgtaaaatttcataaaatttgtgggattttttaaagctaaattattcaatatcttgtacwgttttgtacccatatattaccccggaatatatgtacagcatcccagcaacagtgactgcaacaaaagtaaggtaaataggtctacaaagcatttgatttccttattagagaaagtttttatagaggaaatgcaaacaactgcaattcagatcacattatataagcttgatgattatttaaaccttatataaaattaaatctaacccttaccactacaaatctgtaaggaatcagaaaaggatttatagtacacaagtcttgattactgtttcattccactttgatatcactctgagctaa

SEQ ID NO: 157406 - DNA, 601 bp, Human
tgaactacaggaaaaacaattctaaatacacttttaaaatgctagagagttaagataacctcattaaagaaaaaatactgaaaatgtaaagggtccatacaaactaagagctgtattaagtgtatactttctattttaataattcacttggctgtgctcttaaaatgagagaagcagatattttacccatgtcttctggcaagagattcaaaagcagaagtagcaggactgtaaaatttcataaaatttgtgggattttttaaagctaaattattcaatatcttgtactgttttgtacccrtatattaccccggaatatatgtacagcatcccagcaacagtgactgcaacaaaagtaaggtaaataggtctacaaagcatttgatttccttattagagaaagtttttatagaggaaatgcaaacaactgcaattcagatcacattatataagcttgatgattatttaaaccttatataaaattaaatctaacccttaccactacaaatctgtaaggaatcagaaaaggatttatagtacacaagtcttgattactgtttcattccactttgatatcactctgagctaaaacagcattctt

SEQ ID NO: 157407 - DNA, 601 bp, Human
aaaacaattctaaatacacttttaaaatgctagagagttaagataacctcattaaagaaaaaatactgaaaatgtaaagggtccatacaaactaagagctgtattaagtgtatactttctattttaataattcacttggctgtgctcttaaaatgagagaagcagatattttacccatgtcttctggcaagagattcaaaagcagaagtagcaggactgtaaaatttcataaaatttgtgggattttttaaagctaaattattcaatatcttgtactgttttgtacccatatattaccccrgaatatatgtacagcatcccagcaacagtgactgcaacaaaagtaaggtaaataggtctacaaagcatttgatttccttattagagaaagtttttatagaggaaatgcaaacaactgcaattcagatcacattatataagcttgatgattatttaaaccttatataaaattaaatctaacccttaccactacaaatctgtaaggaatcagaaaaggatttatagtacacaagtcttgattactgtttcattccactttgatatcactctgagctaaaacagcattcttccaagatttaaa

SEQ ID NO: 157408 - DNA, 601 bp, Human
ttgttactgacagaaacaagttttgcttttttccactataattcgctctgatgaaagaaataattctctctcttaactcctaacaaacgctacattttcaagactaagggaattactggtggcattctttctccttgatctaaactatttgtctctaaaatatgtcaagtaagcttttaaagattcaggaaggggcagcgttgtgatttttttctcagtaaattttgaggtggctcctctggcttcattgcttcactgtgatctttttcttcctcttctttgttatcttcttccattttttcatcctcctctctgtccagaggctgaggaataagctgattacccacaaatatgtatgtgttagttctctgtttaactctcttttttttttccttttgggtggagccctttgcggaatccccttggcctgcatctcatcatttatgaaatttctaagtgtgcgtcgaatgtaaatacaagccaagccctgtggattcctgacagcacagggagggagtcccacagaatctggtttaccattatcattcttacttggttgcacaagtggagcaaatgacacaataaggatatttttcctttc

SEQ ID NO: 157409 - DNA, 601 bp, Human
tgtcaagtaagcttttaaagattcaggaaggggcagcgttgtgatttttttctcagtaaattttgaggtggctcctctggcttcattgcttcactgtgatctttttcttcctcttctttgttatcttcttccattttttcatcctcctctctgtccagaggctgaggaataagctgattacccacaaatatgtatgtgttagttctctgtttaactctcttttttttttccttttgggtggagccctttgcggaatccccttggcctgcatctcatcatttatgaaatttctaagtgtgcrtcgaatgtaaatacaagccaagccctgtggattcctgacagcacagggagggagtcccacagaatctggtttaccattatcattcttacttggttgcacaagtggagcaaatgacacaataaggatatttttcctttcccaagtgttttgtccagttctgcgttaactgatcctctacaggcatgatcctctacattcatttgatcttcaatcagtgataccctttcttccacttgatcaaatcagctactgaagcttgtgcatgcatcacgtagttctcgtgccatggttctcagctcc

SEQ ID NO: 157410 - DNA, 601 bp, Human
gcatctcatcatttatgaaatttctaagtgtgcgtcgaatgtaaatacaagccaagccctgtggattcctgacagcacagggagggagtcccacagaatctggtttaccattatcattcttacttggttgcacaagtggagcaaatgacacaataaggatatttttcctttcccaagtgttttgtccagttctgcgttaactgatcctctacaggcatgatcctctacattcatttgatcttcaatcagtgataccctttcttccacttgatcaaatcagctactgaagcttgtgcatgcrtcacgtagttctcgtgccatggttctcagctccatcaggtcattaaggacttctctacactgtttattctagttagccattcgtctaatttttttcaaggtttttagcttctttgcagtgggtttgaacatcctcctttagcttggagaagtttgttattaccaatcgtctgaagccttcttctctcaactcatcaaagtcattctccatccagctttgttccgttgctggcgaggagctgcgttcttttggagaagaggcgctctgatttttagaattttcggcttttctgctttggtc

SEQ ID NO: 157411 - DNA, 601 bp, Human
tggttctcagctccatcaggtcattaaggacttctctacactgtttattctagttagccattcgtctaatttttttcaaggtttttagcttctttgcagtgggtttgaacatcctcctttagcttggagaagtttgttattaccaatcgtctgaagccttcttctctcaactcatcaaagtcattctccatccagctttgttccgttgctggcgaggagctgcgttcttttggagaagaggcgctctgatttttagaattttcggcttttctgctttggtctctccccatctttgtggttwtatctactttttgtctttgatgatggtgacgtacagatggggttttggtgtggatgtcctttctgtttgttagttttccttctaacagtcaggaccttcacgtcctcagctgcaggtctgttggagtttgctggaggtccactccagaccctgtttgcctgggtatcaccagcggaggctgcagaacagcaaatattgcggaatggcagatgttgctgcctgatcgttcttctggaagcttcgtctcagaggggcacccggctgtatgaggtgtcagtctgcccctactggggggtgcct

SEQ ID NO: 157412 - DNA, 601 bp, Human
ttttgctaatgaaagtaaaactatgtgcttgaaacaaaatgtaggtatagttaaatcttactttaatataaaagtctgtataaattagtgaaaaataggaattataattagaaagcaattatatatttatgctcatctttgctaggtaaacattgaacagataagaatgacatacacatatataatatatgtaaatagtttccttctgatgtaaatgtttaaaaggatagtctctttttgtttttttttttttttttgagacagagtctgactctgttgcccaggctggagtgcagtagcrtgatctcggctcactgcaacctctgcctcccaggttcaagcaattcttctgcctcagcctcccgaatagctggattacaggcctgtgccaccatgtccagctaatttttgtatttttggtagagttggggttttaccatgttggccaggctggtctcgaactcctgaccccaggtgatccacccaccttggccttccaaagtgctgggattacaagcatgagccactgcgcccagccaaggatagtctcttatatgatggagaaaataatgaatacagttatttctataattgttttggg

SEQ ID NO: 157413 - DNA, 601 bp, Human
ttatattactttccattgaattttgggttggtaacctaattctggaagacgttcgataatttcaggggtagtcttacaggaattctacctcttttaaaatctgttatacaaagatgattcttttggtaaatggtaatgctggtgagagatattacattggaaagtaatcagatttgtaattcttatttataatagcagctcaagtagctcatgtggaaaacagtttaatcattgtaagcattataaagaaattaattaaaattgcctctatttttctttgagaatcttgtaggtgtgttgrgtatagttttgtctgctatgtagttacttataaaaaacatttctgtacatgaaactcaggctttcataaacatgaaatatagatattataaaattacaccccaagtttctggtttaaaatctaaagtttgttactttcttctttaatataaatgctttgaccaaggttggggaggcttgttttggatttcttgcatgcataaaactctaaaatcttgtttacggaccttagaatattatctgctctcactttgttttacatatagggaaattgtagtctagaataattaaatgacttcaa

SEQ ID NO: 157414 - DNA, 601 bp, Human
ttcaggggtagtcttacaggaattctacctcttttaaaatctgttatacaaagatgattcttttggtaaatggtaatgctggtgagagatattacattggaaagtaatcagatttgtaattcttatttataatagcagctcaagtagctcatgtggaaaacagtttaatcattgtaagcattataaagaaattaattaaaattgcctctatttttctttgagaatcttgtaggtgtgttgggtatagttttgtctgctatgtagttacttataaaaaacatttctgtacatgaaactcagsctttcataaacatgaaatatagatattataaaattacaccccaagtttctggtttaaaatctaaagtttgttactttcttctttaatataaatgctttgaccaaggttggggaggcttgttttggatttcttgcatgcataaaactctaaaatcttgtttacggaccttagaatattatctgctctcactttgttttacatatagggaaattgtagtctagaataattaaatgacttcaagtcgtgaagctaactagggaagagctaggcctagaactcaagtctgttgttcttttcata

SEQ ID NO: 157415 - DNA, 601 bp, Human
attcagtaacaacacaaatacctccttccttccccttttccagaaggtgtcctgggcactgaaattccttcacatttttttaactaacactttcacgctatgctgcagcacagtcagaattgatgctcagaatggtagtttgctgaagatcgagagaatattacattactagtcctacatgcctgactttaaaaattatatgtagggtaagggaatgagagctagagcttggaatttgtgtttaacaatttaaaggccttttagcttgttttctaatatatacaggcagaattcagaggartaaagtagaaagcaagtgatcctttcttgtttctgaatgaagcttaccagtttggaaaacagaatgaaatatatttctaaaaagtgacattcatcttttttaatgattgaaagccttatgttctaaaccagtgaccagatttattttaaaaagttaagttttgtccagtgcggtggctcatgcctgtaagcccagcactttcggaggctgaagtgggtggatggcttgagtccaggagtttgagaccagcttgggcaacatgggaaaaccctgtctgtataaaaaatacaaaaaaattag

SEQ ID NO: 157416 - DNA, 601 bp, Human
gcctgtaagcccagcactttcggaggctgaagtgggtggatggcttgagtccaggagtttgagaccagcttgggcaacatgggaaaaccctgtctgtataaaaaatacaaaaaaattagctgggcatggtggcgcatgcctgtagtccccgctactcaggaggctgaggtgggaggattgcttgagcttgaggggtcaaggctgtgagaccctgtctgaaaaaaaaaagataaaagttaagttttataccttttaaatgcctaaatatattttttaagtgcaggtatatatctccagctcwtaagggttagtggaaaatatatttcttatgataaaaattaaatgtttatatgtattatatataaagagaaaacatacatatttttggtatagtattaaaacacccatgtatcatatactctgtcattctttttgttagttggaactgaggaagactcagattttatttcaagttcagggttctgtgtttatgattatatatgattcagggagaatctgtttgaaccacttcatactaattgtgattggtgactgtaactaaaatgaatttgaattcagagagaaatctaaaattagattt

SEQ ID NO: 157417 - DNA, 601 bp, Human
tgtgtatttctgaattttatgccttggaaaatttataaaacctgtgtttttgttaacctaaagtattataggaattttatgccttgaaaaatttataaaacctgtgtgtttgttaacctaaagtattttcgtgttttgtggatttaaaaaattattttttcagctaggcacagggtgtgtgcctgtaatcacagctacttaggaggctgaagtgggaggattgcttgggcccaggagttcaagaccagcttgagcaaacatagcaagaccccatctaaaaaattcttttttttttttttttgggtagtgatagttggtgattcttgagcatatgtagtttgagtctccttctctgccccttcagatgcatccttgtaggcccaggtatcctcaacctgttgttaaaataaatgtgtcagctgggtgcggtgtctcacgcctgtaatcccagctctttgggagactgaggtgggcggatcacgaggtcaggagatcgagaccatcctggctaacatggtgaaaccccatctctactacaaaatacaaaaaattagctggtcatggtggtgggtgcctgtagtcccagctacttgggaggctg

SEQ ID NO: 157418 - DNA, 601 bp, Human
tagggcacaacctttttggggagcttgatttttgaaaaggaaataaaaatgagaattaaagcaacctctgaagatggaacagttattgctcaggctgagtatggcagtgtggatataggggaagaggtgcttaagaaaggatttgcagagaaatgcagacttgcttccagaactgacatctgtgaggaaaaaaaattggatcctggtcaacttgttctcaggaacctcaaaagccccattcctttgtgggggcatagatcaaaccagtcaaccttcagcaggcccaaggggcacttaagtragaaaatgactcttgacttgaatgatgaaaatgatgcaggcaatcttataacatttccaaagtaagaatttagtcttcactaatttctaattgatggtagaggtccctgtcatagtagaatagaagttaaggcttatgcttttggaatcctttactgtgtcagtgattttaagggctgatgctgatatttctgtttttctcaaatgtattcctctctgctttagcagggatattttcattaaaagctattttgaaagaaaaataactcctgaattattttaaagtttacataccaacttt

SEQ ID NO: 157419 - DNA, 601 bp, Human
cttgatttttgaaaaggaaataaaaatgagaattaaagcaacctctgaagatggaacagttattgctcaggctgagtatggcagtgtggatataggggaagaggtgcttaagaaaggatttgcagagaaatgcagacttgcttccagaactgacatctgtgaggaaaaaaaattggatcctggtcaacttgttctcaggaacctcaaaagccccattcctttgtgggggcatagatcaaaccagtcaaccttcagcaggcccaaggggcacttaagtaagaaaatgactcttgacttgaakgatgaaaatgatgcaggcaatcttataacatttccaaagtaagaatttagtcttcactaatttctaattgatggtagaggtccctgtcatagtagaatagaagttaaggcttatgcttttggaatcctttactgtgtcagtgattttaagggctgatgctgatatttctgtttttctcaaatgtattcctctctgctttagcagggatattttcattaaaagctattttgaaagaaaaataactcctgaattattttaaagtttacataccaacttttcatgccaactatttggaataca

SEQ ID NO: 157420 - DNA, 601 bp, Human
atatactccagactaatcatctttggatttcattggatgtttgcaaatttaataatttctcatttacatttccctttatgttctaaaaacttttcaactaaggcaattttcaaacattctaaaaggagagagacttgaataattaattctcatgtgcccatcacccagtttatacaattataacacatggccaatctttttaaaaatttacacttcctggattattttagaagaagtcccattcatattatttcatagtcttcagtatgtatgactaatagaaaaggactttaaaaaaccrtaataataatactattcatacttaaaagtaaacaataattccttaatattatttatatccaggcagtattcaaatttgccatattgtgtcatgaatgccacatgattgtaggcatgttgattgtagttttctccaatcaggatcccagttaggcacatacattgcattttggttgatatttctcttaaattgctttaatgtgtttccttgtgttgcttaactggattcttgatctccacgtgtgtcttcttttatggtaatcacgtctccagatttgctcagattttagttcagaaattt

SEQ ID NO: 157421 - DNA, 601 bp, Human
caggcagtattcaaatttgccatattgtgtcatgaatgccacatgattgtaggcatgttgattgtagttttctccaatcaggatcccagttaggcacatacattgcattttggttgatatttctcttaaattgctttaatgtgtttccttgtgttgcttaactggattcttgatctccacgtgtgtcttcttttatggtaatcacgtctccagatttgctcagattttagttcagaaattttcccccccagggatacagtgtggttgataagtgtgtgtgtgtgtgtgtgtgtgtgtgtggatgtgtgtttaacaccaaatctgttgttcctgcactagttcctccaattctctgacaccaactgggtgtctaataattcagctccattctgacactacattacctgtacttagcatataccctacaagttaaggactcagttccataaagctgcctctactttagatgccagccacaaatggggtccccaggctacttgcatatctacccccccactataaattcggggtttcccatgaccctccctcaggttagataattcactagaactactcacagaactcacggaagtgctatact

SEQ ID NO: 157422 - DNA, 601 bp, Human
ctgcagccattattctttttgatgcccatcttatactctttggaagtctctttaagttgttgctctgtccttttgatgtgattccagtagtctgatagcttccttgttttctggtgtcacaagatgttccatactcatctgcatttcctaccctaatcctggaaaagttatttctccaagctatagttctttttagtggcaagaggtatttagataccagactttgggtgctagggatatatatagctattgctttagtctttgcttctaggttatagaatgtctaattgatagggttagsaaatattattttctaatgctatattgagatatcatttacatatagtaaaaatgcacaaatactgtgtagaacttgataaattttgacgtatgtatactctcatgtaacctgaatcaccctcatcaagattggctgatgaaactatcattaatcagatatttcacctagtatcaagctctaccaataatttcagggacacaggtaacaaagagactcctttgttccagagcaggtgccccagtctctgaccagagactagaatgtctgctgtggctactgctgccaggcatcaaacaatgt

SEQ ID NO: 157423 - DNA, 601 bp, Human
acttctgtgctcaatcagtgctcctgcctcagcttcctgagtagctgggactacaggtgcatgccaccatgctgagctaatattttaaatttttattagagatgaggtcttgttatgttgaccaggctcttctcaacccctgagctcaagtgatcctcctgcctcagcctcccaaagtgctgggattataggcgtgagccatcatgccaggcctagatctagtatattgttgaagctttggaatgtattttgtatttcattcggtgaatcctttagttctaggatttctttttttttttttaatgatacctatttggtaaatttctcatttataacctgaattgtttttctgatttctttatattatttttcagaattatcttttatctcactgaacttatttaaaatcagtattttggatttttcatctggaatttcagaatttctttttgattatgatctgttggtggagaattactaacttcctttggagttatattttcttgtcttctcatgtttcttttgttacattgatatttgtgcattgggtgtaacagttgcttcttccaattttttggaaataattttgtaggggaggatc

SEQ ID NO: 157424 - DNA, 601 bp, Human
agccaggatggtctcaatctcctgacctcgtgatccacccgcctcggcctcccaaagtgctgggattacaggtgtgagccaccatgcccggcctgttcagattatttttgtgtgagctttggcagattacgtctttcaaagaattagttcatttaatctaggttatcaaatttgtgggacttgagttgttcataatatttttaagttttaatttccattggatctgtactgatgccctctctttcatttctgatactggcaatttgtgtcctctgtctttttttcctttattagcctggtyatagtgttaccaattttattcatcttttcaaagtatcaacttttggttttgctggtttttctctcctgatttcctgttttcaaattgattgatttatactttcctatttttgcatattaagatttaatttgctaaaggagatttaatttcctaagaagcaaacttagattattaatattagtttcttttcacttctaatatatacgcatttcaatgctgtaaatttttgtcaatgcactgcctgtgctgcattctacaaattttggtaagttgtatttttatcttgaaagtatttttaaa

SEQ ID NO: 157425 - DNA, 601 bp, Human
ttatggcccagaatgtggtggcgtattttggtgaatcttccatgtgatcttgacaggaatgtatattctgctgttattggatgaagcatagttcacccttgaacatgagtttgaactacatgggtccacttatatgtggatattttaaataaaagttacatcagttatgcctgcctctccagcctccccttccacttcttccctctctgccatcggtgagataggaataccaacctctcctcttcctccctgtcctcagcctgctcaatgtgaagatgagggaggatgaagaccttaatgrtgatccacttccatttaatgaatagtaaatatatcttctctttatgcttttcctaataacattttcttttttttggcttactttactgtgagaatacagtatataatacatataacatacagaatacttgctaactgatggcttgtcttatcaataaagcttctggtcaacagtaggctattagtaattagctttctgtggaatctaaagttatacataaattttcaagactgttgggggttggcacccctaacacttgctttgttcaagagtcagctgtagtctgtagatgttaattat

SEQ ID NO: 157426 - DNA, 601 bp, Human
aactacatgggtccacttatatgtggatattttaaataaaagttacatcagttatgcctgcctctccagcctccccttccacttcttccctctctgccatcggtgagataggaataccaacctctcctcttcctccctgtcctcagcctgctcaatgtgaagatgagggaggatgaagaccttaatgatgatccacttccatttaatgaatagtaaatatatcttctctttatgcttttcctaataacattttcttttttttggcttactttactgtgagaatacagtatataatacatayaacatacagaatacttgctaactgatggcttgtcttatcaataaagcttctggtcaacagtaggctattagtaattagctttctgtggaatctaaagttatacataaattttcaagactgttgggggttggcacccctaacacttgctttgttcaagagtcagctgtagtctgtagatgttaattatcaactgtacactatagatgttaattatatccaatttattggtgttgagttcaaatgtatctttactgatttttccatgctagatctgtccacctctgatagagggatgttgaa

SEQ ID NO: 157427 - DNA, 601 bp, Human
gaggatgaagaccttaatgatgatccacttccatttaatgaatagtaaatatatcttctctttatgcttttcctaataacattttcttttttttggcttactttactgtgagaatacagtatataatacatataacatacagaatacttgctaactgatggcttgtcttatcaataaagcttctggtcaacagtaggctattagtaattagctttctgtggaatctaaagttatacataaattttcaagactgttgggggttggcacccctaacacttgctttgttcaagagtcagctgtrgtctgtagatgttaattatcaactgtacactatagatgttaattatatccaatttattggtgttgagttcaaatgtatctttactgatttttccatgctagatctgtccacctctgatagagggatgttgaagtcatttttgatttccgttacagtgttttgatatctaacatttctttttggttcattcttaggatttccatctctttgcttacattgcccgtctgttgttactacatgctatctactttctccattatgatgcgtagcatattaatcataattgttttaaattcattg

SEQ ID NO: 157428 - DNA, 601 bp, Human
atttctttttggttcattcttaggatttccatctctttgcttacattgcccgtctgttgttactacatgctatctactttctccattatgatgcgtagcatattaatcataattgttttaaattcattgtctgataattccaacatcccgtctacatctggttctgaatgttttctttcttcaaactgtagtttttgccctagagtatgccttgtaattttttcttttcttttcttttcttgttttttttttttttttgagacagggtcttgccctgttgtctagtctggaatgcagtggygtgatcttggctcactgcaacctccacctcctggactcaagtgatcctcccacctcagcctgctgagcaactgggactacaggcgtgcaccaccatgcctggctaatttttgcttttttttttttttttggggtagagaccattttgtcttgttgcccaggctggtcttgaactcctgggctcaagcagttgacccacttcagcctcccaaagtgctggaattataggcattagccactgtgcctagctgtaattttttcttgataactgtatatgatatatcaggtaaaaaagcaattg

SEQ ID NO: 157429 - DNA, 601 bp, Human
gctatctactttctccattatgatgcgtagcatattaatcataattgttttaaattcattgtctgataattccaacatcccgtctacatctggttctgaatgttttctttcttcaaactgtagtttttgccctagagtatgccttgtaattttttcttttcttttcttttcttgttttttttttttttttgagacagggtcttgccctgttgtctagtctggaatgcagtggcgtgatcttggctcactgcaacctccacctcctggactcaagtgatcctcccacctcagcctgctgagyaactgggactacaggcgtgcaccaccatgcctggctaatttttgcttttttttttttttttggggtagagaccattttgtcttgttgcccaggctggtcttgaactcctgggctcaagcagttgacccacttcagcctcccaaagtgctggaattataggcattagccactgtgcctagctgtaattttttcttgataactgtatatgatatatcaggtaaaaaagcaattggtttaaatatgtctttaataatgtaattgtaagatgtacgcgggagtgatgtgttgtatagtcctgtg

SEQ ID NO: 157430 - DNA, 601 bp, Human
tgtctgataattccaacatcccgtctacatctggttctgaatgttttctttcttcaaactgtagtttttgccctagagtatgccttgtaattttttcttttcttttcttttcttgttttttttttttttttgagacagggtcttgccctgttgtctagtctggaatgcagtggcgtgatcttggctcactgcaacctccacctcctggactcaagtgatcctcccacctcagcctgctgagcaactgggactacaggcgtgcaccaccatgcctggctaatttttgctttttttttttttkttggggtagagaccattttgtcttgttgcccaggctggtcttgaactcctgggctcaagcagttgacccacttcagcctcccaaagtgctggaattataggcattagccactgtgcctagctgtaattttttcttgataactgtatatgatatatcaggtaaaaaagcaattggtttaaatatgtctttaataatgtaattgtaagatgtacgcgggagtgatgtgttgtatagtcctgtgattaggtctcagtctttttgtgagtctatgtctctggcccatgaattcacaagcatttc

SEQ ID NO: 157431 - DNA, 601 bp, Human
gtctgataattccaacatcccgtctacatctggttctgaatgttttctttcttcaaactgtagtttttgccctagagtatgccttgtaattttttcttttcttttcttttcttgttttttttttttttttgagacagggtcttgccctgttgtctagtctggaatgcagtggcgtgatcttggctcactgcaacctccacctcctggactcaagtgatcctcccacctcagcctgctgagcaactgggactacaggcgtgcaccaccatgcctggctaatttttgcttttttttttttttktggggtagagaccattttgtcttgttgcccaggctggtcttgaactcctgggctcaagcagttgacccacttcagcctcccaaagtgctggaattataggcattagccactgtgcctagctgtaattttttcttgataactgtatatgatatatcaggtaaaaaagcaattggtttaaatatgtctttaataatgtaattgtaagatgtacgcgggagtgatgtgttgtatagtcctgtgattaggtctcagtctttttgtgagtctatgtctctggcccatgaattcacaagcatttct

SEQ ID NO: 157432 - DNA, 601 bp, Human
tctgataattccaacatcccgtctacatctggttctgaatgttttctttcttcaaactgtagtttttgccctagagtatgccttgtaattttttcttttcttttcttttcttgttttttttttttttttgagacagggtcttgccctgttgtctagtctggaatgcagtggcgtgatcttggctcactgcaacctccacctcctggactcaagtgatcctcccacctcagcctgctgagcaactgggactacaggcgtgcaccaccatgcctggctaatttttgctttttttttttttttkggggtagagaccattttgtcttgttgcccaggctggtcttgaactcctgggctcaagcagttgacccacttcagcctcccaaagtgctggaattataggcattagccactgtgcctagctgtaattttttcttgataactgtatatgatatatcaggtaaaaaagcaattggtttaaatatgtctttaataatgtaattgtaagatgtacgcgggagtgatgtgttgtatagtcctgtgattaggtctcagtctttttgtgagtctatgtctctggcccatgaattcacaagcatttctc

SEQ ID NO: 157433 - DNA, 601 bp, Human
gctttaaaatttaacctttgtatttttatgacttcaaagagagaaagatagttatttctgagatgaattttatactgtttttgtcaggtttctactgtcactgcttggagctagagtgttctaaggttataactgagactgaaattgaaaaaacagcaacatagcttttaagtgatagtttgatgggaaactaccatatccagttattttgcttggggttattttcaggagtacagcatgtccttgaataacgtgttttcattcaacattatttcattataacattgaagaagaaaatcarttcctagctggagccccactgtctgtgtggagtttgcacattctctccatatttgggtggttttcttggaatactgtggtttcctctcacatcccacttaggtgaattggtgtgtctgtattgtcccagtatgagtgagtgtgtggatgagggtgagtgtgccctgcaatgcaagggtgtcatgtccaggattggttcctaccttaatgctctgagctgctgagatagatgtggccacctgcaacccctggattggaataagcgggttggaaaatgaatgagtgaatgagtatatacaga

SEQ ID NO: 157434 - DNA, 601 bp, Human
ccaaaaattgaaggttcatttgataccatttcaaattctgcagactttcgaagttgccttttttatagtttaaaaaatttttaattttttcatattttttatgtcatgaaattagtatatccacagttgttttttaattaaaagtttatattaaattatgcatgtctgcataaaaatatgtggactgaaaaaaataagttatacatgattttatataaagttttaaaaggtaccccttcaaagccagtgctgtaaacactaacttttagaccattactattaaagtgtaactttttctcayaccagctttctaatttattgatcttcttctttttgatgtttttaaaaataggcatgtcgacatcagtgtccgtttcggaaaagacctttcagatgctatacaagtgttggatgaagggtgctttactactccagcttctttgaatggattagagataatatgggcagaatacagtctggctcaggagaatattaaaacttgtgaatatgtggtgagttgggaatttttctctattgtggtttttatctgttgaacataaggaagtgtttttttaatttcttctaaaaaaaataacaggat

SEQ ID NO: 157435 - DNA, 601 bp, Human
atattaaattatgcatgtctgcataaaaatatgtggactgaaaaaaataagttatacatgattttatataaagttttaaaaggtaccccttcaaagccagtgctgtaaacactaacttttagaccattactattaaagtgtaactttttctcacaccagctttctaatttattgatcttcttctttttgatgtttttaaaaataggcatgtcgacatcagtgtccgtttcggaaaagacctttcagatgctatacaagtgttggatgaagggtgctttactactccagcttctttgaatgrattagagataatatgggcagaatacagtctggctcaggagaatattaaaacttgtgaatatgtggtgagttgggaatttttctctattgtggtttttatctgttgaacataaggaagtgtttttttaatttcttctaaaaaaaataacaggatacatgtgcagaatgtgcagatttgttacataggtatacatgcgccgtggtagtttgctgcacctgtcctctaaattccctccctcacccccccatttcctaacgagccctggtgtgtattgtttccctctctgtgtccatgtgttct

SEQ ID NO: 157436 - DNA, 601 bp, Human
accagctttctaatttattgatcttcttctttttgatgtttttaaaaataggcatgtcgacatcagtgtccgtttcggaaaagacctttcagatgctatacaagtgttggatgaagggtgctttactactccagcttctttgaatggattagagataatatgggcagaatacagtctggctcaggagaatattaaaacttgtgaatatgtggtgagttgggaatttttctctattgtggtttttatctgttgaacataaggaagtgtttttttaatttcttctaaaaaaaataacaggatrcatgtgcagaatgtgcagatttgttacataggtatacatgcgccgtggtagtttgctgcacctgtcctctaaattccctccctcacccccccatttcctaacgagccctggtgtgtattgtttccctctctgtgtccatgtgttctcaatgttcaactcccacttacgagtgagaacatgtagtgtttggttttctattcttgtgttagtttgccgaagatgatggcttccagcttcatccatgtcgttgcaaaggacataaactcgttcctttttatggctgcatagtattccatggtg

SEQ ID NO: 157437 - DNA, 601 bp, Human
attgagatagtcacgtggtttttgtcattggttctgtttatgtgatggattacgtttattgatttgcgtatgttgaaccagccttgcgtcccagggatgaagtggacttgatcgtggtgggtaagttttttgatgtgctgcgggattcggtttgtcagtattttattgaggattttcgcatcgatgttcatcagggatattggcctgaagttttctttttttgttgtgtcttttcccggtttgggtatcaggataatgctggcttcataaaatgagttagggaggagtccgtccttttcarttgttgggaatagtttcaaaaggaatggtatcagctgttctttgtatttctggtagaattcggctgtgaatctgtctggtcctgggctttttttggtcggtaggctgttaattactacctcaatttcagagtttttgttattggtctattcagggattcagcttcttccagaaggggtggccagcccctgcacacctgtgggcgtttctcgtcaggtggaacgagagacttgagaaaagaaagagacacagagacaaagtatagagaaagaaaagtgggcccaagggaccggcgctcagc

SEQ ID NO: 157438 - DNA, 601 bp, Human
gtccttttcagttgttgggaatagtttcaaaaggaatggtatcagctgttctttgtatttctggtagaattcggctgtgaatctgtctggtcctgggctttttttggtcggtaggctgttaattactacctcaatttcagagtttttgttattggtctattcagggattcagcttcttccagaaggggtggccagcccctgcacacctgtgggcgtttctcgtcaggtggaacgagagacttgagaaaagaaagagacacagagacaaagtatagagaaagaaaagtgggcccaagggacyggcgctcagcatgtggaggacccgcgcccgccggcaaaggtctctgagttccctcagtatttattgatcattatctctaccatctcggagagggggatgtggcaggacaatagggtaatagtggggagagagtcagcaggaaaacatgtgaacaaatgtctctgtgtcataaacaaggttagaaaatgtgctgtgctttgatgtgcacatacataaacatatctggtgcattaaagagtagtattgccgtcagcatgtctcacctccagccttaaggtggttttctcctgtctcagtaga

SEQ ID NO: 157439 - DNA, 601 bp, Human
gcaaagaggccttcctcttttactaatcctcctcagcacagaccctttatgggtgtcgggctgggggacggtcaggtctttcccttcccacgaagccgtatttcagactgtcacatggggagaaaccttggacaagacctggctttcctaggcagaggtccctgcggccttctgcagtgttttgtgtccgtgggtacttgagattagggaatggtgatgatttttaacaagcatactgccttcaagcatttgtttaacaaagcacatcctgcatagccctaaatccatgaaaccttgagtygacacagcacatgtcgtagggagcacagggttgggggtagggttgcagattaacagcatctcaaggcagaataatttttcttaatacagaacaaaatggagtctcttacgtctacttctttctgcattgacacagtaacagtctgatctgcctttcttttccccacactacctggtttagtcttggtagggtgtaggcatccaagagtttattcatttcttctagattttctagtttatttgtgtagaggtgtttatagtattctgtgatggtagttggtatttttgtggggtcagtggt

SEQ ID NO: 157440 - DNA, 601 bp, Human
ccttaaatgtaaatgggccaaatgccccaattaaaagacacagactggcaaattagctaagtggtcaagactcatctgtgtgctgtattcaggagacccatcttccgcacaaaaacacatacaggctcaaaagaaagggatggagggaaatttaccaaacaaatagaaagcaaaagaaagcagaggttgcagtcctagtctctgataaaacagactttaaatcaacaaagataaaaaaagacaaaggcattacgtaatggtaaaggaaacagttcaacaagaagaggtgactattctgaayatatatgcacccaaggagcacccagattcataaaacaagttcttagagacctacaaagagacttagattcccacacaataataatgggagactttaacaccccactgtcagtattagatcaacgagacagaaaattaacaaggatattcaggacttgaacttagctctctatcaagtggacctgatagacgtctgcagaactctctaccccaaatcaactgaatatacattcttctcagtgccacatggcacttattctaaaattgaccacataattggaagtaaaacactcttcagcaa

SEQ ID NO: 157441 - DNA, 601 bp, Human
gatcacagctcactgcagcctcaacctccagggcacaagagattctccacttcagcttcccaagtagctaggactacaggcggtgtactaccaaccatgcctggctaatttttttgtactttttatagtgacggggttttaccatgttgtccagacaggttttgaactccttggctcaagtaatcctcctgccttggcctcccaaagtcctgggattgcaagtgttagctaccatgcccgtaccctagttctaaatgttaatatggaacttgaacccagacatgtctgacagcaaagcctrttgtttttccatttaaaccacactattgatattaaaatacttcttaatgtattttcatgtaagatgaaaagatgtaaaaaaacctgccttatttgtttttgtggtttgagcatagtgaaagtattcaggatggagctttagcacttactatcctatgagtacagatgtgactttttttgaaagcagaattttttttttctactactgcttgtgtttccggacttaaagtttacttgatagatggaagtgtagattattggctaaatatataatcataatagccactcaaatgaaatcgtc

SEQ ID NO: 157442 - DNA, 601 bp, Human
gtccagacaggttttgaactccttggctcaagtaatcctcctgccttggcctcccaaagtcctgggattgcaagtgttagctaccatgcccgtaccctagttctaaatgttaatatggaacttgaacccagacatgtctgacagcaaagcctattgtttttccatttaaaccacactattgatattaaaatacttcttaatgtattttcatgtaagatgaaaagatgtaaaaaaacctgccttatttgtttttgtggtttgagcatagtgaaagtattcaggatggagctttagcacttastatcctatgagtacagatgtgactttttttgaaagcagaattttttttttctactactgcttgtgtttccggacttaaagtttacttgatagatggaagtgtagattattggctaaatatataatcataatagccactcaaatgaaatcgtcattttatttcccttattgtacttattttggtttagaattgttaacttttattcaagtattttgcatagttctttaacttgattgccatgtggccatatgcttttttttttttttgagacggagtctcgctctgtcgcccaggccggag

SEQ ID NO: 157443 - DNA, 601 bp, Human
tttctactactgcttgtgtttccggacttaaagtttacttgatagatggaagtgtagattattggctaaatatataatcataatagccactcaaatgaaatcgtcattttatttcccttattgtacttattttggtttagaattgttaacttttattcaagtattttgcatagttctttaacttgattgccatgtggccatatgcttttttttttttttgagacggagtctcgctctgtcgcccaggccggagtgcagtggtgtgatctcggctcactgcaagttctgccttccgggttcrtgccattctgctgcctcagcctcccgagttgctgggactacaggcgcctgccactctgcccagctaattttttgtatttttagtagagatggggtttcaccatggtctcgatctcctgacctcatgatccgcctgcctcggcctcccaaagtgctgggattacaggcgtgggccaccgtgcccagatgttttttttttttaatgatgaaaacagtaggctttacttgaggtcttttcttttttatttatagttttaaaataatctggttgagcttatgcaagaaaaaatatcctaaaatt

SEQ ID NO: 157444 - DNA, 601 bp, Human
gctgggactacaggcgcctgccactctgcccagctaattttttgtatttttagtagagatggggtttcaccatggtctcgatctcctgacctcatgatccgcctgcctcggcctcccaaagtgctgggattacaggcgtgggccaccgtgcccagatgttttttttttttaatgatgaaaacagtaggctttacttgaggtcttttcttttttatttatagttttaaaataatctggttgagcttatgcaagaaaaaatatcctaaaattcaggcttttatagttttatagttttataatrtattttatagttttatttatagttttaaaataatctggttgagcttatgcaagaaaaaatatcctaaaattcaggcttttatagttttatagttttataatacattttatagttttatttatagttttaaaataatctggttgagcttatgcaagaaaaaatatcctaaaattcaggcttttaagtgtatgtgccagacactgttataggtaatagagataaaaacttttttattttattttattttattattattttacttttagggtacatgtgcacaatgtgcaggttagttacata

SEQ ID NO: 157445 - DNA, 601 bp, Human
attttattttattttattattattttacttttagggtacatgtgcacaatgtgcaggttagttacatatgtatacatgtgccatgctgctgtgctgcacccattaactcgtcatttagcattaggtatatctcctaatgctatccctcccccctccctccaccccgagataaaaatttttaaaagacatatcctttctttctttcttgggtacaggatggatatattaatatatagttttaatacagtatggtaagtgctataataaagaaaatgcatagagttcttggatatctttcacrtatgtatttccaaacacagcctgttggacaaattggagggtttatcctggtgtttaagtgtatcttgaaggatgagtagctgaaggagttgagaatgggatgggaatagaaaagaggccatatgtaattagtaggaacttatataattttctgtaagaaaaacaaaaatttcattgttgcagaaataatgggaaaaataaaaattagatcagagttgttgaacttaaatgttttatttttaattaagagaaaggaagtttttttgtcattttgttgatctaaggagagaaatgtcctaag

SEQ ID NO: 157446 - DNA, 601 bp, Human
aatgtgcaggttagttacatatgtatacatgtgccatgctgctgtgctgcacccattaactcgtcatttagcattaggtatatctcctaatgctatccctcccccctccctccaccccgagataaaaatttttaaaagacatatcctttctttctttcttgggtacaggatggatatattaatatatagttttaatacagtatggtaagtgctataataaagaaaatgcatagagttcttggatatctttcacatatgtatttccaaacacagcctgttggacaaattggagggtttatcytggtgtttaagtgtatcttgaaggatgagtagctgaaggagttgagaatgggatgggaatagaaaagaggccatatgtaattagtaggaacttatataattttctgtaagaaaaacaaaaatttcattgttgcagaaataatgggaaaaataaaaattagatcagagttgttgaacttaaatgttttatttttaattaagagaaaggaagtttttttgtcattttgttgatctaaggagagaaatgtcctaagtgctataatgtttggagaatataaagttaattttggagatcactttt

SEQ ID NO: 157447 - DNA, 601 bp, Human
tccctcccccctccctccaccccgagataaaaatttttaaaagacatatcctttctttctttcttgggtacaggatggatatattaatatatagttttaatacagtatggtaagtgctataataaagaaaatgcatagagttcttggatatctttcacatatgtatttccaaacacagcctgttggacaaattggagggtttatcctggtgtttaagtgtatcttgaaggatgagtagctgaaggagttgagaatgggatgggaatagaaaagaggccatatgtaattagtaggaacttayataattttctgtaagaaaaacaaaaatttcattgttgcagaaataatgggaaaaataaaaattagatcagagttgttgaacttaaatgttttatttttaattaagagaaaggaagtttttttgtcattttgttgatctaaggagagaaatgtcctaagtgctataatgtttggagaatataaagttaattttggagatcactttttttcatataggtcatatgcggaaaagacctgatgtattaatgatggttattctttttttcttcctccagagtgaagggaatattttgattgccca

SEQ ID NO: 157448 - DNA, 601 bp, Human
gatctaaggagagaaatgtcctaagtgctataatgtttggagaatataaagttaattttggagatcactttttttcatataggtcatatgcggaaaagacctgatgtattaatgatggttattctttttttcttcctccagagtgaagggaatattttgattgcccaaagaaatgaaatgcagcagaagctgtacatgtcagtagaagattttattctggaagttgatgagtcatctcttaataaacgcttaaaaacattgcaggttggaattaaaaatatattaaatatacgttaaattstaagtttatttaagaagtgaaattagcatttaccttaagactttagattgttctgtgatggttgcaaaagtttttcctgtttcctgaattctgatttctttttaatgggattaaaagtttatattaatatattttgtggctatgtttatatgcatatctatcttgcaaacaaggtaaaatggctagggactccagtattcactggggaaattaatggagacaggagcagtagcaggtatgtgggtccctatcgtccattgcattctagcagaaaatgtagtaggaccacatgttacaggg

SEQ ID NO: 157449 - DNA, 601 bp, Human
tataggtcatatgcggaaaagacctgatgtattaatgatggttattctttttttcttcctccagagtgaagggaatattttgattgcccaaagaaatgaaatgcagcagaagctgtacatgtcagtagaagattttattctggaagttgatgagtcatctcttaataaacgcttaaaaacattgcaggttggaattaaaaatatattaaatatacgttaaattgtaagtttatttaagaagtgaaattagcatttaccttaagactttagattgttctgtgatggttgcaaaagtttttcytgtttcctgaattctgatttctttttaatgggattaaaagtttatattaatatattttgtggctatgtttatatgcatatctatcttgcaaacaaggtaaaatggctagggactccagtattcactggggaaattaatggagacaggagcagtagcaggtatgtgggtccctatcgtccattgcattctagcagaaaatgtagtaggaccacatgttacagggagaagggatcaactctgatccataaattatagggtttttaggctccatgaccagggaagtttctccctgatgtgatc

SEQ ID NO: 157450 - DNA, 601 bp, Human
ctctgtcttgccagctcaggaatgactttaattcggggtgaatgaacatgacagtgttaagtaatttcacctaataatagtgtttctctctacttattcagatctttttttgtcctttaatattgtttaaaatttttctctataagtcctcatgcttttttcttcatttaacttttatttatttatgcttttgattgcttttatgaatattatcttgtcatttcctagttttgattgaatagaggaatactgttcatttttatgtactggtgtttctctgataactctgctgatctctctyttagttctcatttgtctgttgatactctgctttctgtgttttcaaatgttttcatttgaaatgttttcattttctaatgttttcatttgaaatgttttcattttcaaatgttttcatttcattttcaagtgttttcatttgaaaacaataactctttaatcttttctcttctagtccttttaccttttatgtatctttgaatttttactgctttggtcagttaccctagtactaagctgaccagtagctaatatcgatcttgttgtggactgcagggagtaagcttgctagaaatttgga

SEQ ID NO: 157451 - DNA, 601 bp, Human
tggttcagtatatcagtctttgagatatttttgttacatatatctgaaatagataggtttgtccctatttgtccctattgttcttttggttcttgttcaaagtatttcagcgccacattgttgggtgttaaggtattcatgattgtaatgtatttaaaaatgtgtatcccccccatgacacatgtttacctatgtaacagaccttcacatgtacctccaaacctaaactaaaagtcaaaaataataataaaaatgttttctttttaactactatgtaatcttattttttcacttagatttaaaaaaataaaaatttttttgtttgccttttaagttcgtatcccacctttctttttggttaacactgcaacatcttttctttttttctatttttattttatttatttttatttttcttgagatggagtctcgctctgtcgcctaggctggagtgcagtggccgatctccgctcactgcaacctctgcctcccgggttcaagcgattctcctgcctcagcctccctagtagctgggattacaggcacacaccaccatgcctgtctaattttttgtattttagtagagatgggtttcacgatg

SEQ ID NO: 157452 - DNA, 601 bp, Human
gttcagtatatcagtctttgagatatttttgttacatatatctgaaatagataggtttgtccctatttgtccctattgttcttttggttcttgttcaaagtatttcagcgccacattgttgggtgttaaggtattcatgattgtaatgtatttaaaaatgtgtatcccccccatgacacatgtttacctatgtaacagaccttcacatgtacctccaaacctaaactaaaagtcaaaaataataataaaaatgttttctttttaactactatgtaatcttattttttcacttagattttataaaataaaaatttttttgtttgccttttaagttcgtatcccacctttctttttggttaacactgcaacatcttttctttttttctatttttattttatttatttttatttttcttgagatggagtctcgctctgtcgcctaggctggagtgcagtggccgatctccgctcactgcaacctctgcctcccgggttcaagcgattctcctgcctcagcctccctagtagctgggattacaggcacacaccaccatgcctgtctaattttttgtattttagtagagatgggtttcacgatgtt

SEQ ID NO: 157453 - DNA, 601 bp, Human
tattgtttcatttctatcattttatttctttatttatttgagacagagtcttgctctttcacccaggctggagtgcagtggtgccatctcagctcactgcaacctctggctcctgggttcaagcaattctcatgcctcaacctcccgagtagctgggactacaggcatgcaccactgtgcccggctaattttagtagagatggggtttcacgatgttggccgggctggtctcgaacttctgacctcgagtgatccgcctctcttggcctcctaaagtgctgggattacaggtgtgagccaragtgcccagccttcttatttccataattgttatcagtctaatctttgttcttctgtgatcttttttccctctggaagttttaaaattttctcttgactttgttcttaagttgcatcagaacatgtttatgttttgactgaatctgagccagttcagtctgaggttttatatatttctttaattgtaggtaatacttgataattatttattgagatacttctctcccccattaattttttctcttattctgagacttctgatagatatttcagcttctatttctgttatctacatatttta

SEQ ID NO: 157454 - DNA, 601 bp, Human
tactgttatctgggccattgacactgattttgcttcctttttataaagtggcttagttttttatacttctttcagagtgcttgtgctgttcacaccattttatcctcttcttatctctcctcaagatctcatattcccttggaactataagctaccttagttctttgctgttgtgtagttatatgaagggcctagggaagagtgaaagtctggaccacaacttttaagactttggataggtttagggaatagaatggggttatttttatttttaagggtctagcttctgatgttgccatcwgggattatctacttcctctttgcttctctcctgggtggtctgtcctactcttcagcaaacctctattccctctgcctcagctactgctcctttccaggcactaccacccttagatgtaaatgctgccagatattcaggggagaagtgaaggaaagagaatggtcaggggctggccagctcttctgtattggttatcagtttttgcctcatctgtgttcttgtgctgtacttgcataaacctgttgcctcttgatggtgctgctgtttttctttctgatgtgagggagagagaagagccta

SEQ ID NO: 157455 - DNA, 601 bp, Human
cttgatggtgctgctgtttttctttctgatgtgagggagagagaagagcctatgaaaaaagttttcttttcccacaggtaattctgtgctgtgacacagtccttctttcacttgtagggactttgttaattcaatgctaaacaccaaccatcctctgcctaagatttctcagagttttgtgattaaaaacttctgagatctcttaagctttttttcttatctctgtaaaatttctagggtttgatttctggagagagctagcaggctgtgcctatcttgtcttttccaattctttattacrttaaaaaattttattgttactgttattttttttttgtgcacctgccccgacaaacccagccaggccaattcattaaaaaaatgcctttaagtacagtcaagggctgcatggtttggtcagtgatggactgcatatatggtggtggtgccataaaattatagtacttaactgtaccttttctgtgtttacataggcaatcattgttacaattgcttacattattcagcacagtaacatgctatatctaggagcagtaggctatagcatgtagtttggttgtgtagtaaatttataccatct

SEQ ID NO: 157456 - DNA, 601 bp, Human
aacccagccaggccaattcattaaaaaaatgcctttaagtacagtcaagggctgcatggtttggtcagtgatggactgcatatatggtggtggtgccataaaattatagtacttaactgtaccttttctgtgtttacataggcaatcattgttacaattgcttacattattcagcacagtaacatgctatatctaggagcagtaggctatagcatgtagtttggttgtgtagtaaatttataccatctaggtttgcatcagtacactccatgatgtttgcataatgatgaaattgcctcaygatgcatttcttagaagatatccgtgttgttaagtgatgcatgattgtccatatatatgtttaatgtctttacttaattagaattatttgtatattttagcgtgtagtttatttttatttggcaatcggtcttagaaactttcatgccaggacaaacagtagtgattcttatgatagacaaaggagactcagaagggtgattaggggtggagagtggtggatgttgagaaattacttaatgggttcaatgtacatttggatgatagatacactaaagcccagactttaccactacacaat

SEQ ID NO: 157457 - DNA, 601 bp, Human
ataaaacattgcttataattcccttagcctaagagatagttttagagtatttactcactggatgtgcatctgtatgtttgtgagcatatatatatgcattgcattgttttttaagttacttcaaacatactttcttcatttaatggtatattatgaacatttttctatatgatttttctatactgtcatcttgagtgactaaatcctcatccctatgtagatgtacaacaacattaacctttcatgtgtgttggacattaaggttacttccaatttttcctaccataaataacactgtacrtatgtttgtgcataattttttgtttttatttctcagatttctaaattctataattactgagttaaaaggaatggacattattaattaaaacttgatacatattttcaaaccacttttgggaaagatgatttcagtttacatcctcactagaaattcctttttcatccatactaacaatgtgtgttttattgtatgtctcagtttgaaatattacttttgtctttgttactttgagtgctggaactgatattcttctaaatagaaacatggattaaaaaggaaatctattgaattgtcttg

SEQ ID NO: 157458 - DNA, 601 bp, Human
atggtattgctgggtcaaatggtatttctggttctagatccttcaggaattgccacactgtcttccacaatggttgaactaatttacactcccaccaacagtgtaaaagtattcctatttctccacatcctctccagcatctgtggtttcctgacttgtgtgtgtgtgtgtgagtgtgtgtgtgtgtgtgtgtgtatttgtatgttgcctatgttgttttttttttcattattatactttaagttctacagtacatgtgcacaacgtgcaggtttattacataggtatacatgtgccatgktggtttgctgcacccattaactagtcatttacattaggtatttctcctaatgctgtctctctccctgcccccccccaccccacaacagaccccggggtgtgatggtccccttcctgtgttcaagtgttcccattgttcagttcccacctatgagtgagaacatgtggtgtttggttttctgtccttgtgatagtttgctgagaatgatggcttccagttgcatccatgtccctgcaaaggacatgaaatcatccttttttatggctgcatagtattccatggtgtatatgtgccacatat

SEQ ID NO: 157459 - DNA, 601 bp, Human
tcatgtgtctgttggctgcataaatgtcttcttttgagaagtgtctgttcatatcctttgcccactttttgatgggattgtttttttcttgtaaatttgtttaagtcgtggtagattctggatattaaacctttgtcagatgggtagattgcaaaaattttctccattttgtaggttgcctgttcactctgatagtagtttcttttgctgtgcagaagctctttagtttaattagatcccatttgtcaattttgtcttttgttgccattgcttttggtgttttggacatgaagtccttgcycatgcctatgtcctgaatggtattgcctaggttttcttctagagttgttatggttttaggtctaatatttaagtctttaatccaccttgaattaatttttgtataaggtgtaaggaaggtatccagtttcagctttctacatatggctagcccgttttcccaacaccatttattaagtagggaatcctttccccattgctttcccagttttcccaataacatttattaaatagggaatcctttccccattgcttgcttctgtcaggtttgtcaaagatcagatggttgtagatgtgtgac

SEQ ID NO: 157460 - DNA, 601 bp, Human
gcctgttcactctgatagtagtttcttttgctgtgcagaagctctttagtttaattagatcccatttgtcaattttgtcttttgttgccattgcttttggtgttttggacatgaagtccttgcccatgcctatgtcctgaatggtattgcctaggttttcttctagagttgttatggttttaggtctaatatttaagtctttaatccaccttgaattaatttttgtataaggtgtaaggaaggtatccagtttcagctttctacatatggctagcccgttttcccaacaccatttattaartagggaatcctttccccattgctttcccagttttcccaataacatttattaaatagggaatcctttccccattgcttgcttctgtcaggtttgtcaaagatcagatggttgtagatgtgtgacattatttctgaggcctctttgtgttccattggtctgtatatctgttttggcaccagtaccatgctgttttggttactgtagccttgtagtatagttgaagtcaggtagcatgatgcctccagctttgttctttttgcttaggattgtcttggctatctgggctcttttttagttcca

SEQ ID NO: 157461 - DNA, 601 bp, Human
tagcttttgaattagtttgttcttgcttctgtagctcttctaattgtgatgttagggtgtcgattttagatcttttccgctttcacctgtgggcatttagtgctataaatttccctctaaacactgctttagctgtgtcccagagattctggtacattgtgtctttgttctcattggtttcaaagaacttatttatttctgccttaattttgttaattacccagtagtcattcaggagcaggttgttcaatttccatgtagttgtgtggttttcagagagtttctcaatcttaagttctastttgattgcactgtgatctgagagacttgtttgttatgatttctgttcttttccatttgccaggaagtgttttacttccaactgtgtggtcagttttagaataagtgtgatgtggtgctgaaaagaatgtatattctgttgatttggggtggagagttctgtaggtgtttattaggtccacttggtccagagttgagttcaagtcctgaatatccttgttaattttccatctcattgatctgtctagtctaatactgacagtagggtgttaaagtctcccactattattgtgtgggagtc

SEQ ID NO: 157462 - DNA, 601 bp, Human
agctcttctaattgtgatgttagggtgtcgattttagatcttttccgctttcacctgtgggcatttagtgctataaatttccctctaaacactgctttagctgtgtcccagagattctggtacattgtgtctttgttctcattggtttcaaagaacttatttatttctgccttaattttgttaattacccagtagtcattcaggagcaggttgttcaatttccatgtagttgtgtggttttcagagagtttctcaatcttaagttctactttgattgcactgtgatctgagagacttgttygttatgatttctgttcttttccatttgccaggaagtgttttacttccaactgtgtggtcagttttagaataagtgtgatgtggtgctgaaaagaatgtatattctgttgatttggggtggagagttctgtaggtgtttattaggtccacttggtccagagttgagttcaagtcctgaatatccttgttaattttccatctcattgatctgtctagtctaatactgacagtagggtgttaaagtctcccactattattgtgtgggagtctaattctctttgtaggtctctaagatcttgct

SEQ ID NO: 157463 - DNA, 601 bp, Human
tccttgttaattttccatctcattgatctgtctagtctaatactgacagtagggtgttaaagtctcccactattattgtgtgggagtctaattctctttgtaggtctctaagatcttgctttatgaatctgggtgctcctgtattgggtgcatatatatttaagacagttaactcttcttgttgcactgatccctttaccattatgtaatgcccttctttatttttatttttttttatcttcgttggtttaaagtctgttttatcagataccaggattgcaatccctgcttttttttgctytccatctgcttggtaaatcttcctccatccctttattttgagcctatggtgtgtctttgcacgtcagatgggtctcctgaatatagcacaccaatgggtcttgactctttatccaatttgccagtccttgtcttttaattggggcatttcacctgtttacatttcaggtcaatattgttatttgtgaatttgatcctgtcattatgatactaactggttattttgcccattagttgatgtagtttcttcatagtgttgacggtctttacaatttggtatgtttttgcattggctggaacc

SEQ ID NO: 157464 - DNA, 601 bp, Human
gttttatcagataccaggattgcaatccctgcttttttttgctttccatctgcttggtaaatcttcctccatccctttattttgagcctatggtgtgtctttgcacgtcagatgggtctcctgaatatagcacaccaatgggtcttgactctttatccaatttgccagtccttgtcttttaattggggcatttcacctgtttacatttcaggtcaatattgttatttgtgaatttgatcctgtcattatgatactaactggttattttgcccattagttgatgtagtttcttcatagtgtygacggtctttacaatttggtatgtttttgcattggctggaaccagttgttcctttccatatttagtgcttcctttaggagctcttataaggcaggtctgattgtgacaaagtctctcagcatttgcttgtctataaaggattttagttctcctttgcttgtgaagcttagtttggctggatatgaaattctggtctgaaaattcttttctttaagaatgttgaatattggcccccactctcttctggcattgtacagtttctgcagagaaattgctgttagtttgatgggcttccctttg

SEQ ID NO: 157465 - DNA, 601 bp, Human
ttcaaccctcttttcaggggagtcaacggttctgtcttgctggcattccaggtgcaaggggggtatgaataaatattccagcagctagctcggtgtctgcccaaacgtctgcccagttttgtgcttgaaacccagggcactggtgatgtatgcatctgagggaatctcctgctctgtgggttgtgaagactgttggaaaagcatagtatctgggccagaatgaaccgttcctgatggcacagtccctcacggcttcccttggctaggagagcgagttccccagccccttgcacttcctggstgaggtgactccccaccctgcttttgcttgccctctgtaggctgcacccactgtctaactagtcccaatgagataagccgggtacctcagtttgaaatgcagaaatcactcaccttgtctgttgatctcgctgggagctgcagaccggagctgttactatttggccatcttagtatctggatccttgaaatctgacttttaaagtgtaaaccaaactatctgaggcaggtatcaatcaatttagaaagtttgttttgccaaggttaaggatgcatgcctgggaggcaggtctgtgccttt

SEQ ID NO: 157466 - DNA, 601 bp, Human
gccctctgtaggctgcacccactgtctaactagtcccaatgagataagccgggtacctcagtttgaaatgcagaaatcactcaccttgtctgttgatctcgctgggagctgcagaccggagctgttactatttggccatcttagtatctggatccttgaaatctgacttttaaagtgtaaaccaaactatctgaggcaggtatcaatcaatttagaaagtttgttttgccaaggttaaggatgcatgcctgggaggcaggtctgtgcctttctcagagatgattttgagggcttaaatatwtaaaagggaaaggatggatactggggaaagaggaagaaattttaaaaagatgtgagtagataagagacagatggtttgaattctttaatccttgatcacctttcagcaaatacactatttacatttgagagaggggtagaggaatagtcactagctcagtgaatctgcatttttacatcagaggaaggaatcagatatgcatttgtctcagttgagcaaagggatgatgacttagagttctgtcctttgtcctgcacctgagaaaataagccatcaatttaccttgtcagggtaaaattc

SEQ ID NO: 157467 - DNA, 601 bp, Human
acttttgcatattgccttttttctgtttaacataaaacctaaagaccttttccttacatcaacgtcattttcccataatgttgcagtgaaaacattaatggagcacataatttagttgaagaatgtaacaaaataagtctacctggttttgggggcaggagaagttacatcttttaagtctctatttttaccactgatttttgtgagcttgggaaaataagtcattgtattttttctttaaaatggaagaatattgtattttatatctgggagatgttaccaggaagaagttagttaagamacagtgctttgaaagtaaaaatactgaccgggcatggcggctcacacctgtagtcccagcactttgggaggccgaggcgggcggatcacttgagcccgggagtttgagaccagcttgggcacatggtgagaccccatctctacaaaaaatacaacaattagctggtcatggtgtcatgtacctgtagtcccagctgctttggaggctgaggcaggaggattgcttgaacccaggaggttgaggctgcattgagctatgatcatgcctctgcattccagcctgggcaacagagcaagaccc

SEQ ID NO: 157468 - DNA, 601 bp, Human
cataaaacctaaagaccttttccttacatcaacgtcattttcccataatgttgcagtgaaaacattaatggagcacataatttagttgaagaatgtaacaaaataagtctacctggttttgggggcaggagaagttacatcttttaagtctctatttttaccactgatttttgtgagcttgggaaaataagtcattgtattttttctttaaaatggaagaatattgtattttatatctgggagatgttaccaggaagaagttagttaagaaacagtgctttgaaagtaaaaatactgaccrggcatggcggctcacacctgtagtcccagcactttgggaggccgaggcgggcggatcacttgagcccgggagtttgagaccagcttgggcacatggtgagaccccatctctacaaaaaatacaacaattagctggtcatggtgtcatgtacctgtagtcccagctgctttggaggctgaggcaggaggattgcttgaacccaggaggttgaggctgcattgagctatgatcatgcctctgcattccagcctgggcaacagagcaagaccctgtctcaaaaaaaaaaaaaaaaaaaaagaa

SEQ ID NO: 157469 - DNA, 601 bp, Human
ataatgttgcagtgaaaacattaatggagcacataatttagttgaagaatgtaacaaaataagtctacctggttttgggggcaggagaagttacatcttttaagtctctatttttaccactgatttttgtgagcttgggaaaataagtcattgtattttttctttaaaatggaagaatattgtattttatatctgggagatgttaccaggaagaagttagttaagaaacagtgctttgaaagtaaaaatactgaccgggcatggcggctcacacctgtagtcccagcactttgggaggccraggcgggcggatcacttgagcccgggagtttgagaccagcttgggcacatggtgagaccccatctctacaaaaaatacaacaattagctggtcatggtgtcatgtacctgtagtcccagctgctttggaggctgaggcaggaggattgcttgaacccaggaggttgaggctgcattgagctatgatcatgcctctgcattccagcctgggcaacagagcaagaccctgtctcaaaaaaaaaaaaaaaaaaaaagaaaagaaaagaaagtaataatattaatactgtgaaaacaataggta

SEQ ID NO: 157470 - DNA, 601 bp, Human
gcagtgaaaacattaatggagcacataatttagttgaagaatgtaacaaaataagtctacctggttttgggggcaggagaagttacatcttttaagtctctatttttaccactgatttttgtgagcttgggaaaataagtcattgtattttttctttaaaatggaagaatattgtattttatatctgggagatgttaccaggaagaagttagttaagaaacagtgctttgaaagtaaaaatactgaccgggcatggcggctcacacctgtagtcccagcactttgggaggccgaggcgggyggatcacttgagcccgggagtttgagaccagcttgggcacatggtgagaccccatctctacaaaaaatacaacaattagctggtcatggtgtcatgtacctgtagtcccagctgctttggaggctgaggcaggaggattgcttgaacccaggaggttgaggctgcattgagctatgatcatgcctctgcattccagcctgggcaacagagcaagaccctgtctcaaaaaaaaaaaaaaaaaaaaagaaaagaaaagaaagtaataatattaatactgtgaaaacaataggtaagtgtcat

SEQ ID NO: 157471 - DNA, 601 bp, Human
accgggcatggcggctcacacctgtagtcccagcactttgggaggccgaggcgggcggatcacttgagcccgggagtttgagaccagcttgggcacatggtgagaccccatctctacaaaaaatacaacaattagctggtcatggtgtcatgtacctgtagtcccagctgctttggaggctgaggcaggaggattgcttgaacccaggaggttgaggctgcattgagctatgatcatgcctctgcattccagcctgggcaacagagcaagaccctgtctcaaaaaaaaaaaaaaaaaaaargaaaagaaaagaaagtaataatattaatactgtgaaaacaataggtaagtgtcatgctttctttagcaaattcatctgcgtatatgtaaataccttatggaccttgggttaaaatagcgatcttgcaatgatttgacaagtgtttagaagttttgcttaataaatatgtgataagtggcttttctttcgtgagggtactcaattttcacatttatttcaaagttacttatgtagagctatgtgttttttctcttaggctttaaaaatttttcttaacgaaacagctgttattttaaaatg

SEQ ID NO: 157472 - DNA, 601 bp, Human
atggcggctcacacctgtagtcccagcactttgggaggccgaggcgggcggatcacttgagcccgggagtttgagaccagcttgggcacatggtgagaccccatctctacaaaaaatacaacaattagctggtcatggtgtcatgtacctgtagtcccagctgctttggaggctgaggcaggaggattgcttgaacccaggaggttgaggctgcattgagctatgatcatgcctctgcattccagcctgggcaacagagcaagaccctgtctcaaaaaaaaaaaaaaaaaaaaagaaaagwaaagaaagtaataatattaatactgtgaaaacaataggtaagtgtcatgctttctttagcaaattcatctgcgtatatgtaaataccttatggaccttgggttaaaatagcgatcttgcaatgatttgacaagtgtttagaagttttgcttaataaatatgtgataagtggcttttctttcgtgagggtactcaattttcacatttatttcaaagttacttatgtagagctatgtgttttttctcttaggctttaaaaatttttcttaacgaaacagctgttattttaaaatgtcactgt

SEQ ID NO: 157473 - DNA, 601 bp, Human
tttcttaacgaaacagctgttattttaaaatgtcactgtgttcttaatattttgagaaataatgacagttttatgcctcaaattgaaatattatcagacattttcattttagtttggaagtgggtgaggactttgaccttgcaagatttgtgcttatgtatgtatccaaagcttaaaattggtaattaaatttttcttcaattagtaagatggtagtttagatgggttaaaaaaaaaaacttcagccaacttaaatttaaaggagcaatgaacaattcgcaaattgggcagctgaatcacrgcatattcggagagactctggggatgctttgtggtcagaacaaattaatagacgaaaaaaggaaagtggctttcagaaattggcagcgaggtacagaaacagctatattggttacagattggtgtttgccttatttgaacacagtttgaacacttagcagtctgtaagtggttgaagtatggcggctgggattggccaagactcagctattgttataggtccacactgctaagttacattttcagtctcgtctgcctgttaagctaggttgcagttcatccacaaggactcaaatataga

SEQ ID NO: 157474 - DNA, 601 bp, Human
gtaagtggttgaagtatggcggctgggattggccaagactcagctattgttataggtccacactgctaagttacattttcagtctcgtctgcctgttaagctaggttgcagttcatccacaaggactcaaatatagaagtacggagtccttctcaggccatgtttaatttgctttagcagatgcaaggtgagtcgtggttttcacttgttatttcttgaagtagaaggcaaaatcagtgattatgtatcttactggatatgttataaggtagatgctgatatattttcctgaagagcaacrtgtcaaaattgaatatatattgatctacagttaaaaactttttttttttaactttaggagatgctaactagtttggcacagaaatggttccctgagctgcctctgcttcatcctgaaataggattactcaaatacatggtaaactttgtttcccttgcgaattactactcttcagagggtgttgaaaagtgataatattaaatttgtgtcagtgttaaacttatagtatcttttaaataaaaatactcctgatgaatattttatgggtattagaactttttcttatgaccctttaatagt

SEQ ID NO: 157475 - DNA, 601 bp, Human
tttcttgaagtagaaggcaaaatcagtgattatgtatcttactggatatgttataaggtagatgctgatatattttcctgaagagcaacatgtcaaaattgaatatatattgatctacagttaaaaactttttttttttaactttaggagatgctaactagtttggcacagaaatggttccctgagctgcctctgcttcatcctgaaataggattactcaaatacatggtaaactttgtttcccttgcgaattactactcttcagagggtgttgaaaagtgataatattaaatttgtgtcrgtgttaaacttatagtatcttttaaataaaaatactcctgatgaatattttatgggtattagaactttttcttatgaccctttaatagttgcatggtatatatttgtatttttatgtaaatttgcattatccgtttttctgctttcctcatcctcattcagtacattgcatgacacttatttgaattataggtgtttactttttgaaatgacaaaataaaattttaactgctatttcaagagttaggataaaaacaagatattgccagccctgagggatttgagcacaatgggtttttta

SEQ ID NO: 157476 - DNA, 601 bp, Human
gtgggtatggttttctaggtaggcaggattcaaaagctggagatcagcatattaaataggggccatagggagcaggattagtaaacactggtttactaatctgttagtcctgaatctgttagtcctgcgatttatattgccttctacggtgagggcctagatgaggtatttattcattaagattgtcacgaagtccattataatggcttaaatatggtacagagagggatatttgtgtagacatgtgagtttattctaaaaaatatttaagattaaagttccctaacttaaataattactstaaactctttctagactagactttaaaatgatgtgagttttttcttgcaactatttagcttagtgattaccttatgcagtgtgggcaaataagtatgtactgccacatgggacttgaaaattaatatttaaaaatatgctaatctactttattatggaagattataaaaggtttgactcatggtttattgaagtctttaatggctttctgatgtttaactgtaatgtatgcttaggaattttttgtaggttgattatgtattgtagaatacttaaatgtaccgacaagacttaaaaaaaa

SEQ ID NO: 157477 - DNA, 601 bp, Human
gggcagaggtgttagaattacttcatggtagtcataatttttggactaatctttcccatttgatacctacatttttgtcattattttaccttatttattttttgtttttttacaaatgtttatttcagtagtttttggggtacaggtgttttgtggttacatggataagttctttagtggtgatttctgagattttagtgcacccatcacctgagtggtgtacactaacccaatatgtagtccctcattcctcacccccgtcccaatcagttgttactttagtattttttaggaaacataagtggtttttcaagtaaacattagggatcctaggatgcatgtctggttgattctagtcatttcctgaatctgttctaaaattatagcagtaattaaatgtatggtgattacactttgggtaggaggagtttaagagccaggaactggagaaagtacacagttttaaagattttaattttgttggtttttccagtacagttgatggtgtccaagtcatttaatatcgtgtaactaattattttgatgatttttaagtgctgggattgtttggattctttaactgtgataaaaacttgtgcct

SEQ ID NO: 157478 - DNA, 601 bp, Human
gctagaacagcaggagtattgtgtattttaaccataagtcttaggagctacctgacattatatactcaatggcattgacaacattaataattttgtcatcattaggaaacatttaattgctaggaaacatgtaaggaaactaggtggccatctcctaaacctctctccactggtgtccctctgtctatagatacaatttacatatacgtactttgctgttttttgattaataatgtgcatttttagaaaccggggaaccttggactttttagtttaaatcctgattcacctctaatggctrttaattcagtgtcatattacctcagaataggcagtttgtagagatagcaaaatcacacaatttaagagcatgttgtgatttttttgtcgttataatggaaacaattctctattttaattgagaaataaaaattgtatatatttatcatatacaacatgatgttttgaagtatgtatacaatgtggagtggccaaatcagtaattatttttctaaacattacagctttattgagatacaattcacataatgtatacaattcattaatagtttgtagtacattcacaaagtcgtgcagtgat

SEQ ID NO: 157479 - DNA, 601 bp, Human
ttttaattttcagttaaaaatatttattctgaaatattgatcaaactcaccttttgctacattttccatgcaattttcagattgaagtggttatcaggaagataaatttgaaaagtagtctgaggtcaagatcattgcttttcaggccttatagtgcatacaactcacctggggttcatgttaaaatgcaaattaatattcagcatttctgcagtggatcatctgcatttctaacaagctaccagttaatgctgtagctcctggcccttggaccatactttgagaagcaaggatcaaaatygtagctagaaaaaagatagcacttagtgacacatgctaggcattgtatctctgtaaggtagacattatttccattttacaaattaattcaggctcaaagaggtttacacctactatgtacccataaaaattaaaaataaattttaaaaatggacaaaaaagaggttaaagccctcggtcccacagcaaataaataggagagtggggaattgtaaccaagatctgcctgaatataggattcatgctattgtcactgatcatctttgacatgttagaaatggtatatttagagaatgatcag

SEQ ID NO: 157480 - DNA, 601 bp, Human
gagaaggaagactattcttatcagcccaggggccagcaagcattttctgtaaaggaccagatggtctctgttgcaagtactgagttctgctgctatagcatgaaagcagccatagacagtatgtaaacaaatcagtgtggctcttttccagtagtactttatttatggatattgaaatttgaatttcatgtagtttgcatgtgcatgaaatagtattccttcagtttgctattaaacatttaaaaatgtgaaaactacccttggcttgcagctgtacaaaaacaagtagtggaatcagttyggtgcagaggccatatagtttgctgatctctgttccaatcagtgtaataaggtcaaaaaaagaaataaaagtcatagagtttgaaaatgaagaaataaagctgtctttatttgcagatgacatgcttaattatgtagaaaatctttgagaatgtacataaaagctactagaacaaatgagtttagaaagatagcagttttaatttcaatataattgtgtttttatataagcaacaaataataggaaattaaaatttaaaaatcatttacaaaagtattaaaatatggaatttgtaggggt

SEQ ID NO: 157481 - DNA, 601 bp, Human
aagaaataaagctgtctttatttgcagatgacatgcttaattatgtagaaaatctttgagaatgtacataaaagctactagaacaaatgagtttagaaagatagcagttttaatttcaatataattgtgtttttatataagcaacaaataataggaaattaaaatttaaaaatcatttacaaaagtattaaaatatggaatttgtaggggtaaatttagtaaaagatgtgcaagagttgcacactattaaaactacaaagcattgttcagagaaactcaagaagacataaataaatggagmgatacaccatgctcatggactagaagacattgtatggatatcagttgttcttggcttatagattcgatgcaatttcaacaaaattgctggtagattttgcttattttttcagaaattgacaattagattttacaattaatataaaaatggagaggatctgagatagccaaaacaagtttgaaaaagaacaaaattgaaggacccaaactacctgattttatgacttaatagattctaggaaattaagacaatgtaggcctagagtggtggttcaaaactgtaatcccagcacttagggag

SEQ ID NO: 157482 - DNA, 601 bp, Human
ctttcgatttggcaaagatttcttaagtaggacacagaaaacatcaactctaaaagaaaaaaatcatttggatttcatcaaaatggaaaaccttgctcttctaaagacattgtcacaaaaatgaaaggcaagctacagactaggagaaaatatttgcaaaacatatatctgacaaaaatattatatccagattatcaagagctcctacaatcaatactaagaagactgcccagttaagaaatgggcaaaatatttgaacaggtactttaccaaagaaggtgtccacatggcatgtaagcaygtgaaagatgctctgaacaccatttgtcattagggaactacagattaaaaccaaaatgagataccactatactactcactataatgtataaaattaaaaagatcgtaccaacggttgcttagatctgttgtacctagaactcatatatattgcccaggggaatgtaaagggaacaaccactttgaaaaacatttggcagtttgttaaaaggttgaacatattcctaccctatgacccagcaattccacttctagatatttagccaagagaaatgaaagcatatgtccacacaaagatttg

SEQ ID NO: 157483 - DNA, 601 bp, Human
tagagcatctggtggaagaaatttctaagcagcaaagtgttcaagaggtgacttgggtgcttttaaaagcattgttttatgtaatcacaaagatatggtttggaattggaacttatgtttaaaagggaagcagagcataaaagttaggaaaatttggagcctgatgatgtggtagaaaagaaaacccgtttcctgggagaaactcaagccagctgcaggaatttgcataagtaacaagtagctgaatgttaatcgctaggacaatggggaaagtatctccagggcatgtcagaaaccttcrcagcagcccttcccatcacaggcacagaggcctaggaggaaaaaatggtttcatgggctgggcccacggtccccctgctgtgtgcagccttcagacatggtgccctgtgtcccacctgctccagtcatggctaaaaggggccaaggtacagctcaggccatggctttagagggtgcaagccccaagccttgttagcttccatgtggtttgagcctgaaggtgcacagaagtcaagaatggtggtttgggaacttccacctagatttcagaggatgtatggaaatgcctggatgtccaggc

SEQ ID NO: 157484 - DNA, 601 bp, Human
tggaaggggcctggggtggaatgataatggtttagctgtgtccccacccaaatctcaccttgaattttaataattcctgtgtgtcaagggcaggcccaggtggagatatttgaattatggggtggttcccccatactgttctcatgactttagccctatgcctgcatgtatatttaaagttgtctggtttcattgaaccagtaccctcatggaaataaactagcatgattttcatcaatgcttcagtaatctattctttatatcagaagggtgaaagtaaacatatcaagttttttttttttgtttctgggaggactcataagatatcccataagtgtggtaatagcagtttttattccacctatttcctttaaatgatagtaaaaagctccatgagtaaatatattgtctgattttctactcttatgtattgttgattaagtcctttaaaaactttatttttagattaacttgtacaatggacttttttttgtatacattctatgaattttaacacacctatagattagtgtaataaccactgccacagccaggatgcagaacagttccataaccctgaaaattcctgtgtgccatccct

SEQ ID NO: 157485 - DNA, 601 bp, Human
gaattttaataattcctgtgtgtcaagggcaggcccaggtggagatatttgaattatggggtggttcccccatactgttctcatgactttagccctatgcctgcatgtatatttaaagttgtctggtttcattgaaccagtaccctcatggaaataaactagcatgattttcatcaatgcttcagtaatctattctttatatcagaagggtgaaagtaaacatatcaagttttttttttttgtttctgggaggactcataagatatcccataagtgtggtaatagcagtttttattccacstatttcctttaaatgatagtaaaaagctccatgagtaaatatattgtctgattttctactcttatgtattgttgattaagtcctttaaaaactttatttttagattaacttgtacaatggacttttttttgtatacattctatgaattttaacacacctatagattagtgtaataaccactgccacagccaggatgcagaacagttccataaccctgaaaattcctgtgtgccatccctttgtagtcacagcctcctcccaacccttaaacgctggcaaccactgaccttttatcactgt

SEQ ID NO: 157486 - DNA, 601 bp, Human
ttccataaccctgaaaattcctgtgtgccatccctttgtagtcacagcctcctcccaacccttaaacgctggcaaccactgaccttttatcactgtgttttgtgcttttaagaatgtctcacacatagcaatatgaaccttaaatgtaaatgggctaaatgccccaattaaaagacacagactggcaaattggataaagaatcaagacccatcagtgtgctgtattcaggagactcatctcacatacaaagacacacataggctcaaaataaagggatggaggaatatttaccaagataayggaaagcaaaaaaaaaagcagggattgcaatcctagtctctgataaaacagaattttaaccaacaaagatcaagaaagtgtaagaagggcattacataatggaaaagggatcaacgcaacaagaagagctaactatcctaaatattatatgcacccaatacaagagcaccaagattcataaagcaagatcttagagacctacaaagagacttagactcccacacaataatagtgggagactttaacaccccaccgtcaatattagacagatcaacgagacagaaaattaacaaggatatt

SEQ ID NO: 157487 - DNA, 601 bp, Human
ctaaaacaccaaaagcactggcaacaaatgccaaaattgacaaatgggatctaattaaactaaagagcttctgcacagcagaagtgaacacatcagagtgaacaggtaacctacagaatgggagaaaatttttgcaatctacccatctgacaaaggtctagtatccataatctacaaagaactgaaacacatttacaaaaagaaaacaaccccatcaaaaagtgggcaaaggatataaaccgacacttctcaaaagaagacatttatgtggccaacaagcatatgaaaaaagctcatcatsactggtcattagagaaatgtaaatcaaaaccacgatgagataccatctcatgccacttagaatggcactctttgaaaagtcaggaaacaacagatgctggagaggatgtggagaaataggaacgctttacattgttggtgggagtgtaaattagttcggccattatggaaaatagtgtagcgattcctcaggcatctagaaccagaaataccatttgacccagcaatcgcattactgggtatatacccaaaggattataaatcattgtactataaagacatgcacacttaagtttattgc

SEQ ID NO: 157488 - DNA, 601 bp, Human
actgaaacacatttacaaaaagaaaacaaccccatcaaaaagtgggcaaaggatataaaccgacacttctcaaaagaagacatttatgtggccaacaagcatatgaaaaaagctcatcatcactggtcattagagaaatgtaaatcaaaaccacgatgagataccatctcatgccacttagaatggcactctttgaaaagtcaggaaacaacagatgctggagaggatgtggagaaataggaacgctttacattgttggtgggagtgtaaattagttcggccattatggaaaatagtgtarcgattcctcaggcatctagaaccagaaataccatttgacccagcaatcgcattactgggtatatacccaaaggattataaatcattgtactataaagacatgcacacttaagtttattgcagcattgttcacaatagcaaagacttggaaccaacccaaatacccatcagtgatagactggataaagaaaatgtggcacatatacaccatgcaatactgtgcacccttaaaaaaatgatgagttcatatcctttgcagggacatgggtgaaggtggaagccatcattctcagcaaactaa

SEQ ID NO: 157489 - DNA, 601 bp, Human
aacacaggaacagaaaaccaaatacctcatgttctcactcataagtgaacatgttctcactcataagttgaacaatgagaacatatggacacagggaggggaacatcacacagtggggcctgttggggagtgggggtctaggggagggatagcattaggagaaatacctaatgtagattatggtttgatgggtgcagcaaaccaccatggcacatgtatacctatgtagcaagcctgcacgttcttcacgtgtatcccagaacttaaagtatataaaaaaaagaaaaaatagaaaaaaatrtaaataaaaataatatcatattagtggtatcatacagtatataattttgtgagtctagcttctttcattcagcatgtgaatcatcttttgtgattcattcaagttgtctaatgtagtttttcccttttttgtttctgaatagtgctctgttgtatgtacataccaaatttgtttgttcacctgttgcagaacatttgcattgtttccagtgtctgactattgcagataaagctactgtgaacatgtgtgtataggtttttatgtgaacgtaagtttttgtttctctatggtaattaccca

SEQ ID NO: 157490 - DNA, 601 bp, Human
tattgtctgcttctaccactcgagtggaagctttttgggagtagcttatctatcttgtttgccactatatcctcaaatgcctagaactgtgcctggtgcaaagtgggcactcaaatattagttgaatgaatgtttaaattttagccacagttatatgctgaagtattaggctttaaaaaatagttccatgtttttttcctgagttcatttacttacctctcatttatggccccatgtacatcattttattctttaaaaccttgcatgaagattttattccgactcttaatatatttctagragatgttagtggtcatactgatcacccagtgaacctaactttgcatttctggaccttcttaataacgtgagacccaaacctttatgtaatttcagtcacttccccaaaccaggattttgtgaatctctacaattgttatttttcaaaagtaatagagtccaatccattatatttttctcctaacaggatttcctgtcctctcatttactgtgtctgctaatcttaaatctccagtgggtttatttactgtctctcttttcttccagtttatcagcagccttctagcttttttctttattt

SEQ ID NO: 157491 - DNA, 601 bp, Human
cgggcgcggtggctcacgcctgtaatcccagcattttgggaggccgaggcgggtggatcacgaggtcaggagatagagaccatcctggttaacatggtgaaaccccgtctctactaaaagtacaaaaaatcagccgggcgtgttggctggcacctgtagtcccagctactggggaggctgaggcaggagaatggtgtgaacccgggaggcggagcttgcagtgagcagagatcacgccactgcactccagcctgggtgacagagcaagactccgtctcagaaaaaaaaaaaaaaaaaaaaagagagatacaggatggacggactcactaatctctttagtacccttccctgtacaggaatttcgtgtattaatatttctgaaactgctttgagagccaatcaagaaccttagactggtcattcctgtcttatcagatccaaatgcagagaacttggaggaggttcacctttcaaggtttttgtttttgttttttaagatagtctatttacccatatttttattcttattctttttaaaatttctaatgtttcagcatttctccttttatcatttttatcctaataacttcttttggccatt

SEQ ID NO: 157492 - DNA, 601 bp, Human
attctggattggtagttctttttcttttagcatttggaaaagattgtgctactttctttaggtgtccatggtttctgatgagaaattcactgtcatttgaatcatttcctttataggtaatattacatttctctctaaccagtttcaagatttttgttttctttagttttaagtttattatggtatgtagtggcatgtgtttctttaagtttattctgtttgaggttttctcagcttcttcagcctgtgggcttatgtttttcaacaaatgtgggaagttcagcaattatttactcaaatrcattttagccccccaccctttctcctctttttctaggactctgattatacaaattttctgtcttttattgtctcacaggttcttggggctctgtttatcagggtgtttttttttgtaatgatggttgttcaaatgggttattttctattttttcatcttcagattcattagtgctttcctgtcatatttattctatcattcagtccacctaatgagttttaacatttttgattactgtttttctgttataaaatttccaattgattcttttttatatcttctgtcttctgtttctttgct

SEQ ID NO: 157493 - DNA, 601 bp, Human
attgttcaagggactacattatctgtttacccagtcttctatctttgcctcctatttcagagaattaaagtgctccttccccagtgcaagtaattcagtaccgtaacatacaatatggggttgtaaccttggagcggtaggctacactgtatagcctaggtgtgtggtaggatatatcatctaggtttgtgtaagtacatttgttatgatgttcacacaaggatgaaattgcctcatgatgcatttctgagaatatattcctgttatgtattcctgctgttaaacagcacgactgttgttytgtcagttactgagagttgaagtccctggctataattgtagacttgcctatttctcctttcaactctatcttgtggtttaaggtcatcttgtataatatgtacatatttaggattgttatgtcctcttagtagattgatacttttatcattatgtaatatccttctttttctgtagtaattttctttgctctaatgtctactttgtctgatattacagccattcttgtgtttcaacattaatgtttgcatggtatatcttctgccatccgtttactccaaaggtacctacattgttgaat

SEQ ID NO: 157494 - DNA, 601 bp, Human
gtgcttgatttgttctgcagcttctgccataaaaggttttactctttctggtcttcattcttcaagtttgcctttgattgatttaatgtaatctttcatatacatcttgtaggcttcttttatgaagccagcttgctgcaagtgatggttcatgacaatatcaataccagtgattactgtgctttcagtaccttcacccttgggtccttcagtagaggcatttccaccaatgagcaagtcatcaatattaccctatgtcttactgaccatcttcctctccccctccaggcacagcctgttkgcagtatctcagatcttgtaattgtcagagataatcatgatggtggctggaggtagatgatagcagtgctcgcttatagcagaagcctggagcttggagcaagtatggtgcagttggaaaggcactccagggaataggaagcatccagaaaagtatattgtgtttttgagtgtattgcctcttacagttttcctagtggttggtttgggtattacaatatacatatgtggcttattacattctagtgatgtcagcatttcaccattttgagtgaagtatagaaacctcacttcctttgag

SEQ ID NO: 157495 - DNA, 601 bp, Human
ttatagtgtgtacatcccctctgatcggtactttaggagccccaggaaccatttggttgcttgtaattacaatgaaagtgcttttaccctgtaagagagttaatgtgctttctttaagtaagctcttttctagtcaccaggatctgaagttccagagttgactcttctatagattggtgtattaatacattggacatttattcattcttactttctttcacagctttctgttcaaaatcaggagtttgagataaataaagatggaatccccaaagtggatcagtttcatctggtatgtgaacctttttgacatttactggtttgaaacacatgcagtaatataaacttagatatctgactgaaagttgtcctccagtttttctaagaatccaaattaacatttgcaataaatgaagtattgaaaaaaattcaggtgccctacttaacaccacttaattaatacaccagggttactctgctgggttgtttgtcacacagattatataaataatctaacaattagggaagaatattgtttactatgtgtttcaagatcatattatagtaaaataatgttttattataacttagttttttgtaa

SEQ ID NO: 157496 - DNA, 601 bp, Human
gagtttgagataaataaagatggaatccccaaagtggatcagtttcatctggtatgtgaacctttttgacatttactggtttgaaacacatgcagtaatataaacttagatatctgactgaaagttgtcctccagtttttctaagaatccaaattaacatttgcaataaatgaagtattgaaaaaaattcaggtgccctacttaacaccacttaattaatacaccagggttactctgctgggttgtttgtcacacagattatataaataatctaacaattagggaagaatattgtttactatgtgtttcaagatcatattatagtaaaataatgttttattataacttagttttttgtaagtacctaactatatctttgtcattcacatatgtattcagccaacatattttgagtagctatttctgtgataggaattgaaccaggtgctaggattacaaggattgtggcattgagaatgaaatgaataatttagaaatgtgaacaagtaagtgattaacatctataagttgagtaattagcaagtactttgggggtactccatttaccctgatttgattattacacatcatatgcttgtat

SEQ ID NO: 157497 - DNA, 601 bp, Human
ctctaaaatgtaatctggccaggcatggtggctcacgcctgtaatcccagcactttgggaggccgaggtgggcagatcaactgaggtcagaagttcaggaccagcctgcccaacatggtgaaaccctgtctgtactaaaaatacaaaaaaattagctggatgtgctggcgggtgcctgtagtcccagctacttgggaatctgaggcaggagaatcacttgaacctgggaggcagaggttgcagtgagccgagattgtgccattgcactccagcctgggcgacagaacaagactttgtctcmaaaaaataataataataataataatctgcctgtaatctgcaagtaatcatgccttgctaggcatgcagctaggtatatgtataatgaaagtaaatgtaaatacacagtccccgtttaatgtgggtagctactcatggattcaaggattgtggcattgaaaatgagattaataatttagaaatttgaacaagtaagcaagatttataaattgagtaataagcaagttcaaatttaaaaatcttggcttgtatagtatttgcttctgtgatctgagtcagttattagtgctgggaatggaat

SEQ ID NO: 157498 - DNA, 601 bp, Human
atgtaatctggccaggcatggtggctcacgcctgtaatcccagcactttgggaggccgaggtgggcagatcaactgaggtcagaagttcaggaccagcctgcccaacatggtgaaaccctgtctgtactaaaaatacaaaaaaattagctggatgtgctggcgggtgcctgtagtcccagctacttgggaatctgaggcaggagaatcacttgaacctgggaggcagaggttgcagtgagccgagattgtgccattgcactccagcctgggcgacagaacaagactttgtctccaaaaaawaataataataataataatctgcctgtaatctgcaagtaatcatgccttgctaggcatgcagctaggtatatgtataatgaaagtaaatgtaaatacacagtccccgtttaatgtgggtagctactcatggattcaaggattgtggcattgaaaatgagattaataatttagaaatttgaacaagtaagcaagatttataaattgagtaataagcaagttcaaatttaaaaatcttggcttgtatagtatttgcttctgtgatctgagtcagttattagtgctgggaatggaattaccttt

SEQ ID NO: 157499 - DNA, 601 bp, Human
atctgcctgtaatctgcaagtaatcatgccttgctaggcatgcagctaggtatatgtataatgaaagtaaatgtaaatacacagtccccgtttaatgtgggtagctactcatggattcaaggattgtggcattgaaaatgagattaataatttagaaatttgaacaagtaagcaagatttataaattgagtaataagcaagttcaaatttaaaaatcttggcttgtatagtatttgcttctgtgatctgagtcagttattagtgctgggaatggaattacctttacctacattttgtgttsacacatagctgcaaaacaagtcaaggctctgtagtcagcaccttacagataccataccacaaatggagaagaatataaatgtatggaaccatgtagttgagagagttattagaggataattaatacacccttctcatccttcagaatccctccaataatatccccaagagatggccttcagcctctgcttaagtagagtaatgctgattttggtagtttgtgtctaaaagttggtccattccatttaagttatctagcttgttggcatacagttgtacatattttctttataattatttt

SEQ ID NO: 157500 - DNA, 601 bp, Human
tatttttttgtttgtttgttttgagacagagtctccctctgttgcccaggctggagtacagtggtgcaatcttggctcactgcaagctccgcctcccgggttcatgccattctcctgcctcagccttccacgtagctgggactacaggcgcccgccacaacgcctagctaattttatgttttgtatttttgtgatatcaggcatagtgtcttctttttcatttctgattgtgtttattgcagcttttttaaagttttagtacagctagcagtttattgattttgtttatcttttaaaaaawttttttttgtggatcctttgtattttttttagtgtatttcacttagttctgctcccatcgttattcttcgttttctactaatatgtatcaggtcgtttatttgtaatcttactccttttttgatagaagaatttattgctataaacttctcttttctcactgcttttgctatatctcatcagttttgttatgttgctttgattttcaattgttctaagacattttcttattccctctttaacttcttccttgaaccagtgattgctcgaagacattttctaattccctctttaatttctt

SEQ ID NO: 157501 - DNA, 601 bp, Human
gcagtggtgtgatctcatctcactgcaacttctgcctcatgggtacaagcaattctcctgcctcagcctcttgagtagctgagattataggtgtctgccaccacactcatctaatgtttgtatttttagtagagacgaggtttcaccatgtcagccaggctggtctcaaactcctgaccttaagtgatccacctgcctccacctcccaaagagctgggattataggcatgagccaccgtgcctggccaatttccatgcgtttgtatagttttcagtttctcttgttgatttttagttttcyattgtggtctgagatgatactggatatgattttaattttaaaacattttttgagctttgttttgtggcttaagatatggtcgtttcctatagaatgttccatatgcttatgagaagtatgtgtattctgttgctgttgggtaaagtgttctgtaaatatctgttaggttaatttggtttttaagtgcagtgtaaaatcagtttttttaaaattaattttctctctagattatctgtctagtggtgagagttgggtggagtctgtttctccctttagatctaataatatttgatttatata

SEQ ID NO: 157502 - DNA, 601 bp, Human
atgagggttaatttctgtcattgtattaattgattctggttgttttgtgtatcttttgtttcttattttctctcttattcattgtggtttggtggttttctgtcgtggtaacacttgaattatttcttttatttgtgtgtttgttttaccagtggagtttatatgtgttttgtaatggtagatattgttctttcacttccaagtatacaactctcttagtagagacggggtttcactgtgttggccaggctagtcttgaactcctgaccgcaggtgacctcaggtgattccccccaccacrgcctcccaaagtgctgggattacaggcataagccactgtgcccagccagatgatctatttgcagtgtgattatcggctcattgttttggtgtttttttttgttgaggggagtaccagatacctcgtcagtcatcttgaaacccctccttcctgactgtatttattgaaaaaataagtccacttccttcttcattacagatttgtccttttgttcctttgttttgtaacacctgtttttccttgcaggatgataaagtcaaatccctcctctgtagcttgatatgttatagaagttcaatg

SEQ ID NO: 157503 - DNA, 601 bp, Human
gtggtttggtggttttctgtcgtggtaacacttgaattatttcttttatttgtgtgtttgttttaccagtggagtttatatgtgttttgtaatggtagatattgttctttcacttccaagtatacaactctcttagtagagacggggtttcactgtgttggccaggctagtcttgaactcctgaccgcaggtgacctcaggtgattccccccaccacagcctcccaaagtgctgggattacaggcataagccactgtgcccagccagatgatctatttgcagtgtgattatcggctcattrttttggtgtttttttttgttgaggggagtaccagatacctcgtcagtcatcttgaaacccctccttcctgactgtatttattgaaaaaataagtccacttccttcttcattacagatttgtccttttgttcctttgttttgtaacacctgtttttccttgcaggatgataaagtcaaatccctcctctgtagcttgatatgttatagaagttcaatgactgctgaacaagttttaaatgctgaatgtttcttgatgccaaaggagcaatcagttccaaacccagaaaaagatactgaata

SEQ ID NO: 157504 - DNA, 601 bp, Human; identical to SEQ ID NO: 157397

SEQ ID NO: 157505 - DNA, 601 bp, Human; identical to SEQ ID NO: 157398

SEQ ID NO: 157506 - DNA, 601 bp, Human; identical to SEQ ID NO: 157399

SEQ ID NO: 157507 - DNA, 601 bp, Human; identical to SEQ ID NO: 157400

SEQ ID NO: 157508 - DNA, 601 bp, Human; identical to SEQ ID NO: 157401

SEQ ID NO: 157509 - DNA, 601 bp, Human; identical to SEQ ID NO: 157402

SEQ ID NO: 157510 - DNA, 601 bp, Human; identical to SEQ ID NO: 157403

SEQ ID NO: 157511 - DNA, 601 bp, Human; identical to SEQ ID NO: 157404

SEQ ID NO: 157512 - DNA, 601 bp, Human; identical to SEQ ID NO: 157405

SEQ ID NO: 157513 - DNA, 601 bp, Human; identical to SEQ ID NO: 157406

SEQ ID NO: 157514 - DNA, 601 bp, Human; identical to SEQ ID NO: 157407

SEQ ID NO: 157515 - DNA, 601 bp, Human; identical to SEQ ID NO: 157408

SEQ ID NO: 157516 - DNA, 601 bp, Human; identical to SEQ ID NO: 157409

SEQ ID NO: 157517 - DNA, 601 bp, Human; identical to SEQ ID NO: 157410

SEQ ID NO: 157518 - DNA, 601 bp, Human; identical to SEQ ID NO: 157411

SEQ ID NO: 157519 - DNA, 601 bp, Human; identical to SEQ ID NO: 157412

SEQ ID NO: 157520 - DNA, 601 bp, Human; identical to SEQ ID NO: 157413

SEQ ID NO: 157521 - DNA, 601 bp, Human; identical to SEQ ID NO: 157414

SEQ ID NO: 157522 - DNA, 601 bp, Human; identical to SEQ ID NO: 157415

SEQ ID NO: 157523 - DNA, 601 bp, Human; identical to SEQ ID NO: 157416

SEQ ID NO: 157524 - DNA, 601 bp, Human; identical to SEQ ID NO: 157417

SEQ ID NO: 157525 - DNA, 601 bp, Human; identical to SEQ ID NO: 157418

SEQ ID NO: 157526 - DNA, 601 bp, Human; identical to SEQ ID NO: 157419

SEQ ID NO: 157527 - DNA, 601 bp, Human; identical to SEQ ID NO: 157420

SEQ ID NO: 157528 - DNA, 601 bp, Human; identical to SEQ ID NO: 157421

SEQ ID NO: 157529 - DNA, 601 bp, Human; identical to SEQ ID NO: 157422

SEQ ID NO: 157530 - DNA, 601 bp, Human; identical to SEQ ID NO: 157423

SEQ ID NO: 157531 - DNA, 601 bp, Human; identical to SEQ ID NO: 157424

SEQ ID NO: 157532 - DNA, 601 bp, Human; identical to SEQ ID NO: 157425

SEQ ID NO: 157533 - DNA, 601 bp, Human; identical to SEQ ID NO: 157426

SEQ ID NO: 157534 - DNA, 601 bp, Human; identical to SEQ ID NO: 157427

SEQ ID NO: 157535 - DNA, 601 bp, Human; identical to SEQ ID NO: 157428

SEQ ID NO: 157536 - DNA, 601 bp, Human; identical to SEQ ID NO: 157429

SEQ ID NO: 157537 - DNA, 601 bp, Human; identical to SEQ ID NO: 157430

SEQ ID NO: 157538 - DNA, 601 bp, Human; identical to SEQ ID NO: 157431

SEQ ID NO: 157539 - DNA, 601 bp, Human; identical to SEQ ID NO: 157432

SEQ ID NO: 157540 - DNA, 601 bp, Human; identical to SEQ ID NO: 157433

SEQ ID NO: 157541 - DNA, 601 bp, Human; identical to SEQ ID NO: 157434

SEQ ID NO: 157542 - DNA, 601 bp, Human; identical to SEQ ID NO: 157435

SEQ ID NO: 157543 - DNA, 601 bp, Human; identical to SEQ ID NO: 157436

SEQ ID NO: 157544 - DNA, 601 bp, Human; identical to SEQ ID NO: 157437

SEQ ID NO: 157545 - DNA, 601 bp, Human; identical to SEQ ID NO: 157438

SEQ ID NO: 157546 - DNA, 601 bp, Human; identical to SEQ ID NO: 157439

SEQ ID NO: 157547 - DNA, 601 bp, Human; identical to SEQ ID NO: 157440

SEQ ID NO: 157548 - DNA, 601 bp, Human; identical to SEQ ID NO: 157441

SEQ ID NO: 157549 - DNA, 601 bp, Human; identical to SEQ ID NO: 157442

SEQ ID NO: 157550 - DNA, 601 bp, Human; identical to SEQ ID NO: 157443

SEQ ID NO: 157551 - DNA, 601 bp, Human; identical to SEQ ID NO: 157444

SEQ ID NO: 157552 - DNA, 601 bp, Human; identical to SEQ ID NO: 157445

SEQ ID NO: 157553 - DNA, 601 bp, Human; identical to SEQ ID NO: 157446

SEQ ID NO: 157554 - DNA, 601 bp, Human; identical to SEQ ID NO: 157447

SEQ ID NO: 157555 - DNA, 601 bp, Human; identical to SEQ ID NO: 157448

SEQ ID NO: 157556 - DNA, 601 bp, Human; identical to SEQ ID NO: 157449

SEQ ID NO: 157557 - DNA, 601 bp, Human; identical to SEQ ID NO: 157450

SEQ ID NO: 157558 - DNA, 601 bp, Human; identical to SEQ ID NO: 157451

SEQ ID NO: 157559 - DNA, 601 bp, Human; identical to SEQ ID NO: 157452

SEQ ID NO: 157560 - DNA, 601 bp, Human; identical to SEQ ID NO: 157453

SEQ ID NO: 157561 - DNA, 601 bp, Human; identical to SEQ ID NO: 157454

SEQ ID NO: 157562 - DNA, 601 bp, Human; identical to SEQ ID NO: 157455

SEQ ID NO: 157563 - DNA, 601 bp, Human; identical to SEQ ID NO: 157456

SEQ ID NO: 157564 - DNA, 601 bp, Human; identical to SEQ ID NO: 157457

SEQ ID NO: 157565 - DNA, 601 bp, Human; identical to SEQ ID NO: 157458

SEQ ID NO: 157566 - DNA, 601 bp, Human; identical to SEQ ID NO: 157459

SEQ ID NO: 157567 - DNA, 601 bp, Human; identical to SEQ ID NO: 157460

SEQ ID NO: 157568 - DNA, 601 bp, Human; identical to SEQ ID NO: 157461

SEQ ID NO: 157569 - DNA, 601 bp, Human; identical to SEQ ID NO: 157462

SEQ ID NO: 157570 - DNA, 601 bp, Human; identical to SEQ ID NO: 157463

SEQ ID NO: 157571 - DNA, 601 bp, Human; identical to SEQ ID NO: 157464

SEQ ID NO: 157572 - DNA, 601 bp, Human; identical to SEQ ID NO: 157465

SEQ ID NO: 157573 - DNA, 601 bp, Human; identical to SEQ ID NO: 157466

SEQ ID NO: 157574 - DNA, 601 bp, Human; identical to SEQ ID NO: 157467

SEQ ID NO: 157575 - DNA, 601 bp, Human; identical to SEQ ID NO: 157468

SEQ ID NO: 157576 - DNA, 601 bp, Human; identical to SEQ ID NO: 157469

SEQ ID NO: 157577 - DNA, 601 bp, Human; identical to SEQ ID NO: 157470

SEQ ID NO: 157578 - DNA, 601 bp, Human; identical to SEQ ID NO: 157471

SEQ ID NO: 157579 - DNA, 601 bp, Human; identical to SEQ ID NO: 157472

SEQ ID NO: 157580 - DNA, 601 bp, Human; identical to SEQ ID NO: 157473

SEQ ID NO: 157581 - DNA, 601 bp, Human; identical to SEQ ID NO: 157474

SEQ ID NO: 157582 - DNA, 601 bp, Human; identical to SEQ ID NO: 157475

SEQ ID NO: 157583 - DNA, 601 bp, Human; identical to SEQ ID NO: 157476

SEQ ID NO: 157584 - DNA, 601 bp, Human; identical to SEQ ID NO: 157477

SEQ ID NO: 157585 - DNA, 601 bp, Human; identical to SEQ ID NO: 157478

SEQ ID NO: 157586 - DNA, 601 bp, Human; identical to SEQ ID NO: 157479

SEQ ID NO: 157587 - DNA, 601 bp, Human; identical to SEQ ID NO: 157480

SEQ ID NO: 157588 - DNA, 601 bp, Human; identical to SEQ ID NO: 157481

SEQ ID NO: 157589 - DNA, 601 bp, Human; identical to SEQ ID NO: 157482

SEQ ID NO: 157590 - DNA, 601 bp, Human; identical to SEQ ID NO: 157483

SEQ ID NO: 157591 - DNA, 601 bp, Human; identical to SEQ ID NO: 157484

SEQ ID NO: 157592 - DNA, 601 bp, Human; identical to SEQ ID NO: 157485

SEQ ID NO: 157593 - DNA, 601 bp, Human; identical to SEQ ID NO: 157486

SEQ ID NO: 157594 - DNA, 601 bp, Human; identical to SEQ ID NO: 157487

SEQ ID NO: 157595 - DNA, 601 bp, Human; identical to SEQ ID NO: 157488

SEQ ID NO: 157596 - DNA, 601 bp, Human; identical to SEQ ID NO: 157489

SEQ ID NO: 157597 - DNA, 601 bp, Human; identical to SEQ ID NO: 157490

SEQ ID NO: 157598 - DNA, 601 bp, Human; identical to SEQ ID NO: 157491

SEQ ID NO: 157599 - DNA, 601 bp, Human; identical to SEQ ID NO: 157492

SEQ ID NO: 157600 - DNA, 601 bp, Human; identical to SEQ ID NO: 157493

SEQ ID NO: 157601 - DNA, 601 bp, Human; identical to SEQ ID NO: 157494

SEQ ID NO: 157602 - DNA, 601 bp, Human; identical to SEQ ID NO: 157495

SEQ ID NO: 157603 - DNA, 601 bp, Human; identical to SEQ ID NO: 157496

SEQ ID NO: 157604 - DNA, 601 bp, Human; identical to SEQ ID NO: 157497

SEQ ID NO: 157605 - DNA, 601 bp, Human; identical to SEQ ID NO: 157498

SEQ ID NO: 157606 - DNA, 601 bp, Human; identical to SEQ ID NO: 157499

SEQ ID NO: 157607 - DNA, 601 bp, Human; identical to SEQ ID NO: 157500

SEQ ID NO: 157608 - DNA, 601 bp, Human; identical to SEQ ID NO: 157501

SEQ ID NO: 157609 - DNA, 601 bp, Human; identical to SEQ ID NO: 157502

SEQ ID NO: 157610 - DNA, 601 bp, Human; identical to SEQ ID NO: 157503

SEQ ID NO: 157611 - DNA, 601 bp, Human
gacagttatgggcaaggatgaacagaaagtacttgcttctaaaaactaggtttttcgcttgcagagagggatcccttttgacttatcattttaaaaatgcttaaccatgggcaatggtaagagtgagaggcactcttaatttgtggtaaatggctgagttggactaatgtagcagttttcctgcctgtatgtcttttgctgtaaactctcctatacctggagatgcttatgttaatctctaaactgtacatacctctttatgtgaaactgagctgtggggcttccatgttcacccctgttktatttaacacacttcatagtactcttactgaggctagccaagtagacttctgtagtatctcttaagaagggaaagggcagcattgtattctgtctgaattgtcagccagtctcctttttgttacttctctgtcccctgtttggactccatctttctttcttgttcagcactggttcctatgccagtgccggtgcttcagccacctagcttaggtgtgggaaatgtttgcagagagaaatagggcagctgatccccttaagagactagagggtggggcagtgggcaggacacctgtgccta

SEQ ID NO: 157612 - DNA, 601 bp, Human
ctgaggctagccaagtagacttctgtagtatctcttaagaagggaaagggcagcattgtattctgtctgaattgtcagccagtctcctttttgttacttctctgtcccctgtttggactccatctttctttcttgttcagcactggttcctatgccagtgccggtgcttcagccacctagcttaggtgtgggaaatgtttgcagagagaaatagggcagctgatccccttaagagactagagggtggggcagtgggcaggacacctgtgcctaaagaacagcttcaaagaagaaacatactttttttttccctaagggaagataagcaaatgattggaaaacactgaaaatagccattacatcagactacatggaaatccctgtatctactttaatgctactactgtaatagcagtttcagcagttaccatttattgagcaactacaacacttttttttttttttttttttttgagatggaattttgctcttgtttcccaggcgggagtgcaatggtgcgacctcggctcactgcaacctctgcctcctgggttcaagcgattctcctgcctcagcctccggaatagctgggattgcaggt

SEQ ID NO: 157613 - DNA, 601 bp, Human
ttatcatctattaccatgaaatatcacaaatgtattaaaattataaaaccttaaaatgtatcagaacttacgcacacactcgatcacatacatggcaccattcacagtctagataaatagaaacaaatgtaaacaatacagtataaatcgtaattggataaaattaactgcattacctactatactactgtaataattttgtaaccacctcttgttgctattgcaatgatctcaagtattgtgagtatccatttaaaatgccatgtgaccctaatcatgtcacagtgaacagttcatccaktaaattgtgtattgcagtaaaaagtgatctctctatgtccttgagtattttgcatcctgtttagtgcaataacctaaaccttaaataatgccataagacctatacgaagtaccactggtggtgccagaagtgttccccaaagcagaggcaagtcataatgttataggaaaaatttgaattgcttgatgtatactatagattgaggtctgcagttatagttgccatccatttcaagataaataaattaagtgtaaggacgattatttaaaaaaaaagaaaaggaaattcatgaagccttca

SEQ ID NO: 157614 - DNA, 601 bp, Human
tcataatgttataggaaaaatttgaattgcttgatgtatactatagattgaggtctgcagttatagttgccatccatttcaagataaataaattaagtgtaaggacgattatttaaaaaaaaagaaaaggaaattcatgaagccttcactgcagctacaccagcagacatgaaaaacttgaactttttgctaaatacctttttatttcattgaaaataccggcctggtgcagtggctcatgcctgtaatcccagcactttgggaggttgaggtgggcagattgcttaagcccaggagttcragaccagcatgggcaacatggtgaaaccctgcctctactaaaaatataaaaaactaagccaggcgccatggctcatgcttgtaatcccagcactttgggaggccaaggtgggcggatcacctgaggtcaggagtttgagaccagcctgaccaacatggtgaaaccccatctctactaaaaatacaaaaaaattagccgggcatggtatagctgtaatcccagctactctggaagctgaggtaggagaattgcttgacctcaggaggtggaggttgcagtgagccgagattgggccattgc

SEQ ID NO: 157615 - DNA, 601 bp, Human
tttggctttaaaaatgtcaggataacggaagaagcagcttctgccaacgaagaggcagcagacctcaagttctcagatgccatggagaaaatcagtgaaggccgtctgtggtggctcacacctgtaaccgcaccatagctggaccccatctctaccctcaccccaccccctgcaaaaaaaaaaaaaagataagacaaaagaaggaaaatcattgaagagaaaggatatctgcctgaacaggtttttaatgcagacaaaagcgccctattctgagagggaaaaaatgccacaaaggacattkattagtaaggaaagacatgaaagcacaccaagatttaaggcaggaaggaataggctaacagtactgttttgtgcagatgcaatcgggtttatgatcaggacagccctatctatatcctattaaagactgctttttgccttcttttacagcatggacccttttatgatatgggcactgaaactaaagcacatggtggaagaaggattggtagcatatagaaacatttttagacaaatgaaaaagcaaaaaagtcagaaattacagtgtatttccataaagttacaccaagtgtgcctgcct

SEQ ID NO: 157616 - DNA, 601 bp, Human
ctttttgtcttctgccatttctgagtcagcaagacccctcctgttcctccttctcagcctactcagcatgaagacaaggatgaagatctttgtgatgatccacttccacttaatgaatagtaaatatattttctctcacttaggattttctttagcttactttactgtaagaatacagtatataatacatatacaaatatgttttagtcaactgtttatgttatcagcaatgcttctggtcaacagtaggctattagtatttgagttttgtgggagtcagatgttacatgcagattttcarctgtttgtggggtcgacacccttgactccgttgttcagggttcgactgtatgacctttctgtagcctagatcagcagtccaaactcaggaatgaagaaaatggaacattggattattgtgccaaaatagtatactatcaccaaaaaagaaagagatagaagggagtggtaatattttttataacatagttgtttgcacaaggatgcttccctttggaaagatggtatttccccattcttccctctcctccacctttggtaaagtctattctatgttctcaagattattccgtattgtagc

SEQ ID NO: 157617 - DNA, 601 bp, Human
ataacatagttgtttgcacaaggatgcttccctttggaaagatggtatttccccattcttccctctcctccacctttggtaaagtctattctatgttctcaagattattccgtattgtagcatgtatcagaactttattttttataagatattccattgtatgtatatactacattttgtttatgcattcatttgttaatgggcagctggattgtttttactgtttggctattatgagtaatgttgcagtgaactttggtgtacaagtatctgtttgagttccgtttttcaattctttggkttatatacctaggagtagaattgctgggtaaaacagaatacaaacttattatcttacagtttgggaggtcagagtcctaaaatgagagtgttgtaagtgctttatttcttctggaggtactatggaaagtccatttccttctcttttccagcttctagagaccacctgcactccttggcttatggccccttcctccatcttcaaagccagatgtatagcattgtcaaatctgtttccttccctccctttcctgtccccctcctcccctcaaccctgcttccatcatcatatttccttctc

SEQ ID NO: 157618 - DNA, 601 bp, Human
cgcaaaaacagaaatacctgttcccatttaggaccatgggtttccaggcttgagggtggggcctttgctggggaaccaccctcttctacccagtatttccctgtctcctgttcatatcaaaatgatttttccccaggatagtatcactatatttcaggcaaatgaaaagtcaaaagaaatttgttaatgtaacctaatatacataaatacaatagtatttttggaataatatttatgggcttgtattccaaaaatactgtcatccaaagttcctagtaaccagtgatgttattaattcttygggatttactagtgctatggctggtattaggacattatatgctcatttatattcataaaagagcatgatcagatatcattttctccaagatgaagagaaagaatcctgaaagaccagggtaccagtgaatagacttgctattcttcatagtaatttaacaacttgatgccttgaaccagcactagttttggaaataatttccagataaaataccagtgttttccagaaaagcctcaaaatagacctcaatatagttcttgttaaaccagaatggagcatttgcaaatttcagacacttaa

SEQ ID NO: 157619 - DNA, 601 bp, Human
ggagaggggaggtgttgggtttcagagcacgtggtggctgaagtagcctaaagtagaagattcctttttttgttgttttttaggtgagaaatgggagagtaaaggagataaagacagattcagatagtaagttttcaggtagaagggaatgtaagaaagcagtctagagaggattaggaacagtcaattagggatttccttgtgatacagggaaaacaaaactgggaatagaatgcaataaacaagtctaggattaaaataaacactatcagcaggatttgtagcaaagtgtcataatccmagttaggaaggctgacatcagataaactcagaaggtaaagagcattcattgtgtttctgaggaaggcaggaagctgctaccgtttaactggctcacatcctacagggaaagatgagcaagggagcctctgactaggttgagaggcagaacagagatggagcaaggtcaatgtttggtaattttctccaccaacaaaaatattaataagattttaggatattaaaataaggtctgtctttctggttttcttggtcttcaaatatatttcatttatgttcaatatttaagttatttgaaaag

SEQ ID NO: 157620 - DNA, 601 bp, Human
taaaggagataaagacagattcagatagtaagttttcaggtagaagggaatgtaagaaagcagtctagagaggattaggaacagtcaattagggatttccttgtgatacagggaaaacaaaactgggaatagaatgcaataaacaagtctaggattaaaataaacactatcagcaggatttgtagcaaagtgtcataatccaagttaggaaggctgacatcagataaactcagaaggtaaagagcattcattgtgtttctgaggaaggcaggaagctgctaccgtttaactggctcacatyctacagggaaagatgagcaagggagcctctgactaggttgagaggcagaacagagatggagcaaggtcaatgtttggtaattttctccaccaacaaaaatattaataagattttaggatattaaaataaggtctgtctttctggttttcttggtcttcaaatatatttcatttatgttcaatatttaagttatttgaaaagtctcaacagctggtaagtcataagacacttatttttctacaattaagaataaagttaagagcctggaatagtggctcacacctgtaatcccaacacttt

SEQ ID NO: 157621 - DNA, 601 bp, Human
taaagttaagagcctggaatagtggctcacacctgtaatcccaacactttgggacatcaaggcatgaggattcctggagcccaggagttgaagactagcctgggcaacatagtgagacccgcatgtctacaaaaaaaaaaaaaaaacttaaaaaaattaactgggcatggtggcacatgcctgtggtcccagctacttgggaggctaagggaggaagatcgcttgagtctaggaggtcaaggctgcagtgaaccatgattgcgccactgcactccagcctgggtgacagagtgagaccctrgatttttttttaaaaaaagaataatgttaatgaaaacctgttttaactgagtctttcatccagatagacttaacaatttagcaaacagccacctatagaaatcttgtcatgcatcactgataatgcattcatctctaaggtgatgtataaaagtaattttaaaaatacacatactattattacttaggaagtaaaggatatacaatccaatcattacaatcaagtacaatcactgtggagatttttagcagataagtaatacctatccattctatagatcagcagcccccaacctttttg

SEQ ID NO: 157622 - DNA, 601 bp, Human
cttaacaatttagcaaacagccacctatagaaatcttgtcatgcatcactgataatgcattcatctctaaggtgatgtataaaagtaattttaaaaatacacatactattattacttaggaagtaaaggatatacaatccaatcattacaatcaagtacaatcactgtggagatttttagcagataagtaatacctatccattctatagatcagcagcccccaacctttttggccccagtgactggtttcatggaagacagtttttccacagacagcgagtaggggatggtttgggggatraaactgttttttacctcacatcatcagtcattagttagattctcataaggaatgcaccacctagatccctcgcatacactgttcacattacggttcacgcgcctatgagaatctagtgccactgctgctctgacaggaggcagcgctcaggcaataacgctatcttgcccaccactcacctcctgctgtgcagcctgttcctagcaggccacagattggcaccagtcttcaacccaggagttggggacccctgctatagatattctgtgtcatgaattttgattatgcttcttacttttg

SEQ ID NO: 157623 - DNA, 601 bp, Human
tagattgaggtgaaatgcgtaacataaaattaactattttaaaatgaacaattcagtggcatttagtgtattcacagtgttgtgcagctaccaatctatccaggtccaaaacattttcatcacccccaaaggaaaccctataccccttaagtagttgctctccattttcccctctccccagcccctgacaaccaccaacctatagtttgtctctataaatttacctattctaggtatttcatgtaaatgaaatcatatggtatgtgaccttttgtgtatggcttctttaacttagtataaygttttcaaggttcattcatgtaatagcatattatcagtactcattccttttatggctgaatggtattccattatatggatataccacaatttgttggtgtccctttgtctcttgatggacatttgggttgtttccactctctttggctcttgtgaataatgctgctgtgaacatttatatacacggatttgtttgagtacttgttttcatttattttgggtatatagtcatgcataacgtcagggatacattctgagaaatgcaccattgtatgaacatcatagagtatgtttcacaaac

SEQ ID NO: 157624 - DNA, 601 bp, Human
aaaggtacagtaaaaatagggtattataatcatggttctattgttgctgatggaaatgtctttatatggtacgtgactgtatgtctagcagtgaagttgctgggtccactttttgatggtccttcaaatagttaaacatagaattaccgccaaacttttttccatagcagctgaaccattttatatttccacaatcaatgtacaaggattccaatttctctgcatccctgccaacacttatttcttctttaaaaaaattacagccattttaatgggattaaataatgtactttaaaaagtrgcaactcttcattcattttccccaggaaataataataactgaaacctcctccttttttccaatgtttttgtgtattttcctctatcttatagtcaaaatatcttgtaataatgagatgagaatgggcaataataaattgtgtttacatctaaggcagttagatgtttgacttgtcaccttggttgtttgtgccttgctctcttaccctgaactacctgtatcacctcatctctcctacatcttagccacactaaacctctcaaaactctttgtacctttctaagagcaagtaagtgctct

SEQ ID NO: 157625 - DNA, 601 bp, Human
ttcattcattttccccaggaaataataataactgaaacctcctccttttttccaatgtttttgtgtattttcctctatcttatagtcaaaatatcttgtaataatgagatgagaatgggcaataataaattgtgtttacatctaaggcagttagatgtttgacttgtcaccttggttgtttgtgccttgctctcttaccctgaactacctgtatcacctcatctctcctacatcttagccacactaaacctctcaaaactctttgtacctttctaagagcaagtaagtgctctgctttgcwtggcttgaggacagtgacagtaccttattcttttttgtgttctaccttccactttttttagataccacttttcatagatatcttattttttttaatagtgcttgtcttttgtattacttatttacttgtctgccacccaaacctaactgtgagctccttgtagtatgggaatatgactttgtaaccctaggacctaacagggtatttaaaattgttaaaattcttagattttattttttaacgtggccacggtgtcttctacttttggtatagaaatgcttggtattttcttccctcact

SEQ ID NO: 157626 - DNA, 601 bp, Human
ttttcatttttattatctatttcccaactagaatgtaagctccacgaaggacattatttttgtctctccactgctgcatctctgacacctggaacagtgcttgctatacagtatatgctcaatacgtattttttgaatgaattaatcagttaatgaataggcctgagaactacttaagagcagtgactgtggtgtattcatttttataacctcagcatctggaatatcaattctcaataaatatttattgaatacagcatttatttttacagcaggatcttttgctatgtgatattcctgkttctcatttgttgttgtttttgtttgttcctaaataattatataaaaatagaaaatgcacataagcaaaaataattgtttcattcaaaataggagatgattcagtcatagtcttgtgtatatgggcgtaataattttatctaaagccatttcttataaaggtaaaactgttcattcaagggaagagaaatttctactgaactgtaaacatgaacacatcagttggctaagatttaagaaaacagctgaatatttttatattcatatttcaaagtaatcattgctttggagtagattaaaa

SEQ ID NO: 157627 - DNA, 601 bp, Human
tagtcttgtgtatatgggcgtaataattttatctaaagccatttcttataaaggtaaaactgttcattcaagggaagagaaatttctactgaactgtaaacatgaacacatcagttggctaagatttaagaaaacagctgaatatttttatattcatatttcaaagtaatcattgctttggagtagattaaaaataaaggttgtatagggtttcaggtgagttttgattaataagaaaagattacatacacatcaagttagattaagttcccaataagccaatgatactaagtattattgkgaggcaaagtcatttcagaacaggtgtactatacttaatgtagtttcccttgccccctgcaagtaggatcatatcagatgagagaataaaaagagtaccttgcctttttacatattcaggattttggtctccgttgagaatgaatcttttttgttcttttgttggaaatgggctatttacaaatattttccagggttccagaaaactcagttctctgcaaccaactttcttactctgatttaattctattttgtcgtctgtgtgattctgatacttagtctgagacctatagtaacaaat

SEQ ID NO: 157628 - DNA, 601 bp, Human
gaaaccccatccctactaaaaatacaaaaaattagctgggtgtggtggcacgtgcctgtaatctcagctcctcaggaagctgagacaggagaatcgcttgaaccagggagacggaagttgcagtgagctgaaactgtgccacttgcattccaacttgggcaacaagagcgaaactctgtctcaaaacaaacaaaattagctgggtatggtggcacatgcctgtaatcccaactacttgggaggctgaggcaggagaatcacttgaacctgggaggcgcagggttgcagtgagccgagatcrcgccactgcactccagcctggtcaggaagaatgaagcaccatctcaaaaaaaaaaaaaaaaaaaaaaaagaaagaaagaaaaaaaagaaaagaaactattaatgttatatcttaagtaatgattaaacgtcctaaggaaaactagattttataggagttaagattttggaaatattatttataattaggctggcccttaaagtcttcttgaaggaagtagattccaggctggatatttcataatgactaggattttcagagctagagaggagggtgaaggatatctgcattttcatccta

SEQ ID NO: 157629 - DNA, 601 bp, Human
tagctgggtgtggtggcacgtgcctgtaatctcagctcctcaggaagctgagacaggagaatcgcttgaaccagggagacggaagttgcagtgagctgaaactgtgccacttgcattccaacttgggcaacaagagcgaaactctgtctcaaaacaaacaaaattagctgggtatggtggcacatgcctgtaatcccaactacttgggaggctgaggcaggagaatcacttgaacctgggaggcgcagggttgcagtgagccgagatcgcgccactgcactccagcctggtcaggaagaaygaagcaccatctcaaaaaaaaaaaaaaaaaaaaaaaagaaagaaagaaaaaaaagaaaagaaactattaatgttatatcttaagtaatgattaaacgtcctaaggaaaactagattttataggagttaagattttggaaatattatttataattaggctggcccttaaagtcttcttgaaggaagtagattccaggctggatatttcataatgactaggattttcagagctagagaggagggtgaaggatatctgcattttcatcctatttgagggtttcaccttagctttctccctgac

SEQ ID NO: 157630 - DNA, 601 bp, Human
ttttggaaatattatttataattaggctggcccttaaagtcttcttgaaggaagtagattccaggctggatatttcataatgactaggattttcagagctagagaggagggtgaaggatatctgcattttcatcctatttgagggtttcaccttagctttctccctgactctcctctcctccctcccacctcttcttttctccttctttccctaatgtgtaatgtttcctctctcatttatacattttaaaattaatgttcataggatatagatttccattctcatttgtggaaaaatgayaacaggaataggataaaggagaggactgtcctcccaccgcaaaaatagatgcacacctgggcagaattcaaacagcagaagtgtgtctcttttaagagactggagactgattgctttggagatgacattgaaggataaattgaaaggatgcccattttaggaaaattttagcaataaaaattaaagctgttatcacaacttaatggtaatactcatcatggtagagaatttgaaaaatacagaataatgtattcactattaacattttgatgcatttcctatttgaagacgttttttgac

SEQ ID NO: 157631 - DNA, 601 bp, Human
cctcaccacctccctcttcaatactttacatttttctgtttttacctaccttctccttttttttttttttgcatctgacaaagaaatatctctctttacccccaccgcctccattatttgaattgtcttctcgtacccttcaggtttctgccctatctttcaaccgctattgttcttaccttttcagcatatcccttccacagactctttcagtcttttaagtttgctcaggttttatcaacctcaagtctttccttccaccctatctgcccctttgaattatcatcctcacgctgtcccrccagtacctgacttatgaaagaaacgatcatcactcaccaccttggcttcattattacctgcttttgcctttattccttgcaatctggatgtgtacccagaattttgttgcacttttttttattgttgattcttttacgattttatgcaaaagtaattgtaaaaacttgtatgtaaacatgaatgtagcgtttaagtactcatatctaccactgtggccataaagtagaatgttaccattcctcagaaggcttctgtaggcccaccctgaacatattccatttttctaccacaaaaataa

SEQ ID NO: 157632 - DNA, 601 bp, Human
tttttctgtttttacctaccttctccttttttttttttttgcatctgacaaagaaatatctctctttacccccaccgcctccattatttgaattgtcttctcgtacccttcaggtttctgccctatctttcaaccgctattgttcttaccttttcagcatatcccttccacagactctttcagtcttttaagtttgctcaggttttatcaacctcaagtctttccttccaccctatctgcccctttgaattatcatcctcacgctgtcccgccagtacctgacttatgaaagaaacgatcrtcactcaccaccttggcttcattattacctgcttttgcctttattccttgcaatctggatgtgtacccagaattttgttgcacttttttttattgttgattcttttacgattttatgcaaaagtaattgtaaaaacttgtatgtaaacatgaatgtagcgtttaagtactcatatctaccactgtggccataaagtagaatgttaccattcctcagaaggcttctgtaggcccaccctgaacatattccatttttctaccacaaaaataaccactatcccgaagttagcgttaatggtga

SEQ ID NO: 157633 - DNA, 601 bp, Human
taggtgtgtgtacctctgtctctagactctgcactggtatatgtgttgatccctatgctaataccacactgcctcaattattattgctctctaaatgttaatatcttgataatccacgtctccatgttttaaagaacatcttggccccatgccattctatgtaaattttagaatcaacttgttaagttctacccctctgctccaaaaaaaagacagagagaaaataatttattgagattttcatatgaatttactttgaatccataggtcagtttggggagaactgacatttttacaatawtgagctggcatctgtctatacaactggcatactataataactgcacatttttaattactattttttttcactatgttgctcaagctggtgtcaaactcctggccttaagcgatcctcccacctctcaaatctctgggattataagtgcgagcctccatgcccagccatgtctttgtttttaaataaagttttataattttctgcctatggaacttgctgtattttgatagatttattttcaggactttgtatcttttaagtgtttataaataaaatctttaaaaattgttttcatttgga

SEQ ID NO: 157634 - DNA, 601 bp, Human
ggagtgcagtggcaggatcatggctcactgcagcctcgacttccctcagatcaggtgatcctcccacctcagcctcctaagtatgttacttagtactgggactatactgttactaagtagctgggactataggcacgtcccaccacgcctagctaatttttctttttcttttttttttttttttttcttgtagaggcggggtttcaccatgttgcccaggctggtctctactcctgggctcaagggatctgcccgccctggctcacgcctgctaggattacaggcgtgagccaccctgccyggccacaaaggcagttttaaagtagattttgtgtgctgcatcctcattaaactctcttattctaataataaattattagattccttagaacattctgtacacacaaatcacctgcaaagggttttattttgttttttccaactcagatgttttcttttttgtcttgttttgctggataggccttggagtatgatagaagtagtagtagtgttaccagtggcaaatatccaagtttcacagcatcaaatgtgttaccggtagaaggtatttgagtcactggcggcaaatatatacgggtct

SEQ ID NO: 157635 - DNA, 601 bp, Human
aaccttctgggttcaagcagtccttcccctctcagcccaagttgctgggactacaggtgtgcaccatcacgcctggctgattttggtatttttggtagagatggggtttcatcatgttgcccaggctcatctcaaactccagagctcaaataatccacctgcctcagcctcccaaaatgctaggattacaggtgtgagccagcacacccagtccttatgccaagaatttttatcataagtggatattgtatttgtctaagagttttatgcatcttttgagatttctatatgattccacccsgccctttattgaacttggtgaatcttattaattgatttttttttttttttttttttgagacagagtctcactctgtcttcaggctggagtgcaatggcgctatctcggctcattgcaacctccgcttcctgggttcaagcaatccccctgcctcagcctcctgaatagctgggactacaggcgcacatcactacacccagctaatttttgtatttttagtagagatggggtttcaccgtgttggccaggatggtctcgatctcttgacctcgtgatctgcctgtctcgaccttccaaagt

SEQ ID NO: 157636 - DNA, 601 bp, Human
aggctcatctcaaactccagagctcaaataatccacctgcctcagcctcccaaaatgctaggattacaggtgtgagccagcacacccagtccttatgccaagaatttttatcataagtggatattgtatttgtctaagagttttatgcatcttttgagatttctatatgattccaccccgccctttattgaacttggtgaatcttattaattgatttttttttttttttttttttgagacagagtctcactctgtcttcaggctggagtgcaatggcgctatctcggctcattgcaacctccgcttcctgggttcaagcaatccccctgcctcagcctcctgaatagctgggactacaggcgcacatcactacacccagctaatttttgtatttttagtagagatggggtttcaccgtgttggccaggatggtctcgatctcttgacctcgtgatctgcctgtctcgaccttccaaagtgctgggattacaggcatgagccaccgcatctggcctaattgatcttttttcttttctttttttttttttttttttttttgagacggtgtttcgctcttgttgcccaggcaggagtgcagtgg

SEQ ID NO: 157637 - DNA, 601 bp, Human
cagagtctcactctgtcttcaggctggagtgcaatggcgctatctcggctcattgcaacctccgcttcctgggttcaagcaatccccctgcctcagcctcctgaatagctgggactacaggcgcacatcactacacccagctaatttttgtatttttagtagagatggggtttcaccgtgttggccaggatggtctcgatctcttgacctcgtgatctgcctgtctcgaccttccaaagtgctgggattacaggcatgagccaccgcatctggcctaattgatcttttttcttttcttttyttttttttttttttttttgagacggtgtttcgctcttgttgcccaggcaggagtgcagtggcgcgatctcggctcactgcaacctctgcttcccaggttcaagtgattctcctgcctcagactccctagatctaccttagccataatattttatattagtagattaggtttgctattattatttagtattttttcatatatgtttatgaatgaaactggcttgtatttatatttttcacactttatcaggttatggtatcgaggttatgctggtctcataaaatgagttagaagtgtttc

SEQ ID NO: 157638 - DNA, 601 bp, Human
ggaaacgtttgtggaggattagaattatttgttccttgaatttttggaagcacttgggtaaaatcaacaaggctttttattctcttgggaagatttttacttacctactaattcagtttccttaaatgctgtgggactctatggattttctatttcttcttgagtcagtcttgataaattatattttctatagagttattcatttttaagttttaattgtattgacatgaaacgcttcacaatatattcttaatctttttattatctgcagcttttttttttttttttttttttttttttkgagacaggttctgactgtgctgctcaggctggtcttgaactcctggcctcaagtaattcttctgcttcagcctgtctagagtgctgggatacaggcttgagctactgcacctgacctgcagcagtttttgataggcctttttgttacacttaaattgtttgtttgctccttctctcttattttcttgttccatcttaccagaagtttatacgttacaaagtgacaagattcttttgaaagaaccaagttggtgtttctattatgtggaagttttttttaatggtattcattattggtctt

SEQ ID NO: 157639 - DNA, 601 bp, Human
ttttttttttttttggagacaggttctgactgtgctgctcaggctggtcttgaactcctggcctcaagtaattcttctgcttcagcctgtctagagtgctgggatacaggcttgagctactgcacctgacctgcagcagtttttgataggcctttttgttacacttaaattgtttgtttgctccttctctcttattttcttgttccatcttaccagaagtttatacgttacaaagtgacaagattcttttgaaagaaccaagttggtgtttctattatgtggaagttttttttaatggtaytcattattggtcttacctttattattacctttccctctattttctttggatttatttatttctcagtgctcttatccttatcttctctgtaccatttaatagtattaaaccactccatccttgtagctttctcatccctggctcctgaaacacactagactttttttaaaaaaaaaaaactatttttgttttagatgtagggggtaaacgcacaggtttgttacatgggtatatcgcctgatgctgaggtttgggattctaatgattctgtcacccaagtagcaaacctagtaccgtagg

SEQ ID NO: 157640 - DNA, 601 bp, Human
gctactgcacctgacctgcagcagtttttgataggcctttttgttacacttaaattgtttgtttgctccttctctcttattttcttgttccatcttaccagaagtttatacgttacaaagtgacaagattcttttgaaagaaccaagttggtgtttctattatgtggaagttttttttaatggtattcattattggtcttacctttattattacctttccctctattttctttggatttatttatttctcagtgctcttatccttatcttctctgtaccatttaatagtattaaaccactscatccttgtagctttctcatccctggctcctgaaacacactagactttttttaaaaaaaaaaaactatttttgttttagatgtagggggtaaacgcacaggtttgttacatgggtatatcgcctgatgctgaggtttgggattctaatgattctgtcacccaagtagcaaacctagtaccgtaggtagtttttcagcccttgccttctccttcccttcccccttttggaatccctagtttctgtttctgtctttgtgtcttatgtgtttaactcccacttaaatgtgagaatatgtggta

SEQ ID NO: 157641 - DNA, 601 bp, Human
gattttgttctgtttatggctgcatagtattccacggtgcatatgtaccatattttctttatctaatccactgttttgggcacttgggttgattccatgtctctgctgttgtgaatagtgctgtgataaacatgcaaatgcaggtgtcttttgggtagaacgatttatttttctttgggtatatatccagtaatgggattgctaggttgaatggtaattctgtttttagttctttgagaaattgccaaactgctttccacagggactgaactaatttgcattcctaccaacagtgtgtacrtggttttttttttttcagctttgtcaacatttgtgggtttgttttttttttttttactttttaataatagtctgcctagtgtgagatggtatctcattgttattttgatttgtatttctgatgattagtgatgttgagcattttttcatgtttgttgacttgcttgtatgtcttcttttgagacgtgtctgtctttgcctgctttttaatgaagttttttttcttgttgatttaagttccttatagattttggatattagtccttttttggatgcacagtttgctaatattttctcctat

SEQ ID NO: 157642 - DNA, 601 bp, Human
ttgttctgtttatggctgcatagtattccacggtgcatatgtaccatattttctttatctaatccactgttttgggcacttgggttgattccatgtctctgctgttgtgaatagtgctgtgataaacatgcaaatgcaggtgtcttttgggtagaacgatttatttttctttgggtatatatccagtaatgggattgctaggttgaatggtaattctgtttttagttctttgagaaattgccaaactgctttccacagggactgaactaatttgcattcctaccaacagtgtgtacgtggttttttttttttcagctttgtcaacatttgtgggtttgttttttttttttttactttttaataatagtctgcctagtgtgagatggtatctcattgttattttgatttgtatttctgatgattagtgatgttgagcattttttcatgtttgttgacttgcttgtatgtcttcttttgagacgtgtctgtctttgcctgctttttaatgaagttttttttcttgttgatttaagttccttatagattttggatattagtccttttttggatgcacagtttgctaatattttctcctattctg

SEQ ID NO: 157643 - DNA, 601 bp, Human
atgtaccatattttctttatctaatccactgttttgggcacttgggttgattccatgtctctgctgttgtgaatagtgctgtgataaacatgcaaatgcaggtgtcttttgggtagaacgatttatttttctttgggtatatatccagtaatgggattgctaggttgaatggtaattctgtttttagttctttgagaaattgccaaactgctttccacagggactgaactaatttgcattcctaccaacagtgtgtacgtggttttttttttttcagctttgtcaacatttgtgggtttgttttttttttttttactttttaataatagtctgcctagtgtgagatggtatctcattgttattttgatttgtatttctgatgattagtgatgttgagcattttttcatgtttgttgacttgcttgtatgtcttcttttgagacgtgtctgtctttgcctgctttttaatgaagttttttttcttgttgatttaagttccttatagattttggatattagtccttttttggatgcacagtttgctaatattttctcctattctgtaggttgtttattctgttgatagtttcttttgatagtt

SEQ ID NO: 157644 - DNA, 601 bp, Human
tccagtaatgggattgctaggttgaatggtaattctgtttttagttctttgagaaattgccaaactgctttccacagggactgaactaatttgcattcctaccaacagtgtgtacgtggttttttttttttcagctttgtcaacatttgtgggtttgttttttttttttttactttttaataatagtctgcctagtgtgagatggtatctcattgttattttgatttgtatttctgatgattagtgatgttgagcattttttcatgtttgttgacttgcttgtatgtcttcttttgagacrtgtctgtctttgcctgctttttaatgaagttttttttcttgttgatttaagttccttatagattttggatattagtccttttttggatgcacagtttgctaatattttctcctattctgtaggttgtttattctgttgatagtttcttttgatagttggttttggccctcagtgtacctatctcctcagtcctgtctctttagtttaattaaatccaagttgtctgtttttatttttgttgcgtttgcttttgagtacttagtcataaattctttgcttaggccaatgtttacaagagta

SEQ ID NO: 157645 - DNA, 601 bp, Human
gtgatttcttttaacagtgttttatagtactcatagatatctttcacctccttgattagatgtattcctagctgtttttattttattttattttattttttatttttttcaattttgtggctaccgtaaatgggattgtattcttgatttggttttcaacttgaacgttattcatgtataggaatgctactgatttttgtacattgatttcgtatcctgagtctgctgaagtggtttatcaggtctaggagtctttgagcagaatctttatataattttacttctgcttttcctatttagrtgctgtttatttgtttctcttgcctgattgctctggcaaggactttcagtactatgttgaatagcagtggtgagagtggacatccttgccttgttcttaggggaaatgctttcaacttttgactgttccatatgatattggctatgagtttatcatagatggctcttattattttgaggtatgttccttcaatgcctagtttattaggagtttttattataaagggatgttagattttattgaatgcttttttctggttctattgtgatgatcatatggtttttgttttaattctgtttg

SEQ ID NO: 157646 - DNA, 601 bp, Human
gagcagaatctttatataattttacttctgcttttcctatttagatgctgtttatttgtttctcttgcctgattgctctggcaaggactttcagtactatgttgaatagcagtggtgagagtggacatccttgccttgttcttaggggaaatgctttcaacttttgactgttccatatgatattggctatgagtttatcatagatggctcttattattttgaggtatgttccttcaatgcctagtttattaggagtttttattataaagggatgttagattttattgaatgcttttttctrgttctattgtgatgatcatatggtttttgttttaattctgtttgtgtagttaatcacgtactgatttgtatatgttgaaccacccttacatcccagaaataaagcccacttgatcatggggaattgactttttgatgtgctgctggatttggattactaatattttttgaggattttcgcatctatgttcatctggatgttggcctgtagtttcctttttttgttgtatcattgccagatttaggtatcaagatgatgctgctttcatagaagaagttagggaggagttcctcctacttg

SEQ ID NO: 157647 - DNA, 601 bp, Human
atagaagaagttagggaggagttcctcctacttgatttttgggggatagtttcagtagaattggtacgagctcttccttgtacggctggtaaaatttggctgtgaatctatctggtccagggattttttggttaagtttttcattactgatttcgtttaattactcattattgatctgttcaggatttctgtaaacacactaatcttgaatggttttttttctacttttccaactgctccttctgtttctctgtgtcttcatgtctcctaatgtaggtgctcctattatgtctcctaatgwagggtgctccttttctcccaggcacacaaaaccaagtgctatttggttttggcccgcaatgtacctacctccacatttctagctcatacttaacttccagttggggtatgtgtgtgtgtatctgtttctctctcctttccttgtagtccaatttaggtctttatgttttacaagaatgatttccatgtaataactactttcttctacttctcacctcccagtggagcctcagttgccacagtaaaagaggttaacctaccttagcaccttaaattcctctatttatctgagtagttgtct

SEQ ID NO: 157648 - DNA, 601 bp, Human
tgtgaatctatctggtccagggattttttggttaagtttttcattactgatttcgtttaattactcattattgatctgttcaggatttctgtaaacacactaatcttgaatggttttttttctacttttccaactgctccttctgtttctctgtgtcttcatgtctcctaatgtaggtgctcctattatgtctcctaatgtagggtgctccttttctcccaggcacacaaaaccaagtgctatttggttttggcccgcaatgtacctacctccacatttctagctcatacttaacttccakttggggtatgtgtgtgtgtatctgtttctctctcctttccttgtagtccaatttaggtctttatgttttacaagaatgatttccatgtaataactactttcttctacttctcacctcccagtggagcctcagttgccacagtaaaagaggttaacctaccttagcaccttaaattcctctatttatctgagtagttgtctaagagtattctttttaccttactacctttgaatactgttttgtattctgttatgaggtggttagtccagtgtggccacaataggtgacataagaaaagct

SEQ ID NO: 157649 - DNA, 601 bp, Human
aggtttttatgatgtcaaaatatcataatacattaaaaatgtaagaacattttacaatacagagaccatgccttcagctcctcctcccccccaaggcagaaccagggcacttaaatactattaccagtagaccattgtaccagggatactagacatcaatgtctctgttacttagtgctttgtgacttataagaagctttgatagcatttttatggcaacttgaaagtggaaccagtatatagaattttcacaaactccatgagagtggaatatttggttctggaagacctcctattagtwgtgtgttaatcttttaagtgcttgtctcggtttttcaaaatctcatattcttttagtcttgttgatttatttaatatatcttgagcatgtttctctaatggtgaacagtctctttttcctccagttttattgaggtatgattgacaaaataatataatgctgtactatcttaaaatctccacaaagggactgatatcctgcatagagatagagataacaactaatgacaaaacgcatgactttaaaatagtgaaacttctacatgtggcttatggaagtgactacttacttgactagaat

SEQ ID NO: 157650 - DNA, 601 bp, Human
acattaaaaatgtaagaacattttacaatacagagaccatgccttcagctcctcctcccccccaaggcagaaccagggcacttaaatactattaccagtagaccattgtaccagggatactagacatcaatgtctctgttacttagtgctttgtgacttataagaagctttgatagcatttttatggcaacttgaaagtggaaccagtatatagaattttcacaaactccatgagagtggaatatttggttctggaagacctcctattagtagtgtgttaatcttttaagtgcttgtctcrgtttttcaaaatctcatattcttttagtcttgttgatttatttaatatatcttgagcatgtttctctaatggtgaacagtctctttttcctccagttttattgaggtatgattgacaaaataatataatgctgtactatcttaaaatctccacaaagggactgatatcctgcatagagatagagataacaactaatgacaaaacgcatgactttaaaatagtgaaacttctacatgtggcttatggaagtgactacttacttgactagaatgtctcgttgtggaaaaaaataaaaaataa

SEQ ID NO: 157651 - DNA, 601 bp, Human
gaaatattcatacatatcttttataattatctcaaggaaacaaatagggctctgcttcatgttctatacctaattattcattcttatttaagtaatacatctgccagaaattaggatgtgtatattggcagacgttagcactgtcttacaaacactgctgtaaggttctaactttgtgctcttctgactggtttgctctggatgtgtgtgcacatgtaagtgtaaggatgggaagaatgggatgtttgagtggtaggaaatggaagtgtagaaccatatccatggtctagacaattcttasagattcctgtggcctattatattttattcagtacataatgttctggctttttaaaataataactggatatagtaatttgaaaacaatgtattataatcccttagaaaatatttctgggtgttagggtggcatgtctttccataaattagccctattctaatatcagatcacagcagaagtggttaaaaagctcttgcatggctcacgcctgtaatcccagcactttgggaggccgaggcgggcggatcacgaggtcaggagatcgagaccatcccggctataacggtgaaaccccgtctc

SEQ ID NO: 157652 - DNA, 601 bp, Human; identical to SEQ ID NO: 25726

SEQ ID NO: 157653 - DNA, 601 bp, Human; identical to SEQ ID NO: 25727

SEQ ID NO: 157654 - DNA, 601 bp, Human; identical to SEQ ID NO: 25728

SEQ ID NO: 157655 - DNA, 601 bp, Human; identical to SEQ ID NO: 25729

SEQ ID NO: 157656 - DNA, 601 bp, Human; identical to SEQ ID NO: 25730

SEQ ID NO: 157657 - DNA, 601 bp, Human; identical to SEQ ID NO: 25731

SEQ ID NO: 157658 - DNA, 601 bp, Human; identical to SEQ ID NO: 25732

SEQ ID NO: 157659 - DNA, 601 bp, Human; identical to SEQ ID NO: 25733

SEQ ID NO: 157660 - DNA, 601 bp, Human; identical to SEQ ID NO: 25734

SEQ ID NO: 157661 - DNA, 601 bp, Human; identical to SEQ ID NO: 25735

SEQ ID NO: 157662 - DNA, 601 bp, Human; identical to SEQ ID NO: 25736

SEQ ID NO: 157663 - DNA, 601 bp, Human; identical to SEQ ID NO: 25737

SEQ ID NO: 157664 - DNA, 601 bp, Human; identical to SEQ ID NO: 25738

SEQ ID NO: 157665 - DNA, 601 bp, Human; identical to SEQ ID NO: 25739

SEQ ID NO: 157666 - DNA, 601 bp, Human; identical to SEQ ID NO: 25740

SEQ ID NO: 157667 - DNA, 601 bp, Human; identical to SEQ ID NO: 25741

SEQ ID NO: 157668 - DNA, 601 bp, Human; identical to SEQ ID NO: 25742

SEQ ID NO: 157669 - DNA, 601 bp, Human; identical to SEQ ID NO: 25743

SEQ ID NO: 157670 - DNA, 601 bp, Human; identical to SEQ ID NO: 25744

SEQ ID NO: 157671 - DNA, 601 bp, Human; identical to SEQ ID NO: 25745

SEQ ID NO: 157672 - DNA, 601 bp, Human; identical to SEQ ID NO: 25746

SEQ ID NO: 157673 - DNA, 601 bp, Human; identical to SEQ ID NO: 25747

SEQ ID NO: 157674 - DNA, 601 bp, Human; identical to SEQ ID NO: 25748

SEQ ID NO: 157675 - DNA, 601 bp, Human; identical to SEQ ID NO: 25749

SEQ ID NO: 157676 - DNA, 601 bp, Human; identical to SEQ ID NO: 25750

SEQ ID NO: 157677 - DNA, 601 bp, Human; identical to SEQ ID NO: 25751

SEQ ID NO: 157678 - DNA, 601 bp, Human; identical to SEQ ID NO: 25752

SEQ ID NO: 157679 - DNA, 601 bp, Human; identical to SEQ ID NO: 25753

SEQ ID NO: 157680 - DNA, 601 bp, Human; identical to SEQ ID NO: 25754

SEQ ID NO: 157681 - DNA, 601 bp, Human; identical to SEQ ID NO: 25755

SEQ ID NO: 157682 - DNA, 601 bp, Human; identical to SEQ ID NO: 25756

SEQ ID NO: 157683 - DNA, 601 bp, Human
gtggcgaccacaccaagccttgtgactagcagtgcagcaactaccctcacagtcagccctgtcctccctctgaccagtgctgctgtgacgaatctttcagttacaggtaagcagctgccaggccatgcacctgctgagcacatgggaggcccgttttgggttattataagagtctaccattaaattgtgaattaaggccctaactaaagataggtgttgctcataaatatcaattttctttaaagtaactcctttccttaaaagccttcaatagccgtggctttttgcattcagaaaaacmtccaagtttgtcaattcgtgaaggttatttccggtctgaacctgatctcccactagtcttttgcctacgcaccctcaacacacaggaggcctccatccatacctttgtaaacatccctacaatggaaatgtccatcttagcctgcagttcttgatctgttactgataaaactataccagcttgtatgtcaattttcttggaaatattctttagctttcccaggaaactattcatttccatgtacctgtattataaatgattttatttttacacacctgtctttcccaatagactgcactt

SEQ ID NO: 157684 - DNA, 601 bp, Human
ttataagagtctaccattaaattgtgaattaaggccctaactaaagataggtgttgctcataaatatcaattttctttaaagtaactcctttccttaaaagccttcaatagccgtggctttttgcattcagaaaaacatccaagtttgtcaattcgtgaaggttatttccggtctgaacctgatctcccactagtcttttgcctacgcaccctcaacacacaggaggcctccatccatacctttgtaaacatccctacaatggaaatgtccatcttagcctgcagttcttgatctgttacygataaaactataccagcttgtatgtcaattttcttggaaatattctttagctttcccaggaaactattcatttccatgtacctgtattataaatgattttatttttacacacctgtctttcccaatagactgcacttctcaaaagatttgattattctttttgaactcttgatgcctagctcagtgcatgacatactcactataaaatgaatgtttttttttcctttggcctcttttaaatagcaaattttccagataaatttaaaatcacttagcattgtcatcagatgttttttagtg

SEQ ID NO: 157685 - DNA, 601 bp, Human
agcaaattttccagataaatttaaaatcacttagcattgtcatcagatgttttttagtgatacatagtgcataagacatgctgtaattattcaccaggttggttatttgctagtacatcattgggtagattaatgatatttcataatgaagcttgatttaacctagaggtagggacttttatttttctcacccatgttttaagtttacaatgcctccttggctctatgacctacccatgatgtaaaaattgaataaatggctttatattatattaaatttctacattattagaacattttktttattgttttctgcatccaatcatccattaatttttgcttatgttaaacagtacttcttgacctcttctggatgttggacctttttaagaatttgaaagctacagacttttcctcacacaaaatagacatatacacaatttttagtaaaatttaaggagatttataaatgacagctcccatcaacctcccactccaaggctatttgtggatacctacaggttccagttttaataaccttggttcaagaatatacttaagaaccttggttaagaatatatataatattgagcacttccac

SEQ ID NO: 157686 - DNA, 601 bp, Human
tcctgagttagatccaatgtttctcagatgccctgtcatcctctttgattcctttttgtctggagcacgttctcaagtaattttatttagaaaggttacatgggaggtaaaacttctaaatacatgtataactgagaagtatttattttgccttcacagttttttttggagtttgtccagttacaaaagtatttttcctttgaattttgttgtgttttagcatctagtgttgctagtgaaaagtctgatttcaatctctttttccttgttttttctctctgtaaaccttaagggttttttwaaatcttatactgttctaaaatttcactacaaggtttcaaagaaggggccttttaaaacttgccctcattggccttcagcaagcattttcaatgtgaattaatgtatttcttgcactctggtaatttatctttttttttttttaagttaggattttttggcattcactctgtttattcattttgtgtcatttgtaatgtgctgttggcttttttcattgtctggtgatttttgtagtgatgaatgcaagattacattacttattatcagtagcctgtaagggtttttcctgacattgtgt

SEQ ID NO: 157687 - DNA, 601 bp, Human
gcccagctaatatttgtattttttgtagagacgaggttttgccatattgcccaggctggtctcgaactcctgggctcaagcaattcacccaccttggcctcccaaagtgctgggattacaggcatgagccaccatgctcagtcttccagcttgatttatagattcaacaaaatcatagtaaaaattccaacaggttttttctttgttttgttttaaagaaatcgataaactcttggaagggaccaagaatagccaaaacaattttgagaaagagtgaaatcagaggattttcatgtcctgmtttcaaagtttactgtaaagcaacaataatcaaagcagtgtattactggtatacatatagatatatagattaaatggaacaaaattaagagtccagaagcaaaactttaaatttatgctttattgatttttgacagaggtgccaaggcaattcaatagggaaaggacagtcttcaacaaatggttctaggacaactggatatccatatgcagaaagaggaatagaggaatttagatccttaccttacaccgtgcataaaaattaactgaaatggatcaaaggcctaaatataagagctga

SEQ ID NO: 157688 - DNA, 601 bp, Human
tcataatctggattgtgatgatggttgtataactgtaagttgattaaaagtcatcaaattttaaagctggatgaattttcatgtgcttactagtcactcctatatcttccttgttaaaatgtctactaacatttgtccatttaaaaatctaagttgtttatattcttactattgagttgtaagaattgtttatacattctgacacaattccagttcctttattggatatgtgatctgcaaatgttttctctcagtctgtggcttttgaagcgcaaaagattttacttttgatgaagttgarttcactgatttttcttttcttttatggatcattctcttggtgctgtgtctgtgaactctttgcttaacccagggtcacaaagattttgtcctactttatttactagaagctttatagtttcagctcttatatttaggcctttgatctgttttagttaatttttatgcacagtgtaaggtaaagatctaaattcctctttctgcatatggatatccagtttataagttgtatctcaataaaagctgtttgagaaaagacaagacagggcgggaagcacagggaagtgccaggtactatata

SEQ ID NO: 157689 - DNA, 601 bp, Human
ttatgtttacctcattcatttggcagccacttttgcacagctttataggaggtgaagaaagtagtcagtgctgaaataaatgatgtctgagtctctcccaaccctgtgacatgtgataaaaactgaagagtggaagtgagagttcaattctagatgttcttagtacagaccagaagaaggttttaaaacagatttttggaaggacaaaattgcctgaatttgtaacaagattgttatgaaagaagagcatgttctgaagcttggtaaaagatttcatcaccaaaaaatgttattattattwttattattttttttaacggagtcttacttcgtcacccagactggagtgtaatggcgtcatctcggctcactgcaacctccacctcttgggctcaagcagttctcctgcctcagcctcctgagtagctgggattacaggcgcccaccaccatgcctggctaatttttgtatttttaatagagacggggtttcaccacattggccaggctggtttcgagctcctgacctcaaatgatccactcacctcagcctcccaaagtgctgggatcacaagcgtgagccaccacacctggccttgtct

SEQ ID NO: 157690 - DNA, 601 bp, Human
tgtttacctcattcatttggcagccacttttgcacagctttataggaggtgaagaaagtagtcagtgctgaaataaatgatgtctgagtctctcccaaccctgtgacatgtgataaaaactgaagagtggaagtgagagttcaattctagatgttcttagtacagaccagaagaaggttttaaaacagatttttggaaggacaaaattgcctgaatttgtaacaagattgttatgaaagaagagcatgttctgaagcttggtaaaagatttcatcaccaaaaaatgttattattattattwttattttttttaacggagtcttacttcgtcacccagactggagtgtaatggcgtcatctcggctcactgcaacctccacctcttgggctcaagcagttctcctgcctcagcctcctgagtagctgggattacaggcgcccaccaccatgcctggctaatttttgtatttttaatagagacggggtttcaccacattggccaggctggtttcgagctcctgacctcaaatgatccactcacctcagcctcccaaagtgctgggatcacaagcgtgagccaccacacctggccttgtcttac

SEQ ID NO: 157691 - DNA, 601 bp, Human
ttacctcattcatttggcagccacttttgcacagctttataggaggtgaagaaagtagtcagtgctgaaataaatgatgtctgagtctctcccaaccctgtgacatgtgataaaaactgaagagtggaagtgagagttcaattctagatgttcttagtacagaccagaagaaggttttaaaacagatttttggaaggacaaaattgcctgaatttgtaacaagattgttatgaaagaagagcatgttctgaagcttggtaaaagatttcatcaccaaaaaatgttattattattattattwttttttttaacggagtcttacttcgtcacccagactggagtgtaatggcgtcatctcggctcactgcaacctccacctcttgggctcaagcagttctcctgcctcagcctcctgagtagctgggattacaggcgcccaccaccatgcctggctaatttttgtatttttaatagagacggggtttcaccacattggccaggctggtttcgagctcctgacctcaaatgatccactcacctcagcctcccaaagtgctgggatcacaagcgtgagccaccacacctggccttgtcttaccat

SEQ ID NO: 157692 - DNA, 601 bp, Human
cttaaaccaaaagcatattcaggcacttttttctaagacctcacaaataatttcttttttttttttttcttgagatggagtcttgctctgtcgccaggctggagtgcagtggcgcaatcttggctcactgcaacctccgcctcccaggttcaagcgattctcctgccttagcctcccgagtagctggaactacaggcgcgtgccaccacgcccagctaatttttgtatttttattagaggcagggtttcaccatgttggccaggatggtctcaatctcttgacctcttgatctgcccacckcagcctcccaaagtgctgagattacaggtgtgagccaccatacccggcctacaaataataatttcttagatcttaatttttatgcttttatgagattcatagtatcattgtatgttgttttttttttttaccacaatggactttttgagagctaatttttattacagaatagttgtttgaatgtagagaaggcatgtagtcatttttatactatgttgttgttgatactgaattcttagaaaagcatataactttctgtttttcttctccttgttttgatttttctgaggagacccctaa

SEQ ID NO: 157693 - DNA, 601 bp, Human
ttcatagtatcattgtatgttgttttttttttttaccacaatggactttttgagagctaatttttattacagaatagttgtttgaatgtagagaaggcatgtagtcatttttatactatgttgttgttgatactgaattcttagaaaagcatataactttctgtttttcttctccttgttttgatttttctgaggagacccctaaggagatttctgaatgaaaagagctttacagaagtttttcttcttttgctttctttttcttccccagagcagttgtattccataattagagcttctrtgattcttttgtttcttgaataggaaacaggcaatggaaaacttctctgtttctttcattgctcatatctcttaaagtagggttcctagctgtgatcctaaaatgtttggttttgtagttaatttccataaaagcactaaactaggttattaaaggacagctttactaggtggtaggttaattattccattgattatagagtttggctgagtaaagccaccattcttccaaaaccatttacaaaaggtcatcttctaatctgtttgtcttttcaggcacttcagacaccacctccaacaa

SEQ ID NO: 157694 - DNA, 601 bp, Human; identical to SEQ ID NO: 25757

SEQ ID NO: 157695 - DNA, 601 bp, Human; identical to SEQ ID NO: 25758

SEQ ID NO: 157696 - DNA, 601 bp, Human; identical to SEQ ID NO: 25759

SEQ ID NO: 157697 - DNA, 601 bp, Human; identical to SEQ ID NO: 25760

SEQ ID NO: 157698 - DNA, 601 bp, Human; identical to SEQ ID NO: 25761

SEQ ID NO: 157699 - DNA, 601 bp, Human; identical to SEQ ID NO: 19820

SEQ ID NO: 157700 - DNA, 601 bp, Human; identical to SEQ ID NO: 19821

SEQ ID NO: 157701 - DNA, 601 bp, Human; identical to SEQ ID NO: 19822

SEQ ID NO: 157702 - DNA, 601 bp, Human; identical to SEQ ID NO: 19823

SEQ ID NO: 157703 - DNA, 601 bp, Human; identical to SEQ ID NO: 19824

SEQ ID NO: 157704 - DNA, 601 bp, Human; identical to SEQ ID NO: 19825

SEQ ID NO: 157705 - DNA, 601 bp, Human; identical to SEQ ID NO: 19826

SEQ ID NO: 157706 - DNA, 601 bp, Human
gatatagctaaaaacttggcaagccagttgataatggattatttcatttcagttttggtatctgccctcacatgacagaagacaataaagatttgatacagggcaaggacttacttattgcttactatgatgtggactatgaaaagaacgctaaaggttccaactactggagaaacaggtaataagaattatgtttttccctcatgaacaagtttacccaatgtatagacagtcccttctaactatcttgttggttccttaagaatctgtaaaacaataaatggttccttaagaagaggtaaaaaaaaaaaaaaaaaaattaaagtaactatcctgttaccatgtgtggtataaaagcaggaaagaatgggaacatttggcttccaaattgtctacaattgacttcaaatggctacatttgaagccataaggacaaataaactgttttcacaatctgttgggcatgtatttcgtaggtgtttctttgctttgtgacacagtgactccaagtagaaggtggaaatttgatataaaatgcacttaaaacattgtgcttacttgcacattgagcctctcagtgcattttacccttacaaatttt

SEQ ID NO: 157707 - DNA, 601 bp, Human
gccttgaaaagctaaaatacatagtaactattcaaagaaattgctgtaattttctcagcggtgggaatagattaacaagccttacccttgttttccaattgtaggcgtgatgggaaggctctggagaggttcctgcaggattactttgatggcaatctgaagagatacctgaagtctgaacctatcccagagagcaatgatgggcctgtgaaggtgaggtgctcacagcctcatcaagctatgagcaattgcctgtcctcatttctttgttccaaaactgtggggtctaaatgaagacttygttggccatctctttttttttttgtccttactcccgagtcataaaataagcattggcaggccaagcggtggctcatgcctgtaatcccagcactttgggaggcaaaggcgggcacatcacaaggtcaagagtttgagaccagcctgcccaacatggtgaaaccccgtatctactaaaaacacaaaaaaatcagccgggcatggtggcgggcgcctgtaagcccagctactcgggaggctgaggcaggagaatcgcctgaacccaggaagcagaggttgcagtgagtcaagattatgccac

SEQ ID NO: 157708 - DNA, 601 bp, Human
cctgaacatagtttgacaggtgacagacataggaacgagttggtatctagtgaatgacaacatctttaatacaatctgtaaatgtgatttgggtttccatgacttattttctgtggtaacacatcaaattagagagggattgggtctaggaacaaatacagttgtgaatttatttttttatgttaccaactagagattcttctgtgttttccaggtagtggtagcagagaattttgatgaaatagtgaataatgaaaataaagatgtgctgattgaattttatgccccttggtgtggtcaytgtaagaacctggagcccaagtataaagaacttggcgagaaggtaagtgtgaaccctattctgaggataacatttgagcgggagcagtaagtttatgtatgtattcagcattggctaatttggttggttcctaagtactgatagatttttttcccaattacttgctgtttactcactttctcgtgactgccccctagtgctccagcctgtgcagtgcctgagatacccacttttaacattccattcctcaggctcaatctagataatggttaaaaatatctaaggacttctgaattttgg

SEQ ID NO: 157709 - DNA, 601 bp, Human
ataaagcttgtaaccaccaggaaatcattactagacatagttttcatattcagttgaaggcagaaccactgattccttcttggcttaagagttctgcagtatgggcccacataactgcttgaaattaataaatgtttctttccccagttttcctaccatatacttctctccagccaacaagaagctaaatccaaagaaatatgaagtaagtgaattgtcccatatccccacaaatatatacacagacgtaaacacacaaccttaaacatagttctttaattgggtttatttatttatttawttattttttgagacggagtttcgctcttgttgcctgggctggagtgcaatggcgtgatctcggctcaccgttcaagcgattctcctgcctcagcctcccgagtagctgggattacaggcatgcgccaccaccccggctaattttgtatttttagtagagatggggtttctccatgttggttgggctggtcttgaactcctaacctcaggtgatcagcctgccttggcctcccaaagtgctgggattacaggcgtgagccaccgtgctaggctaattgggtttatttaactaaaatctctt

SEQ ID NO: 157710 - DNA, 601 bp, Human
cccctataaattctagtaggaggaacagcagctgcggagccagaggacaggccccagatcccaacatcatgtagcctaacagtgaagcttagataaaacacagcctctgtaaaccacgatggctttatttgtaaaatagaaatagcaacctcaactcacaagggtgttgggagggtcaaagtggacagcaagtttaaaagtactcacaaaatctaataggcaattcaacataaaactccatggctatcgctgttcctcactttctgaacctttacctgcctgactttactccataccactycaactcacttcaaccacttcccatgcagaaaaaaataaactcaccatctcctctgtgactctgctggttttctgccttctgcccaacccagactgcttacagtctcactgcctcccctcagtgtcaggctgtttagaaaaacaacttcctattcacattccagaaactcaccacagcccttcccatgaagttagaatgttgataatgcaagagtaatgttggcagcttagaaatagtggttgccaagaggcaaggggtcacccccttccatggaagatggtctggaggcaggcgcaaggt

SEQ ID NO: 157711 - DNA, 601 bp, Human
ttctcagagagcccctataaattctagtaggaggaacagcagctgcggagccagaggacaggccccagatcccaacatcatgtagcctaacagtgaagcttagataaaacacagcctctgtaaaccacgatggctttatttgtaaaatagaaatagcaacctcaactcacaagggtgttgggagggtcaaagtggacagcaagtttaaaagtactcacaaaatctaataggcaattcaacataaaactccatggctatcgctgttcctcactttctgaacctttacctgcctgactttacyccataccactccaactcacttcaaccacttcccatgcagaaaaaaataaactcaccatctcctctgtgactctgctggttttctgccttctgcccaacccagactgcttacagtctcactgcctcccctcagtgtcaggctgtttagaaaaacaacttcctattcacattccagaaactcaccacagcccttcccatgaagttagaatgttgataatgcaagagtaatgttggcagcttagaaatagtggttgccaagaggcaaggggtcacccccttccatggaagatggtctggaggc

SEQ ID NO: 157712 - DNA, 601 bp, Human
caataagcttctacttaaagatctctgaagatgcacattctaagagctggtggctagcccaggagagtctgaactattttagttgcattttgaaaaacaggtaatgaaaagaagagtaaggactggaagccacataaggtggttaaaaggtataaatggacgaaaatccagacctgctccttagcccactaaaactttttttttgttttgtttttgagacaagtcttgctctgtcacccaggctggagttcagtggtgtgatctcaactcactgccacctccacctcctgggttcaagagwttgtcctgcctcagcctcctgagtagctgggattacaggcacatgccaacatgcccagccagtttttgtaagtttagtaaatatggtgtttcaccatgttggccaggctgctcttgaactctcgacttcaagtgatctatgcgcctcggcctcccaaagtgctgggattacaggcatgagccactgagcccggccatagcccgctaaaactttgacaaacatcagtgcaatttaactataagttcccaatcaagagctactcctctgagatctatctgattgaaaataccccaccagaaa

SEQ ID NO: 157713 - DNA, 601 bp, Human
gagatgtttcccattttaacctgtttgtttgtttgtttgaactttttttaagcaaaatttcatcagcaaattctctaccacacaagataaaacaaagtgagagagagcgagacaacttgttttaaacatttgaaggttttagaggactggtacagtgcttttgatgaaggcacaacatctaagaaaggaaaatgcaagtcagtgtgcatcccctgctttaatctgacatacttttctgtttctatgcatcaccaaataccaagattcacctcttacaggttatttcagagctataggagamcataaaggtcacttccaagccaacttagcatttatctgctgttctgcaggaagtctttcagacttcgaatgcctaagatggggcagccaccactccccaccactgagactcagtgagcgtaaatgatttgcccaagcttgctcacatgaatgtgcatagggttaacacagttattcttattcttccagggcttatgaattttgaaaatctgataaaagccgtggtcagatttcttcaaaacaaatgcatgcttgcagtagtttagagaatctcagatggttcatgacctactaagtctgt

SEQ ID NO: 157714 - DNA, 601 bp, Human
caaaaagagatgtttcccattttaacctgtttgtttgtttgtttgaactttttttaagcaaaatttcatcagcaaattctctaccacacaagataaaacaaagtgagagagagcgagacaacttgttttaaacatttgaaggttttagaggactggtacagtgcttttgatgaaggcacaacatctaagaaaggaaaatgcaagtcagtgtgcatcccctgctttaatctgacatacttttctgtttctatgcatcaccaaataccaagattcacctcttacaggttatttcagagctatrggagaacataaaggtcacttccaagccaacttagcatttatctgctgttctgcaggaagtctttcagacttcgaatgcctaagatggggcagccaccactccccaccactgagactcagtgagcgtaaatgatttgcccaagcttgctcacatgaatgtgcatagggttaacacagttattcttattcttccagggcttatgaattttgaaaatctgataaaagccgtggtcagatttcttcaaaacaaatgcatgcttgcagtagtttagagaatctcagatggttcatgacctactaa

SEQ ID NO: 157715 - DNA, 601 bp, Human
ggacttcaaggaattgagacattgctataataaaacttctaattccatttacttattcatatgaatgaagtttctcaatgtttaaatccttgaaaatgaaatatgggaataatattgatgccaaacttgtctaattttgttgataagtaatattcattcatggatatatgaacaaatgagggaaagctcctcctgtcttagagatgaatctttaatagcaatttaaatataaaggtttaagttacttgtcaaaacttgcagtatatttactttatttaattgtgtactgaaagtagttgtmatgctaactcaatagaaaagaaaaacattttaacacatagagacttacagttgtagaaaattgaaattttatatttttattttgcaaagaagtataataatcaagaaaatactttaagcttaaaatgtgtaatcttaggctaaatactgtagaagtgggatagaaataactattcaaggagagaaaaatgaataatataaaatttcttaagagcctgcttgtggtcttttaagtgatgaggattgcagatcatgctagtactttattccattggataaactttaagaaattatgtaacaa

SEQ ID NO: 157716 - DNA, 601 bp, Human
tgatagtaaatcactatataatttggggcatataacttggaaggacttcaaggaattgagacattgctataataaaacttctaattccatttacttattcatatgaatgaagtttctcaatgtttaaatccttgaaaatgaaatatgggaataatattgatgccaaacttgtctaattttgttgataagtaatattcattcatggatatatgaacaaatgagggaaagctcctcctgtcttagagatgaatctttaatagcaatttaaatataaaggtttaagttacttgtcaaaacttgyagtatatttactttatttaattgtgtactgaaagtagttgtcatgctaactcaatagaaaagaaaaacattttaacacatagagacttacagttgtagaaaattgaaattttatatttttattttgcaaagaagtataataatcaagaaaatactttaagcttaaaatgtgtaatcttaggctaaatactgtagaagtgggatagaaataactattcaaggagagaaaaatgaataatataaaatttcttaagagcctgcttgtggtcttttaagtgatgaggattgcagatcatgctag

SEQ ID NO: 157717 - DNA, 601 bp, Human
tgcttgtaatcccagctccttgggaggtcgaggcaggagaatcgcttgaacccgggaggcggaggttgcagtgagcggagatcacaccactgcactctatccggggcgacagtgcaagactccgtctcaaaaaaacaacaaaaaatgtttttgggcatctaagttctagtgatgctcatcttgtccgacttcctcatgttgcacatgaaaatactgaagcttggggcatctaaataacacgttcagaatgacagtagcagagcttgactttgaaacaagaaagagctctttccactgtacttttttttttttttttttttaaccttcattaacctccaggcttctaaatcccatgctgcattgctgttttggatgataaagcatgcgacatgaccaagcctagctgctacatcagttcccctctaaagccactcaacattactatcaacataaaaacagtgcatttgctatgcatttgcagttttgtcactatcccagccagactgctacctaaaacctttcctgtaaagaaatctcaaattgcctcagaccacaatttggtctgtgacaatttgctgcgaggttatgtgtgtgttcgtgt

SEQ ID NO: 157718 - DNA, 601 bp, Human
acctcttcacatggaaaataacatgctttatgacctggagcctaccagttggtccagcctcattgcccactgtatgtactttctcagcaaaacagaattcctacttccttgaatttgcacatgctctccccacaatcctggctgtcctctcttcttatgtctgataaactttactccacctattctccatggctttcccaggtggactctgtgttccttcctccaggctcccacagcacctcatccctgcctccattgtgctcattgccatgtacggtaatgtctgtttctatgatacagkctacatctgccaggttgtaaatctccgacggtgttttctttttagctttggatccttagcactgagcctagagtttagcacttaataggccttcaataaatacttgttgaatgagtgaaacacagtaggtttgtggcagaacccgggtgggaaatcagatatcctgatctgcaatcttatagtctttccattcttcttggctgtttgtctttcattaactactctacttcttccatgtctgaatactcccttattaagatagggctcagaacagccctttttcacaagtgtttttgatac

SEQ ID NO: 157719 - DNA, 601 bp, Human
ctcagatgaatttccgaccagaacattaatacacaaaacaacgactagtttatgtctaatgtagttgtttgaaggaaaaagagtggtttccacctttcacttaaaagtgtgaatgatgtcagaataggaaaatgtcatcttctgaggatccttgatgttaaaggtttggaatcataagatatcaaagttaggagggaccctggaagtcatctaatttactcctgtccttttataaaagaaggagacataagtaatttgcccaagctcagattaaatgacatataaaatgtcttaagggcargctctacctcttcacatggaaaataacatgctttatgacctggagcctaccagttggtccagcctcattgcccactgtatgtactttctcagcaaaacagaattcctacttccttgaatttgcacatgctctccccacaatcctggctgtcctctcttcttatgtctgataaactttactccacctattctccatggctttcccaggtggactctgtgttccttcctccaggctcccacagcacctcatccctgcctccattgtgctcattgccatgtacggtaatgtctgtttctatga

SEQ ID NO: 157720 - DNA, 601 bp, Human
gttagttctagagtaaaggagagtgagtgccaggttagtacccctcaccaaaaaagaggccgtgatcccaagtatgcttctgcatactcagatgaatttccgaccagaacattaatacacaaaacaacgactagtttatgtctaatgtagttgtttgaaggaaaaagagtggtttccacctttcacttaaaagtgtgaatgatgtcagaataggaaaatgtcatcttctgaggatccttgatgttaaaggtttggaatcataagatatcaaagttaggagggaccctggaagtcatctaayttactcctgtccttttataaaagaaggagacataagtaatttgcccaagctcagattaaatgacatataaaatgtcttaagggcaagctctacctcttcacatggaaaataacatgctttatgacctggagcctaccagttggtccagcctcattgcccactgtatgtactttctcagcaaaacagaattcctacttccttgaatttgcacatgctctccccacaatcctggctgtcctctcttcttatgtctgataaactttactccacctattctccatggctttcccaggtggactc

SEQ ID NO: 157721 - DNA, 601 bp, Human
cttgggatctcagaactctaggggaaaaaaagagacaatgttctgtattctatcccatttcagggtttcctgaatagataggttagcaatttgtctattcctttggatctccagggagaagatgatttattcatgatgattcaatgaataaatcttttttcgatagcctgctctgaggtctaataattcctgacatgtggagaattattccaacaatcaaacttaatttcatattacagtaaatatatctatttctcatctcccatggataattgatgcttctctacatcctttacatctyagatggcaaaacgacaatcaatggtagtggctgcttagagtactgtgttggtggagataaaacccatctgtgttcaggtaaagttgtattaattagtgatgtctctaccactgttgtgggttagaggagtgtcatcatttatgccagtaattttttatcttttttctatcttgcaatttttttggcaagctttattgaggaagactgtcttgcagaaatggattttgaaggttgggtgtgaaggggaagtagtggcatattgaaacagctagtggcagtcaaggttatctgataagagat

SEQ ID NO: 157722 - DNA, 601 bp, Human
tattttagggtatatgcacttgatgagaattagtattagaattgatactttcaaagcactgagatgtttttattaatgaggtcatagttgggggtaagttctatggctgaactgttttctggtggttacttcctctgtcttaagccctgtccacatgctggttcacttggaagtatattacaaaagaatatccatatgtcatatgtggatatgctgtgctacatgatctctatgtttcctctcaattctgagatactaaaattctataaaccatgcaaggttctataggaagaagttcctrtggcagccagtgaatttggtgaagctgcactgagacactgggaagggttcaaataaagagaagatgtaggaggcaatagcagctaaatggatacaggtttggtccacatcctattcacttcgctccctgaccttaaccccaccaatgtcttaataccttacagtagcaacccctgcctgccctatgttcttggagcatacaaatgtttccccaattatagcttccttgggatctcagaactctaggggaaaaaaagagacaatgttctgtattctatcccatttcagggtttcctgaata

SEQ ID NO: 157723 - DNA, 601 bp, Human
aacaccttcccatgcccctcttggcctgactcactctcacctgcccttcaggtctcagcttagacttccctttccttaggaagccctcccttcccaccttaactaagggtagaagcccctgcaatgtgctcccacagcctctgttcttgcgctgttcatacatgattgtcattcttccccattataccgtggtctcctcgaagttgggctcagtcattcatagttttattctggagctgagcagagtgttttgtacattgaaagtgctcattaaatattgacattatctgtgaaattgaayctgaaaagagtatatacaggaaaatgctggacttatagggaaaaaaaaaaaagctggactagcatagcttattgttgacactgttacctagtcctgtaaaatgatcctgaccgggctttgtctctagaacacaggatgtcatcctaatcagacttcagttgccaagtgagtgcagccaaagtgaattcctgagcacaattaagccctgagtgacctcagttctgataaagattggtttcctcatgctcttccttgataaagcatttcatttccaggctatttctgaaacttttcaaagtg

SEQ ID NO: 157724 - DNA, 601 bp, Human
agggccgggttcttcctcagaaaaaattcctagatgctatatctttcctgtccacattttcagtgtgttcagaaccctaaaacctccattttccaaaagagagactgcctggaacaccttcccatgcccctcttggcctgactcactctcacctgcccttcaggtctcagcttagacttccctttccttaggaagccctcccttcccaccttaactaagggtagaagcccctgcaatgtgctcccacagcctctgttcttgcgctgttcatacatgattgtcattcttccccattataccrtggtctcctcgaagttgggctcagtcattcatagttttattctggagctgagcagagtgttttgtacattgaaagtgctcattaaatattgacattatctgtgaaattgaatctgaaaagagtatatacaggaaaatgctggacttatagggaaaaaaaaaaaagctggactagcatagcttattgttgacactgttacctagtcctgtaaaatgatcctgaccgggctttgtctctagaacacaggatgtcatcctaatcagacttcagttgccaagtgagtgcagccaaagtgaattc

SEQ ID NO: 157725 - DNA, 601 bp, Human
cacacattaattcacaactactagtgaggcaggtaggtaaggctgataatagtagccccattttacagaagatactgagcctcagagagtctaaaccactagcttaaggacaggaagtgacaggactgagctaaacaccttgtccattacccttccccatcccatgctattcctcatgcatgatttattcccccaagccccatcttcttcattccaatgcaccctatatgtgtcaatcagtgcaaacctcaccttgactatactatagtggacatgtgcctaagactggcttcacgcaccrtttcatctcatccctggtcccaagcacaaaggacatggcccatagtaggttctcagtgaatatctgataaagaaaggcatgccaatgctcagtgcagatgctgatgcctctaacgagctgagacacacagaaaaacattaccactgttacagtaccttgacagactggggctggtgctgtccactgtcccaagttatcacaccgaactatatcggctcctctcagcatgaaaccttcagcacagcggaagctacagttggtgtcatactgaaacgctctcaaggatggagagcaatccat

SEQ ID NO: 157726 - DNA, 601 bp, Human
tgctatattagtagcagtggtagtaatagatagtaataatatcattaaggctttgcgtcacatgcagacactgagttcaggagtgggaaacattcagaaggcctatgaagggggttagtgagaccacatctctggatacttaagagaatatccaactatcttttcttgattagacatttaccttcctggagacaacaatggcttgaataatcccttatgatccgttttaagtgtgtcaaagagctcattgtgtctttttctcccagataacatatacaatacattccataactcagactargtgtcagcatcatggtgtatagccatctattctattgccttcttgttttttctttttttttttttttgctgttcaattttttattatagtgagatatacgtagcatgaaatttaatttaccatttaccatgtcaccaatatcaagtgtacagttcagtggtattaagcacattcatattattgtgccaccatcaccattattcatctccaaaactcttttcatcatctcaaactgaaactccgtatccattaaaccataactccctatttccctcttccgccgagcccttggcaacctcc

SEQ ID NO: 157727 - DNA, 601 bp, Human
gtcaagaacagggattcctgaattgggcttgtttaacatagaagataagaaaaagtgtcatttaattataacggcacatgaaggattttattaggaaatgctaaacctttgttgagcatcttggcaacatgtgtcaataatttttaagttatcatgcttttggacccaagaatttatgctaagtatgtaatcaagatgcataccaaaaaatctatttagagatttttgtgaagacattatttgtaagagcggaatattgaaaacaaacacaaatgccattaattgagggtggaaattaatkatggtggatccatgaaaagaatgttaaaggtcactaaaaataatatattttaacttgtaaagataggagagaggtctcaatgtatgatgttaaataaaaaatcagagtaaaaattataatatacaccatgatctcaaagatgtaaaataaataaccatatacgaagagagcacacatattccatgtgttgtctcttctcatctttaaaatggtagtaataattgtaactacctcatagagttagactgagatcatagaaagtgctcaatgaacattagctgctatattagtagcagtggt

SEQ ID NO: 157728 - DNA, 601 bp, Human
cattgcaggtgaagctgcagactgactggtacctaaaggcaccgaaggggtgggagcagttcacccgggcctcatttggaactgggagatcctggcactgcaaagctaagggatgaggaagtaaggaataaagaaacagtaatacacatgtactcattgatttttgaccattaactctttctagtgtcaagaacagggattcctgaattgggcttgtttaacatagaagataagaaaaagtgtcatttaattataacggcacatgaaggattttattaggaaatgctaaacctttgttgarcatcttggcaacatgtgtcaataatttttaagttatcatgcttttggacccaagaatttatgctaagtatgtaatcaagatgcataccaaaaaatctatttagagatttttgtgaagacattatttgtaagagcggaatattgaaaacaaacacaaatgccattaattgagggtggaaattaatgatggtggatccatgaaaagaatgttaaaggtcactaaaaataatatattttaacttgtaaagataggagagaggtctcaatgtatgatgttaaataaaaaatcagagtaaaaatt

SEQ ID NO: 157729 - DNA, 601 bp, Human
cctttcaatctgatcaacttgtccaaagatctggttcttttcttctagttgaaaagtatttctgtagtaagtgtgtatgtggggctggagaggacacaactcaagaagcctataaactgcaaggacttatgggggaaagggtgtgggtgaggatgttggtaccacagaacccatttccagctcttctgtggctttgccttctgacagcaggggtagatgtggaggggtgggaggacattaaaaagggaaattgtctgataacactctctcagaagtattacaacagcgagtggattgcacwctgcatggtaccttcctgcccagcccacatttgggtatttcacttgatgtgcacccagcaacaagaggagaaagttcagagtaaataaagaactaaaagcagaagggaactggaaggtcacaggaagccgtggtgagtggcaacctccttgctgtgaaacacccagaggcaggacagtatggagcaatgaactgtaatctgtgccctgcaccacccaggcttgcctgtaagagtttcaatcactgtgatcactgtcctcagggattcccagttcttcccacaacttccccaaagttgtgt

SEQ ID NO: 157730 - DNA, 601 bp, Human
acagatgaattgacatgtggatttataactggaacttccaagaggttgaacacaggtcattgttccattctgagggcttagcaaaggtgtgcagggaatggctatcatgggcatggcagaggagaaaagaagagatcattttataattcagcaacctgaactctgtaactctctctctctttctccctctctctctctgtgtgtgtgtgtgtgtgtgtgtgtgtgtgtgtgtgtgtgtgtgtgattaatatacaacgatggtatttggctaaaagtgattgtttgaatttcatgatgcttyatcaccagttagagattgtagaggtgtaaaatagcagcagcttacagttgattgacatcctgaagtgctcaatcacaaacagctttagaggtgatttttaaaggaagctggtgctctgtttgggaggatagtggtgcaactcatttttgttgcttctagacaggggtggaactggtttctcccttgataccttcttcagaaacaccccaatgaccttaccagaaaacaatgacaaatgattggaaacacagaaatggaggaaaatactttcttccccctttcccaaccaagtggtggaat

SEQ ID NO: 157731 - DNA, 601 bp, Human
taccttcacacattggtggggagtctgtccagcgtcccgatcgagtacaatccaatctttctggtccagacaaagaatatccctcgtcacagatgaattgacatgtggatttataactggaacttccaagaggttgaacacaggtcattgttccattctgagggcttagcaaaggtgtgcagggaatggctatcatgggcatggcagaggagaaaagaagagatcattttataattcagcaacctgaactctgtaactctctctctctttctccctctctctctctgtgtgtgtgtgtgtstgtgtgtgtgtgtgtgtgtgtgtgtgtgtgattaatatacaacgatggtatttggctaaaagtgattgtttgaatttcatgatgcttcatcaccagttagagattgtagaggtgtaaaatagcagcagcttacagttgattgacatcctgaagtgctcaatcacaaacagctttagaggtgatttttaaaggaagctggtgctctgtttgggaggatagtggtgcaactcatttttgttgcttctagacaggggtggaactggtttctcccttgataccttcttcagaaacaccccaatg

SEQ ID NO: 157732 - DNA, 601 bp, Human
cctaccttcacacattggtggggagtctgtccagcgtcccgatcgagtacaatccaatctttctggtccagacaaagaatatccctcgtcacagatgaattgacatgtggatttataactggaacttccaagaggttgaacacaggtcattgttccattctgagggcttagcaaaggtgtgcagggaatggctatcatgggcatggcagaggagaaaagaagagatcattttataattcagcaacctgaactctgtaactctctctctctttctccctctctctctctgtgtgtgtgtgtstgtgtgtgtgtgtgtgtgtgtgtgtgtgtgtgattaatatacaacgatggtatttggctaaaagtgattgtttgaatttcatgatgcttcatcaccagttagagattgtagaggtgtaaaatagcagcagcttacagttgattgacatcctgaagtgctcaatcacaaacagctttagaggtgatttttaaaggaagctggtgctctgtttgggaggatagtggtgcaactcatttttgttgcttctagacaggggtggaactggtttctcccttgataccttcttcagaaacaccccaa

SEQ ID NO: 157733 - DNA, 601 bp, Human
gtggagtggaaaagagtaaattcacaagtgacttacctgagattcagaagctctgccactgggtgatagtgtagttcagtggtcaaaacactagccctataatcagactaggcctgggtttgcatcctgtctccatacttcaagctatatgaactttgctagctacttaacctctcaaagcctcagtttcttcacctttaaaatgggcatagtaataaccaacttaagggtcatttgtgtggattgaatgtgatgatgcttatgaaataggtagtcctacattaagcaataattattaccattatcactggtctcattattactaactctacactgaacaatacattagaacaatagcaccttttgcaactaaacaggagctatgaattaattaattcagtgcacttctattttagaacataaaatatactagatactttgccagccagatgtctcaggggaattaaagacagataagatctggcccctgcctttgagaattccactaaattaccaaagcttgtgtttgagtaaattttactggtaaatgatcaccttcaattcaacagatatttgtcacacacacccatttttattctgt

SEQ ID NO: 157734 - DNA, 601 bp, Human
tctgatcaccaggcactgccatttctaaagttcatttagcagttatagctgcaatctgtggagtggaaaagagtaaattcacaagtgacttacctgagattcagaagctctgccactgggtgatagtgtagttcagtggtcaaaacactagccctataatcagactaggcctgggtttgcatcctgtctccatacttcaagctatatgaactttgctagctacttaacctctcaaagcctcagtttcttcacctttaaaatgggcatagtaataaccaacttaagggtcatttgtgtggaytgaatgtgatgatgcttatgaaataggtagtcctacattaagcaataattattaccattatcactggtctcattattactaactctacactgaacaatacattagaacaatagcaccttttgcaactaaacaggagctatgaattaattaattcagtgcacttctattttagaacataaaatatactagatactttgccagccagatgtctcaggggaattaaagacagataagatctggcccctgcctttgagaattccactaaattaccaaagcttgtgtttgagtaaattttactgg

SEQ ID NO: 157735 - DNA, 601 bp, Human
taatattttagctgtttttgtgtaacacgaatagatttctaccaacatattctctcatctgatcaccaggcactgccatttctaaagttcatttagcagttatagctgcaatctgtggagtggaaaagagtaaattcacaagtgacttacctgagattcagaagctctgccactgggtgatagtgtagttcagtggtcaaaacactagccctataatcagactaggcctgggtttgcatcctgtctccatacttcaagctatatgaactttgctagctacttaacctctcaaagcctcagyttcttcacctttaaaatgggcatagtaataaccaacttaagggtcatttgtgtggattgaatgtgatgatgcttatgaaataggtagtcctacattaagcaataattattaccattatcactggtctcattattactaactctacactgaacaatacattagaacaatagcaccttttgcaactaaacaggagctatgaattaattaattcagtgcacttctattttagaacataaaatatactagatactttgccagccagatgtctcaggggaattaaagacagataagatctggccc

SEQ ID NO: 157736 - DNA, 601 bp, Human
tatgtaggttatatgcaaatattatgccattttatataagtgacttgggcatctggggattctggtatctgcagggagtcctggaaccaattccccctgcagatactgaggaacaactaggcagaggccacatcccagagggcccagggaaccggcattctaactaaagtggaactatcggtagagccatcccccaaaatgaaatctcacattgcactctgaagagacagcttgagaactccacctgccacactgcctctgcttacttggaggcccctgagtccatctgatgtatcctagwactctgcaaaacaccatgtgaaaattggggttctagggggcagtgctgagggttaaaaattaatgggttcaggcatatgggaaaataagaggaaccatttgcctaaatttagagcataaatttggagaacgaagaagaaacacaaatgcaaaaaccagggctcaagatcaggatcagtcaaggttgataattccaagggccatagtgggttaaagctgctgttcatggtcagggttgggtcttgacagtgagtggggatggggcctgcaaagtgggaggcaaatgcctcctcctgcagag

SEQ ID NO: 157737 - DNA, 601 bp, Human
ctctctcaggtaaaaattaaccttgacccttacatactaagaatttggctctggatcatgtaaagaagtgggtttacctgtttgaggggcagcctagatgagttacatggaagcctaacccagatccggcatatggtgggcactcagcaaacatgggatgaatgacatttgtggagttatcaaggatgctgctggaatggagattagtgcagatgcaggaaaagagttatacccaggaatgacttttgtgcataactttgagaagtggtcatattcttgagcctactctaaaactttggcaaaaaaaaaaaaactcctgaataattacaaaaatagaaaacagataaggtttgcatttattgcacgcttagtgttctattttcactgactaccaaggcagttctatcacatatgggtattcattggtgttcttctatagtccatcaagaaagtatacatgattgcatctgaattcttaaacatattgatttatattatttcaaatagatttagtaaattatctgtttcctttcattatatcattttacttgagtttgatagagttttctcaataattttctggaaagaagatatagtatga

SEQ ID NO: 157738 - DNA, 601 bp, Human
tggtattaaaaccaaaggttcccggatgatgcctacagtacatggttccctgcccaggagtggtgagggctggacattgcacccctggagtaggaagtgatgctatgcctgttgtgagaaaatgtttccattcagagacctcccaattaaaagaagcgttaacagagttaaggctaatctggaataactgcttttcactcccttcataacaagggaggctcctgcaagagctatttaaggaagttaagaaaaactatcagtgtcagagatagaaaaccagatgaggaaaattattaaaaakcatccttgaggagatgattctcctggccaagagaagaaatcagaggagtcattgttgttgctattttaaaaagaagcaagaaatggtacagaaatataagaaattcagcagaaagccaaatatacatgggccaactgcctgcccaaccctgccttattgggaaatggtactgttctctgactaaaggtcaatgtgaaagttgaaatttactgcaatgattgctttctgtctcaaactatttcttccatttgaatgatcccaccagctttgtcattaacttgccatgtggcaggaagatga

SEQ ID NO: 157739 - DNA, 601 bp, Human
acacccactaccaagtctccccatagaaggatctatatttttaggaagttccctaggtgattctaatggacaatcagttctcaagatcacttatcttggctttattttcttttaatgcaaatgttttccaacatgaactactgaagttgtggtttttgcctccccaccctaaattacataaatcaatttcttttgatttatgtaaccaagatgcaaagagaagactctttcctatttacctttttgtctgaaacgctttcttagcaaagccaggagcgtcccacccattatcagacctatygtagaagccaccgctccaccaaagtaagtcagggcttcctggatagtcaatggtcctgctacaaaacaaacacacacacatgcaagacataagaagtgtattatgcaaaagactagtctttctctcccagaaagttttcaagaactctaagatgtgcgatcaagtaggatcaccaaaggtcctgggaatgctgacaagctaacatgaaagaagatctggaattcataaatccactgcaacagaatgggaagtggggccttattttattcctaaggcttaaatatagactgtaatttccaa

SEQ ID NO: 157740 - DNA, 601 bp, Human
cgcctaagtttttgcatcttgtttttattataaattacttttcattttattcctactttatattttaattagaatatttgttatctgtgtattttacttcagagtagaaaagaagacattgcaaaagacattgtaaaaaggaggcaggcattgcatgtaatcattctgacatattacagtgaattataaagttaaggtagcaaaatttactcaatcataaaacatttctaccttacctgtgaggattcaaggggcatttcccatcatctaaaatcagcaagaagacaagaatgaatgattaaaaaaaaaaaacaagatgaaagagagggtcattaaggatagaaattactggggaaaaccagtagactgattttcaggagggctcattataaggggaatattgggaacagtttctccctgaaaggtagaaagtgttttaggctaaattaaacattcgacaatatttaactccagagtcctgtcactttcttcctccttcctttcagtaaatacataaatcaatttcttttgagggcatcttgtgtcacttgccctcagcccttagctgagcaagctaatcacatacatgaatccaaaccaa

SEQ ID NO: 157741 - DNA, 601 bp, Human
caggaaacttgatgttcacaacaggatcatatggaggctgaatgaggagaccaggaaaaggacaggtctctggaaatgagaccaaagaaatttaaataattatcatttccttaaaaaaataaaagaaagaaaaaaattgctcatcatatctacaccctgaggcgcagcataatcttttctttctagatttcgaatattctgccattcaggctttttgtaggacactcaactacccactttttgggagagggatagcatcagattatttttgtttttccagcaggtagcatagggaattgaytccataacagttcgtaaacatttttcagcagtcctgacttctgctttgcaggcaaggccacatcatcaccacctagcagttaataatggaaatgttacacatcctgaaataagttatgtcttgttaggacatttctgtcctggaggaaatgaaaatccttttgtgaactcttttgtaactccattgtcatacctgtgtcctactgccaacacaatttccttcatgcctgaaaatttaatacatacttaaaatttaatatatgattatgtaaagaaaagttaagctttatagtcttccatt

SEQ ID NO: 157742 - DNA, 601 bp, Human; identical to SEQ ID NO: 19098

SEQ ID NO: 157743 - DNA, 601 bp, Human; identical to SEQ ID NO: 19099

SEQ ID NO: 157744 - DNA, 601 bp, Human; identical to SEQ ID NO: 19100

SEQ ID NO: 157745 - DNA, 601 bp, Human; identical to SEQ ID NO: 19101

SEQ ID NO: 157746 - DNA, 601 bp, Human; identical to SEQ ID NO: 19102

SEQ ID NO: 157747 - DNA, 601 bp, Human; identical to SEQ ID NO: 19103

SEQ ID NO: 157748 - DNA, 601 bp, Human; identical to SEQ ID NO: 19104

SEQ ID NO: 157749 - DNA, 601 bp, Human; identical to SEQ ID NO: 19105

SEQ ID NO: 157750 - DNA, 601 bp, Human; identical to SEQ ID NO: 19106

SEQ ID NO: 157751 - DNA, 601 bp, Human; identical to SEQ ID NO: 19107

SEQ ID NO: 157752 - DNA, 601 bp, Human; identical to SEQ ID NO: 19108

SEQ ID NO: 157753 - DNA, 601 bp, Human; identical to SEQ ID NO: 19109

SEQ ID NO: 157754 - DNA, 601 bp, Human; identical to SEQ ID NO: 19110

SEQ ID NO: 157755 - DNA, 601 bp, Human; identical to SEQ ID NO: 19111

SEQ ID NO: 157756 - DNA, 601 bp, Human; identical to SEQ ID NO: 19112

SEQ ID NO: 157757 - DNA, 601 bp, Human
tcctgcctcagcctcctgagtagctgggactacaggcacctgtcaccccgcccagctaattttttgtatttttagtagagacagggtttcaccatgttggccagaatggtctcgatctcttgaccttgcgatccatccacctcggcctcccaaagtgctgggattacagctgtgagccaccccgcccggccttcactcacttcttaaaatggagacggtcaacagggttggtgctgaattaatgaagtaagatccagaaatcactagagctgtgatgggcacatagtcaccgcagcggtgragaactgaccatctgtcccttgtgttgtttaggcctcatctctgcatggtcctcattggctctgagttctagtgtgtagtgtccacagtgccaccctccatgagggttgtgttgactgtgaggtggtgcagagaatgtccctgtccttgtgagcatatgacagcaagacactggccctggaatcctccgtgtcacatgtgggctgctgacaggaagaatgtgcttttgttgttgttgttgttgttgaggcagagtcttactctgtcgcccaggctgcagtgcagtggcatgatcttggct

SEQ ID NO: 157758 - DNA, 601 bp, Human
ggcacctgtcaccccgcccagctaattttttgtatttttagtagagacagggtttcaccatgttggccagaatggtctcgatctcttgaccttgcgatccatccacctcggcctcccaaagtgctgggattacagctgtgagccaccccgcccggccttcactcacttcttaaaatggagacggtcaacagggttggtgctgaattaatgaagtaagatccagaaatcactagagctgtgatgggcacatagtcaccgcagcggtggagaactgaccatctgtcccttgtgttgtttaggyctcatctctgcatggtcctcattggctctgagttctagtgtgtagtgtccacagtgccaccctccatgagggttgtgttgactgtgaggtggtgcagagaatgtccctgtccttgtgagcatatgacagcaagacactggccctggaatcctccgtgtcacatgtgggctgctgacaggaagaatgtgcttttgttgttgttgttgttgttgaggcagagtcttactctgtcgcccaggctgcagtgcagtggcatgatcttggctcactgcaacctctacttcccgggttcaagtgatt

SEQ ID NO: 157759 - DNA, 601 bp, Human
cctcaaaactccaggattaatgtgctattcccttttttctactgttctctgtctccccccaacccatcagcagtctgagaaatgctatggtggaaaaaaaaaaacaacagccctataaccagtacaaacaaaaagccaagacaaaaaaaaaaaaaaaaatcagaaggggagattttgaggccaggaagccatggcattcactggaaatatatcagtgataaaataacaggctacagggtttattttattttatttttaagtcaataggcctgagtgttggtaaagactagatacccagcartccttcttgcatttcttcttggggtcggggggcagaagggaatggagaggaaatgaaggcggattgctggtaagtgaggcaggaaggcagggagtttattatggaatgtcatcggtaagtttccccatgatttgatcccaagctggtgtggagtgaagggtaagctgttggctcaacagatagtgagaatcaaacttagtggagttgtagatcctgtttcctgcagcggacagcaagatgtacaagccgtccactgcaggaatgacgtgctgtaaaagggatgcagtgtcaagtgtagtc

SEQ ID NO: 157760 - DNA, 601 bp, Human
attcccttttttctactgttctctgtctccccccaacccatcagcagtctgagaaatgctatggtggaaaaaaaaaaacaacagccctataaccagtacaaacaaaaagccaagacaaaaaaaaaaaaaaaaatcagaaggggagattttgaggccaggaagccatggcattcactggaaatatatcagtgataaaataacaggctacagggtttattttattttatttttaagtcaataggcctgagtgttggtaaagactagatacccagcaatccttcttgcatttcttcttggggtsggggggcagaagggaatggagaggaaatgaaggcggattgctggtaagtgaggcaggaaggcagggagtttattatggaatgtcatcggtaagtttccccatgatttgatcccaagctggtgtggagtgaagggtaagctgttggctcaacagatagtgagaatcaaacttagtggagttgtagatcctgtttcctgcagcggacagcaagatgtacaagccgtccactgcaggaatgacgtgctgtaaaagggatgcagtgtcaagtgtagtcatggatgggtgggaagaccagacaaa

SEQ ID NO: 157761 - DNA, 601 bp, Human
tcatggatgggtgggaagaccagacaaaggcatccaatgggactgacttacctaaacaaaccagaaggaagtcagaacagtgggaagatctgatagataagcagtattctgcaggcagatgaaggagcaagctttgggcccccaaatcttcaccagtgcatccacattacagaggataatgcctgagggaggggaagatcatctcaggattctggaacactgggccctccctttcttattccaaaaggctggagcagttctgcatgtaggcttctctggaaatggtctaggaaccagctcrtccaggccaggagcacctgatcattctcagagttacgtacatatgcgataagattgcagggaacagtatagttctatagacttaagtgtgaacatagtcctcatttatagtccctagtctcccatggctcacgcagcttggtctttatgtgtttctgaatttagtgctgcagaggcacaatggggtctggtttctggatcttatacagacaagcacttaggtcagctgcagtggatgtcctgcacagacaccgtcgcaactcttgcctggttcctttttgtttttggagatggagtctcg

SEQ ID NO: 157762 - DNA, 601 bp, Human
tttgggcccccaaatcttcaccagtgcatccacattacagaggataatgcctgagggaggggaagatcatctcaggattctggaacactgggccctccctttcttattccaaaaggctggagcagttctgcatgtaggcttctctggaaatggtctaggaaccagctcatccaggccaggagcacctgatcattctcagagttacgtacatatgcgataagattgcagggaacagtatagttctatagacttaagtgtgaacatagtcctcatttatagtccctagtctcccatggctcaygcagcttggtctttatgtgtttctgaatttagtgctgcagaggcacaatggggtctggtttctggatcttatacagacaagcacttaggtcagctgcagtggatgtcctgcacagacaccgtcgcaactcttgcctggttcctttttgtttttggagatggagtctcgctctgtctcccaggctggagtgcagtggcgcgatctcagctcactgcaagctctgcctcccaggttcacgctattctcctgcctcagcctcccaagtagttgggactacaggcacccgccaccacgcccggc

SEQ ID NO: 157763 - DNA, 601 bp, Human
aaggctggagcagttctgcatgtaggcttctctggaaatggtctaggaaccagctcatccaggccaggagcacctgatcattctcagagttacgtacatatgcgataagattgcagggaacagtatagttctatagacttaagtgtgaacatagtcctcatttatagtccctagtctcccatggctcacgcagcttggtctttatgtgtttctgaatttagtgctgcagaggcacaatggggtctggtttctggatcttatacagacaagcacttaggtcagctgcagtggatgtcctgcrcagacaccgtcgcaactcttgcctggttcctttttgtttttggagatggagtctcgctctgtctcccaggctggagtgcagtggcgcgatctcagctcactgcaagctctgcctcccaggttcacgctattctcctgcctcagcctcccaagtagttgggactacaggcacccgccaccacgcccggctaattttttgtatttttagtagagacagggtttcaccgtgttagccagtatggtctcgatctcctgaactcgtgatccacctgcctcggcctcccaaagtgctgggattaca

SEQ ID NO: 157764 - DNA, 601 bp, Human
ggtagcttgtcacatacaacagctgcatttatcatacggttgatcagcttcctgccctcacctacttttctcctccttcatgtggacatgcagagtctctgagaacatttcatcaagtgggttgcctatgcccacattaatacaagatgggaaagggtggaggttatctttgctttttaagttcccatctttttctcccttggtcctctcccacccctacaagttgttggctggtaagcaattgatgctcagaaaaatgatgttcatctgaaatcttaaatgagtggactttttctacctkccctgactttgcaggtgcttcttgaagagccaaggagaaaagaaaacttctgacctcatcacctagtcaataagctgtctgagaaacaaacaaaagagtttagactggctgctaaagctaggaacccagctgatagctttgttttgatgtccttgtaatgtttgcggatcgcagagggtgctatttagagcagggggcatctactgggacagactcactgggaagttgaaacagctagctcaaagtccaagagatgctaaagatagtgaaatacagcccaggaattgagggggagggggt

SEQ ID NO: 157765 - DNA, 601 bp, Human
acttcttaggtgggaagtggacaaggccaaggggcttttgatttccagctactatggctggactcccagtgaggaaggagtcgctgccatggattgcctgggactgggaagactccttttaactgctgtaatgtttctgcatttgtggtttggcctcctgtgagtttgggctccggggcggcacttctgttgttaaaagaacagaaaagaaaacaaaacaaaacaaaaaaccaggactgtcactgttagatgttggttgaggctagaaagaatggattgagttttgaccccctacaccccrgggagtagggaggcctgggaggcacagtggcctgagtttgaattctgactctgcctctttggaaggctctggaaggttaaaggagcttgtgtgttcaaatcttagcctggtacctggcatatactcagcatgtattttttcccctttcctgacaatgttccttgccccgaacacttgaatagtggagagaggaatgtttgcttttcctctccattgaaccaacactcgcccatccactgagcccaagattcaccttaggattgtctgttggactcggctcttttgtgacctaacagtgca

SEQ ID NO: 157766 - DNA, 601 bp, Human
acaaaaaaccaggactgtcactgttagatgttggttgaggctagaaagaatggattgagttttgaccccctacaccccggggagtagggaggcctgggaggcacagtggcctgagtttgaattctgactctgcctctttggaaggctctggaaggttaaaggagcttgtgtgttcaaatcttagcctggtacctggcatatactcagcatgtattttttcccctttcctgacaatgttccttgccccgaacacttgaatagtggagagaggaatgtttgcttttcctctccattgaaccawcactcgcccatccactgagcccaagattcaccttaggattgtctgttggactcggctcttttgtgacctaacagtgcaggggccttgtgctgagctgcacatgctcgctctcgctggtgctccctctctctctctctctctctctgcattatttatagtaaaccatattagaacagagtgttaaagaggaaggatgagtcattcccattgaaaccattgatgacataaataaaagcaaaatgcttactatgtgttttgtgcagtatttaaggccaggttgtgctaatttgaatgctccca

SEQ ID NO: 157767 - DNA, 601 bp, Human
aggctctggaaggttaaaggagcttgtgtgttcaaatcttagcctggtacctggcatatactcagcatgtattttttcccctttcctgacaatgttccttgccccgaacacttgaatagtggagagaggaatgtttgcttttcctctccattgaaccaacactcgcccatccactgagcccaagattcaccttaggattgtctgttggactcggctcttttgtgacctaacagtgcaggggccttgtgctgagctgcacatgctcgctctcgctggtgctccctctctctctctctctctstctgcattatttatagtaaaccatattagaacagagtgttaaagaggaaggatgagtcattcccattgaaaccattgatgacataaataaaagcaaaatgcttactatgtgttttgtgcagtatttaaggccaggttgtgctaatttgaatgctcccaaactggatctgtgaaagcatacatatgtgggaaaaaattcaggtttaactagagggaagttatttattgaaaatccatttcagtatctgctttctcccttctatttacttcagatccatattcatatcatgcttgttgttct

SEQ ID NO: 157768 - DNA, 601 bp, Human
gatctgtgaaagcatacatatgtgggaaaaaattcaggtttaactagagggaagttatttattgaaaatccatttcagtatctgctttctcccttctatttacttcagatccatattcatatcatgcttgttgttctggctaacgagagggactggcttattcactagctaaggtttgtttattttcggaaggttgaggaatagcacagagaggttgtctaagtgtccctgtctccattcctcctcttgccacctgttgaggaaggcactctccacctgctttgcaggcgtgggctctcartgtgtccaagaatcacagtcagagctgaagggcccttggaatcatttattgcagcatgctcatttgggaggagtaagtggaggtccagagaggttctgtgattttccctaggtcacacagcaagctagaggcaaaaccaggaccctcactcccagcccactttaattcttccttcacaagcctgcctgtgactgcccaggtctgttctctgcttctaccaaggggtaggcaagactagaatctgacttgagagcagtttcagatctttgtctgtgagggatgctggggggtttctggcat

SEQ ID NO: 157769 - DNA, 601 bp, Human
ggaatcatttattgcagcatgctcatttgggaggagtaagtggaggtccagagaggttctgtgattttccctaggtcacacagcaagctagaggcaaaaccaggaccctcactcccagcccactttaattcttccttcacaagcctgcctgtgactgcccaggtctgttctctgcttctaccaaggggtaggcaagactagaatctgacttgagagcagtttcagatctttgtctgtgagggatgctggggggtttctggcatggtgacttgcctcctgggacactcattaacctctctgytgctgagcctgagcagactaatgtacatcaactccttaggatttacagacaatgccctatgttgggggttttgagacccaaagattgctaagacatgggacttttccttgaagagcttatactttgagttaaaatatgtatgttgatatctatgacagagaataggaaatggaaagactatgatatatatattcagagttgaaatgacttctgtctggagtgattcattttaaattttaaaaccttgttgagcacttactgtctgctgggcacctgggtaggccctgggaatactgtgat

SEQ ID NO: 157770 - DNA, 601 bp, Human
tgactgcccaggtctgttctctgcttctaccaaggggtaggcaagactagaatctgacttgagagcagtttcagatctttgtctgtgagggatgctggggggtttctggcatggtgacttgcctcctgggacactcattaacctctctgctgctgagcctgagcagactaatgtacatcaactccttaggatttacagacaatgccctatgttgggggttttgagacccaaagattgctaagacatgggacttttccttgaagagcttatactttgagttaaaatatgtatgttgatatctatgacagagaataggaaatggaaagactatgatatatatattcagagttgaaatgacttctgtctggagtgattcattttaaattttaaaaccttgttgagcacttactgtctgctgggcacctgggtaggccctgggaatactgtgatgagcaagatagacaagacgtctaccctcctggggctttcctaatggggaagaaagatccttacttagctagcagtcctgtccgtaactgtgtaagggtgattttgatacatgttgggagcctggatgaagtagcacatgagtaggatatta

SEQ ID NO: 157771 - DNA, 601 bp, Human
aaaatatgtatgttgatatctatgacagagaataggaaatggaaagactatgatatatatattcagagttgaaatgacttctgtctggagtgattcattttaaattttaaaaccttgttgagcacttactgtctgctgggcacctgggtaggccctgggaatactgtgatgagcaagatagacaagacgtctaccctcctggggctttcctaatggggaagaaagatccttacttagctagcagtcctgtccgtaactgtgtaagggtgattttgatacatgttgggagcctggatgaagyagcacatgagtaggatattaaaggataagtaggttttgaagacggggacagaaagaaggaaaattgtggtcagggccaggggagaaaacaaggagtaactttctttggcaggaatgagggtgattcatgctggaatggtaggctggggtcagactgtggtgctataaatgcggggagagagattagagaaggcagcatgaagaatggagagaaaatgagtttgaagttgagcagacccgggttcagattttcatgctgccacttgcaaactgtgtgatgttggccatcaaggactgtgaa

SEQ ID NO: 157772 - DNA, 601 bp, Human
agactatgatatatatattcagagttgaaatgacttctgtctggagtgattcattttaaattttaaaaccttgttgagcacttactgtctgctgggcacctgggtaggccctgggaatactgtgatgagcaagatagacaagacgtctaccctcctggggctttcctaatggggaagaaagatccttacttagctagcagtcctgtccgtaactgtgtaagggtgattttgatacatgttgggagcctggatgaagtagcacatgagtaggatattaaaggataagtaggttttgaagacrgggacagaaagaaggaaaattgtggtcagggccaggggagaaaacaaggagtaactttctttggcaggaatgagggtgattcatgctggaatggtaggctggggtcagactgtggtgctataaatgcggggagagagattagagaaggcagcatgaagaatggagagaaaatgagtttgaagttgagcagacccgggttcagattttcatgctgccacttgcaaactgtgtgatgttggccatcaaggactgtgaactggctgggtgcagtggctcacacctgtcatcccagtgctttgg

SEQ ID NO: 157773 - DNA, 601 bp, Human
ggtaggctggggtcagactgtggtgctataaatgcggggagagagattagagaaggcagcatgaagaatggagagaaaatgagtttgaagttgagcagacccgggttcagattttcatgctgccacttgcaaactgtgtgatgttggccatcaaggactgtgaactggctgggtgcagtggctcacacctgtcatcccagtgctttgggaggccaaggcaggaggattgcgtgaggccagaagtttgagactggcttgggcaatatagcgagacgatctttccaaaaaaaaaaaaaaaaaattaaaaatgcagctgtgcatgcccataatcccagcttctcgggtggctgaagagggaggatggcttgaacttataagttcaaggctgtggtgagctatgatcacgccactgcactccagcctgggcaacaaagtgagaccctatctctatttcaacacaacaacaacaacaacagcaacacacaccatgaactgtagcttcttcattcctacagtgcagttattgtgtgggatagcctgaggatttggggtagtgtacttaacacactctgcacagtgcctgtaacagtgtagttgctca

SEQ ID NO: 157774 - DNA, 601 bp, Human
actgtgaactggctgggtgcagtggctcacacctgtcatcccagtgctttgggaggccaaggcaggaggattgcgtgaggccagaagtttgagactggcttgggcaatatagcgagacgatctttccaaaaaaaaaaaaaaaaaattaaaaatgcagctgtgcatgcccataatcccagcttctcgggtggctgaagagggaggatggcttgaacttataagttcaaggctgtggtgagctatgatcacgccactgcactccagcctgggcaacaaagtgagaccctatctctatttcaamacaacaacaacaacaacagcaacacacaccatgaactgtagcttcttcattcctacagtgcagttattgtgtgggatagcctgaggatttggggtagtgtacttaacacactctgcacagtgcctgtaacagtgtagttgctcaataaatataactgctgtttgttttaactgctgtttctttttggactttatcccgggagagttggagccttggaaggcatttgaaaaggagagtgacgtgactggagtgctccatactgatgtgacatccactaggcatgtgtctgactgccccctg

SEQ ID NO: 157775 - DNA, 601 bp, Human
ggcttgggcaatatagcgagacgatctttccaaaaaaaaaaaaaaaaaattaaaaatgcagctgtgcatgcccataatcccagcttctcgggtggctgaagagggaggatggcttgaacttataagttcaaggctgtggtgagctatgatcacgccactgcactccagcctgggcaacaaagtgagaccctatctctatttcaacacaacaacaacaacaacagcaacacacaccatgaactgtagcttcttcattcctacagtgcagttattgtgtgggatagcctgaggatttggggtmgtgtacttaacacactctgcacagtgcctgtaacagtgtagttgctcaataaatataactgctgtttgttttaactgctgtttctttttggactttatcccgggagagttggagccttggaaggcatttgaaaaggagagtgacgtgactggagtgctccatactgatgtgacatccactaggcatgtgtctgactgccccctgctccttccctgccttcacgagcctgtctgaaaaggagtttagtgcgtgatcatcagctcctaaggagacctctcccctgtatcttgtacctggcac

SEQ ID NO: 157776 - DNA, 601 bp, Human
aggcatgtgtctgactgccccctgctccttccctgccttcacgagcctgtctgaaaaggagtttagtgcgtgatcatcagctcctaaggagacctctcccctgtatcttgtacctggcactctaccaagatttgatgaaaggacatgaaatggacccttgccacctctcggtgggcggggaagctgggagaggggcctggggagagggggtcttcagctgtcaggatcaaaggaagtgacactctgaagctggtctgccggactgttacccgtctctctaactctcttttaatagaaaccsagtctcccctcttgcctccctgatagtgaacagcgacgctatctcccgcgggccagtctcggctgtggtcgtagcactacgcaatgtctgcaaaccgacagtggcatggggagataagggccccaacgttgtgtaacgaggggcatgggctgtttgcccgagtggctcctggcccctgggtaactgctaacctcaacggaggagcgggccggccttggaaacgccgttccagggcccctcgctggttccacggatgcctttttgtggttggataaaggaagctcatgtaggccgcccaca

SEQ ID NO: 157777 - DNA, 601 bp, Human
tgattcttataaccctctctcagatacttccaggatgataaatcttctatcactgtttcatctgatcacatcagggtgattatatttcgtgacataaccaggtggctttaatccgttggtggaagaaccaggctctcacctccattgtttaagatgttatgtttctactaatctgtccactgagtgtctccatcctattgtttccattgcatgctctcaggttatttcctttgttcttggctgtctgattgctcccagaggctgcagttattttattttatttatttcattttttggtggsagtaggggattgatctctctcttgcctttagcttgaatgggtggtcatttccaggcttacacattgctccatgcccactgtaggggtctggcttagagatggtcgggggagagaaggtggtgatttaaaagatttggaggcggtggcttacattgattttagcttatctaaccctttagctagaggctgctcttccctcagagtgtccaactagctgtaacttaaagcaacagagaaatgtatatcatcccttttcttgcattaattagggctgagaaattcattatttagagggataag

SEQ ID NO: 157778 - DNA, 601 bp, Human
ctgtaggggtctggcttagagatggtcgggggagagaaggtggtgatttaaaagatttggaggcggtggcttacattgattttagcttatctaaccctttagctagaggctgctcttccctcagagtgtccaactagctgtaacttaaagcaacagagaaatgtatatcatcccttttcttgcattaattagggctgagaaattcattatttagagggataagagctccggaggaggagggttttttgaactaatgtagagatctgtggccagctgtgtgattctcaggtagcaggtgagsgggtgggggttgatgagaggggtgagaaggagcaggtgccagggtcaggcaggggagggagcccccactccgtgcatcatcccagagccctgttcctccaagcccagattagacacccttctccacgtggggcctcaagttagaaatcctgggaggaggccttattgctcaggatcatctgggaatgttgctttctgggtttaaaatacagtcaatgtttagatgagctgctgttcaggcacatggtctggttagcaaagggttaaatcctgcatcccgtttttagtcatcaagctagct

SEQ ID NO: 157779 - DNA, 601 bp, Human
tgtaaaacagaaatgacagccatatgtgtatgactttgtgtgtgtgtgtatatatatatatcagactgtatgattaaatattatataagtgaggtatgggggagcagaggagaggaattgaattttgaattttgattgaagattcaggagggcttcatggaggaggtagcatttggccaggttttagagaatggctaggctttggacaagtggagacaggaactgccatttggaggtaggagatgagctaatgtgtggcagtgtatgggtgggggcaggtgcctgtatacaaggtagtgtrctggaatggggcgatgggcatggggtaggatgggagatcaagcagggaaagtggattggggccaggtcctagaatgatttgaataccaagctagctttctggacatttgtaaggcgcacttgataggggttggatcattgcgatattattggaagacaaaactggggagggtgtgagaccatgtggctgctcagaatgcagagcccctctgatgtcctcagccttctacgtatttagtgatgggggtggtggtggtaaagagccttgcagacagcctggcttgggtgcttgcttgaagtt

SEQ ID NO: 157780 - DNA, 601 bp, Human
cattacgcagcagtgcaaactcagccctgggcctcagaggagccaggcgtggccaggagagtgggatttggaacggaagtgcttttgtttttggcattcactactcccccacccccactggcacttggattgtccttctttttctccttggtgtctctcatcctgtccagccttcaagacctcctcaagtcaggcttctctgggaagcgctgtctgtctgtcttggtgcttgctggcttcctcttctgtctcctgtgccatctccagtttgcaccatttgagtataagctctgctgcctcrtttgagtttaagttttatccccccagccacaacctaagttccatgaggatagtgattgtggtttatcttctctccctcagctgtctgctgacaccatgctgaatacatagtaggtactcagtaaataatagctaattgagcatttactatggacaaagcactttacttgcattaacacatcccatcctcacaaccacctgtgaggtgaatcctattaaaaggaatacttgggtgctttcagagttattctctccagctttggacttcttgtttcatttgccctgagagctcctcaactct

SEQ ID NO: 157781 - DNA, 601 bp, Human
attttagacattactttcaatggcaaaaactgcaattacttttgcgccaactaatactttcccagactccagtattggctccattgacccctcctgttcctgccaacttctccccctcctcctctggtatttcctggaactccctccctagggtcagtgccatgtggtgcctggaactccctgggatctgtgtttgaatcctgacattgccactttctaagtggcaaacactttggccacctccccctcttcctgagtctgtttcatcatctgcaaaatgctggtagtttctcttctcacrggaaagatggtggttgttcatcgatgtctgttgaaaccgtgaccctctctgctgaatgtagaagaagatgaccttaccagttctcctgtctctccagtgtctttcttgacaatcttgtggtttccacaagcaaccctctgtgggtgatttccagatctctacctctagttgtttttcgttttttgtcttttcttgtgtttcacacattcttttccagtagcctcacgggcacaccagtcctgcaaggatctagaatgtgatgtgtttgagctagttcaacaccttcctctcgaatcgtct

SEQ ID NO: 157782 - DNA, 601 bp, Human
cacaggaaagatggtggttgttcatcgatgtctgttgaaaccgtgaccctctctgctgaatgtagaagaagatgaccttaccagttctcctgtctctccagtgtctttcttgacaatcttgtggtttccacaagcaaccctctgtgggtgatttccagatctctacctctagttgtttttcgttttttgtcttttcttgtgtttcacacattcttttccagtagcctcacgggcacaccagtcctgcaaggatctagaatgtgatgtgtttgagctagttcaacaccttcctctcgaatcktctcctgtgtcctcatgttttgtggtctctgccctcttcccaggcacccaactgcagactttggcatcatctgtggctcctgtcttccctttgccttccatatccaccatttgcctctccagcctacttaaccagatggctgtcctgatttcctcaccagccttcctgcagtgcacccctgcaaggctcatcaccccacttccctgagcagagtagggctctgatggggttgctctcctgctctgaaccctgcagtggctcactatggcctattctagagaagaaacgagagaattctta

SEQ ID NO: 157783 - DNA, 601 bp, Human
tgtggctcctgtcttccctttgccttccatatccaccatttgcctctccagcctacttaaccagatggctgtcctgatttcctcaccagccttcctgcagtgcacccctgcaaggctcatcaccccacttccctgagcagagtagggctctgatggggttgctctcctgctctgaaccctgcagtggctcactatggcctattctagagaagaaacgagagaattcttagcgtggcattcaaagccatccgggatcctagattccagctacattttcactcttcatccctttctctgcatrtttcttagaatgtacacccctgaaggcagggaccatctttttcacatctgtgttacaaccttttagtccactctctagcatatggcaactcagcagatgctgctgttgagtaaactcttatgcttcccttcccatgccatatccttctctggtcatcgcaacagggccaaatctctcatgcttcagtgtaaatgccctctccttgcagcatcctttcctggggcattcttcctccttgcatccagttggaaataatatgtccctccattggagctcccacaccagaagaggtatagataa

SEQ ID NO: 157784 - DNA, 601 bp, Human
tagattccagctacattttcactcttcatccctttctctgcatatttcttagaatgtacacccctgaaggcagggaccatctttttcacatctgtgttacaaccttttagtccactctctagcatatggcaactcagcagatgctgctgttgagtaaactcttatgcttcccttcccatgccatatccttctctggtcatcgcaacagggccaaatctctcatgcttcagtgtaaatgccctctccttgcagcatcctttcctggggcattcttcctccttgcatccagttggaaataatrtgtccctccattggagctcccacaccagaagaggtatagataaagccagatacttctttttttttttttttttttgatacagagtctcactctgttgcccaggctggagtgtagtggcatgaacttggctcactgcagcctctgcctcttgggttcaagtgattcttgtgtctcagcctcccgagtagctgagattacagacatgcgctaccatgcctggctaatttttgtatttttagtagagatgcggtttcaccatgctggccaggctggtccccaactcctcgcctcaagtgatct

SEQ ID NO: 157785 - DNA, 601 bp, Human
cctttcctggggcattcttcctccttgcatccagttggaaataatatgtccctccattggagctcccacaccagaagaggtatagataaagccagatacttctttttttttttttttttttgatacagagtctcactctgttgcccaggctggagtgtagtggcatgaacttggctcactgcagcctctgcctcttgggttcaagtgattcttgtgtctcagcctcccgagtagctgagattacagacatgcgctaccatgcctggctaatttttgtatttttagtagagatgcggtttcrccatgctggccaggctggtccccaactcctcgcctcaagtgatcttcctgccttagcctcccagagtgctaggattacaggtgtgagtcactgtgcccggcctggatcttttattgtttgtatttctgttcatttcttccctaagaaaccccacgtttttgtgggcaggacctggaatcctattcagttatacagccccgcttcgtccactgctccccttcagagtctagtgccctggacatcataggtattcagtacctcttgctggcttaggaacaggaggatgcctgatggccaggg

SEQ ID NO: 157786 - DNA, 601 bp, Human
gcaaggcctggggacgaggactacgaggcctgcagctgggtcctcttttctccctcctcacccccacccagtacccacgtgattgggccacatcccagtaacaagcagtccttgtggaagagccttcatgaagacctttgctgggagtggcgggcagggatctgcggggagcgttgctggttcaagctggggctttcctatggatgatgtcctgtgaagggtagatcctggagggacagacaggtgtctgatctttggcaggcagggatgtctcatttgtacattataggtattcagtatstcttgctggcttaggcttcataatgtctcatttgtacatcatagccttcagtacctcttgctgatttggttaacccagttgttataccacgatattgatttttcatgccattttctttaggaagattggaagatcattgaggatagggactgtgaccttttctttttttctaccccagtacccaacctggcaggtagcacagcgcaatgatccacgatgtttaataggttgaattgtagagggggcctctgattccaaagatgggggcagaatatcagtcctctccagactgcctgggaa

SEQ ID NO: 157787 - DNA, 601 bp, Human
tctaattgatgaagggcatgggccaccccatggattgcaatgctgtggctgtttgggtggcatccagcttctaggggatggtggcaaacttgggtgtgcaggcagtaggaaggaggaggtagcttccagagagagccattgctggggctcaagaagtttctttctgggctcaagcatggttgctagtggtccacacagtgctttcgtgtgaattagaaaaagcacccttgttgtggatggatgtggctcttaactagggtctatcccacagtgagctggttggggctggatctcaaacctstttgcccctcaatcagaggcaggaggtccctggcccaaggggcttccatggttggagtggtcgtcagccgaaagctgttctggtgagatgttttgagctatcagttccaagtttccaaaggccaaggcctctgggatcagtttcactgatccttcaaccagcttatgtgccctgttagcccagatacccctccagagtgcttcgcactgggctgcaggtcactgtggccccacaccatagaagctgggggcctgtctgcatgttctggcatccataaagctgcctgcaaacgtgagaggg

SEQ ID NO: 157788 - DNA, 601 bp, Human
agtgactatcagaatcctctcttctaaagatcagcgatctacagctttcgcaaaacttaaggctgacttgggaatctagacagcccctagtatggtgagtgaccctagagtggtttttaatgaggagatactcacgggagccagcatctcgggggtccccggggggttcatggccaggagcgttgcaagctggtttgtttgtttgtttgttttgagacagggtcttactctgttgctcaggctggagtgcagtggcataatctcggctcactgcaaccttgcttgctctccctggctcaarcaattctcccacattagcctcccaagtagctgggattacaggtgtatgccaccacagcctgctaatttttaagttttttgtagagatgaggtttcactgcattgcctaggctgatcttgaactcctgggctcaaacaatcttccctccttgtcctcttaaagtgctgggattacaggtgtgagccacagcgcgaggccttgtttggtgtttttgtttgtttgtttgtttgttttatggatcattacctataaagtaatttagaatacccactcatttatgatccagccttccctgcattt

SEQ ID NO: 157789 - DNA, 601 bp, Human
tagaaaactgggacctaaccatgttcttctcttcagtcttatggtcattgctactttgaaggcagaaaggataaaagtagcatagggagtggtttaccataactgcaagtaaataccaagcatgtgcgagcctgtagacattgcctgctattggggaaagacggagttagctggggaaatacatcagtcttcactcccagcacccaagatgtaaacatttcttactcttcctggatcaggctatctctgctttgccttttctttcacctacctccttctttcatggcaggaagggaaaggraagtacccccaagcagccagcagtcagcactggggcctctagggaagagtggattggtgttgttttgctgtggtttgctgtgcgttttccagaatctctcttggatgactatcagattcagtgaagggatggacctgcaggaagctgagagataggagatcctgtggcctgggaacccagaggcctgggccctgggaacaactcaccacaggactcagcctgcgaaataggaaacatcattgtagcttctgcatcatgttttccatgttccactggaaaaccatctgttaaatggacata

SEQ ID NO: 157790 - DNA, 601 bp, Human
caggctatctctgctttgccttttctttcacctacctccttctttcatggcaggaagggaaagggaagtacccccaagcagccagcagtcagcactggggcctctagggaagagtggattggtgttgttttgctgtggtttgctgtgcgttttccagaatctctcttggatgactatcagattcagtgaagggatggacctgcaggaagctgagagataggagatcctgtggcctgggaacccagaggcctgggccctgggaacaactcaccacaggactcagcctgcgaaataggaaacrtcattgtagcttctgcatcatgttttccatgttccactggaaaaccatctgttaaatggacatagaccaattcttgcttttcttctttctggtaccaaagagaacggtggtgtctcttgtcatctagatgttcttgtaggggcaccagagtcattgcaaccattttgagtaaagattgagtccactggggcatcagaaggggagtgtgtcattgctgttgttaccacacaggccgtggtacttgccttttcctgacccattttgcagagcaggccagctacttaacccctcgccacccac

SEQ ID NO: 157791 - DNA, 601 bp, Human
acccctcgccacccactcacctgtggaaggcacatttgcaaaacaatagaccagttggtaatttggcacttgttaggtagacatagtggtacattgaggaagttcctcctgttaactaacctagtttttcttgctgtaatccgaatatacttctctgattttttgaaaaagcctgtgagtggagcctggctcgacagcccaaaacgctgaattaattctgtctctctctctctctcttttttttttttgagacgtggagtctcgctctgtcacccaggctggaatgcgctggcacgatctyggctcactgcaacttccacctcctgggtccaagcaattctcctgcctcagcctcccaagtagctgggactacaggcattgccactacgcccagctaatttttgtatttttaatagagacggggtttcgccgtgttggccaggctggtctcaaactcctgatctcaggtgatccaccagccttggcatcccaaaatgctgggactgcaggaatgagccaccgcgcccgacccaattctcttgagtgacatgctgagtggggctgctttttggtggaggtaacaaaaaaagagttgaggtat

SEQ ID NO: 157792 - DNA, 601 bp, Human
acttgggaaggggcaggatgcagatggagataaatgcacatacatatagatgcccctgagaaagacagctctggaacctgctagagtgatcccagccacgaggcgccagggccctggtgatcgctctgattttctaggtgagataagggaatggaatcacagagggatcagtgacttgcgcaaggtcacgctgtcaacaagggtcatagccagaatgagatccacttcctaggtgcatgggaggtataagcctcacctgccttgaagcctgcttgtgttttgtttctgatgatatccagaraagaactttttagaccttgtaatgtgcattataaaacacttcgcatttagatctaacttcactccctcaagtctcagattaagactgtgttcttgtgttccgtcctccccagtgatgaaatgcttggttgtctagagtgaacaaatccaacaactctgccaaggggttctctgtgcaggtcacttttcaaagggatcttttctcccttggtgtctctcctccaaagagcatgatttctgagcctaccaaagtgattactgtgctaaaatttccaccctagaagaactattgtgtagctgt

SEQ ID NO: 157793 - DNA, 601 bp, Human
ttttagaccttgtaatgtgcattataaaacacttcgcatttagatctaacttcactccctcaagtctcagattaagactgtgttcttgtgttccgtcctccccagtgatgaaatgcttggttgtctagagtgaacaaatccaacaactctgccaaggggttctctgtgcaggtcacttttcaaagggatcttttctcccttggtgtctctcctccaaagagcatgatttctgagcctaccaaagtgattactgtgctaaaatttccaccctagaagaactattgtgtagctgtgagaagcractaaaagattattttcttttcccagggtgggtgcgcaacattgactttttctcaatgtgtgatgtggagatatatgcatcttgggaggagatgcataatatgtgtctgattctataatatgttggtaaaaatgaccttggtgatgaataattttcaaagagaaacaaagctgggctgagaagagtggagcttggattggagatgatgtgcagtctacattttttgttttctgttttatttgaggagagagattttcaaattaatttggagtgaacagaaaatacagtggaaatttggga

SEQ ID NO: 157794 - DNA, 601 bp, Human
ctgtgcaggtcacttttcaaagggatcttttctcccttggtgtctctcctccaaagagcatgatttctgagcctaccaaagtgattactgtgctaaaatttccaccctagaagaactattgtgtagctgtgagaagcgactaaaagattattttcttttcccagggtgggtgcgcaacattgactttttctcaatgtgtgatgtggagatatatgcatcttgggaggagatgcataatatgtgtctgattctataatatgttggtaaaaatgaccttggtgatgaataattttcaaagagraacaaagctgggctgagaagagtggagcttggattggagatgatgtgcagtctacattttttgttttctgttttatttgaggagagagattttcaaattaatttggagtgaacagaaaatacagtggaaatttgggacttttttttttttaaagcctgtgttccttatagtgggatcccattttcacctcctctcctcccacctttattatgatgattattatcattattattattagtttgtactcaggaagcattgtaaaagatgctgggagggtttgaatgctgcttgtgagaggaa

SEQ ID NO: 157795 - DNA, 601 bp, Human
ttttattctcaaggtacctgctgctttctggcttatggaagatacatctctgcatgtctaatctttcttagagtgtcatgtgatagcagagatgctgtcttctgtctcactcgtctttgaattctatactgtctttagcggtgtataacaaccatttataagtacataagtgatttaccagacaggtcaattcttatccattctttcctcctatacgttcttctgggacattcttcaaaagagatatttggggtcttgaagtccaacacttcgggtatttggcataaattaggttgaggamactggttggaattttgggaagaatgaaggggagagaaccaaggaagaaggaattccagagctggtagcgttgatttcagagtattctcaatctaaaaaccctgtaatcatgacctattcccaaaggtgagttcatggcagcttattcaacagatatttattgagtacctgacaagtgttttgctttgagtgaggcactgtagggcaagtaggagtaagtaaagatctttgcccttctgaagctgttctccagtttgggatttagaaaatttgttcaggaagagggcttaaaaaatagaga

SEQ ID NO: 157796 - DNA, 601 bp, Human
agtattctcaatctaaaaaccctgtaatcatgacctattcccaaaggtgagttcatggcagcttattcaacagatatttattgagtacctgacaagtgttttgctttgagtgaggcactgtagggcaagtaggagtaagtaaagatctttgcccttctgaagctgttctccagtttgggatttagaaaatttgttcaggaagagggcttaaaaaatagagacattctgtaaatgacctttctttgaaatcccttattctactttgactactgctgtctattcctcttcctaaatgaagctrgtggaggctttttcaaaatcaattctatggaggttattggggcagatataagttagtcatctaatcatccagttagtcctgaactgaaacctggaattcattcttttatttttatattcatttattcaattagtcaacacaaagttgcacaatcaatattagctaaattagccaagtttaaatccatggtaaggcgaaactcccacttcttttctattagaaagctgatttcttagtggcagtaatgggtggtagggataaaaactcatcccatggctgtcttagaaccttcaggtgatt

SEQ ID NO: 157797 - DNA, 601 bp, Human
gtgaggcactgtagggcaagtaggagtaagtaaagatctttgcccttctgaagctgttctccagtttgggatttagaaaatttgttcaggaagagggcttaaaaaatagagacattctgtaaatgacctttctttgaaatcccttattctactttgactactgctgtctattcctcttcctaaatgaagctagtggaggctttttcaaaatcaattctatggaggttattggggcagatataagttagtcatctaatcatccagttagtcctgaactgaaacctggaattcattcttttayttttatattcatttattcaattagtcaacacaaagttgcacaatcaatattagctaaattagccaagtttaaatccatggtaaggcgaaactcccacttcttttctattagaaagctgatttcttagtggcagtaatgggtggtagggataaaaactcatcccatggctgtcttagaaccttcaggtgattcagtagaaatagtgctgtttctatctccatgatttattttcgggaaataagtagagatactggggtccagaataacttgatattctagttgacaatgatttctggagaa

SEQ ID NO: 157798 - DNA, 601 bp, Human
tcactcccagcttcaaggtttgctgaaattgggggcagaaagctctagaagaaataagaatatgggtacatgtgtttaagtatgcttaatggacagcctcggcgaagtgaggggtgatggggacattaatagctggggagccactgacctgaaatggtacagtcttcctgtagttactgacggatgaaatcatgactttatgaaattttaatccttgggtatagaggcacaactgactttattactggaccccaggtgtgtgtgtctgaaatgagtgttttgaatctaactgcatatttgattactttctaaaatttaggcgttgctgaacttctcctcatgcttaggttggaatctgaccttctgtaaccctcagctcagaagatggatatttgggcatttgaaaacctctcagggcctcctaagtaggtgattgagcattgcgtcattgcatcgtcatcttctttttttaaagctaggtcctgtccactggggagcagctttgaactcactttattcaactcatcaaatatttactgaatacctactagatgtgtttggctctgttggagaagtaatggtgaggcgtaatgcgttccta

SEQ ID NO: 157799 - DNA, 601 bp, Human
gagcacctgtatcgtgtcagtctctgagttaggttctttaaaagacagagttttgttaatcctcacaattttgtggtattgttaaatcagagtacagatgataaatggaagctcagagtggttaagcgctttacctggtgtcacacagctagcaagcggtggagcgaggatcttgactaatactgcagcttttcccacttccatggcacgctgcctccttctagcattcagtgaggaaagctctcaccgctgggagttgttcactctagactgagcgcctttcttagagaagggatttctyggagaaagattgcagagtcttctctaatgattacaagaaggacagagtcctggtggacacagttggagggtcttgtctggaggcagtggaatgagccaggtggcctcttggagctttttcaggagggaaatctgtaagggagaggagatgggactctaccttcgatcacttggaaggcggttggctgaggccagagagtatctttccataccttcccaggagccaccccaaactcctcaggcctttgtttctgaggttctctcagaaccactccaggcagagcccacaacacatcctgat

SEQ ID NO: 157800 - DNA, 601 bp, Human
tgtttcatccctttccttcagtccaccctggatctcatcctttaaagccgaatcctctttcctgaagaggaaagaaggaaatcctgactccttagatcactatcctgtgagatgaaagttgctcttctaatttgtcccattttcttcaactcttcttcccctctgtccctgctccacactcaccactggcaaccactgagtctgagaccctcccgcacactttctctgcgtgtcttcggatgctgtatttacttaagctgaatacagggtctaaagggtggcagtgtcacattagggcccrtcgagggagcagagggcctttgtcagagtctgcaggttgtggggatggtgactggcctggagtcggggtgaagcaatgggaactgtagaagaaaggggaaggagagcagggcagcgtggatgctggacctgtctcctcttcagccttttggactctgtgttccctctcctgggaagccatacagccttggccgcttcaagatggtgcctccttgggcagcacctactctggagtcggtctgcatagttaaatggttggaaaaaagactggagagccaatcagggatgctcacttgcagtt

SEQ ID NO: 157801 - DNA, 601 bp, Human
ttaattacttccttacgggttctgtctccaaataacagtcacattcgagatcagcgcttcaacatattaattgtagaggggcacaattcagtccatagtagtcatgtaggataacatggctgctgggatccactcttgggccttgggaatagaatggatctcattggctcccccagaaggagaccagtgcagatgaaaaggctgaataccctgccaagacaatgtcctgtgccagattagaatctaaacctcattgtcgaactcaaacacattgcacttggggtgaatagtcctgctgtgygtgtgtgtatccatatacgagatgtgtgcatatatacacatatgtacaggcatatatatacatatatgtatgtatgcacatgtctgtctgtgtgtatgtaattagagaggactttctggaaaaggaatgtttgagggtggccttgggttcctgttggctgtgaacacactcctaatgagctgccctgtgtctcagtttacacgtggtatttgaaattgagtctaaattcccatttcttgtactttctgaggagcagtcaagaaagagccagatttacagtttgccagtctcttagctcta

SEQ ID NO: 157802 - DNA, 601 bp, Human
gaataccctgccaagacaatgtcctgtgccagattagaatctaaacctcattgtcgaactcaaacacattgcacttggggtgaatagtcctgctgtgcgtgtgtgtatccatatacgagatgtgtgcatatatacacatatgtacaggcatatatatacatatatgtatgtatgcacatgtctgtctgtgtgtatgtaattagagaggactttctggaaaaggaatgtttgagggtggccttgggttcctgttggctgtgaacacactcctaatgagctgccctgtgtctcagtttacacrtggtatttgaaattgagtctaaattcccatttcttgtactttctgaggagcagtcaagaaagagccagatttacagtttgccagtctcttagctctatgttccaaaggaattaagtcactcttcttgacagtggccttaaaatagggttttaataaaatgaaaagaggagcagtggagccacccacccctgtcacctgtggctaaatggatatacgggcgccaggctgctacgggagccttttgtggtgtcacctccagtgccagtgggatacgtgccgcaacagagaccagatgatgaa

SEQ ID NO: 157803 - DNA, 601 bp, Human
atacacatatgtacaggcatatatatacatatatgtatgtatgcacatgtctgtctgtgtgtatgtaattagagaggactttctggaaaaggaatgtttgagggtggccttgggttcctgttggctgtgaacacactcctaatgagctgccctgtgtctcagtttacacgtggtatttgaaattgagtctaaattcccatttcttgtactttctgaggagcagtcaagaaagagccagatttacagtttgccagtctcttagctctatgttccaaaggaattaagtcactcttcttgacartggccttaaaatagggttttaataaaatgaaaagaggagcagtggagccacccacccctgtcacctgtggctaaatggatatacgggcgccaggctgctacgggagccttttgtggtgtcacctccagtgccagtgggatacgtgccgcaacagagaccagatgatgaatatatttttaaacttggaacccatgaaccacttattatttctgaattaggaatcaaaacatatgaataatttcaacagggtttcagcagatgtattctgcttttaaggtcactctgctttgcggagattgg

SEQ ID NO: 157804 - DNA, 601 bp, Human
actttctaatgatgcagggtttattctgcttaccgcgggtcagagacaatctgacgatgacagacttagaactgctttcagaatgtgtaaacatgttcattggtttgaatggctctaagtgagtcttcggcagaatctgtctggttttggtatgatatatgtatcttggggaaaatggggagattttgcatgctctgtatctttgactttctttgagaaaatacttgggagtcaatgagttcacataccaaaaaagccttatgcagaatctaactgggtgtgtgtgaaagggggagcggcrgaagttaggaagactgaaggacctcctttatgacagtaaaaaaaaaatcttttaaacttaatttcaaatgaaactttaatgtcaaatgttctggaactgtcacacatcattttgttaacctatacctattaggtataggtataggtctagaatgctgtacaagacgggttaaatgaagtctgtgtgtgtctggtgaatgcatatgagtagttagagatacaccattcaatacttgatttatttgtgcaggttacctatcatggtaacctctggcaggggctcattatttcatataaacta

SEQ ID NO: 157805 - DNA, 601 bp, Human
ctgagatagaagtgtatttatagcctggtgtaagtacaatcagaaggttcctataaaactctgttattactgcagtacaaagttagaaatgcttgaggtttcggcttcttggctcttccatgcggcaatgaatattttatgggaaaggaaatacttagtgtctgactctttttatagtgcagctactcacagtgctggtaaccttccaaatctcgccaaaatcaaaattgctgcctgtccatctctctactcccttcttcacaaaattgactggtgtcctgcctcgctgaggtgtccagaytctcttggtggacgggtccatttacaaaatgtggggggtgcagttttcaatcctagtgaatgccctaaaccagaggcgttggctcctccccagccctgccccacccctggcaccttgtggtgctggtcagccccagcagggcctgctggcagagtgcccactggatcttccattgaaggtctccatctgccttttctgccatgcccctttcctgcatgcccactagccgctgagtggaggtggcccaacctctccaaagttcactctgatcttggaattcaaaaagcaacaggtgagttt

SEQ ID NO: 157806 - DNA, 601 bp, Human
cttctgctctgcccctggtgtttgtcttggcgccaaagtaggtaaagggaaaaaatgatttgcaaacctctggcagctttggtttgatctcccaactctggttgcattgctgccaaacagagctgtattttcacatgacagcttcgtactgggccttttctttctttctttcttttttcttttgtactttttggtatccaaacttggtggtagcagaaggcaaggtggggaatagagagcttttggtatcacaggcttagaagctcatttgtctcttaagatgtgagggtaaggaaagggytagttattatttttgataaatgggaatggggtcagccaatggcttactggagaaactagatatagccctttatacttaggactgaccacacagttgaaattaattagcacagttgaagtaattagcacagttaaaatttagggttcctatgaccatgaagttgatgggtgggagataggtaaggctcgaagaactgaaaatcctcaaatgtgctaaaagcttcattattggtccttattcatattttaactcaccctcctcatctgtgaagtcattttttttaaacaatgaaaatggata

SEQ ID NO: 157807 - DNA, 601 bp, Human
gatgtgagggtaaggaaagggctagttattatttttgataaatgggaatggggtcagccaatggcttactggagaaactagatatagccctttatacttaggactgaccacacagttgaaattaattagcacagttgaagtaattagcacagttaaaatttagggttcctatgaccatgaagttgatgggtgggagataggtaaggctcgaagaactgaaaatcctcaaatgtgctaaaagcttcattattggtccttattcatattttaactcaccctcctcatctgtgaagtcattttktttaaacaatgaaaatggataaaagaaatggaaccagagagagaagcaagagagaaaaactttaattaagtgcctattgtatgatagacactgctgtgttcttttaaataaatacctttcagattaattccaaagctaagatttagcaattccctggttctgggattatttggccctaggatcagataagccaccagtattcactgagtcattcagactccagagttgcgccagatcccatggaagatgcaagaatgcatataggctgtagttccttctcttgggggttgagatcacaca

SEQ ID NO: 157808 - DNA, 601 bp, Human
tcttctggaagggagatgaagttacctgcctactctattacagtttatttcattaaggttgaccatgcccttttttttgggcagagggaataggatggattctctggagaaaacagtgtagcaaggcaatggagaaatgtccacactggagtaaggggctttctgggacctggatggagtctccttcctcccctagggaataggacagaggtgggaaaggtgctgcctgactgctctgtgcacatctgcatgttggtgatgagtgtggccagccccatgctgtgcatcggtgagaggaccrctcaggcaggtgttgctgtgctggcagcttcttaggaaggcaaggagcaaggcgtgggctgtggggcccttggggcagagcctgtcatggagtgggatgaaagggtgcacgggacctgttggcagccccagcggccaggctctgttcccaagctggagagagaggcaagtggtgagggagggcaggaggaccagtcatgggtttaatgcaaaatgacagttacgggggttgccattttagagtaaaacaggccatgtgactgaggagcaggtagcattcatattattcatatttcgagct

SEQ ID NO: 157809 - DNA, 601 bp, Human
aggggctttctgggacctggatggagtctccttcctcccctagggaataggacagaggtgggaaaggtgctgcctgactgctctgtgcacatctgcatgttggtgatgagtgtggccagccccatgctgtgcatcggtgagaggaccgctcaggcaggtgttgctgtgctggcagcttcttaggaaggcaaggagcaaggcgtgggctgtggggcccttggggcagagcctgtcatggagtgggatgaaagggtgcacgggacctgttggcagccccagcggccaggctctgttcccaagytggagagagaggcaagtggtgagggagggcaggaggaccagtcatgggtttaatgcaaaatgacagttacgggggttgccattttagagtaaaacaggccatgtgactgaggagcaggtagcattcatattattcatatttcgagcttggtagatgtagaattttgcagtggaggccaggagaggatgtgagagctgcaggacagaggcataggtttttggaggtggttgtggtgttccccgatggcaatcaacttcacggagagaagaggttattttctacttaggttgcctggagcct

SEQ ID NO: 157810 - DNA, 601 bp, Human
gtggccagccccatgctgtgcatcggtgagaggaccgctcaggcaggtgttgctgtgctggcagcttcttaggaaggcaaggagcaaggcgtgggctgtggggcccttggggcagagcctgtcatggagtgggatgaaagggtgcacgggacctgttggcagccccagcggccaggctctgttcccaagctggagagagaggcaagtggtgagggagggcaggaggaccagtcatgggtttaatgcaaaatgacagttacgggggttgccattttagagtaaaacaggccatgtgactgargagcaggtagcattcatattattcatatttcgagcttggtagatgtagaattttgcagtggaggccaggagaggatgtgagagctgcaggacagaggcataggtttttggaggtggttgtggtgttccccgatggcaatcaacttcacggagagaagaggttattttctacttaggttgcctggagcctacattccaaacttttagtcctcttcatctagcactaagttttgcatctcccttattcctgtcatacattattagtgtgcactgttttaaagtcttttacatacatatgtct

SEQ ID NO: 157811 - DNA, 601 bp, Human
agtgctcacatatgtcttgtacagatttgcttctaattcttcttcatcaccaatatcatctaaacgttgttggtattacagttatcacttttcgtgtctctgacatcattttagcacctgagatgatgttatgctcttggcttgtgctcaggaaatgcttaatgaatgactgaaaaggcacttgggcttctggaggtgacttggtgacaaatgctcagtgtgatgttgtctttgtggcagatgctcattatgaggttgtctttgcctatattcaggcttggcaggttcttgtggcagcggyggttaaggattaaggcattgtgtggagtatggtgggggctgcagccgacaaccttcctgttgcctaaaaactttttctccttcccacccccttccccagtagctctatgccctgccaagtctgtgcacaagccttgaaatgacaaagtaccctttagttaattgcacaacggattgcctagagttaaaagttctgatttatatgactatagctctaactgctcaataacacaggcctgtaatctaccttcatttcaaacagaacggtgatttatagggcagcatgccgctttagctcaga

SEQ ID NO: 157812 - DNA, 601 bp, Human
acagttatcacttttcgtgtctctgacatcattttagcacctgagatgatgttatgctcttggcttgtgctcaggaaatgcttaatgaatgactgaaaaggcacttgggcttctggaggtgacttggtgacaaatgctcagtgtgatgttgtctttgtggcagatgctcattatgaggttgtctttgcctatattcaggcttggcaggttcttgtggcagcggtggttaaggattaaggcattgtgtggagtatggtgggggctgcagccgacaaccttcctgttgcctaaaaactttttytccttcccacccccttccccagtagctctatgccctgccaagtctgtgcacaagccttgaaatgacaaagtaccctttagttaattgcacaacggattgcctagagttaaaagttctgatttatatgactatagctctaactgctcaataacacaggcctgtaatctaccttcatttcaaacagaacggtgatttatagggcagcatgccgctttagctcagaaatgaggtgttcaacatatgcgctgttgacataaatttggaatttatcgctgttgtcaaaactgcctgttggacaaa

SEQ ID NO: 157813 - DNA, 601 bp, Human
tatgccctgccaagtctgtgcacaagccttgaaatgacaaagtaccctttagttaattgcacaacggattgcctagagttaaaagttctgatttatatgactatagctctaactgctcaataacacaggcctgtaatctaccttcatttcaaacagaacggtgatttatagggcagcatgccgctttagctcagaaatgaggtgttcaacatatgcgctgttgacataaatttggaatttatcgctgttgtcaaaactgcctgttggacaaaggtgggtattaaggcaataaatggctcasaatagttttctgtcacatttcctaaccattgtattcagtctatttgagggaaaaatatatacttaaaagtaatcaaatgtccaaaatccatgcatcttgttttgaatggtgggaagggaggatgtagggaggatggaggagcatggggccttggggagggggagctggggggattgtggaggagaaagcttttcatgaagttatggcccgtttaaaaaagattccactctgcctcctcccccatccccatcgggaggtgggctttcctttctcatttacaaaaacggggaggaaaaatga

SEQ ID NO: 157814 - DNA, 601 bp, Human
tgccaccaacccctgtccttttcacacaaagctccctgttgggaaaactcataattttcacaccacacagccttgactggccattgctggaattactgtctctttgaagtgctttctactggggcatttacaggccgttttaattacctgcagcttgcaaagggccttgctctgtcccagcctttgtttgtttgttctttgcaaggagtctgtgtagaaaggaatacggctgacttcttttacaaaaaagaaaagggggtagaaaaagaagtttggggagcccttaacagagcttcttgcygcagcctgctgtgggacaccatgcccactctaacaaggccaggaagagaggctctcgcccttggctgtcttctcagcaggttccagcaccgtgggtcccactcctggagcttgcctgggatatttttgttcatgcgtttatgttttaattattattaagtatattttcaagctttctaccagagacagcaagggctgtcaaatcatgtttccctcactgttgaccaaatcaaagctggcttcagttgagctgggatccctcttatattttcaactaaatctgttcaaggaaggtgcatta

SEQ ID NO: 157815 - DNA, 601 bp, Human
ttggctgtcttctcagcaggttccagcaccgtgggtcccactcctggagcttgcctgggatatttttgttcatgcgtttatgttttaattattattaagtatattttcaagctttctaccagagacagcaagggctgtcaaatcatgtttccctcactgttgaccaaatcaaagctggcttcagttgagctgggatccctcttatattttcaactaaatctgttcaaggaaggtgcattattaaattattgagtttagacgtgggctggagggtaggggttgaaatcacatatgtgaaagkagtgcccactttgagctgtctggtgtttttctttccttttcttcatttttcacttgattctctaaaaggaactacatataaatagcattctttggggtttctgttaaatatgagtgtagcatgtcatgtctgcagatgaagatgctagtttaccaaagaagcctcagaactgtatcccctttttggggggcttttacagcagaggaaatctttattcatttattcacttagtccaaaaatgtattgagaaattggaaacctcatacattgctgatgggaatgtaaaatggtatagctgct

SEQ ID NO: 157816 - DNA, 601 bp, Human
cgataagatcatcctatagcccagtgcacaaatgaaaaacttttgttcttggtgaaatttgttgatagagatatttcaaataaatgacttaggagaacttagtattttaaaacaaaggaccggttacgtagcagccagaagcccaggcctcttggttctccacagccacgaagatccctccttgagcagttgctgcagggagattagtgtgcccctttgtcatttctgacattgtgttttagcactcgcaggcagccttatctgcaagtgctgtattcggtgtggtcatggccccagggartgccattgtccttcctcatattttcaaggctcaggacagttccctccactcttcagtcagctccagattggccttcatccaggccaaggcaggatgcataggatgcatggctggctggctggcttgcttccttccttccttccttccttccttccttccttccttccttccttccttcctccttccctccctccctccctccctctctctctctctctctctgtctgtctgtccctctctctctctctctctctctctctttctttctttctttctttctttctttctttctttctttct

SEQ ID NO: 157817 - DNA, 601 bp, Human
ttatttaaaaaagaaagtacaggagaatggactgaatatggaaacactctgcagtctccctggaagttgctttggggaggaaatactgatagcctcataactttgcattcatcccttcctcttaaaattagagcacagaatgccgttgactatttcacctttcctttgtcatttgaattaaaggtaaatggacgttgaaagtgtgtttttgacttaaaggtctaaggaggaagagtgagcccattgctaaagtacataagctttccctttactcaattctgtgtctacttggaaaggtgawtgaggctagggcaaggttctcttatcaccgagcttaagagtcggttgcttttgcggctgagagcattggcagagctccataaagggacctaccttatgctgtccccacatggggcccaaggctgcatgtcagcaccaactgcccaggtcctgctcgacaggaccaggaagtttgcatggtggctgggtaagtagatgatcttggagagtgttggttctcatgggggcggcagactttttggagaagagaggatcatttaggtcatggctgggatcttacagaatctcccgtctgcttcct

SEQ ID NO: 157818 - DNA, 601 bp, Human
actgaatatggaaacactctgcagtctccctggaagttgctttggggaggaaatactgatagcctcataactttgcattcatcccttcctcttaaaattagagcacagaatgccgttgactatttcacctttcctttgtcatttgaattaaaggtaaatggacgttgaaagtgtgtttttgacttaaaggtctaaggaggaagagtgagcccattgctaaagtacataagctttccctttactcaattctgtgtctacttggaaaggtgaatgaggctagggcaaggttctcttatcaccragcttaagagtcggttgcttttgcggctgagagcattggcagagctccataaagggacctaccttatgctgtccccacatggggcccaaggctgcatgtcagcaccaactgcccaggtcctgctcgacaggaccaggaagtttgcatggtggctgggtaagtagatgatcttggagagtgttggttctcatgggggcggcagactttttggagaagagaggatcatttaggtcatggctgggatcttacagaatctcccgtctgcttcctatctattctgagtacccctctgaagcactg

SEQ ID NO: 157819 - DNA, 601 bp, Human
aggaagtttgcatggtggctgggtaagtagatgatcttggagagtgttggttctcatgggggcggcagactttttggagaagagaggatcatttaggtcatggctgggatcttacagaatctcccgtctgcttcctatctattctgagtacccctctgaagcactgagaaggtcaaattgatggtcataggatcagaaaggggtggtcataggatcaaaaagcccaaagcatcggggtgacttttgcactgatgaggtcaaattgatggtcatagaatcagaaagcaaaaacccaaagcaytggggtgacttttgcatgtggagtggcctcatacctacaatagggtgagttgggaaggattatgtactgcattgatgtggtctgagtgttggttcagaggatggctcagttaggctgaaaacaaggacaacatcgtcttataaatgcccttacaggatggatttcccactttatttttcctcattcaaaggcgggagagagcagtgggtagtccagctgtggagccctcccattcacttttcccaattacaggtcctagttccccatgctggtctttccagcaaaactcacaggtcagac

SEQ ID NO: 157820 - DNA, 601 bp, Human
gatcaatcccttttgaacgaggcctcatgaggaaaggaaatataggcacggtctctgccattatggagtttgctctctaaaccagatgaaatctttatgagtttgcagactcacaatagcacagaaatggttcaaatgatgagcttgtatcttgctagcttcgttttactagtgagagttgtttggttgaaaaccagtgagaaggaatgaattcttctcttcagtttcttgtcaaaaggttcagatttgtttagcttgaatttctcataatgattcagctttcttgagacaatagaaactkgttagaggttaatgtgttctttgtctttttggacataagtgaaaatctgttacaagcaaggtgagtttacctaatgagccactaagagttggggagaacttgagtctgttccccaggaatggagagtgaggacctgaagcatatggggcaatggaatctccactgagtataggatggagatgcgtgggctgtactagaactgggttactttcaaaatggtgttcagcaaggtagcttcttctcagagaagagtgtgtgaaaactctaccaccaactaaggcagtgtgcagaaaggtgcaa

SEQ ID NO: 157821 - DNA, 601 bp, Human
gatggccacgtgcaattaaaccttatgaaaagacaggactagattgggaagatgtgagtgtgtggtaaggaagaaggaggtggatagaatttccattttgatctaaatgctttgcagttgcataatgtggtgatggtagtggtgggaggttgtggtctaaagagggaatagactgtgagttcacacaaatttgcacttttgctccaggaatcggttggaattctatttccacattggctgttctgcagactgtgccatggagagtctactggtagccaggtacctcaaatgcactgaaatyctccaccattattttctttgaattaggagaagccttcacttttccacattcttcctttggtagatgaacaagaattaaagatacgagcaaaccagtgctgggctctgttgaactcccaggcctgtgaggttgttccctttttctctaatgaactttatgtgctttgcccaggtctctctgccagtgaggaaagacctttgcccttgtacttcatgtgaaatcacatggacaccatattaatctctggtaacctgtatggggcactgagttagtgggtcagttgcagggcagtgaccttac

SEQ ID NO: 157822 - DNA, 601 bp, Human
gatagaatttccattttgatctaaatgctttgcagttgcataatgtggtgatggtagtggtgggaggttgtggtctaaagagggaatagactgtgagttcacacaaatttgcacttttgctccaggaatcggttggaattctatttccacattggctgttctgcagactgtgccatggagagtctactggtagccaggtacctcaaatgcactgaaatcctccaccattattttctttgaattaggagaagccttcacttttccacattcttcctttggtagatgaacaagaattaaagayacgagcaaaccagtgctgggctctgttgaactcccaggcctgtgaggttgttccctttttctctaatgaactttatgtgctttgcccaggtctctctgccagtgaggaaagacctttgcccttgtacttcatgtgaaatcacatggacaccatattaatctctggtaacctgtatggggcactgagttagtgggtcagttgcagggcagtgaccttaccctgaggattagacaggataggacatccgggtctctgaaggcagcgaaatgcatgacaacagagtcattccgaggacaggct

SEQ ID NO: 157823 - DNA, 601 bp, Human
ttcacttttccacattcttcctttggtagatgaacaagaattaaagatacgagcaaaccagtgctgggctctgttgaactcccaggcctgtgaggttgttccctttttctctaatgaactttatgtgctttgcccaggtctctctgccagtgaggaaagacctttgcccttgtacttcatgtgaaatcacatggacaccatattaatctctggtaacctgtatggggcactgagttagtgggtcagttgcagggcagtgaccttaccctgaggattagacaggataggacatccgggtctytgaaggcagcgaaatgcatgacaacagagtcattccgaggacaggctggtggtaacttctggaagtttctttcactgaaagataaatagcaagtgagtaaaggaggaaactcaggccacttggattagattttaaatgactagattgctgggattgggtctagaggtttgcttgggcaatcctagcctggctgcctcagtgtcagaggacatcacaatgcaccgtaagaagtgggacgtggctcagggagaataatagtgccccttagaggaccacctggtaggctaggtaaaaggatat

SEQ ID NO: 157824 - DNA, 601 bp, Human
tgcccttggaaaggatgatttgatgattaggcaggtgcgatgagtcatagtagtgttttaattcacccttgcagatagctcacggcctatattctgatatttctattcttttttttctttctgttgtccggcatactcctcacctccgtgctgagaggtcttgaaaataaaatagcacaaagggcttagtgaggctagaccatttcctgaattgtttggccactgttaaacaggccctgggggcctctggagtgacctggacttgttggggagttggggtcagagggctgggctggtggckctgggtcttcttacagattccagtagtggtttacatgttctgatgcctgaaaacagaactaggtgatgttttagaagagacattgaattagatgatgtgaggttttcctgctgctctattttgaaggttccatgaagaaagctgacagtgagaatgggtgtgccaggtctgtagagtagacccattttacagatgaccaagggttcaagcagcccacagcctggaagaacagtagttgctccagaaccctgggcgggggaggcgggggggaggcgagcattttttttcaaaaggcgcagg

SEQ ID NO: 157825 - DNA, 601 bp, Human
cctggacttgttggggagttggggtcagagggctgggctggtggctctgggtcttcttacagattccagtagtggtttacatgttctgatgcctgaaaacagaactaggtgatgttttagaagagacattgaattagatgatgtgaggttttcctgctgctctattttgaaggttccatgaagaaagctgacagtgagaatgggtgtgccaggtctgtagagtagacccattttacagatgaccaagggttcaagcagcccacagcctggaagaacagtagttgctccagaaccctgggcrggggaggcgggggggaggcgagcattttttttcaaaaggcgcaggctgtggagaagtgagtccaggatctgggtaggggttgtggttgcccccctaaatgttgctgcccttgcactggcacattcctgctgttttcttctgctcagcggagccgaacggctctcacttcctggctagctctgtgtgctgccccaccccctcttggcgagcattgcctgtgtttgttattgtagtcctggctccaggccaggcctggctgcgagccagacttgtgggtacagtatgtacagtgagtgctga

SEQ ID NO: 157826 - DNA, 601 bp, Human
gagttggggtcagagggctgggctggtggctctgggtcttcttacagattccagtagtggtttacatgttctgatgcctgaaaacagaactaggtgatgttttagaagagacattgaattagatgatgtgaggttttcctgctgctctattttgaaggttccatgaagaaagctgacagtgagaatgggtgtgccaggtctgtagagtagacccattttacagatgaccaagggttcaagcagcccacagcctggaagaacagtagttgctccagaaccctgggcgggggaggcgggggggaggcgagcattttttttcaaaaggcgcaggctgtggagaagtgagtccaggatctgggtaggggttgtggttgcccccctaaatgttgctgcccttgcactggcacattcctgctgttttcttctgctcagcggagccgaacggctctcacttcctggctagctctgtgtgctgccccaccccctcttggcgagcattgcctgtgtttgttattgtagtcctggctccaggccaggcctggctgcgagccagacttgtgggtacagtatgtacagtgagtgctgagccaagtttgtcatc

SEQ ID NO: 157827 - DNA, 601 bp, Human
ggggtcagagggctgggctggtggctctgggtcttcttacagattccagtagtggtttacatgttctgatgcctgaaaacagaactaggtgatgttttagaagagacattgaattagatgatgtgaggttttcctgctgctctattttgaaggttccatgaagaaagctgacagtgagaatgggtgtgccaggtctgtagagtagacccattttacagatgaccaagggttcaagcagcccacagcctggaagaacagtagttgctccagaaccctgggcgggggaggcgggggggaggcragcattttttttcaaaaggcgcaggctgtggagaagtgagtccaggatctgggtaggggttgtggttgcccccctaaatgttgctgcccttgcactggcacattcctgctgttttcttctgctcagcggagccgaacggctctcacttcctggctagctctgtgtgctgccccaccccctcttggcgagcattgcctgtgtttgttattgtagtcctggctccaggccaggcctggctgcgagccagacttgtgggtacagtatgtacagtgagtgctgagccaagtttgtcatcataca

SEQ ID NO: 157828 - DNA, 601 bp, Human
taggtgatgttttagaagagacattgaattagatgatgtgaggttttcctgctgctctattttgaaggttccatgaagaaagctgacagtgagaatgggtgtgccaggtctgtagagtagacccattttacagatgaccaagggttcaagcagcccacagcctggaagaacagtagttgctccagaaccctgggcgggggaggcgggggggaggcgagcattttttttcaaaaggcgcaggctgtggagaagtgagtccaggatctgggtaggggttgtggttgcccccctaaatgttgcygcccttgcactggcacattcctgctgttttcttctgctcagcggagccgaacggctctcacttcctggctagctctgtgtgctgccccaccccctcttggcgagcattgcctgtgtttgttattgtagtcctggctccaggccaggcctggctgcgagccagacttgtgggtacagtatgtacagtgagtgctgagccaagtttgtcatcatacaccattaattttttttttctaatctggttggggtggggtgaaggaggaggcaagaaaagagtttctccgatgcttgagaataggcc

SEQ ID NO: 157829 - DNA, 601 bp, Human
ttttcctgctgctctattttgaaggttccatgaagaaagctgacagtgagaatgggtgtgccaggtctgtagagtagacccattttacagatgaccaagggttcaagcagcccacagcctggaagaacagtagttgctccagaaccctgggcgggggaggcgggggggaggcgagcattttttttcaaaaggcgcaggctgtggagaagtgagtccaggatctgggtaggggttgtggttgcccccctaaatgttgctgcccttgcactggcacattcctgctgttttcttctgctcagcrgagccgaacggctctcacttcctggctagctctgtgtgctgccccaccccctcttggcgagcattgcctgtgtttgttattgtagtcctggctccaggccaggcctggctgcgagccagacttgtgggtacagtatgtacagtgagtgctgagccaagtttgtcatcatacaccattaattttttttttctaatctggttggggtggggtgaaggaggaggcaagaaaagagtttctccgatgcttgagaataggccgcattgaattccgcagagatgtcatttctgaaaggcagacgga

SEQ ID NO: 157830 - DNA, 601 bp, Human
gctcagcggagccgaacggctctcacttcctggctagctctgtgtgctgccccaccccctcttggcgagcattgcctgtgtttgttattgtagtcctggctccaggccaggcctggctgcgagccagacttgtgggtacagtatgtacagtgagtgctgagccaagtttgtcatcatacaccattaattttttttttctaatctggttggggtggggtgaaggaggaggcaagaaaagagtttctccgatgcttgagaataggccgcattgaattccgcagagatgtcatttctgaaaggsagacggagctccggcttgttcttccttcgcagtttttcctcctttctctccctgtcgtcctcctctcctcttcatttccctatcacgcgaaatcagcctgcaggagatcgacaatgcaggtcttattttcagtgactagaatactaaatttacactgctaaatcagttttcattgtgttgaaattgacaatttgtttaattagaagtttgccctgtaggaggcccttctgagagacagtgccttccctttttctctctcccttactttctgttttaagggtttttaaaagagcctaaatg

SEQ ID NO: 157831 - DNA, 601 bp, Human
ggttttgctttttagctcctgttttggctgggatccgaaaccctgctgctgattcacagccagagtatttttcccctttacctgatgaaatatactgattttccagcccagatggggtgtttttggttttgttgtgtgggttgtttttgttttttttggtttttgttttttggccagggattttgtttacagcaagtatcaggttccatgatggtgctgggtgcgatgctggccccagggcagataaatcccccacgtaactgccaccttagtgctgcggttttgcgtgcctgggtccccyggtcctagtcaggccagctgaaccgagaaagttgggaaagttcattgcaggtcatggttttaaacagtgttttcaccagttctctcccaccccttcacctacagcccctgtgtgaagagggggttcacatgtccctgcccccaaatacacatgtctctgtctccatatggtgccttagcaggggttggggaagctcgttccatctacccctctggatcccagcatctcctcccaccccgcaaatcccccatcccaatttattctataaatttgtttccacattatgtctatccatttaca

SEQ ID NO: 157832 - DNA, 601 bp, Human
tgccttgctggtccttgttattgtctgaggatgaatagatatggggttattggggagggatatttacgtgggatcaacctgataatggcaatgccatttctgatttccagggccttttcgtcttcccttggcttcgcagacacacaccctgccggaagcgttcttaggaggcctggccgtgctttctcttgccctcagccccattccctagccctctaaccaggctgggcctgggtatctgtatccagggctgtgcctgaggggccccaccctgctttgggcatccatcacgctactgcgscccttactttcagtgctcttgtccaggtctctgtggtggcaggtatttatttttcagctcttctcttctccttctatttctccccaatctgctttcatctcacttcatctctttgtccctgtcctttgtgtctgtgtcagcctcggccttttcttgacactcctgtgtattttctgtcttccttcttatgtcttcatctgtctttgtctccatctgtcttcgttggtcttttctctgtctctctctttctctgtctttgtctctgtctctgtctctccctgcctccctgcctccctgtcc

SEQ ID NO: 157833 - DNA, 601 bp, Human
ctcctagaaatcggggacacagtcctaatcagaacaccatgtgtgcatgtgtgtgtttgtgtgtccaagcatgggaacaaaaagagattgagaagaagcatttacatgaaatactcaaatttgttcctttgctgtaatgggcccgcacagaccattaccttgaagatttaaaaactaaatgagctcatcatatcgagtgacttctaccgacattcatgcttgattgcaaagcctgctttacctttgaatttcaacttcattgtttgttattaattctcagatggtggtggtgtgtttctaycttttggattcagccatgaaaatgttgattttgtgtgatggatgtgaacatttctcaacaagaccccactgaagaaccttttcattttaaaaatagccccatgacctttggggctcagactggagtttccgaggaatccagtgggctgaggcaaggcttgggttgactttggagggggcagaagtttgcatttttttgtctaataatttgagtttcatatgaatgattctgtgctccgtgcaatactatgcattttcataactgtctctttcactttgggtaaaggaagggagggaaaaa

SEQ ID NO: 157834 - DNA, 601 bp, Human
tttacatgaaatactcaaatttgttcctttgctgtaatgggcccgcacagaccattaccttgaagatttaaaaactaaatgagctcatcatatcgagtgacttctaccgacattcatgcttgattgcaaagcctgctttacctttgaatttcaacttcattgtttgttattaattctcagatggtggtggtgtgtttctaccttttggattcagccatgaaaatgttgattttgtgtgatggatgtgaacatttctcaacaagaccccactgaagaaccttttcattttaaaaatagcccyatgacctttggggctcagactggagtttccgaggaatccagtgggctgaggcaaggcttgggttgactttggagggggcagaagtttgcatttttttgtctaataatttgagtttcatatgaatgattctgtgctccgtgcaatactatgcattttcataactgtctctttcactttgggtaaaggaagggagggaaaaaataacagcagcagcattctgtgggcaaaggaagaaaacaagagaatggggcagagaacaggctaaatttaaaattgtaattggctgacttccactggctt

SEQ ID NO: 157835 - DNA, 601 bp, Human
tctgtgctccgtgcaatactatgcattttcataactgtctctttcactttgggtaaaggaagggagggaaaaaataacagcagcagcattctgtgggcaaaggaagaaaacaagagaatggggcagagaacaggctaaatttaaaattgtaattggctgacttccactggcttgcgggtgttttaatgactcataataacttcatttaaaaccagctgagcagaaaatagattggagaggagcctcgggccattatggatttgtggtttttttttttttgttttttttttttttttttttttgacaagcttggttttcagcagccaggaaggctctcagagagggcttggctgtgttttctctctctctctctctctctgagggttggtggtctgcccaggagagattgtatagaaaccagggcgagtttttttgtttttttttttttttaaattctccctctaccccttgcttttttttttttaactgattaaaaatagatgccttgaggtattattttagcatcagtaggatttttttcacctttgatgtggtaaatggaacataaataaaattgtttttgaaattactgaattaatta

SEQ ID NO: 157836 - DNA, 601 bp, Human
agtgagcaggcatgcggatgggcacatggtaaggaacagacctgaggtgctgcctgcttccctccagccccaggagtcagcaatctggatgagaagacaaggatggaaggcggggaccttgtcagtagtgtgctctgttgcatcctcacagcgggacacatagcaggctctcaggaaatatctgttgaagaagtgaagggctcaggatgcatggtttggctgcaggaaggagagaaagacatttattgaaacttgctgtgttccaggcacagtgctatgtgttctgcatatctgaactcartctttcttcaactttggaagacagatatgctgattccgttttgcagatgaggacagtaaagagttaacttgcctaagatcataaagctagaaagtagcagagctggacttcaatctccctctctttctctctccttccaccctgtgtcttgcttttctattatagtatagcatgctgctatacctagccctggcctcgtgctgtttgagtgcctaaatgcctgcttctctgtttgtagagctaaccaatctcaaactggggagctgagaccaggaaggccctgtgcccaagggtcctggg

SEQ ID NO: 157837 - DNA, 601 bp, Human
tgggcctccctgacctttcagattatgtccagtgaagctggaccacttgacatgaggctggttgtgtccattctctgacagcctcatcttccccaggcacgcgctggggatgctggagctttctctggggagcgaaacatcagccaaatgggaaccagatggtgaaggttgagcagcagagaaacctcgatgactactctgggtcacacgtgtggccctcttttgcaggaaatcgtttgtgaagtcattcatcagttagcaactgaacctagggccagtggtgtgcaaagcttggcagggyggacagaggggttgaagccagtgtccttgtctgcaagaagctggtggtctggctgagagggtgacacgagccccctggcaagagaaggcgttgagcaaggctgggtgtgctcattgtgaccgcaagaggaaagactgagtgctgcaggcatttagagtggggagaagctcctaagaaccaggggaatgaggagagcttcgggaaggaggttcatgggattttgatgaggtctttgctgctggagtatccagaaggagtgctgtggtgggagtggcctacctttctggacaagaggaagca

SEQ ID NO: 157838 - DNA, 601 bp, Human
gtgggtcaggtggtggggcctctttcccagctgtcaccaagagtggaatcacagtggaagcacatccgtacccgtatatgtgtattaatgactttaaaggaactgacaactctggagtctctaggagggatgcctaggcctaaaatttacgtactcagccccaagataattgaatttacctgctgttctgggagaaggagtccaatctgggcagtgagtaaagggcagactataaggggcacaagaagagggacatggggaagagcagaggcctttacagccgagagtgaggatctgctcracaagccttgattaactaggatgctcagagaagatgtaatcaaaggactttttggtgaactgaaggttaaccaggaaaccttgtctatatcggcctttgtcgtttgctatcattcatcaatgtgagagtccatttttctactttcagtgaatgcaactgattgtctttttatgatagaacatcttgcttgcttagaagtcaaaaggagaatgcctaagaagggagttaagcatggaggtatatgcctagagttttattataagtcactctagaagatcgtttgtacgttttccttcctac

SEQ ID NO: 157839 - DNA, 601 bp, Human
gggcgtggtggcatgagcctcctagcatctctctccaatgccacttgcaactgtctttgtagtgtgtatgtgtgtattttgtttctaagataaaacatctctaggtaatatttcaacaaatgaaagaaataaagccttttagaaggctcctgatgctgtcacaaatgtgataatcattgcactcttcaagaaaccaattggcagagctctgtatgcaagttatctgctgacaattggctgtaagctgtacaagccctgtagatgagagcttctcttttcctggaaactccaccaggaagcmgtgccatagaccccaaagacatccaggtcaagctgcagggaagaggcagggttcagtaggcatagaaggctgtctaagctgggcccgtgctcccatcacaggcagtttagtggagaacctgggctggatgttgacagaactgagatgttagctcagctacccactagctaaatcaggagcgttagcagcttaactctctgagccttggtttcttcacctgttaaagagatgatgatacatccttcctatcctaaaagcaggacttcaaagttgcacaacagcagtgacaccactcactca

SEQ ID NO: 157840 - DNA, 601 bp, Human
atatttatgtggggtcctgtatcattagttcattcaccctcccatcttgtagtgagtgaggccgaactctgaggatctttccccacagccttgtcaaccacagctacccttgaaccatatcctggacctatcaatggggctggttgttttcctttcagccaggatttgctcacctgctttcccttttccctcttccctgaatctgtgtatcttccagaaactctggttctggatcagctttttgttttgttgacaaaggagaaagagcaagagagagagctagagagagagagagagagaaccttcaagctcctctctgggagtacacatctccttgagggaaagaacacacagtgccggcctttggaattggcagccagtgtgctgttctccgtctgataagaggtactgtaaataaaactgtacaccatggcctgttgtaaaatgccctgcgtctgtactcattgttctgacagcttatgctttttttgggtctgctgttttggtacactctgtacttccttatgtaagcaggcgtgcagatctcatcagaacattcaagatgtttattttaaaatctcaaggaattttgaaaaaaagg

SEQ ID NO: 157841 - DNA, 601 bp, Human
gtctgacccaaatgttgagttcttaaccacactgcactgcctcctgaggtataaatggcaccaaggacctctgctatccacagaatgttttgtgattgacaaggagttttgtattcacttatgtctattatcctgtttgctcctcacagcagcctcagggaggcagacagataggcttatgcccattttacagattgggaaatcagttcatcaaggtgtgatgactagtgtgatgcccacagctgtgagtggccaagttaggcgtgggatctcgtgcctgcacctctagatcctgctattkttctcggtttgcttggatctgtgattgctgtggttagcaagggtctagcgcactttatcttctgctattctccctctgctatttaatttctttcccgcaatctatcccttaacttcccccagccccgcatctcccacctccatgtcactccatcccgtgcagctggcctccttgctcctcttgccttgcctggcgagggtgttctcacgtggtggccttgctctatgcagatgtcagtgcatcagcaagggcctccctgactacgctgtgtaaaagaacagcccctggcactctctgttt

SEQ ID NO: 157842 - DNA, 601 bp, Human
aacaggcagagactgtcttattgattaacagatgaggcctctattatcgatcaaagcttggcgaggaaatttatcacttttaatttcagggctgccaaatatttctgcctctgagccagccattacagagaccatttaaaggcacaagcctcctcaggagagaggattttgtctgtctcgctcggctccgctcacgtgtccatggaactgcctgtctttgctctcaccctggagagctgggggggaagtcagagcctgtccgggtgggcgtgggagtactggggcttcgtgagtgggggcwagcaatgggagctgacgtttgtgttatccacgtgtaaggagggacctggcccagagtcactgaggacaggggctttcacatgctcagctcagtgtcgtgacttcagcgaggtgggggtggagtggcgggactttgaaggcaagcagatgtggtcaggcttgggccgaggcagccgcctttactgatcatgtgtgcttatctgtcttcatcttcctctgcacttgtctgatggtacacatccggccctttatttcctacctggcctccttcctttctctctgcttctcagtcattaaagcg

SEQ ID NO: 157843 - DNA, 601 bp, Human
gctcctctagcccacagtgatggctgttttctaagaaccctccgcgccacatcccttggaagcctgtggcatggtgggcttctcgccgattggagtgccctccccttcccagctggtgcttccctcctcgggcctttgcttcccctttctcctttagggagctgtgagagcggatagaacccaaggaagaaatacaattaaaatcagattccttacagatccacagaaaatcattgatggctgatgatttgggactgggggcagtttctaattgtgagggagctgtgacttcatccagccscagctttcccatccaggcccactctgctcttggaggtgctttctgcatttccagtgtaaatggatgaaaggtagtcttggctgctacccctgtgaacacatgtcatgactgctttgctgtcactgggggctagaagttttcttggctctttcttcaaagctctcttaagccgtgtaccaggtgcttggcctgaggatgccctgtggcgtgaagggacacccagaggtcaccatgggattctccctgcctccaggtgaaattcaaccccagccacctaaggcaaatgacaatatttatttt

SEQ ID NO: 157844 - DNA, 601 bp, Human
acccacttatccagccagtcgactcacatttattgagcacctactagagtatatcctgctcatcagtagaagataggtgtcagtgagatagagaaagtcgatacccccagaggaccccacattctagacctcctctagggtcctcatattcttcactgcaagaagcattcattggtattgaagtctgtgctggaacagcttgtatttggagttacattccttcagtatgtgctgattctccaaggcagaggttttcaaatttctagaaaagtagtggagtcatttttccaaccccaaagcyctgatgtgtaaaataggtaaattgaattttcattcagagatgggagctcagaccccacccatggagtcttatccacaaaacatctttgcagatggaaccccagggaggccgaagggtacggggattactctgaaatcaggctctgaaatcaggctgcctgtgtttgaattcacctttactatgtcaaccactgtgtggcattgggcaaagtgcttaacctctctgagcttgaatttactcatctgctacctggaggtaatgctagcatgtactataaatggtggttgttgggacaaacca

SEQ ID NO: 157845 - DNA, 601 bp, Human
ggacaaaccatacatactaagcatttagtgtcatgcctggcatatagtcaagcctcaggaaatctgaggtgatttgaaacagcactgtgggctacaaatttgtgtaacaagtagttctggctcgtacgaggctccaatacaaaactaaaacacaggcatatttaaagaagagctaagatgaccagacacagtggctcacacctggaatcccccagcactttgggagaccaaggtgggaggatcgcttgagcccaggagctcaagaccaacctgggaaacacagtgagacctcatctctttcaaataaataaataaataaaataaaataaaataaacaaaaaaacagaattagtcaggcatggtggcgtgcacctgttgtcccagctactcaggaggctgaggtgggaggatcgcttgaaactaggaggttgaggctgccattaagctatgactgcaccactgtactccagccttggtgacagacagagaccctatctcaaaaacaatgacaacaacaacaaagcgctaagacgtgttgaaaggaacagagtgcagtggcagattggaaaggacagaagagtaagggacttgagtgcttgat

SEQ ID NO: 157846 - DNA, 601 bp, Human
tgagacctcatctctttaaaataaataaataaataaaataaaataaaataaacaaaaaaacagaattagtcaggcatggtggcgtgcacctgttgtcccagctactcaggaggctgaggtgggaggatcgcttgaaactaggaggttgaggctgccattaagctatgactgcaccactgtactccagccttggtgacagacagagaccctatctcaaaaacaatgacaacaacaacaaagcgctaagacgtgttgaaaggaacagagtgcagtggcagattggaaaggacagaagagtaasggacttgagtgcttgatgtccacaaactgtggccttgaaaatgaagtgggattcgaacagatggaagaatgggactgagcattgctcaggcacagagactctgggaaggtaagtggtgcccagagagggccggtgaggacagcttacctatggaggtgggtggctaactgggacaggttatggaaggccttgaagccaagtagaggaatttagaatcagtacacattgggaggcgttgtatcttcttgagtaagaacgtgtgaggaatcaggtggctgtagaggaacctgcatctgttga

SEQ ID NO: 157847 - DNA, 601 bp, Human
gcagatgcagctgtgcacaagacgacacagtccctcctccagggagcttacggtgtggtgagagagaaagacagggccataggcatttaaaatggagcacataaagggccgagagctggaacatatcaggtgctatgggagcataaaggagcattgcctcacctacagttgggggcccgggtattgaagttgatgtatgaatgacgaacaggagctccaactgcaccatagcagccagagaagcatgggagaatgtcagaggcagaggacatgcagaagaatatgcacaggcctagcaataggaagaacacggttcctccaggcagcccgcgtggttcagtgtagctggagaaaagagagcaagagtgaggtgtgagagacgaagcaggaaagaggagcacacccagaaatgctttgtgagtcacagtaaggagtttggaccttgttctccaggcacaggggagccattcaggggttttaaatggtcagatgcaggtggcagttgggggacagacgatgagtttagttttggacacactgagtcagaggtccccatggacatccaggttgaggtatgtcagcaattcttacattcccataa

SEQ ID NO: 157848 - DNA, 601 bp, Human
ctgtgcacaagacgacacagtccctcctccagggagcttacggtgtggtgagagagaaagacagggccataggcatttaaaatggagcacataaagggccgagagctggaacatatcaggtgctatgggagcataaaggagcattgcctcacctacagttgggggcccgggtattgaagttgatgtatgaatgacgaacaggagctccaactgcaccatagcagccagagaagcatgggagaatgtcagaggcagaggacatgcagaagaatatgcacaggcctagcaatgggaagaacayggttcctccaggcagcccgcgtggttcagtgtagctggagaaaagagagcaagagtgaggtgtgagagacgaagcaggaaagaggagcacacccagaaatgctttgtgagtcacagtaaggagtttggaccttgttctccaggcacaggggagccattcaggggttttaaatggtcagatgcaggtggcagttgggggacagacgatgagtttagttttggacacactgagtcagaggtccccatggacatccaggttgaggtatgtcagcaattcttacattcccataaagtacagttt

SEQ ID NO: 157849 - DNA, 601 bp, Human
gtgcacaagacgacacagtccctcctccagggagcttacggtgtggtgagagagaaagacagggccataggcatttaaaatggagcacataaagggccgagagctggaacatatcaggtgctatgggagcataaaggagcattgcctcacctacagttgggggcccgggtattgaagttgatgtatgaatgacgaacaggagctccaactgcaccatagcagccagagaagcatgggagaatgtcagaggcagaggacatgcagaagaatatgcacaggcctagcaatgggaagaacacgsttcctccaggcagcccgcgtggttcagtgtagctggagaaaagagagcaagagtgaggtgtgagagacgaagcaggaaagaggagcacacccagaaatgctttgtgagtcacagtaaggagtttggaccttgttctccaggcacaggggagccattcaggggttttaaatggtcagatgcaggtggcagttgggggacagacgatgagtttagttttggacacactgagtcagaggtccccatggacatccaggttgaggtatgtcagcaattcttacattcccataaagtacagtttag

SEQ ID NO: 157850 - DNA, 601 bp, Human
gttggtatcatttttctcctgtcccccccatcacctggagctaggtcttcagatcctccttcttcttgaggtatctaacttggaacccatttccgtttatcttggttgttctgattttgtttctccttctctctagaagagccctagacaagggcattcagaattcagttgggtgaatgctcacctcttggaggagggtctgagccatggatgatccctcactcaggatttttgcgggtgtccagtccccttccctagtgtctacctgcacagttgtggcccaggacctccccgctcaccrgtggactattgctctagtggtaactgcctctcctttctttcagcgggtgccaaagcctttgtctgtgatcagtgcggtgcacagttttcgaaggaggatgccctggagacacacaggcagacccatactggtgagttgacttggattcctgttctccaggttttccacagtgttggtagcacatggacatgaactgtctgggtggcaacctctttttagcaaatgtgacatccagtaatttcctgggcgagctgtgagtaggatgggcttctgccacgttcagctactcttgtctgtgtg

SEQ ID NO: 157851 - DNA, 601 bp, Human
ctagtggtaactgcctctcctttctttcagcgggtgccaaagcctttgtctgtgatcagtgcggtgcacagttttcgaaggaggatgccctggagacacacaggcagacccatactggtgagttgacttggattcctgttctccaggttttccacagtgttggtagcacatggacatgaactgtctgggtggcaacctctttttagcaaatgtgacatccagtaatttcctgggcgagctgtgagtaggatgggcttctgccacgttcagctactcttgtctgtgtggctggcccagcagragtttacaagtatgacatggccccatgagaatggctgtcctagattaggccaagatctgtctctaaccagccactgagagctcatgttcttggaggtatctagtatgctcttgttgaggccttagtctgtgttgttatcaaaacatcttcttcccttggtcaggaaatctctcacacccatctgatgaaactgaaaccctcgtgtggccacagttggctggtcctccctctgcgagagctgagacattgtctaaaatcagcgtgtacgcaggatgcatttgaacaatattaactcacgat

SEQ ID NO: 157852 - DNA, 601 bp, Human
atcaaattaaataatgggcaaaggttctgaacagacatgtctccaaagatagacaaatagccaatgagcacatgaaaaagatgctcaactgcattcaccatcagagagatgcaaatcaaaaccacagtgagatactgcttcacacccactacaatgtggctacaataaaaaatacagatagttacaagtgttatcaaagatgtggaaaaaccagaactctcatgggagtgtaaaatggtgtagccactttggaaaacattctggcaattcctcaagaggttagctgaggcaggcagatcaygaggtcaggagatcgagaccatcctggccaacatggtgaaaccccgtctctactaaaaaaatagaaaaattagctgggcgtggtggcatgtgcttgtaatctcagctacttgggaggctgaggcaggagaatcacttgaaccagggagtcggaagttgcagtgagctgagattgagccactgcactccagcctggcgtcagagtgagaccccgtctcaaaaaaaaaaaaaaaaggttaaacacagaattatcatacgatgcagcagttcttcttttaggtatacagccaagagaagtgag

SEQ ID NO: 157853 - DNA, 601 bp, Human
tgagcacatgaaaaagatgctcaactgcattcaccatcagagagatgcaaatcaaaaccacagtgagatactgcttcacacccactacaatgtggctacaataaaaaatacagatagttacaagtgttatcaaagatgtggaaaaaccagaactctcatgggagtgtaaaatggtgtagccactttggaaaacattctggcaattcctcaagaggttagctgaggcaggcagatcatgaggtcaggagatcgagaccatcctggccaacatggtgaaaccccgtctctactaaaaaaatasaaaaattagctgggcgtggtggcatgtgcttgtaatctcagctacttgggaggctgaggcaggagaatcacttgaaccagggagtcggaagttgcagtgagctgagattgagccactgcactccagcctggcgtcagagtgagaccccgtctcaaaaaaaaaaaaaaaaggttaaacacagaattatcatacgatgcagcagttcttcttttaggtatacagccaagagaagtgagaatatatgttcacacaagaacctgtacgtgaatgtttatagcagcattattcataatagccaaa

SEQ ID NO: 157854 - DNA, 601 bp, Human
ccagaactctcatgggagtgtaaaatggtgtagccactttggaaaacattctggcaattcctcaagaggttagctgaggcaggcagatcatgaggtcaggagatcgagaccatcctggccaacatggtgaaaccccgtctctactaaaaaaatagaaaaattagctgggcgtggtggcatgtgcttgtaatctcagctacttgggaggctgaggcaggagaatcacttgaaccagggagtcggaagttgcagtgagctgagattgagccactgcactccagcctggcgtcagagtgagacyccgtctcaaaaaaaaaaaaaaaaggttaaacacagaattatcatacgatgcagcagttcttcttttaggtatacagccaagagaagtgagaatatatgttcacacaagaacctgtacgtgaatgtttatagcagcattattcataatagccaaaaaatggaaacaacccaatgtctatcaactggtgaatggataaacaaagtgtggtatattcataccatggtatactatttggccttaaaaaggaatgaagtactgatacatactacaacacagatgaacttgaacatgctccatgaa

SEQ ID NO: 157855 - DNA, 601 bp, Human
aatggtgtagccactttggaaaacattctggcaattcctcaagaggttagctgaggcaggcagatcatgaggtcaggagatcgagaccatcctggccaacatggtgaaaccccgtctctactaaaaaaatagaaaaattagctgggcgtggtggcatgtgcttgtaatctcagctacttgggaggctgaggcaggagaatcacttgaaccagggagtcggaagttgcagtgagctgagattgagccactgcactccagcctggcgtcagagtgagaccccgtctcaaaaaaaaaaaaaaaaggttaaacacagaattatcatacgatgcagcagttcttcttttaggtatacagccaagagaagtgagaatatatgttcacacaagaacctgtacgtgaatgtttatagcagcattattcataatagccaaaaaatggaaacaacccaatgtctatcaactggtgaatggataaacaaagtgtggtatattcataccatggtatactatttggccttaaaaaggaatgaagtactgatacatactacaacacagatgaacttgaacatgctccatgaaagaagccagatgcaaaatgattc

SEQ ID NO: 157856 - DNA, 601 bp, Human
ggaaaacattctggcaattcctcaagaggttagctgaggcaggcagatcatgaggtcaggagatcgagaccatcctggccaacatggtgaaaccccgtctctactaaaaaaatagaaaaattagctgggcgtggtggcatgtgcttgtaatctcagctacttgggaggctgaggcaggagaatcacttgaaccagggagtcggaagttgcagtgagctgagattgagccactgcactccagcctggcgtcagagtgagaccccgtctcaaaaaaaaaaaaaaaaggttaaacacagaattrtcatacgatgcagcagttcttcttttaggtatacagccaagagaagtgagaatatatgttcacacaagaacctgtacgtgaatgtttatagcagcattattcataatagccaaaaaatggaaacaacccaatgtctatcaactggtgaatggataaacaaagtgtggtatattcataccatggtatactatttggccttaaaaaggaatgaagtactgatacatactacaacacagatgaacttgaacatgctccatgaaagaagccagatgcaaaatgattctgttcatgtaaaatatc

SEQ ID NO: 157857 - DNA, 601 bp, Human
aaacaaagtgtggtatattcataccatggtatactatttggccttaaaaaggaatgaagtactgatacatactacaacacagatgaacttgaacatgctccatgaaagaagccagatgcaaaatgattctgttcatgtaaaatatctagaataggcaaatctatagagacagaaagtaaattagtaggtgccaggggctggggaagttgcgaggaaattgagagcgactgccgatggagctggagtttcttcatggagtgatgaaaatgttctaaaattgattgtggtgatgactgcacascttcgaatactgaggctcctcgacttacaatgggactgtgtcctgataaacccatcataagtagaaaagataataaactgaaaatgcatttaatccaactaacctactgaacatcatagcttagcctagcctaccttaaatgtgctcagaacacttacattagccaacagttgggtaaaatcatctaatataaaacctattttataataaaattgttgaagatctcatggaatttattatatcctgtacatgacttcaaaactgtgatggtttcccacaattataaacttgaaaaatcct

SEQ ID NO: 157858 - DNA, 601 bp, Human
atgaaagaagccagatgcaaaatgattctgttcatgtaaaatatctagaataggcaaatctatagagacagaaagtaaattagtaggtgccaggggctggggaagttgcgaggaaattgagagcgactgccgatggagctggagtttcttcatggagtgatgaaaatgttctaaaattgattgtggtgatgactgcacagcttcgaatactgaggctcctcgacttacaatgggactgtgtcctgataaacccatcataagtagaaaagataataaactgaaaatgcatttaatccaactracctactgaacatcatagcttagcctagcctaccttaaatgtgctcagaacacttacattagccaacagttgggtaaaatcatctaatataaaacctattttataataaaattgttgaagatctcatggaatttattatatcctgtacatgacttcaaaactgtgatggtttcccacaattataaacttgaaaaatcctaagtcggggaccattctgtgtattagttgaactgtacactttaaaagacatgaattttatattaaatggtatgtgtattaggtctctgaaaagcggcatgg

SEQ ID NO: 157859 - DNA, 601 bp, Human
aaagtaaattagtaggtgccaggggctggggaagttgcgaggaaattgagagcgactgccgatggagctggagtttcttcatggagtgatgaaaatgttctaaaattgattgtggtgatgactgcacagcttcgaatactgaggctcctcgacttacaatgggactgtgtcctgataaacccatcataagtagaaaagataataaactgaaaatgcatttaatccaactaacctactgaacatcatagcttagcctagcctaccttaaatgtgctcagaacacttacattagccaacagtygggtaaaatcatctaatataaaacctattttataataaaattgttgaagatctcatggaatttattatatcctgtacatgacttcaaaactgtgatggtttcccacaattataaacttgaaaaatcctaagtcggggaccattctgtgtattagttgaactgtacactttaaaagacatgaattttatattaaatggtatgtgtattaggtctctgaaaagcggcatgggtgtgtacatgtatataaatgagctctgccagtgtcaggaagagtcactggcatcactcatgccacctctc

SEQ ID NO: 157860 - DNA, 601 bp, Human
atggagtgatgaaaatgttctaaaattgattgtggtgatgactgcacagcttcgaatactgaggctcctcgacttacaatgggactgtgtcctgataaacccatcataagtagaaaagataataaactgaaaatgcatttaatccaactaacctactgaacatcatagcttagcctagcctaccttaaatgtgctcagaacacttacattagccaacagttgggtaaaatcatctaatataaaacctattttataataaaattgttgaagatctcatggaatttattatatcctgtacatkacttcaaaactgtgatggtttcccacaattataaacttgaaaaatcctaagtcggggaccattctgtgtattagttgaactgtacactttaaaagacatgaattttatattaaatggtatgtgtattaggtctctgaaaagcggcatgggtgtgtacatgtatataaatgagctctgccagtgtcaggaagagtcactggcatcactcatgccacctctctctcatacacacacacacacacacacacacacacatatatatacacacatgtgtatacatacacacacaaacagagtgac

SEQ ID NO: 157861 - DNA, 601 bp, Human
taaaattgttgaagatctcatggaatttattatatcctgtacatgacttcaaaactgtgatggtttcccacaattataaacttgaaaaatcctaagtcggggaccattctgtgtattagttgaactgtacactttaaaagacatgaattttatattaaatggtatgtgtattaggtctctgaaaagcggcatgggtgtgtacatgtatataaatgagctctgccagtgtcaggaagagtcactggcatcactcatgccacctctctctcatacacacacacacacacacacacacacacayatatatacacacatgtgtatacatacacacacaaacagagtgacgtgccatgtattaagccgttcttgcattgctgtaaagaaatgcatgagactgggtaatttacaaagaggtttaattggctcacagttctgcaggctttccaggaagcatgatgctggcatctgctcaggctctggggaggcctcaggaagcttacaatcatggtggaaggcaaagggggtgcaggcatgtcacgtggccagagcaggagctagagagagagagttgggtgagggagaagcagctgcacacttttaa

SEQ ID NO: 157862 - DNA, 601 bp, Human
gtcactggcatcactcatgccacctctctctcatacacacacacacacacacacacacacacatatatatacacacatgtgtatacatacacacacaaacagagtgacgtgccatgtattaagccgttcttgcattgctgtaaagaaatgcatgagactgggtaatttacaaagaggtttaattggctcacagttctgcaggctttccaggaagcatgatgctggcatctgctcaggctctggggaggcctcaggaagcttacaatcatggtggaaggcaaagggggtgcaggcatgtcamgtggccagagcaggagctagagagagagagttgggtgagggagaagcagctgcacacttttaaatgaccagttatctaagagaactcactcattgtcatgagaatagcaccaagaggttggtgctaaaccattcaggagaaatccacccccatgatccaatcacctcccaccaggcctcacctccagcattggggattacagttcaacatgagatttggacaggacaaatatccaaactatattacaccatataataataacattttggtcaacaatggattgcatatatgacagtggtc

SEQ ID NO: 157863 - DNA, 601 bp, Human
ttaattggctcacagttctgcaggctttccaggaagcatgatgctggcatctgctcaggctctggggaggcctcaggaagcttacaatcatggtggaaggcaaagggggtgcaggcatgtcacgtggccagagcaggagctagagagagagagttgggtgagggagaagcagctgcacacttttaaatgaccagttatctaagagaactcactcattgtcatgagaatagcaccaagaggttggtgctaaaccattcaggagaaatccacccccatgatccaatcacctcccaccaggccycacctccagcattggggattacagttcaacatgagatttggacaggacaaatatccaaactatattacaccatataataataacattttggtcaacaatggattgcatatatgacagtggtctcataagattataataccgtatttttactgtgccttttctacatttagatgtgtttagatatgtaaatacttaccactgtgttataattgcctgcagtgtttagtacagtagcatgctgtaaaggtttgaagtctaggaacaattggctgtcccatatagcctaggtgtgtagaaggc

SEQ ID NO: 157864 - DNA, 601 bp, Human
ataattgcctgcagtgtttagtacagtagcatgctgtaaaggtttgaagtctaggaacaattggctgtcccatatagcctaggtgtgtagaaggccgtaccatctaggcttatgtaagtgtgctctaggatgtagcctagaagctacccactaggaagtggagagctggaacttgacccaactcacgtgctctttccacgactccccagctgcctgcacattgactgagtgttgtccgtgggctaaaaggctcaggatcatttagctcactgccttgtcatgggcagggctcttttggctygctgtgccctatttaagacaaaattgtctaatgaaacatttctcagaacatatccttatcactaagtgacatttgactatacacacatgcatgcacgcacatatacacacacacgcatacgtagctttactgagatataatacatatacacacacagatgtgcatttatagggaagggggaaaagtagtccattggagggttttgactgggagaatgacatgacttgatttatgtgtttaaaagattattctggctcttgtgttgcggactgaccatagagagtgttgtcatgtaacaaa

SEQ ID NO: 157865 - DNA, 601 bp, Human
gctctaggatgtagcctagaagctacccactaggaagtggagagctggaacttgacccaactcacgtgctctttccacgactccccagctgcctgcacattgactgagtgttgtccgtgggctaaaaggctcaggatcatttagctcactgccttgtcatgggcagggctcttttggctcgctgtgccctatttaagacaaaattgtctaatgaaacatttctcagaacatatccttatcactaagtgacatttgactatacacacatgcatgcacgcacatatacacacacacgcatacrtagctttactgagatataatacatatacacacacagatgtgcatttatagggaagggggaaaagtagtccattggagggttttgactgggagaatgacatgacttgatttatgtgtttaaaagattattctggctcttgtgttgcggactgaccatagagagtgttgtcatgtaacaaaccactccaatagtagcttaaaacaataaagtgttattgtctctgacagttctttggataactgggctcagctgggtggttttcacttggggtctcatgtggtttccatcaggtaatggctg

SEQ ID NO: 157866 - DNA, 601 bp, Human
tcactgccttgtcatgggcagggctcttttggctcgctgtgccctatttaagacaaaattgtctaatgaaacatttctcagaacatatccttatcactaagtgacatttgactatacacacatgcatgcacgcacatatacacacacacgcatacgtagctttactgagatataatacatatacacacacagatgtgcatttatagggaagggggaaaagtagtccattggagggttttgactgggagaatgacatgacttgatttatgtgtttaaaagattattctggctcttgtgttgmggactgaccatagagagtgttgtcatgtaacaaaccactccaatagtagcttaaaacaataaagtgttattgtctctgacagttctttggataactgggctcagctgggtggttttcacttggggtctcatgtggtttccatcaggtaatggctggagctggtgtcatctgaagactcgactgggctggatgtccaagatggctccttcactcaattatctgagtctcagtgttcctttgcatggcttctctcttcagcagagtaacctggacttgctgtgtgacagctcaggtttccag

SEQ ID NO: 157867 - DNA, 601 bp, Human
ctcttttggctcgctgtgccctatttaagacaaaattgtctaatgaaacatttctcagaacatatccttatcactaagtgacatttgactatacacacatgcatgcacgcacatatacacacacacgcatacgtagctttactgagatataatacatatacacacacagatgtgcatttatagggaagggggaaaagtagtccattggagggttttgactgggagaatgacatgacttgatttatgtgtttaaaagattattctggctcttgtgttgcggactgaccatagagagtgttgwcatgtaacaaaccactccaatagtagcttaaaacaataaagtgttattgtctctgacagttctttggataactgggctcagctgggtggttttcacttggggtctcatgtggtttccatcaggtaatggctggagctggtgtcatctgaagactcgactgggctggatgtccaagatggctccttcactcaattatctgagtctcagtgttcctttgcatggcttctctcttcagcagagtaacctggacttgctgtgtgacagctcaggtttccaggagtcaggacacaggaactgcca

SEQ ID NO: 157868 - DNA, 601 bp, Human
taactgggctcagctgggtggttttcacttggggtctcatgtggtttccatcaggtaatggctggagctggtgtcatctgaagactcgactgggctggatgtccaagatggctccttcactcaattatctgagtctcagtgttcctttgcatggcttctctcttcagcagagtaacctggacttgctgtgtgacagctcaggtttccaggagtcaggacacaggaactgccagccctcttaaaagctaggctggaagtacacagcattacttctaccatatttcatcaatcagatagtcayaggtcagccccagatagaaggcggtggaaggctggactctccttctcagtagggaagtgacagaaacctatagggaaggaggaattgatggcagtcatctttggaaacaagctaccacaggggactaaagtggaagaaggaagaacaccagtcagctgctgttaagattattgtcatcagtatttcagcgttcttgtccttgccttttctgagtggaaaacatgcctcctgactggcatcttgagctttggtctggaggggccttgccctgtcatgatgggaggggagctttacaggtga

SEQ ID NO: 157869 - DNA, 601 bp, Human
ggtggttttcacttggggtctcatgtggtttccatcaggtaatggctggagctggtgtcatctgaagactcgactgggctggatgtccaagatggctccttcactcaattatctgagtctcagtgttcctttgcatggcttctctcttcagcagagtaacctggacttgctgtgtgacagctcaggtttccaggagtcaggacacaggaactgccagccctcttaaaagctaggctggaagtacacagcattacttctaccatatttcatcaatcagatagtcacaggtcagccccagatwgaaggcggtggaaggctggactctccttctcagtagggaagtgacagaaacctatagggaaggaggaattgatggcagtcatctttggaaacaagctaccacaggggactaaagtggaagaaggaagaacaccagtcagctgctgttaagattattgtcatcagtatttcagcgttcttgtccttgccttttctgagtggaaaacatgcctcctgactggcatcttgagctttggtctggaggggccttgccctgtcatgatgggaggggagctttacaggtgagctgtcattccagtca

SEQ ID NO: 157870 - DNA, 601 bp, Human
aggtcagccccagatagaaggcggtggaaggctggactctccttctcagtagggaagtgacagaaacctatagggaaggaggaattgatggcagtcatctttggaaacaagctaccacaggggactaaagtggaagaaggaagaacaccagtcagctgctgttaagattattgtcatcagtatttcagcgttcttgtccttgccttttctgagtggaaaacatgcctcctgactggcatcttgagctttggtctggaggggccttgccctgtcatgatgggaggggagctttacaggtgakctgtcattccagtcagcatctccctagctcagttatagagaaagtgacctggctaggttattttgcccagggttccagaggtggttgtcatgaaagcaaggggagaaccgggtctcccagggtcccagccattttcttattgctagaccgcatgtaactgagaatcccactctgagagttctaatctgggggaatgagctgtgagccagctttgccaagcagcttaattctgtccatccagattaaatttgcagcagcagggagccagctgccctctcagccaggggcaggggagtaagc

SEQ ID NO: 157871 - DNA, 601 bp, Human
gtgagctgtcattccagtcagcatctccctagctcagttatagagaaagtgacctggctaggttattttgcccagggttccagaggtggttgtcatgaaagcaaggggagaaccgggtctcccagggtcccagccattttcttattgctagaccgcatgtaactgagaatcccactctgagagttctaatctgggggaatgagctgtgagccagctttgccaagcagcttaattctgtccatccagattaaatttgcagcagcagggagccagctgccctctcagccaggggcaggggagyaagctgagtccccgagggatgagcagctgtggaggctgttcctaggcggaccccagacatatggagcaccccctgtgtgcctggcacctgctggggatatgatggtgaccaactcaggcacatgccctgttcttgaaataagctgaaggtctgaatgtggtggtctgggccttttgttttttccccagagatcttgtggatggggctcctcagctggaggagggagaggtcagctaccgagtgccccctgctgatgttgaggtaaaatgtggcttgctcaataggccacatgtggtgtgc

SEQ ID NO: 157872 - DNA, 601 bp, Human
tcccagccattttcttattgctagaccgcatgtaactgagaatcccactctgagagttctaatctgggggaatgagctgtgagccagctttgccaagcagcttaattctgtccatccagattaaatttgcagcagcagggagccagctgccctctcagccaggggcaggggagtaagctgagtccccgagggatgagcagctgtggaggctgttcctaggcggaccccagacatatggagcaccccctgtgtgcctggcacctgctggggatatgatggtgaccaactcaggcacatgccmtgttcttgaaataagctgaaggtctgaatgtggtggtctgggccttttgttttttccccagagatcttgtggatggggctcctcagctggaggagggagaggtcagctaccgagtgccccctgctgatgttgaggtaaaatgtggcttgctcaataggccacatgtggtgtgctcaataaagattgagtaaactgagctcttgaaaggatggggaatggagaaaatgaatccaaattaggggtgagagaccaaggtggatgctttgagaagggctccctgccagccttagtgtgagctgt

SEQ ID NO: 157873 - DNA, 601 bp, Human
tcttattgctagaccgcatgtaactgagaatcccactctgagagttctaatctgggggaatgagctgtgagccagctttgccaagcagcttaattctgtccatccagattaaatttgcagcagcagggagccagctgccctctcagccaggggcaggggagtaagctgagtccccgagggatgagcagctgtggaggctgttcctaggcggaccccagacatatggagcaccccctgtgtgcctggcacctgctggggatatgatggtgaccaactcaggcacatgccctgttcttgaaakaagctgaaggtctgaatgtggtggtctgggccttttgttttttccccagagatcttgtggatggggctcctcagctggaggagggagaggtcagctaccgagtgccccctgctgatgttgaggtaaaatgtggcttgctcaataggccacatgtggtgtgctcaataaagattgagtaaactgagctcttgaaaggatggggaatggagaaaatgaatccaaattaggggtgagagaccaaggtggatgctttgagaagggctccctgccagccttagtgtgagctgtgggcgagctccc

SEQ ID NO: 157874 - DNA, 601 bp, Human
ggctcctcagctggaggagggagaggtcagctaccgagtgccccctgctgatgttgaggtaaaatgtggcttgctcaataggccacatgtggtgtgctcaataaagattgagtaaactgagctcttgaaaggatggggaatggagaaaatgaatccaaattaggggtgagagaccaaggtggatgctttgagaagggctccctgccagccttagtgtgagctgtgggcgagctcccccagcagggaagagccacttccttgtgtggggcaggtgtcgtgctcagtgccgaggggagatacracagcagttttaccctcaggatagggctggcaaagaggggtcctgtgtgaccatggtgactctttccgacatgtggcagagctcattcatcactcacagcgctacttcctgctgaactcaggtggatttttagttcccctaataatcaatgagagaatacagtctgaaatctatttgccctctctgttccaggaaaggggtcccaggaggaagggagttgcctgatgacagggagcgctgaaaatgtcactaaagctattggagtgggaaaagccaggtgggagaccaggtaccgttggg

SEQ ID NO: 157875 - DNA, 601 bp, Human
tcaataaagattgagtaaactgagctcttgaaaggatggggaatggagaaaatgaatccaaattaggggtgagagaccaaggtggatgctttgagaagggctccctgccagccttagtgtgagctgtgggcgagctcccccagcagggaagagccacttccttgtgtggggcaggtgtcgtgctcagtgccgaggggagatacaacagcagttttaccctcaggatagggctggcaaagaggggtcctgtgtgaccatggtgactctttccgacatgtggcagagctcattcatcactcayagcgctacttcctgctgaactcaggtggatttttagttcccctaataatcaatgagagaatacagtctgaaatctatttgccctctctgttccaggaaaggggtcccaggaggaagggagttgcctgatgacagggagcgctgaaaatgtcactaaagctattggagtgggaaaagccaggtgggagaccaggtaccgttgggaagccaacgggagagtaggtagggaagagctctgaaaaagagaaggaatggagaccctgggacagtaaaaatactgccagtgccacttgatattttt

SEQ ID NO: 157876 - DNA, 601 bp, Human
aagccaggtgggagaccaggtaccgttgggaagccaacgggagagtaggtagggaagagctctgaaaaagagaaggaatggagaccctgggacagtaaaaatactgccagtgccacttgatatttttgctaccttagtttataaaacaatttccttgattacacccatttaacagatgagaccatggaggcctagacactacccactaggaagtagagaactggaacttgacccaactccaactcaagtgttctttctactactccctggctgcctccgcactgactgagtgttgtccagkagtctgtaggctgattggttccgggtgatcctgtttagaggtcattgagttcatggccctgcctgggaagagctcttttggaaccctgtgctccattgcactaagaagccgcaacaccctgatgtgtacatcctcctcctggagtaggatacagtttgcctgaatcagatcagtttcatatccaaggctgccatgtgggagttcatggagctcacgtgtggctttgcatagggcaggtggttatggtgttgtacaggtattcttgaaactggaaaatgaatttaatggaaactatttcca

SEQ ID NO: 157877 - DNA, 601 bp, Human
cagtaaaaatactgccagtgccacttgatatttttgctaccttagtttataaaacaatttccttgattacacccatttaacagatgagaccatggaggcctagacactacccactaggaagtagagaactggaacttgacccaactccaactcaagtgttctttctactactccctggctgcctccgcactgactgagtgttgtccagtagtctgtaggctgattggttccgggtgatcctgtttagaggtcattgagttcatggccctgcctgggaagagctcttttggaaccctgtgcyccattgcactaagaagccgcaacaccctgatgtgtacatcctcctcctggagtaggatacagtttgcctgaatcagatcagtttcatatccaaggctgccatgtgggagttcatggagctcacgtgtggctttgcatagggcaggtggttatggtgttgtacaggtattcttgaaactggaaaatgaatttaatggaaactatttccaattccagcctatccaagagaatggcatgttcacatctcacccttttgaccctatttgacctggatttctgtcctggtgtgtgtgacccctcc

SEQ ID NO: 157878 - DNA, 601 bp, Human
ttctttctactactccctggctgcctccgcactgactgagtgttgtccagtagtctgtaggctgattggttccgggtgatcctgtttagaggtcattgagttcatggccctgcctgggaagagctcttttggaaccctgtgctccattgcactaagaagccgcaacaccctgatgtgtacatcctcctcctggagtaggatacagtttgcctgaatcagatcagtttcatatccaaggctgccatgtgggagttcatggagctcacgtgtggctttgcatagggcaggtggttatggtgtygtacaggtattcttgaaactggaaaatgaatttaatggaaactatttccaattccagcctatccaagagaatggcatgttcacatctcacccttttgaccctatttgacctggatttctgtcctggtgtgtgtgacccctccttgccccctgccctcaagatcttgacgggctcaagctggtgttctaggaggccacgcttatggttgggctgggctcaggctttgttgtcacattcagttttctgttttggtacaacgaaggctttgaggagataaacagagatcattttacacctttt

SEQ ID NO: 157879 - DNA, 601 bp, Human
ttaaggccctgaggtctggaatgcccaaagcttcccaaaggaaccattccctgttggtgtctaaacaggtgatgtgtaaacccaggccagacaggccgcaaaactggaatcgagactaagcaggtgtaccagcctccaggagcaccaggcctgtgcccttccacgtcttaagaggaggcttcagtgactggtgccctcaaaggctcaggaattttgggttcctggtagggtcctgaaccatgtctgctatcaccaggaacctgggtattccctatctcttgacttcttcaaatagaacctyccacctcatcctaccttttcgccagtaagaaaaaagaggcaaggtcattcctaggtttagaagttctgaggctgggaagcttaagggcaccctctgcaggcccagggtactaggttgaactagaccctagacttaccctggaggaattcagctctctcctccagccctcaacctgccctgcaaggtctgccaggttagtgactcaagtttgctgtgagagtagcctgtgtagctggcttatcctgtagttccttcatttcctcattctctgagtttttaagtacctactgtatgctaggt

SEQ ID NO: 157880 - DNA, 601 bp, Human
ccctcaacctgccctgcaaggtctgccaggttagtgactcaagtttgctgtgagagtagcctgtgtagctggcttatcctgtagttccttcatttcctcattctctgagtttttaagtacctactgtatgctaggtgctttgtggacttaatacataatagtgaacagaaattgggccctgccttcctgaaggttacggtgttatgaaggaaatgagcatgtaggttgaacttgccttaggtacagataattcaatagctgtactcttttggatacttttgagttattatttttattaagycttcactatagtccaaaaatatagaccttttttcctccctaatctttgccagagaaaactgagtcccagaaaggttaaggaagaccaatctggggcaggacttgaatgtgtgccttgggcttctgtaccccagagcccacattttagcattgtcttccctccctgtgggggcctgggcatcagctctcatgtgcggatcaatggatcaaagcccctatttgaaaaagggggtcagttaagaacacacaatccaaactagaattagggcccacgagttcagcccaaggttctctccactgt

SEQ ID NO: 157881 - DNA, 601 bp, Human
tagaaaaggttgcttagtttccacattactgcgtcacaggggaagccactcaaccagatgcaaatgttgagatgctggttctcatccactgtgttgtcggctgcaagagtcttgcagtccagaaacggcatacctctggcggctgagggtccatgctgtggactctgcccttcccttctagcagggagtgggcattggagggaaccccacccaaagggtcctcttcgtttcagtgtgaaggagtctaggaggcatatactctgtcttccccccactctctgtttctctctctttgtctctstctctctctttgcactgtgtggcctccccctttggaggtgcagaactgtctctccaaccttggtgttggctgcctgcttgcactggcccctctctcctgatatgttaataatatttggaggaagcttcagggacagtccctggctctgaacttcagagtagaaaatgaagtccttgtttggagaattttctgtagtgggtgatcatggtgggggcagggggtggggtgggagtagcaggcaagacagaggatttattttattttaattattatttttgagacagagtctcgctctgtcgc

SEQ ID NO: 157882 - DNA, 601 bp, Human
tccacagacatcttgagtgtttctcgatgccagacatggatgctgggtcctgggatagggattttggacatgtatgctgggacctgggaccgggatgccagacacggatgctgggccccgggacggggatgccggacatggatgccgggccccgggacggggatgacggacatggatgccgctgggcccagggacggggatgccggacatggatgccgctgggcccagggacggggatgccggacatggatgccgctgggccccgggatggggatgccggacatggatgccgctgggcccygggacggggctgctggacatggatgccgctgggccccgggacggggatgctggacatggatgctgggccccgggatggggatgccggccatggatgccgctgggcagtgggcaggacacagaccttgcccttccccggcctcccaccctagtggaaatgtgattgcagattaccattggggatgtggaggcagcatggtgtttggaagcaataatgaattaggagaaggagaactaggttcttatcctggctctgctatggacttgcttcatatgggacaaatggcttcgtttccttgct

SEQ ID NO: 157883 - DNA, 601 bp, Human
ggaccgggatgccagacacggatgctgggccccgggacggggatgccggacatggatgccgggccccgggacggggatgacggacatggatgccgctgggcccagggacggggatgccggacatggatgccgctgggcccagggacggggatgccggacatggatgccgctgggccccgggatggggatgccggacatggatgccgctgggccccgggacggggctgctggacatggatgccgctgggccccgggacggggatgctggacatggatgctgggccccgggatggggatgccrgccatggatgccgctgggcagtgggcaggacacagaccttgcccttccccggcctcccaccctagtggaaatgtgattgcagattaccattggggatgtggaggcagcatggtgtttggaagcaataatgaattaggagaaggagaactaggttcttatcctggctctgctatggacttgcttcatatgggacaaatggcttcgtttccttgcttctctcaaaggtagtgtgtaggaattgggcaagaaaagtactgtttggggggttctgtggttccaaggacagcctaagattctgat

SEQ ID NO: 157884 - DNA, 601 bp, Human
gacatggatgccgctgggcccagggacggggatgccggacatggatgccgctgggcccagggacggggatgccggacatggatgccgctgggccccgggatggggatgccggacatggatgccgctgggccccgggacggggctgctggacatggatgccgctgggccccgggacggggatgctggacatggatgctgggccccgggatggggatgccggccatggatgccgctgggcagtgggcaggacacagaccttgcccttccccggcctcccaccctagtggaaatgtgattgcarattaccattggggatgtggaggcagcatggtgtttggaagcaataatgaattaggagaaggagaactaggttcttatcctggctctgctatggacttgcttcatatgggacaaatggcttcgtttccttgcttctctcaaaggtagtgtgtaggaattgggcaagaaaagtactgtttggggggttctgtggttccaaggacagcctaagattctgatcttgcattgatggtctgtatttttctcaaccttagtttttcacatttgtaaactacgattaataatcataatggttgctgta

SEQ ID NO: 157885 - DNA, 601 bp, Human
tgccgctgggcccagggacggggatgccggacatggatgccgctgggcccagggacggggatgccggacatggatgccgctgggccccgggatggggatgccggacatggatgccgctgggccccgggacggggctgctggacatggatgccgctgggccccgggacggggatgctggacatggatgctgggccccgggatggggatgccggccatggatgccgctgggcagtgggcaggacacagaccttgcccttccccggcctcccaccctagtggaaatgtgattgcagattaccaytggggatgtggaggcagcatggtgtttggaagcaataatgaattaggagaaggagaactaggttcttatcctggctctgctatggacttgcttcatatgggacaaatggcttcgtttccttgcttctctcaaaggtagtgtgtaggaattgggcaagaaaagtactgtttggggggttctgtggttccaaggacagcctaagattctgatcttgcattgatggtctgtatttttctcaaccttagtttttcacatttgtaaactacgattaataatcataatggttgctgtaagaactac

SEQ ID NO: 157886 - DNA, 601 bp, Human
ggacatggatgccgctgggccccgggacggggatgctggacatggatgctgggccccgggatggggatgccggccatggatgccgctgggcagtgggcaggacacagaccttgcccttccccggcctcccaccctagtggaaatgtgattgcagattaccattggggatgtggaggcagcatggtgtttggaagcaataatgaattaggagaaggagaactaggttcttatcctggctctgctatggacttgcttcatatgggacaaatggcttcgtttccttgcttctctcaaaggtagkgtgtaggaattgggcaagaaaagtactgtttggggggttctgtggttccaaggacagcctaagattctgatcttgcattgatggtctgtatttttctcaaccttagtttttcacatttgtaaactacgattaataatcataatggttgctgtaagaactacataaaaccatacatgtggggccgggcacggtggctcacacctgtaatcccagcactttgggaggccgaggtgggcggatcatgaggtcaggagatcaagaccatcctggctaacatggtgaaaccctgtctctactaaa

SEQ ID NO: 157887 - DNA, 601 bp, Human
cagtagacaagaattcctccactttatttagtagcttattcagtaacagtgtattaaatacctactgtgtctgaagaagggattaaagatgaagatcttttgcctcttaaaaactgttctagaaattggaggggaaggatagagtctgatctttgaggactattattcagaacgtggtctgtgcccagcactgtggctttttatgtatggtccaatatagtcatcaggacaccactaaggggggcttcactgtctgcatcactgatgaggaatcacaggcccagagaggcttaaataataygactcatccagtggcaggactgggattccaggttggtgttttcttggggtgatctggcaggactcaccgtcctcactggtctgagttgccccttcactctcagaattgtccccacatccgagtcctgaataatcaacctcagttcttgatctcaggtttccactcgtctcccctcgtgcccatgctcagcccctcaagcttctcctttatccctctctctcccactgtccactcctgtgtttcctctctgacttctcacccttctccttagtgacgccatggctgcctgatgacagaaag

SEQ ID NO: 157888 - DNA, 601 bp, Human
gtccactcctgtgtttcctctctgacttctcacccttctccttagtgacgccatggctgcctgatgacagaaaggagttaataaaaaccaatgtgtaactgaaacttgaaaggccataaattgccttgttttttctaggatgttggtagcattttgatttaatagttggacaaacacaagggcctattttattcagagtttacaggcctcaaggctgttattcctccaaagttaatagcattgaaattgcagggtttgctataatttgcctatcgctttctgctccaccattgatgtttaytgtcagcgggatggaatctcaatccgactcacttagataacatgtctgttaaacatttagataattgtaccatcattaacttgtcacattattttagagattcaaaacagaggcagggtaagtagaggtacccaaagggagtggaggtgggaggagggggaggaggaggaggaggaagagacaacctcttctgagttagacagccaggagaggagaaagttcattgcacaccttggcatctcattggaggtgtctaagttaaggaggtacgtgccaccaagccgggcccagggttgctcc

SEQ ID NO: 157889 - DNA, 601 bp, Human
tttttcttacaccgacataaggactgaggtcacacctggagggggtgacagaggccacaaataagaatgagctcagctggaagtgggagtgactccccatatgggagacttggggatcaattaaatatcaacagtagtggggcactgagcttggaatacaaaactgccctcgagaaataacggggtgtttgctccctgttcccatggtaccacgaggtcacagaggtgactacagtgctgtccatctggctttggacactgttatctcctgcattcccagggccttctgtgtgacctgggygagagaactgtcactattgcctctctccaatctgtgtgtgccccagtgacacaggcaataggaaaaatgtttccccaactgtaccgtaaataatgcagatatttgggcgtgggagaaacaaataatatcaatattttatagactgtaggctaaataatgtatatatttagaaaagcggcttaaatatttcatatgctgcagtgaagattcctgcttagaggcataatttgggctggtgagggctgtgggttaaggatgcagtcctgcggagccccggggtgagggggcagaggggaatgc

SEQ ID NO: 157890 - DNA, 601 bp, Human
ttcatagcagtgttgttcacaatagccaaaaggtggaaactacccaattgcctatcagctgatgcatggatatacaaaatgtggtatatccataccatggactataatttggccataaaaagagtaaaatattgatgcatgttacagcatggatgaactttggaaatcccgtgctaagtgaaacaagcaagacatgaaaggccatgaattagatgattccatttatgtgaaaatgttcagaacagagagctctagacagttagtagattagtggatgccacaggcttggggaaaatgagargtgactactaatgggtatgtggttcctttttggagtgatgaagatattctggaattagatagtggtggtgatggtattcagctttatgaatacattaaaaaccaataaaagggccgggcacagtggctcatgctttgggaggttgaggcagaaggatcacttgagcccaggagcttgaggctgcagtgagctttgatggcaccactgtactccaggctgggtaacagagcaagaccctgcctgttaaaaacaacccccccgcccccctgcaaaaacaacaacaacaaaaacattaaaagg

SEQ ID NO: 157891 - DNA, 601 bp, Human
acagttagtagattagtggatgccacaggcttggggaaaatgagaagtgactactaatgggtatgtggttcctttttggagtgatgaagatattctggaattagatagtggtggtgatggtattcagctttatgaatacattaaaaaccaataaaagggccgggcacagtggctcatgctttgggaggttgaggcagaaggatcacttgagcccaggagcttgaggctgcagtgagctttgatggcaccactgtactccaggctgggtaacagagcaagaccctgcctgttaaaaacaacmcccccgcccccctgcaaaaacaacaacaacaaaaacattaaaagggtggaattttatggtacatgaattatatttcaattaaaataaaaaacaacttccaggtatgttgttggttcttacagacttaacccaacctcctatacctgcggcatcacaggactgcaggtaacgctttgcatcatagtgaccattcagacagtgcaggagactgtggcacctttagaatcattctattcacagaaggcagcagggagtaggggtggctctgggatgcctccttgccctccccattcctccatt

SEQ ID NO: 157892 - DNA, 601 bp, Human
agttagggtgaagattgaaccaccttggggacttgggcctttctactgtgttagttcaaataatcattcaataaatgcttattgcatgattaatcaaaaacagaaaagggagcttcctgattagaagcaggaatgaagaatctgttcttgtctggcttcagatttttgctcttcacttgccaggtgaaggaccttggaagagtcactcatcctttgcaagtctcagattccttgtctgaaaaattaggacaccatacctgccctttatacctcaaaaagggatgtgaggaccaaaatggtsttagaacagggtagggtctttgcaagcagtaaagcatgattcagatgtaaggtgatgtcattgtgatgtttcctcttgctgtggtttcctgtcatgggctctggcttcagggtgccctgcaatgccaatgcaccccagtctgtgccctctgcacagcctcccatcccagcttttctgggcccttttcttccgttggcttcttttatcttgcacctaccttgctttctccctgcacgtaccaccaccacaaatgctgtacaagagcaagttaaccactattgttttgaatgatagagaaaa

SEQ ID NO: 157893 - DNA, 601 bp, Human
gaggaccaaaatggtgttagaacagggtagggtctttgcaagcagtaaagcatgattcagatgtaaggtgatgtcattgtgatgtttcctcttgctgtggtttcctgtcatgggctctggcttcagggtgccctgcaatgccaatgcaccccagtctgtgccctctgcacagcctcccatcccagcttttctgggcccttttcttccgttggcttcttttatcttgcacctaccttgctttctccctgcacgtaccaccaccacaaatgctgtacaagagcaagttaaccactattgtttkgaatgatagagaaaataatgagggaaacagactggtccattcagtgattaagtattcagtaattaagtattcagtgttaggtggtgggcagaagttaggaagaaaggtatcttaaggtttttgattcggcgtcatccgaatgggtcaatgagacagattccacaggcaaaccattccagatccataacctctagagtagaaagtttcagaaggaagagatcccccaaactgtgtaattcccttgtaaatctcattcattcaatgggatttgagaaccaaccacttgtgcaggtgcccgca

SEQ ID NO: 157894 - DNA, 601 bp, Human
tcttgcacctaccttgctttctccctgcacgtaccaccaccacaaatgctgtacaagagcaagttaaccactattgttttgaatgatagagaaaataatgagggaaacagactggtccattcagtgattaagtattcagtaattaagtattcagtgttaggtggtgggcagaagttaggaagaaaggtatcttaaggtttttgattcggcgtcatccgaatgggtcaatgagacagattccacaggcaaaccattccagatccataacctctagagtagaaagtttcagaaggaagagatyccccaaactgtgtaattcccttgtaaatctcattcattcaatgggatttgagaaccaaccacttgtgcaggtgcccgcatccgaagataacttgcccccaggagacagcagataagaagagggcagagacaaaggaggtctttttgtgacttgcatcatggatgcagaaaaggtggataacccaactctggtggggtgagtgggcagggaaggtttggaagcaggaggaggagacactcaaagctgctttggggtgcacttattttgtgtgctggagaaggatttgctggccatttcttg

SEQ ID NO: 157895 - DNA, 601 bp, Human
aggatatctgtatgtctgctacagtctcaggaatgcagccacaggaacaaagaaatttctagccctggtgctgctacttattaggagcaagacttcagacaagttgcttttcctttcagaagcttggtttcctcattggtagaagagggtcaaaaagtcacttgcccggtgagcctgctgagaagagcagatgaaggaggtgtactctgcactctgtgaaacattgcaaatgtgcgggttgatcattaatgttttctcttacagccaaagctagtgtgtgtgtgtgtgtgtgtgtgtgtgygtgtgcgcgcgcgcgcgtgcacagtttgtgagtgtcgggttcccaagcatttactctcctctctcctttctaggacatttcaggaagcattattcaaaagccggtggggtgggacagagggactattaaaatttttaagaatcaccttgcatttctttcactttggtcttaataataaataactctaaccctgcagccaggagctgggatgttctgtccaaattagcacaaatctctgtctgcaacagccgagcatccccgttcagtgggcgggatcagtaccatttccccagcaatgag

SEQ ID NO: 157896 - DNA, 601 bp, Human
ctagccctggtgctgctacttattaggagcaagacttcagacaagttgcttttcctttcagaagcttggtttcctcattggtagaagagggtcaaaaagtcacttgcccggtgagcctgctgagaagagcagatgaaggaggtgtactctgcactctgtgaaacattgcaaatgtgcgggttgatcattaatgttttctcttacagccaaagctagtgtgtgtgtgtgtgtgtgtgtgtgtgtgtgtgcgcgcgcgcgcgtgcacagtttgtgagtgtcgggttcccaagcatttactctmctctctcctttctaggacatttcaggaagcattattcaaaagccggtggggtgggacagagggactattaaaatttttaagaatcaccttgcatttctttcactttggtcttaataataaataactctaaccctgcagccaggagctgggatgttctgtccaaattagcacaaatctctgtctgcaacagccgagcatccccgttcagtgggcgggatcagtaccatttccccagcaatgagaaaaagccctcttgctaagctacagaaaaatctcccttgtgctttaattttggaagaa

SEQ ID NO: 157897 - DNA, 601 bp, Human
ctctcctttctaggacatttcaggaagcattattcaaaagccggtggggtgggacagagggactattaaaatttttaagaatcaccttgcatttctttcactttggtcttaataataaataactctaaccctgcagccaggagctgggatgttctgtccaaattagcacaaatctctgtctgcaacagccgagcatccccgttcagtgggcgggatcagtaccatttccccagcaatgagaaaaagccctcttgctaagctacagaaaaatctcccttgtgctttaattttggaagaagcrgattagtgtggccatatttaacctttgaccctgaaacaaaagcattatcaaaattatttaccaagagcgtctgtcttcttctcctcacccccacttccctgtttgccggggctagtttagaatcttggtaaacttcttcagagcaagagcaaaattttggaaggccatcattaccttagagacatcccaggcctggtgttcactgccagggctcttggggtctaaggtgggttaaaggacagagatgagaatcttataccacagtggggttcaaaatttgtgagttggatgtaaaaactc

SEQ ID NO: 157898 - DNA, 601 bp, Human
ctgcttgtcctctgccctcaccttctttgcagtgattttcagagtccccgtttgcgttcgcagtggggagtttgacttcatttcataccaggaaggccagcttgcagtgggggattgggagggcagagcgctttataagctcgcgatgaaagctgtaaaacgagatggtcaaggatctggccaggcctggttcgggattatggccggcccctggaatgctgaggggggcctcttttaagaagccagtgtctatttacagtgtatctctcataaaccccaacgctggggcgagggcaggggractcgccctcctggcatgtgattgattatctggtatttatgccattgaggacttgtcagcggtctggggtcaaagggtcatctcatgtgtcttgccgccagcccacctccttttgtacagtgtggaccgggcgagctgtgcacaaaacagctttttcttttccttgggaaaggggggatggggaggggggagtgtcaatgaaatttttttttcagccttttctgaatagtgttctttaaattctaaagaacttttaattaaaagtagcaggaaaattcatcttgagaaggtttaacttac

SEQ ID NO: 157899 - DNA, 601 bp, Human
ctcataaaccccaacgctggggcgagggcagggggactcgccctcctggcatgtgattgattatctggtatttatgccattgaggacttgtcagcggtctggggtcaaagggtcatctcatgtgtcttgccgccagcccacctccttttgtacagtgtggaccgggcgagctgtgcacaaaacagctttttcttttccttgggaaaggggggatggggaggggggagtgtcaatgaaatttttttttcagccttttctgaatagtgttctttaaattctaaagaacttttaattaaaagtmgcaggaaaattcatcttgagaaggtttaacttaccttaacagatacttttgtgtcccaagaagctgggagtgactttgaaagaaagaaagaaagaaagtaaggggctttgttgtgcctctccccctcccccaggcattttcaaagtttcctggagttcttgtccactcctgtctggtgtggaccctgcttgggaaagcaggaagggaagaggtcattcttctcctttaacatagccacacaaatttagaaagggacttggggattctctgctccaattttctcctgttatagatgaagaa

SEQ ID NO: 157900 - DNA, 601 bp, Human
ctcaattggggtggagggatttggaagccagagagaggagcttatcttttttttttttttcctgcttataggtggaagttgcttctttaatataaagatttctggatctatgaggttaactgtgtccagttaattgaatttataattcagcaccaaaacgctgaaaagaattgtcttttatgtcccttaatgagtgctataaaaacaagtggtgaatctaattttacgaatgttcctttatgacttacctgataactagtagttgttcaacacaaaggacacataactcagtctggacctrcactggctgcctgccgtaaaataacttgttttagaagttggccttcttgcttctcttgagtggcccagggattcacttgttcccttctctgctccctcttctcattgaggatcaggctcgggttcttcattctggaggattgagatgggttaccttccctgccagtccaggatgaccaagacctcacatctcattggctctttccaaaaaggggaagggaaagatatggcagctcattcagatgtctctctggtgcagcatattgcttctacctagaagttgcctggtgtgctaggaaga

SEQ ID NO: 157901 - DNA, 601 bp, Human
acctacactggctgcctgccgtaaaataacttgttttagaagttggccttcttgcttctcttgagtggcccagggattcacttgttcccttctctgctccctcttctcattgaggatcaggctcgggttcttcattctggaggattgagatgggttaccttccctgccagtccaggatgaccaagacctcacatctcattggctctttccaaaaaggggaagggaaagatatggcagctcattcagatgtctctctggtgcagcatattgcttctacctagaagttgcctggtgtgctagsaagaaaagagaaattaagagaaagactccttttgtctttaccctacaacgagaggtaaagagctttacagccgcagcagccgcattaggttagacattggtgagaacttcctgagttgcaaagatgttcctaagagagactgataactgtccatctctggagctgcttcagttgtgagtgggcacatatatagatgcccttatctttttatagcttttgtctttttttatgttttgaaagtttaatttgaattattttgtgattacagatcttacaggtagatgttgggtacaaaattca

SEQ ID NO: 157902 - DNA, 601 bp, Human
tatctttggtcagaaggaggctgggtgacaaggacagggggaggggctgctgcacaagcccagcctttggacactggtaaccttttgtgggggaatgtacacccagctgctttggggcccagaggaacattctggcaagacagtgctatcagcctaaactcatcacaccggaggcagcctgcagcacatacacatttctcttgacttacaggagactggagatggagggaaataagaagtcacctccccttaccccctattctcactgagttggcatgacactaaaagatcccctattccytatcattttcagaagaaccaagacggcttgccactcattcattcaacatttattgcatatctactatgtgcttaaatgctgggaatagaaagatgactagacccagtctgttgattcaaggaattcagagttgagaggaagacagacacataaacaggcaattataatgcagaatgctgagtgcagcgatagagatatttatacacaggatactgtggtagcccagaggaagggtgctcagcagatacccaggggacagataaggcttctagaaaggaagacaccacaaggttttcaaga

SEQ ID NO: 157903 - DNA, 601 bp, Human
tttggggcccagaggaacattctggcaagacagtgctatcagcctaaactcatcacaccggaggcagcctgcagcacatacacatttctcttgacttacaggagactggagatggagggaaataagaagtcacctccccttaccccctattctcactgagttggcatgacactaaaagatcccctattccctatcattttcagaagaaccaagacggcttgccactcattcattcaacatttattgcatatctactatgtgcttaaatgctgggaatagaaagatgactagacccagtctsttgattcaaggaattcagagttgagaggaagacagacacataaacaggcaattataatgcagaatgctgagtgcagcgatagagatatttatacacaggatactgtggtagcccagaggaagggtgctcagcagatacccaggggacagataaggcttctagaaaggaagacaccacaaggttttcaagaagtagaaagtagccaggatgaagggagagaaggacagaagaaatggaactgtatgtgtttagaaacagtgacactgtggcctgagtagctcagctgagatagaacgtggt

SEQ ID NO: 157904 - DNA, 601 bp, Human
ggggacttaggggattgcagatccaccctcttgcttccagggggattggatgggcagtcctccaggctgctgttggaaatttctcagagaaggacctgctgtgctgcacggaccttcctggaagtccaacccaggtgaacccttcttgctggttccattgctgcacgtaccatccctttgcacatgtgtctctcttttctgaggttcatcatgcttggttctgtcgcattgtctggagggaatacaagcaccctgattccttccaaagaagaggagctcagggccctgggtcctgccccaytggggctttacatttcctgaaacccctcttccactttccctgtcccacactgatcctagaatgagcactccatttgggatgggtggccgctctccctctacaccctcctccagtggcttggcacttcgggaccagctgctggagtgattgacataaagccaatctataaataaagtctttttcttttctcataaagactttgtggttgagtttgccttcaaggtcaagatcagacctttctaaataaacacatatcaaaggatcattagcaaagcagcactgttaaattgagatattaac

SEQ ID NO: 157905 - DNA, 601 bp, Human
ccactttccctgtcccacactgatcctagaatgagcactccatttgggatgggtggccgctctccctctacaccctcctccagtggcttggcacttcgggaccagctgctggagtgattgacataaagccaatctataaataaagtctttttcttttctcataaagactttgtggttgagtttgccttcaaggtcaagatcagacctttctaaataaacacatatcaaaggatcattagcaaagcagcactgttaaattgagatattaacttctgtcaactgcttgtttcttttttgttcwgtaactcatgactgcagtaggtttttattattttgtcctcaggcagtagcatctggcttctgtagagactgtaaaaattaaaaagcaacacaaatcattgcgagagaaaagcagtaaattcaatgataagaatttaaaattaaaatgtttcggtgcttttatattctgcaaaacatgaaatgagtgagtttgttgcctgttgccataaacctcacccagctaatcgtccgcttgagttttttcctgtctcttttgctcatcaccatcaattctgtcttggcacaaggcgtaaagtgagag

SEQ ID NO: 157906 - DNA, 601 bp, Human
gagaatgtttcagggactccacacacattcattccccttctccactccaccccactgtcatgccatcctgactttccactcactgtaaggtgcttcagaagacccaagactcaggctgccagagtggctgagttgggtgacttgggggttgtttctctcccattcatgtctgagatcatgaatggtcctctgggccatttcttgagtgtttcatttccaaggcctgtcagagggaggcagtctttagcattctctgactgtgctggtattactgggaaacaacagtcttctcttaaaaggyaatttcagaaaacaactgcaactgaatgactcaggaagaggaaggaaaggggaataggatgagtgaaatgtatggcccaagagcttttggagtctggaagaacaaaggaggaataaaggatgggtacgtggcaagaggagacccatgttacagagtgtccatgatcatgcagtgaccatccagcttggctctgctgtcgcctgcagagaatacactaatgaaacaagtgagtcttgggtgaggggtggtgtggaatcgtgcttggtggaagcatcttttgaatcacagggtctttcatgc

SEQ ID NO: 157907 - DNA, 601 bp, Human
caactgcaactgaatgactcaggaagaggaaggaaaggggaataggatgagtgaaatgtatggcccaagagcttttggagtctggaagaacaaaggaggaataaaggatgggtacgtggcaagaggagacccatgttacagagtgtccatgatcatgcagtgaccatccagcttggctctgctgtcgcctgcagagaatacactaatgaaacaagtgagtcttgggtgaggggtggtgtggaatcgtgcttggtggaagcatcttttgaatcacagggtctttcatgctgatccttgaggygctgaaaacttcacagaacttccatctgggttcaaatggggacatttagaaagttcttcaaattcactcctctcaatgacttttgcccgaagactccaagcccacaattactttaacctgaatgaacagaaagtatcatccatgctgtttaattctcagtggcctcttggactagcctgaaagtcacagctcccccaacccccaaaatataagttaagaaagaagcctgaaggtgatggaataaacactacggcttgtctttcttatttttaggggctctttgagagagggggaatcagg

SEQ ID NO: 157908 - DNA, 601 bp, Human
ggaagaggaaggaaaggggaataggatgagtgaaatgtatggcccaagagcttttggagtctggaagaacaaaggaggaataaaggatgggtacgtggcaagaggagacccatgttacagagtgtccatgatcatgcagtgaccatccagcttggctctgctgtcgcctgcagagaatacactaatgaaacaagtgagtcttgggtgaggggtggtgtggaatcgtgcttggtggaagcatcttttgaatcacagggtctttcatgctgatccttgaggcgctgaaaacttcacagaactkccatctgggttcaaatggggacatttagaaagttcttcaaattcactcctctcaatgacttttgcccgaagactccaagcccacaattactttaacctgaatgaacagaaagtatcatccatgctgtttaattctcagtggcctcttggactagcctgaaagtcacagctcccccaacccccaaaatataagttaagaaagaagcctgaaggtgatggaataaacactacggcttgtctttcttatttttaggggctctttgagagagggggaatcaggaagtgtaggagtgagcaaagt

SEQ ID NO: 157909 - DNA, 601 bp, Human
tctgaggtcagcttatgtgcctgagggcagctcacagcaggccctgcagggatagctgagagcctgccctggtcttggaggagaaagagatagggagtgtgcaccaggagacatctacatgttccaccagtgcccagaagttgttgtcaggtttgacttcagatcccaaactgtaggtgctcgttggctgcaatctcacagctttggccacagagtgatagccgttctgcaggcctctctagagatctgtgtcttcaattgtgaatgactcctcatcaggaagggacatctgggtagcacygcactgagtcccacatgaatgaatacttccaggttgagaggagaaaccaaacccacaaaagcctatgccctgctcctaacacatgtggatatgagtgtacacctaacaatcgcacgtattaaaagatatgggaatatacggactcagaagcctgcaactcatagggaattggggatggtgagtgggtgggtggcttgagagaggagagtaagccagcatgtttacttgagttgaagttggtcagagtcagatattaatggtgtaggctctgaaaattatgacttgcctggagctctggct

SEQ ID NO: 157910 - DNA, 601 bp, Human
gcttatgtgcctgagggcagctcacagcaggccctgcagggatagctgagagcctgccctggtcttggaggagaaagagatagggagtgtgcaccaggagacatctacatgttccaccagtgcccagaagttgttgtcaggtttgacttcagatcccaaactgtaggtgctcgttggctgcaatctcacagctttggccacagagtgatagccgttctgcaggcctctctagagatctgtgtcttcaattgtgaatgactcctcatcaggaagggacatctgggtagcactgcactgagtmccacatgaatgaatacttccaggttgagaggagaaaccaaacccacaaaagcctatgccctgctcctaacacatgtggatatgagtgtacacctaacaatcgcacgtattaaaagatatgggaatatacggactcagaagcctgcaactcatagggaattggggatggtgagtgggtgggtggcttgagagaggagagtaagccagcatgtttacttgagttgaagttggtcagagtcagatattaatggtgtaggctctgaaaattatgacttgcctggagctctggctcaagcccaca

SEQ ID NO: 157911 - DNA, 601 bp, Human
tggttcacagttttgaaggctaagtccaagatcagggtgccagcgtcttacaagggccttcttgctgcaccactccatggtggaaggcgagagggcaagagagagcagagcacaagaggggactagattcattttttcctaaggaacccactcccttgagaacgacattaatccacgcgtgagggcacagcccccatgacccaaacacctcccaagaggccccacctcccaacactgctgcattaagatcaagtttccaacacaggaactttgggggacacatttaaaccatagaagtacytaagttaaaacaccacagcccactgatttaaatatctgtaccccacacccttcttcacccagccactggatcagtgttctaagcagctactgtttctccatcccctaatcatgtgacactgtgatagacattgttcatatattatctctaatctgcccagcaaccttgcatggtgggtactataactctaatacagaaaggaaactaagacccagagatactaagtgatttgcatatgattatgtagttagtaaataaatggaagagtcagaatttgaacccaggtgtggtctgacttca

SEQ ID NO: 157912 - DNA, 601 bp, Human
tgctagtgggcaatgtgctcttttattttactatttttctttatcatatcatattcctctctctccctccccaaatagcaagaaggacagtatcttccttccaggctttaaaatcccttgcatgcagcctgacgttgcctaaaagcctctccctcaggcctacggactccctctcattgcttgcctattcagtaagcctataaatttactgtcccctgtccaccaccatcaccaccagcctgttgtggcagggaaggtggcctggtgagcccagtggactccagcaggactgcagcaaggsgatactgctttgtgcagcagccggagcagcgctgtccctgaggtctgcaggaaagtcctggggcccaggaagacagtggcccatcacccccagtattgcacatcaggtatcccccacctgtgtgcaccatgcacacccccaccatccacctcctgggccccatgtgctgggggaaggtgtggtcagcagacaggggaggatgtcatgctgacggagccccttagaacaataggagcttcacaggatcacaaagcctatcccccctcaggttacagaagagttgaagtccagagaaatcaa

SEQ ID NO: 157913 - DNA, 601 bp, Human
gcccagtggactccagcaggactgcagcaaggggatactgctttgtgcagcagccggagcagcgctgtccctgaggtctgcaggaaagtcctggggcccaggaagacagtggcccatcacccccagtattgcacatcaggtatcccccacctgtgtgcaccatgcacacccccaccatccacctcctgggccccatgtgctgggggaaggtgtggtcagcagacaggggaggatgtcatgctgacggagccccttagaacaataggagcttcacaggatcacaaagcctatcccccctcakgttacagaagagttgaagtccagagaaatcaaattcatttgtgcaatcctttatccatctattcgtccttctctccatccaataaatattcattgaacacctgtcagaaccaagagatagagtgctgtataagagaagtgaggtcgcagctctcatgcagctttcattctgacaggtggggaagacagtaaaccttgaacttaaagcaagtctctaagtcttgtgggtgtcacagctgaagactaaggctgggcctcctgtagtgtcctttgcaaggccccatactccctgcttcctggg

SEQ ID NO: 157914 - DNA, 601 bp, Human
ctgtgtgcaccatgcacacccccaccatccacctcctgggccccatgtgctgggggaaggtgtggtcagcagacaggggaggatgtcatgctgacggagccccttagaacaataggagcttcacaggatcacaaagcctatcccccctcaggttacagaagagttgaagtccagagaaatcaaattcatttgtgcaatcctttatccatctattcgtccttctctccatccaataaatattcattgaacacctgtcagaaccaagagatagagtgctgtataagagaagtgaggtcgcagstctcatgcagctttcattctgacaggtggggaagacagtaaaccttgaacttaaagcaagtctctaagtcttgtgggtgtcacagctgaagactaaggctgggcctcctgtagtgtcctttgcaaggccccatactccctgcttcctgggaggccaagcatttagtttggctctccattgcagatggagaagtttgagggaataaataccagtttggactagatacttctgggcggcagaagggtacaggtagtttcagaccaggattggtttttaattttttaattttggtaaattata

SEQ ID NO: 157915 - DNA, 601 bp, Human
tcctggggataacttattgttcagacaaggaaattgggtcttaccttcacgtggaaactccgtgcctcccgtgaagctctggacacacagccagaatgtaaatgcctactatgtgttggacactgtgctcttgtaatgaaactgctagattcagagggtctggttctctgacttgctctctatatgggctttcttgggggtcttctctatcattctgctgctgggggcttgggagagaaagctccccctccatattccccaccccaactgctcagccctcacctggcacagagaggcttcrggtactctcagacccagctactcaataattgcctctgtgagtgttcagccagttctaggaggtcttaagctgctaactggtagtcccctagaaaagggacctagaggttctctcaagtcctgtgaaattttcccatcttcctaaaaatccccatctcacagtgctgcttgagaaaggttgaacctagattggcacccagcaggtgcccagtcaatgttggatcctttctttgccttgtctgtgactgtccctctgtcagcctaagaatgtggttccttttagttaaagagattctcttta

SEQ ID NO: 157916 - DNA, 601 bp, Human
caggttttgtactcttgttcctgttcagttgggagtctgcagtaaaaagccacgtgagggcaagaggatggctgggatgtgaagatcctggcctgccctttcatgctccgtcccgatgttcccccacccgctttggggcttcttttcctggaagcctctaagatcagctgaattcgagaccaagggacccatatttcttgcagtgctcatgcaaccttgcagagggttacaggcagaatacatgccagggaatggacttaggaagaaactgattgtagcttttggtttatttgctacccayctacccccaaatgcaggaagtagggagccctttggctttaggaaccctgagagtaaacaggtgcctgtctctctcctttgaacttcatttctacagaacaagcagtgtagagaaaccgaggaaaacagttctctgcatcttgggagaagttgttgagcacggggccctcaagtcggcaccctgcctacttgctccatcccacagtccatcattctcccagcctgatcccatctcagaggcacctctctgccagaacgggcagtccctgagagaggcttccacatcagatgccccacccag

SEQ ID NO: 157917 - DNA, 601 bp, Human
acccagggttgggctgggttgggttgggctgggctaggctaggcttgctctgcagagctgggctaggttaggctactgcaagctgcccttctcctctctgggttgttgaagttggtccgatttttcaatcgtgggccaattagtttcacaaatgggggcccccgtggtgccagggcacatttgttccgggcctgcgcactggccaggccccattgttctgcctcccacccccgtgtgggcccattgtcctcgcccccagcgggtgctgcttactgctgatttatacgggcaggcgtcctgygggctccaggcttctctgccacagctggcggaggtgcttaaggccttggaccccgtgacctttgccctagtcctgctgtcattttgaaagttacagaccagagggctgcatacctctccggatttactttccaccccaactcatcccccccgccccacccactctattgcacatacgcatgcgcgcgcacgcgcgcgcgcacacacacacacacacacacacacacacacacacactctctcacactccctttccttcttcctctgcttgctcttggagaagttttaattcattttggaa

SEQ ID NO: 157918 - DNA, 601 bp, Human
tattgcacatacgcatgcgcgcgcacgcgcgcgcgcacacacacacacacacacacacacacacacacacactctctcacactccctttccttcttcctctgcttgctcttggagaagttttaattcattttggaatgtctggaagggtccagccactggactggaaaccaagaagaaggagctgctggggcaggtgggaggtaccagccgaggatattagtctctgctgatgtgcttggaagcagctacttcccggaatgtggtttttaatcctcggattcattagttccatatctgatrctgggaggaagggaggaggatgttgctgtcggtgtggcactgccagggaatcaggacttgatttggcttcttgcaacttaacatgcccccttcctgccagaggcccctgcaccctagaaagggcaacgcagcgtaggaggtagattgaatgtgaaggtggttttgtagcccagtacgaaaatgcagatcttgtcccctcttaacccgtttattctctctctccttgcaaaccaaacttctctcctcctttttttttaaaacctccttccctttttttatccaccccttttcttgtccccc

SEQ ID NO: 157919 - DNA, 601 bp, Human
cttggccatttgtccagtagattccttgaaaaggaggtgagccctaaatgatagcacagtggaagtcaaaatggaggagccactcagattcaagggctggactttgttcctttctgtctattcctcaccccaccccagccttctccatccttttaagatgcagacagagccttccttccttgggtgggagtcagcctgatgctgcttgcctctgcctctctttctctcttgccgagtggatggtacagccctgctacctttttcagcagcaacctgggggcaaagggaggagaagatgggygaaaggaaaaggcgtcagtttatatgatggtttgaatgtgtggtcacgaaggttgcccatgctggagatggtgtcttaggaaagagtaatcccccaggatgtcagagggagcagaaagacatatctgaaggatttgggggctgggggtggagggagggggaagtttctagtttaaatcaaggttttcacaccctcctaaatttgatattttctttctgtggggagaagaagctttcggggtggcaggggaggcagtccttcctttgttgggtgaggttgggtaggattggacgtgagaag

SEQ ID NO: 157920 - DNA, 601 bp, Human
gtgagccctaaatgatagcacagtggaagtcaaaatggaggagccactcagattcaagggctggactttgttcctttctgtctattcctcaccccaccccagccttctccatccttttaagatgcagacagagccttccttccttgggtgggagtcagcctgatgctgcttgcctctgcctctctttctctcttgccgagtggatggtacagccctgctacctttttcagcagcaacctgggggcaaagggaggagaagatgggtgaaaggaaaaggcgtcagtttatatgatggtttgartgtgtggtcacgaaggttgcccatgctggagatggtgtcttaggaaagagtaatcccccaggatgtcagagggagcagaaagacatatctgaaggatttgggggctgggggtggagggagggggaagtttctagtttaaatcaaggttttcacaccctcctaaatttgatattttctttctgtggggagaagaagctttcggggtggcaggggaggcagtccttcctttgttgggtgaggttgggtaggattggacgtgagaagcccctccggggtacatgtgcatgcacgagcacacac

SEQ ID NO: 157921 - DNA, 601 bp, Human
ggaatgccattcatgttccctctgcccaggttccttccatgccggggatctcagaggatgcataaggagaagccttggctcttaaagggcatggctggcctccaaagcctactcaaccctactgatttaaggtagctgtttgaacacctggcttaatttgggctctctgtggggtgggggttaagggcagagagggagtagatgctgggggctctcaagttgaaggagtgggggccaccgggcacagaacgcattgcagatgcactgtcctcctgtgtacgtcggccaagcagggagggayattgaagactcactgtcaactcttggcattgcttctgtccagaaagatacatctctcattatgtctccctccagcaagtgaagctgagtagactactcagcatttctgagagaccttggtggctcccagtgggattggaaggcctcagagagctatgccttgtgacccagccccagctactgcccactcctggccaggggttctctagccattgctggagctgtactagaggcaggagtcctctgtaccgtccttactgggcctcttccagggtaagcccagacaggcgggcagtcagct

SEQ ID NO: 157922 - DNA, 601 bp, Human
actgtcctcctgtgtacgtcggccaagcagggagggacattgaagactcactgtcaactcttggcattgcttctgtccagaaagatacatctctcattatgtctccctccagcaagtgaagctgagtagactactcagcatttctgagagaccttggtggctcccagtgggattggaaggcctcagagagctatgccttgtgacccagccccagctactgcccactcctggccaggggttctctagccattgctggagctgtactagaggcaggagtcctctgtaccgtccttactgggcytcttccagggtaagcccagacaggcgggcagtcagctccagaggtagcattgagtccagccccgtggtttctgaaagacaaaccgagatattttcagatcccaactctgcctctttctgtgtgatcttaggcaagttatttaatctctcttttacactggtaaaaagggggataagaatgcctgccttgtaggattgcaagttttaaatgaactgacaacatagataaggtacctagcataacgcctagattcgctccccttccttcctgctttttgttggccaggagcaaaatccagtg

SEQ ID NO: 157923 - DNA, 601 bp, Human
gtcagctccagaggtagcattgagtccagccccgtggtttctgaaagacaaaccgagatattttcagatcccaactctgcctctttctgtgtgatcttaggcaagttatttaatctctcttttacactggtaaaaagggggataagaatgcctgccttgtaggattgcaagttttaaatgaactgacaacatagataaggtacctagcataacgcctagattcgctccccttccttcctgctttttgttggccaggagcaaaatccagtgctggctgtttttctccttccctgctcagccwtcctgactgctggtgagatggggcgtggctccaggtgcttagacttcagtgtctgcaaagggaagggatatcagggtgggtgtgaggggcacagaagtgtgggggacagtgagaggtgggccttgcctgcctactagtccatcctaacccagccatgagtgggacggaggtggtgaggaccagacctctcacttgctatctccattgatggccaggaaggcagggaggttcttcgtgccatcccttctcttccccctaccttccaccagacacttcccgattccatgctgagcagcccat

SEQ ID NO: 157924 - DNA, 601 bp, Human
gagtatgcagaccaggtcttgcatgggtggcaggctctgctaaataagggaagagctttacttctcatggactgagctggcctggccagccagcagcaggtatcctcattaaggagccttcctggctgtcacttctggatgccattttgttcaggggagcacattgtcttagcatcaccagatttgcacagaactacttaaaatttctgggacaggacggaggtagggcccagaggggtgggctcaataaaaagggcccaggagagtgggatgttgacaaggactttctctacagcgattrcgtaagcatttcccctgcagctatatgcaccttcctatgaacgcctccctcaacagttccccaggttcattcggtcttatgaaagatggctagatacctttcagccacttctgagcatgccactgggtccaatcagttggcttcatgtgacttgaatgatctcagtcctgctaaatccacccaggatgtgccctgctctgaccatgccaccttctcagagctcagatatgaaaatgtcacatgctcttgtgtcagtcatggctcagatccacggggaggggctgtttccagagttaggga

SEQ ID NO: 157925 - DNA, 601 bp, Human
gtggggaaggttgatttacagaagggtgagaggtggtggaagctggaaaacaaagacgccccctctgatcaggggagacagctgtcctgtccagaggaagggggagaggtggcttcaggcaggtcctgctggcttagaggagagtacgttgcccttggaggggaagggtggacagaaggagcagtaagcagagctatgtgttgtcagagctcgtttttcgtgtcccagtttgagcccacaaggagagggttgggtgtccgttgatgacaactatagtggcccagaggatttcccagagccctggggtttccttagccccttgtcagggatgtgacctggcaggtggatcattaactgtattggcagtgactattgtaaatagctggtcgatagttagatcactttggctgttcattacttcattatttgctggggcctgtgcgcgggggagtattgatagcgagatggctggccagttaattactgtattgaaacaaggttcccttacatcctctgctcagctctaggggactctatggaaggaaagttggggtatagaacgctagggtgtggctgtgcactcccaggttctttatccctc

SEQ ID NO: 157926 - DNA, 601 bp, Human
attgaaacaaggttcccttacatcctctgctcagctctaggggactctatggaaggaaagttggggtatagaacgctagggtgtggctgtgcactcccaggttctttatccctcccatcccaccccacccccaattccagcctcaggagggaggcagggtccagggcaaggtcttagcggttttagcaggataggccgggtgggggagctcatgcctataatcccaggactttgggaggccgaggcaggcagatcacttgaagtcaggagttcaagtccagcccggccaacatggtgaaamcctgtctgtactaaaaatacaaaaattagccgggcatggtggcggcacctgtgatcccagctacttgggaggctgaggcaggacaatcacttgaacccgggaggcagaggttgcagtgagctgagattgcaccactgcattccagcctgggtaacagagtgagactccatctcaaaaaaaaaaaaaaaaaaaaaaaaaaggccgggcgcggtggctcacgcctgtaatcccagcactttgggaggccgaggcgggtggatcttgaggtcaggagatcgagaccatcctggctaacaaggt

SEQ ID NO: 157927 - DNA, 601 bp, Human
gctcacgcctgtaatcccagcactttgggaggccgaggcgggtggatcttgaggtcaggagatcgagaccatcctggctaacaaggtgaaaccccgtctctactaaaaatacaaaaaattagccgggcgcggtggcaggcgcctgtagtcccagctactcgggaggctgaggcaggagaatggcgtgaacccgggaagcggagcttgcagtgagccgagattgcgccactgcagtccgcagtctggcctgggcgacacagcgagactccgtctcaaaaaaaaaaaaaaaaaaaaaaaaaaragagctttagcaggataggtgtccccaggtgcagcatatttgaaggactgggttccctcaatttccccccacccctgctccccaccatctgtagccctgaaaggtctcgatccacctgctctctggacggaactgtggcttgaagagccattcctgaggactttggggcctttctctttctagacacccattttcttaattagaaagggaaaagactgtggccttgggagagttaagaatagtaagacaaggagctgggcaatccagtagtcaactagctacatgtagctatttaaatta

SEQ ID NO: 157928 - DNA, 601 bp, Human
ctcacgcctgtaatcccagcactttgggaggccgaggcgggtggatcttgaggtcaggagatcgagaccatcctggctaacaaggtgaaaccccgtctctactaaaaatacaaaaaattagccgggcgcggtggcaggcgcctgtagtcccagctactcgggaggctgaggcaggagaatggcgtgaacccgggaagcggagcttgcagtgagccgagattgcgccactgcagtccgcagtctggcctgggcgacacagcgagactccgtctcaaaaaaaaaaaaaaaaaaaaaaaaaagagagctttagcaggataggtgtccccaggtgcagcatatttgaaggactgggttccctcaatttccccccacccctgctccccaccatctgtagccctgaaaggtctcgatccacctgctctctggacggaactgtggcttgaagagccattcctgaggactttggggcctttctctttctagacacccattttcttaattagaaagggaaaagactgtggccttgggagagttaagaatagtaagacaaggagctgggcaatccagtagtcaactagctacatgtagctatttaaattag

SEQ ID NO: 157929 - DNA, 601 bp, Human
aggccgaggcgggtggatcttgaggtcaggagatcgagaccatcctggctaacaaggtgaaaccccgtctctactaaaaatacaaaaaattagccgggcgcggtggcaggcgcctgtagtcccagctactcgggaggctgaggcaggagaatggcgtgaacccgggaagcggagcttgcagtgagccgagattgcgccactgcagtccgcagtctggcctgggcgacacagcgagactccgtctcaaaaaaaaaaaaaaaaaaaaaaaaaagagagctttagcaggataggtgtccccagrtgcagcatatttgaaggactgggttccctcaatttccccccacccctgctccccaccatctgtagccctgaaaggtctcgatccacctgctctctggacggaactgtggcttgaagagccattcctgaggactttggggcctttctctttctagacacccattttcttaattagaaagggaaaagactgtggccttgggagagttaagaatagtaagacaaggagctgggcaatccagtagtcaactagctacatgtagctatttaaattagttacaatgaaataaaattagaaaactgt

SEQ ID NO: 157930 - DNA, 601 bp, Human
ggccttcccacttcctcattcgtccacaaggcacactcccggcccttgatcgctcccagtgtctagggatctccggacttgaggttttatatttacagaagacagcagatatgtatatagtttctgtgcgcctgacgctaaggttacatacagccaggaacaaggtcaaaagtgtccctggtttacagagtgtacatcggaatgggggaggcaagccttaaacaagtaaacacataaatgagataactttaagagagtgaaaggtgcaatgaagaaatcgggggaactcgaaggaaagagktacgctattttatttagatggaatagtcaagagaaatcgtctccgaagaagcaacatttgaacagaaaccggaattataaggagccaggcaggtgcagaaggtcctgagatgggaataatataggggtgttcaggtaacagaagaggcagtgtgtggcctgacttcaaggaagagaacaaagactggtgtgtgaatgaagtagaaaatgggtcaggtcaaataggttcttggtcagtaattgaggttagtctaaatagatcacccttcacaagacatacgtttgcttgtcttgtaaatca

SEQ ID NO: 157931 - DNA, 601 bp, Human
acatacgtttgcttgtcttgtaaatcacttgagtcatttccttatcaccttttccccagacacacacattcgcactcgcacaaccctggcagctggactcacatcagtttctgccccctccttttcacaaggcactcctgaaacttttgatacctcccagctcttggcattctcctagcttcataataatgacagcttacagagagggcttttcagtggattaggcacttttgcatctgtgtaaatatatctgattctcttcttttttatttttctctctcttcttccttccttcttcttcttttttttttttttactttacagagtctcactcttttacccaggctggagggcagtggtgcaatctccacgcactgcaacccctgcctcccgtgttcaagcgattctcgtgcctcagcctccggagtagctgggattacaggcgtgtgccaccacgcccagctaatttttgtatttttagtagagatggggttctgctatgttggccagactggtctcaaactcctggcctcaaagtgatccacccgcctcggcctcccaaggtactaggattacaggcatgagccatcatgcctggcct

SEQ ID NO: 157932 - DNA, 601 bp, Human
taaatcacttgagtcatttccttatcaccttttccccagacacacacattcgcactcgcacaaccctggcagctggactcacatcagtttctgccccctccttttcacaaggcactcctgaaacttttgatacctcccagctcttggcattctcctagcttcataataatgacagcttacagagagggcttttcagtggattaggcacttttgcatctgtgtaaatatatctgattctcttcttttttatttttctctctcttcttccttccttcttcttcttttttttttttttactttmcagagtctcactcttttacccaggctggagggcagtggtgcaatctccacgcactgcaacccctgcctcccgtgttcaagcgattctcgtgcctcagcctccggagtagctgggattacaggcgtgtgccaccacgcccagctaatttttgtatttttagtagagatggggttctgctatgttggccagactggtctcaaactcctggcctcaaagtgatccacccgcctcggcctcccaaggtactaggattacaggcatgagccatcatgcctggcctccctcatttccttttttttt

SEQ ID NO: 157933 - DNA, 601 bp, Human
tgtttatagtagtgtatctgtttttggaatacactcaactcacatttatcaagtttttccttctatatctcatttataatctaccagaaattctagcactgtcagaaatgtatatatgtatgtatacattcgactttaccaataattttgtttatttatttatttatttttgagacagggtctctctctgtcacccaggtttgagtgcagtggggcgatctcaactcactgcaacttccacctcccaggttgaagcgattcttgtgcctcaggctcccaagtagctaagattacagatgtrctcctccactcccagctaatttttgttttttgtttttagtagagatggtgttttgccatgttggcaaggctggtctcaaactcctgacctcaagtgatccacctgcctcagtggattacagagtgctgggattacaggcaaagtgctgggatcacaggcatgagccactgcctggccagctttaccagtacttctatgttattccagtaattgagataaaaagatgaatccctggttctaattcacatattagtatatataggagatattgcaagttcagttccagacctgagtaaatag

SEQ ID NO: 157934 - DNA, 601 bp, Human
ttttcatccatggttcctggctcataactctcagcccttgctacagtattttgttaggcatcctaggccttaggagcaggccttgggaaacagaatctctcctgccctcctttcacctaccccaaggcaggactggaatctttccctgtctttcaaattgtgagtcttaagaccctcctcagagagggaccccaccctataccctgggggaaggaatgctgacatcatgaagcttccataaaaacctaagaggaattaaaaaaataaaaactaaaataaacctaagaggacttgaagccarttggtcagaagttccataggccccagcttgctatttgtgtctggaggagggtggggtgcagtcttggggaccaagccctcaacctatgatctgacactatctccaggtagatagtgtcaaaattgagttggaggatacccagctggtgtccactacttattggtggggaaaaacccccacatttttggtcacagacgtcggggttgattgttgtgagagcagagggaaaatgtgatgtgtttttccaaaatagtcgtacatctgtatcacatgggaaaaggaaaagatttaaataaagca

SEQ ID NO: 157935 - DNA, 601 bp, Human
gacgttattgataaatttgactatattacctttaaagatgtgtttaaaaggacataataaataacaatggctaacatttattgaaatcttaactattcactagcacagtgctctgtgttgtttatgggtacttaaataaaaaccggtaagggagtgacatgagaatgatatacaccaactttaagatggtaattacctctggagaggaaaggaggagaatgaaagggagaatttcagctgtatctgtagtgttgatagtaaaactgaagcggataagagtgcaacttctactgcatcctarcttgtgcagccctgggcaagtttcctactctttctttgtctcagttttcttatctgttaaatgagaatattaatagtacctgcttcagggttgtgaggatcaaataagttaatacatttaaagcacttagaagagtgcctggcaagtagaaaaggctcaataaataatagtttttgtttttgtttttgttttagtacagaaagagactgaggaaattaggtcaaaatattcacatatgttaaatcttttttactgtagatgtttgcaatagaccatgacttaaaatattttttaaaaaat

SEQ ID NO: 157936 - DNA, 601 bp, Human
tgtttttgtttttgttttagtacagaaagagactgaggaaattaggtcaaaatattcacatatgttaaatcttttttactgtagatgtttgcaatagaccatgacttaaaatattttttaaaaaattaaaaatcttgatcatagctgggcacagtggctcacacctgtaatcccagcactttgggagactgaggcaggaggattgcttgatctcaggagttcgagaccagcctggacaacatggtgaaaccccatctctacaaaaaatacaaaaattagctgggcatggtggcacgtgccrgtagtcccggctacttgggagactgaggtgggaggatggcttgaacccaggaggcggaggttttagtgagccgagatcatgccactgcactctagcctgaacaacagagccagatcctgtctccaaaaaaaaaaaaaaagaaagaaaacttcatcgtaatgagcatttcacatctttattgtgatgaggaagccaaggaagcaaacattaaatagtgtgtctccagaggagcatggctcgtgtaatttaaggttcaaattctctttttagataaattctaatctacctcatcaagcttaa

SEQ ID NO: 157937 - DNA, 601 bp, Human
tccacatcagctgattcttacttgtaacttagcttttctcaaacttacatgatcacagaacctacatcctcttccccacttacagcggtaaacacccttggaattggtatgctgagtaatatactgtactttggaatgtggttatttaaatccctctctgcttgtcatctttgcagtactgaaaagggtgtgctcactggttattcatgtaatatcaattatccagacaatgatcgattctcttggaaaattaagtatttgacccaacagttaagttatactttttcctaaaagatgatcyagacctgttttcctaggatctgaaaaacattagtctgccgaaggaagtcatactgtaggcaggaaagaatattggtaacacttgagaattatgagtccaagttgctagaattgttcttgagtgtcatcagatattgtattgctctgcttatgcaagggaaaggctggtttgaatattataatgacattgcagctaataaaatgtcaggttcaaagttaatacttaaagcaaaaatgtttagggtcatcattacccttaaaaatcctttaagggagcactgagtccatttctctggaattt

SEQ ID NO: 157938 - DNA, 601 bp, Human
aatgtggttatttaaatccctctctgcttgtcatctttgcagtactgaaaagggtgtgctcactggttattcatgtaatatcaattatccagacaatgatcgattctcttggaaaattaagtatttgacccaacagttaagttatactttttcctaaaagatgatccagacctgttttcctaggatctgaaaaacattagtctgccgaaggaagtcatactgtaggcaggaaagaatattggtaacacttgagaattatgagtccaagttgctagaattgttcttgagtgtcatcagataytgtattgctctgcttatgcaagggaaaggctggtttgaatattataatgacattgcagctaataaaatgtcaggttcaaagttaatacttaaagcaaaaatgtttagggtcatcattacccttaaaaatcctttaagggagcactgagtccatttctctggaatttgtgcatcctaggaaaaaaaattgtgattttcaaaaaatcccttaagaagacagcaaaggcaacatattatctcagtgtctttaacacaaccagtctttgctccactattggaacagagtgtgttctatgattga

SEQ ID NO: 157939 - DNA, 601 bp, Human
ctaggatctgaaaaacattagtctgccgaaggaagtcatactgtaggcaggaaagaatattggtaacacttgagaattatgagtccaagttgctagaattgttcttgagtgtcatcagatattgtattgctctgcttatgcaagggaaaggctggtttgaatattataatgacattgcagctaataaaatgtcaggttcaaagttaatacttaaagcaaaaatgtttagggtcatcattacccttaaaaatcctttaagggagcactgagtccatttctctggaatttgtgcatcctaggraaaaaaattgtgattttcaaaaaatcccttaagaagacagcaaaggcaacatattatctcagtgtctttaacacaaccagtctttgctccactattggaacagagtgtgttctatgattgaaaactaaatgaagtaattggcttgtgtttacggattatgttgtgggaaaaaatagatattttctctagaattatgctcagtgtgatgagatgcttgtcctgagaggaggataaggaggaaactaagatcagccaaaggaataacaaattcaggtctcccatcttttactctcagggaat

SEQ ID NO: 157940 - DNA, 601 bp, Human
tgtgcatcctaggaaaaaaaattgtgattttcaaaaaatcccttaagaagacagcaaaggcaacatattatctcagtgtctttaacacaaccagtctttgctccactattggaacagagtgtgttctatgattgaaaactaaatgaagtaattggcttgtgtttacggattatgttgtgggaaaaaatagatattttctctagaattatgctcagtgtgatgagatgcttgtcctgagaggaggataaggaggaaactaagatcagccaaaggaataacaaattcaggtctcccatctttyactctcagggaatagaaattgattagaatggctgggataattgcctgtaatgtttaaattatccttatcttttttttttttttttttttgagttggagtttcactcttgttgcccagtttggagtgcaatggcatgatcttggctcactgcaacctccacctcccgggttcaagtgattctcctgcctcagcctccagaatgctgggattacaggcacatgccaccacacccagctaatttttgcatttttagtagaaacgaggtttcgccatgttggccaggctggtctcgaactcctg

SEQ ID NO: 157941 - DNA, 601 bp, Human
tcagccaaaggaataacaaattcaggtctcccatcttttactctcagggaatagaaattgattagaatggctgggataattgcctgtaatgtttaaattatccttatcttttttttttttttttttttgagttggagtttcactcttgttgcccagtttggagtgcaatggcatgatcttggctcactgcaacctccacctcccgggttcaagtgattctcctgcctcagcctccagaatgctgggattacaggcacatgccaccacacccagctaatttttgcatttttagtagaaacgrggtttcgccatgttggccaggctggtctcgaactcctgacctcaggtgatctgcctgcctcagcttcccaaagtgctgaatttacaggcatgagcccactgtacctggcctatccttacccttttttaaaagcatgatcttacagttgaaataatgcagttgaattagcattaagttaaataataattttattatgagagaaaagctaatttcttttgtatcaagcacttagttttcattttctttatcagaaaattatgtcttagaacattatttattttaaacagttgcacttaaata

SEQ ID NO: 157942 - DNA, 601 bp, Human
ggcatgagcccactgtacctggcctatccttacccttttttaaaagcatgatcttacagttgaaataatgcagttgaattagcattaagttaaataataattttattatgagagaaaagctaatttcttttgtatcaagcacttagttttcattttctttatcagaaaattatgtcttagaacattatttattttaaacagttgcacttaaataaatacacaatacagttaacagatttatgtattcctaagaattcctcctgcatagcattctattagggaaattacaatctgaaaattmagtctttgagttttccaaaggtggcatatactctgccctttgggaagtagggttattaataatgttattaattcaatagaaattcagtgatttcttaaaaattaaatgatttttgttgttgttgctggtctttggtcaagaatatctgtatttgaacacatggaggttcctgaatgatggagcactcagaaagggcatggaagctctatgcccctttccccatacctcaccctacgcatgtcttcatctgtatgctgtgtaacatattttataataaacctgtaaacatgtttgagttcc

SEQ ID NO: 157943 - DNA, 601 bp, Human
gcattctattagggaaattacaatctgaaaattaagtctttgagttttccaaaggtggcatatactctgccctttgggaagtagggttattaataatgttattaattcaatagaaattcagtgatttcttaaaaattaaatgatttttgttgttgttgctggtctttggtcaagaatatctgtatttgaacacatggaggttcctgaatgatggagcactcagaaagggcatggaagctctatgcccctttccccatacctcaccctacgcatgtcttcatctgtatgctgtgtaacataytttataataaacctgtaaacatgtttgagttccgcaagccactctaacaaattaattgaacccaaggaggaggaggtgggaaccccaatttatagctagtgtcagaagcacagaattaccagaaaacaaatcaaaacaaaacaaaacaaaaaacagaaaaataacatccattatacaatataagaaaccaaagaccatcaatctctaatctctgtgctcaggtgtctgtgtgcttcaattcttctcatctacgagtcttgggttttcaatgctcacttgtcaccaggatatgaattaaaa

SEQ ID NO: 157944 - DNA, 601 bp, Human
tttgctaaatatggaatgattgactagccagagcaatcaggaaagagaaagaaataaaaggcatccaaattggaaaaagaggaagtcagattgtacctctttgccgacaacatgattttgtatgtagaaaaacctaaagacttcaccaaaaaactgttaaaactgataaacaaatttagtaaaattgcaggatataaaatcaacgtacagaaatcagtagcatgtctatacgtaaataatgaactagctgtaaaagaaatcaagaaagtaatcccatttacatagctaccaaaaaaaaaaataacaaaatacctaggaataaatataaccaaagaggtgaaagagctcttacaaggaaaactacaaaacactgatgagaaaacttaagaggacacaaatggaaagacatcccatgctcatggatcagaagaattaatattcctaaagtgaccattctactcaaaataatttacaattcagtgcaatccctatcaaaatatcaaagacattcttcagagaaatagaaaagcaacaatcctaaaattcatatggaaccgtaaagaagcccaaatagctaaagcaatactgaacaaaaaggaca

SEQ ID NO: 157945 - DNA, 601 bp, Human
cttatctagttagaatggccattatttaaaagatttttaaaataacagatgctggcgaggatacagagcaaaaggaactcttatattctgttggtgggaatgtaaattagtacagccattatggaaaacagtatggaggtttctcaaaaaactaaaaatatagaactaccatacaatccagtaatcccactagttggtatctatccaaaagaaaggaaactagtgtatcaaaggcatacttgcacccccatgtttattgcaacactattcacaatagccaagatacagaatcaacctaagkgttcatcagtggatgaatggataaactgtggtaaatatactcaatggaatactatgtagttagccataaaaaaggatgatatcctgtcatttacagcaacatggatggaactgaaggtattatgttaaatgaaataagataagccaggcacagaaaggcaaatattacatgttgtcactcatatatgggagctaaaaaagttgatctcatggaggtagagaggagaatgatagttaccagaggctgggaagggtttggggttgggggaagaggagaataaggagaatttggttaatgagt

SEQ ID NO: 157946 - DNA, 601 bp, Human
tttgctacggtcgaaaaaaggaagttggagaaaacactctttccttttgattgagagacatatgcaaaatgtttgttgcaatacagtttatctgtttctcttttttcctacaacgtattttctcttctcttacaggaatgatttccctgatgaaaagatccctaccctaagggaagctgttgcagagtgcctaaaccataacctcacaatcttctttgatgtcaaaggccatgcacacaaggtacagtttaaattgtggacttcactttgttaaaaagacatcttatttcattgacggtcrtttccgaagttacatatattttgttatttattctttttaaaacttatttttataaattgtatttgtttaatggaagtgtacaatgcaggaatctatatcatttaaggaaacagtgcattatggaactttttaaccttttatggaaactttacaaaaccagcacaaaatggaagagtcaagtttctattatttacataaagcatttacaaaagatattaagtaaacagtaaaaaaggcatttctagaaaaaaaccactgtagtaaccttgagttacttgaaaaaaaggaattccgaagttg

SEQ ID NO: 157947 - DNA, 601 bp, Human
accctaagggaagctgttgcagagtgcctaaaccataacctcacaatcttctttgatgtcaaaggccatgcacacaaggtacagtttaaattgtggacttcactttgttaaaaagacatcttatttcattgacggtcatttccgaagttacatatattttgttatttattctttttaaaacttatttttataaattgtatttgtttaatggaagtgtacaatgcaggaatctatatcatttaaggaaacagtgcattatggaactttttaaccttttatggaaactttacaaaaccagcayaaaatggaagagtcaagtttctattatttacataaagcatttacaaaagatattaagtaaacagtaaaaaaggcatttctagaaaaaaaccactgtagtaaccttgagttacttgaaaaaaaggaattccgaagttgtacacaagaccagttttatctagcttaaaagttaagggccttatatggacaactatggactgcatttaaagagaattcctatattaaaagcttctaatagttaacagaacatataccttttacatagatgtatccctttgtataatttatatcccttatgtat

SEQ ID NO: 157948 - DNA, 601 bp, Human
ttaaccttttatggaaactttacaaaaccagcacaaaatggaagagtcaagtttctattatttacataaagcatttacaaaagatattaagtaaacagtaaaaaaggcatttctagaaaaaaaccactgtagtaaccttgagttacttgaaaaaaaggaattccgaagttgtacacaagaccagttttatctagcttaaaagttaagggccttatatggacaactatggactgcatttaaagagaattcctatattaaaagcttctaatagttaacagaacatataccttttacatagatktatccctttgtataatttatatcccttatgtatagttttttattcattgattttagcagttatacttttatcagaaaatcatttattttcttcaaatgtatttgacattcctagataaaattttgcttaaattttagggcctgcacttacactcataagaacatattattacagtgaaaatcagtgggaagatatgattctgattacatttgttctcttataaccagcttttcaagtgcaagtacttttttccccatttgggcaacttgagtatttttcccctagcaatattaataatcg

SEQ ID NO: 157949 - DNA, 601 bp, Human
aaattagcagtgtttcacaaattatgcagcagcagcattgcgtcccacatggctggtgactttcttgttgttagctgctattgatgtcacttcactaggggttaccaaataatacttaaattctatcatgtcttcttcatttcgtagctagactactataaaaagaaacttctgttcaccttgggaagaattgggagccccttaactcttcccagtccctcctacccttgccccattacttctccctccatattggtgatgggtaatgcgtcctctcagtcccctggactgagaaatctaycctctgtagttcccagactggctggctcatgtttcatttagaaaaggcacagagtgatagagctgtgggtatgaaaggacttttcatagtggctaaactagggtataaggcaaggaaaattttgcctctggcctcatctgacctacggcttaccacacttttcaaaagtattccaaaaggggtgaggccctcagagggagtaaagcagcagtactccaccttcttccttgtttgctgctggtgtgagtttaaaatgcatcccagtggataatagactctaccaatactttcagtacctcc

SEQ ID NO: 157950 - DNA, 601 bp, Human
ctctaccaatactttcagtacctccatttctagtaaacttctgttttattccatagggttgtacttaatatgtgatagttattggctggggctatctatcacattttaatcaattttaaatatatgaatctctttattttacaggctactgaggctctaaagaaaatgtatatggaatttcctcaactgtataataatagtgtggtctgttctttcttgccagaagttatctacaaggtaacattcgggatttttcttgtacatattaggtgagctggtgtagataattgcaatgggctgygtaagcacaggatagatgcctattaaattgaactgcatcagggtcacagttgagaagctcctcttttaaattaaccagagaaattccagaaggggaatgtactcataccccttacagaatgccattattcctcttttgccccttcttttatgttgtttataggctcactcagattactgtagtaaaattctcacaacagaaaagaattatgtagcccctacttctcaccaactaacagcagaacataccttcataaaataaattcttaattatggagaatctaaaacatgcataaaataa

SEQ ID NO: 157951 - DNA, 601 bp, Human
cagcctctcaaagtgctgggattacaggcatgagccacagtaaccagcctagtgatgcctttttaaaaacatagccacaatgccattgtcccatctaaaaattattaacaataaattattcatatcatcaaatatccagtgtataaattttgacttgtctcggaaatgtcataaatggttgtttttcataaattgctcattcgaataggacccaagtaagatcggcgtgttacaatcgtaaatctttttttgtttgtttttgagacggagtcttgctctgtcgcccagtggtatgatctcrgctcatcgcaacctctgcctcccgggttcaagcaattctcttgcctcagcctcctgagtagctgggattacaagcacacaccaccatgcctggctaattttttttgtattttagtagagacggggttttgccatgttggccaggctggtctcgagctcctgacctcaggtgatctgcctgcctcggcctcccaaaatgattacaggtgtgagccactatgccctgccggcaactgtaaatcttaaaacttgcaggttctgtctctctctctctctgttttttttgtttgtttgttttggg

SEQ ID NO: 157952 - DNA, 601 bp, Human
caggcatgagccacagtaaccagcctagtgatgcctttttaaaaacatagccacaatgccattgtcccatctaaaaattattaacaataaattattcatatcatcaaatatccagtgtataaattttgacttgtctcggaaatgtcataaatggttgtttttcataaattgctcattcgaataggacccaagtaagatcggcgtgttacaatcgtaaatctttttttgtttgtttttgagacggagtcttgctctgtcgcccagtggtatgatctcggctcatcgcaacctctgcctcccrggttcaagcaattctcttgcctcagcctcctgagtagctgggattacaagcacacaccaccatgcctggctaattttttttgtattttagtagagacggggttttgccatgttggccaggctggtctcgagctcctgacctcaggtgatctgcctgcctcggcctcccaaaatgattacaggtgtgagccactatgccctgccggcaactgtaaatcttaaaacttgcaggttctgtctctctctctctctgttttttttgtttgtttgttttggggggggtccttgttttgtatttact

SEQ ID NO: 157953 - DNA, 601 bp, Human
atcgcaacctctgcctcccgggttcaagcaattctcttgcctcagcctcctgagtagctgggattacaagcacacaccaccatgcctggctaattttttttgtattttagtagagacggggttttgccatgttggccaggctggtctcgagctcctgacctcaggtgatctgcctgcctcggcctcccaaaatgattacaggtgtgagccactatgccctgccggcaactgtaaatcttaaaacttgcaggttctgtctctctctctctctgttttttttgtttgtttgttttggggggggtccttgttttgtatttactgaagaaaccggattattgttttgtagagtttacccaagtccaaattttgctgattatgccatgatatggcttaatatttttttctctttattttctataaactggtagcgagagctggaagcttgccttgatgaggttagggttggttattcttggcaagataactctagagatgagggtgtttttccgtcaggaggcacttgacatctggttgactcctgttgtttttggctgctattgatgctcattggccagatctgtccattttctagggagctaca

SEQ ID NO: 157954 - DNA, 601 bp, Human
ctttaaaacgtataagacattcccccagaggagcacaagagcagagactaaaggaactccatccacatctctccatttctctgttgtcctctcccattctctcgtcacaatcccttctctcccttcccacctcacttccccatccccctcctcacccctacaactcttcagccatttgctctggaaagggtcaaaactaaacagcccatcttgaactgaccttggttccctcctcattgagttctaattaattatctctggccaggatttaagtcaatagccaattaaaagtttattctcrtgacattattaaaatttgatcctgaagttttaatttttccattttaaagataggattgcagtttttaaggactgggaaaaaaaagttctcatatgtgctgcatattagtgctttacattcttcacattattttctcaaagggtttatgattgagaacttatttagtagataccggggcagggtaccaaccatgaccacctcatctgattgagcacattggctaaatctaaactaataagtattcaactttacatatgatcattattttacttccccaaattcctttgcagatgagacaaa

SEQ ID NO: 157955 - DNA, 601 bp, Human
gtgagtgggaattgggaggaatccagatcagagagaaaaatacatgtaatgtgctctggcaggaaggaacatggttctttccaggaagtgaaagaaaattaatattctttcaattaatttaaaattaatcagcacagaaaagaaagggggaatgtggtgtgagatgaagccaaggagacaggtcggggccaggtcaggcacaccttcagtggctgtgccaaggacatttgggggtggcgatcattagtgagctactgaaatgttttaagctgggacagtgtagaggaggttcatggcatcytgggttttggaacagtccctctgatcacagtgcagaggccagttaggaggcattctctgggcaccattggtatgcagtgaacaccatacttagtggccattatggattcctgagacagctgcttattattctaacaggattggctttcctctttccccagggcctacttgaagaagtggtcagctaaaggaatccaggttgttggttggactgttaatacctttgatgaaaagagttactacgaatcccatcttggttccagctatatcactgacagcatggtagaagactgcgaacctc

SEQ ID NO: 157956 - DNA, 601 bp, Human; identical to SEQ ID NO: 29284

SEQ ID NO: 157957 - DNA, 601 bp, Human
aacaaacgattttgagtaaatatttacaaatgtaggatcttagtttaggaaattataacaaataccttaatataacattttaagctacttatagtccttggaaatagcaacaaatatcttagttattggactattataaccttagtcatcttattactgcttgattatgagacactctccctgctaatccttagaacatcttggttcttggtacttgacttttagcccctctgacatatagttgatgtcagagtgtctggcatttcagtagtgctctattttacaaatcccagtaaactgytccactgtggcttgtttatgtgttaatactgcttgttttctgttataaattattttttgctttggagtaagatatcatcattttgcatagctacaaatctgaagttaaagaaaattttaaaaatgtaattgtgggaaaataacaaatagatctgctgagatggaggctttgactaatgttttaataacaggcaacaaaacaaagaggcaggatattttggtcacaactaaacctaaattaaatcctcatacaaagccccattaagataaatgctcaaattctgggaacatttcacttgct

SEQ ID NO: 157958 - DNA, 601 bp, Human
ctcggtgactgatgcgtggggcactgggttttcccgggcggggcagggctggacgcgatagggctcctgcccctctcctgctcgcggctcccagcgcctccacggggcctgactctgacgctctggagctggggagttcatttcaaaagctgcttattttggtcagactgaacagcctcaataacaacagcggattcattcgggctttttccttatcctgttacccagaccccacccctgtccttaaacaagtggcaaaaagtgaattaagttcatctagtgaaagcaggagaggagaaarcctgtacttggagttgccacattgagtagcattcattttatgttttaaactgaggctccattagtaagtttcctgaaatgatgggctaaggcaggaaatgcgaatacagcaagcacagccttaatccactggagtctaaagtgggataaacccagggcgctggccatggcagaagtatatttgggactccaccgatggatgtactgttctaagtagaacagtactcagctgttgtgagtgttgaaacatgtagcatacttggcttgattaaatgaattctttaatgtaaaacgggtgcca

SEQ ID NO: 157959 - DNA, 601 bp, Human
gcccagagattgaatgtggtcgaatcaagagagactagaaatgacatttttgactccttgtctcatattgcatccttactgctattactgaccacaggaactgtaactcacaaaacgtccctcaaaataattttgtatcagggacagacattagagagacctgatatatatgcatcgatggaggtatttcctaattaagattatttgaatacacaatttttgcatagtaatttaaaactttaatttttgtactaagaattcccatgaaattaccatgattggagttttctaaatcaagtgrttttaaaaatagcttttcagtaagatatactgggtatttcaggcacctcaatgacgatccacatacccagggggaaaatatgtctgtcctttaatgccaggggaattaaaacaaacaaagaatgaagctctttcattcagtgtttttaaatatcatttgcaaatgtgttccccatccttcctttattgcagcttcaaaagctcagcaccaaagaggcaaattagatggagaaaaaacttattttagggtttaaggcatgaacataaaaaccatgcaactcagaaattttatgaactaaag

SEQ ID NO: 157960 - DNA, 601 bp, Human
atttttgcatagtaatttaaaactttaatttttgtactaagaattcccatgaaattaccatgattggagttttctaaatcaagtgattttaaaaatagcttttcagtaagatatactgggtatttcaggcacctcaatgacgatccacatacccagggggaaaatatgtctgtcctttaatgccaggggaattaaaacaaacaaagaatgaagctctttcattcagtgtttttaaatatcatttgcaaatgtgttccccatccttcctttattgcagcttcaaaagctcagcaccaaagargcaaattagatggagaaaaaacttattttagggtttaaggcatgaacataaaaaccatgcaactcagaaattttatgaactaaagctcctgtgggagatgatgttcctaattgccctggaagctccctgggtgttgcacaaagggcattatatacagccaggtctctgctctttctggttttcttttttatcatctaggattcatttgaagtttgctctcagtacatagccctgatgaaatctgtcatcttagattttctttcaactgagaatctatgtagaggagagcagctagtagag

SEQ ID NO: 157961 - DNA, 601 bp, Human
gccctggaagctccctgggtgttgcacaaagggcattatatacagccaggtctctgctctttctggttttcttttttatcatctaggattcatttgaagtttgctctcagtacatagccctgatgaaatctgtcatcttagattttctttcaactgagaatctatgtagaggagagcagctagtagagatgtcctgagactagtgaggagggtctctgaggagccaggccaggaacaactctcatcctagcagggccagaatttgggcatgtgtcactgtctcacacagacaccatgctcwgcttgtcctcactactctgtctgtggttggtcacagggcactcttccaagctttcagggaagggaaaagataacgaggcagatggcaaagtgcagatgtgtacacaccacacctggtgttgagcaccagctcagccactgtgtgctgaataactttgagttttggggggggggttttggagacagagacttgctctgtcgcccaggctagaatgcagtggcacgattttggttcactgcaacctccccctcccaggttcaagacgttctcgtgcctcagcctcctaagtagctggaatta

SEQ ID NO: 157962 - DNA, 601 bp, Human
tttgaaccctgaagaaaatatcagttttgccgtctcacctttctctgttctcagccaagttactctttagcaatcacagtggtatttgattggtccagtactttctgaatctttctggaggtttataaaaatgaacttggaggagagtggcctccccaaggtcatttttcctttgggatatgcagtgattcagggctggtatatcctgccgggttatatcagttttccctgttcaggagccccaccaaaccgaagcaatccaggcccatccctggggctgaggctgagtcacactggctcygggatataggctgaagccaagctgagtgaggcacccacgctgtctacaactttccatgcttcattcttctgtttccctttattctggttgcctcttctcatgtggtcatcacttcattttacaggggccactatcccattaacttggaatttggggattgccatttccttaacagaacctggatatatgggtaaatccacttaggtgacttctctttgaccaatgcctgggtgacttgatgaatattcaaggtgtggttacagactaaagaggcccttggtgatctatgatcagaaattt

SEQ ID NO: 157963 - DNA, 601 bp, Human
ggggccactatcccattaacttggaatttggggattgccatttccttaacagaacctggatatatgggtaaatccacttaggtgacttctctttgaccaatgcctgggtgacttgatgaatattcaaggtgtggttacagactaaagaggcccttggtgatctatgatcagaaatttatgtccagtgggattttaggaaaacaaataggtcattttttatctatccataaatgtgactccaatccccaatcaaaagatgattgaagtctttttacttcgattacaaaagattcctgtaagrggggaaaaaaacccagaatggagtcactgtggagactacgtaacctgtaaaagtgctgttcatgtattataattctttatagatggtttgagggttgtaagtcataccgcaatgacaaaacaaagtgaaatagcaacttttgaggatgcacttggctgggtacagaggatcctaggacagagaagtgtgttctgcattttattctgttaatggctttagtagctaagtcagatgggaattcaagcttgctcatttttctggaattcttattgatgaaaaatgtgtaaggattgaagtaat

SEQ ID NO: 157964 - DNA, 601 bp, Human
tgcacttggctgggtacagaggatcctaggacagagaagtgtgttctgcattttattctgttaatggctttagtagctaagtcagatgggaattcaagcttgctcatttttctggaattcttattgatgaaaaatgtgtaaggattgaagtaatctaaggactttggggattttacttctcactcaaatgaatacaggtttagtttaggtaaagcattgcatgcttaacgtttggttttcccttcctcattcagtaacatctgtggagggtgtctgctgtgctacgcattggcctaaaaayaatgaatcaactacctggaggagatctccagatcctgatggacatgtgcccttattatatctgacagtaatgaatacttccgattagaaaatttaacgtacacaaatatttttaagatccatttacctttcaaagtattccacttgcagtgatttatttgctttggcatctctactctgaagtcaatttaagtgcaaactcttgcttctcatccccagtgaatatgtttagtattcgatattctcctggcccttgtagggaatattcccatggaaagtgagaatttctttgccttattat

SEQ ID NO: 157965 - DNA, 601 bp, Human
tttatccaaatgtttttgatccgtggttgattatattcatggatatggaacccattgatacagagggctgactgtagttgtatattcaaacacagacaaatttatttatgacatttaagacaactatgaggtaatagtaaggaatgtgttattactccattttggcttctggattctagaagaattcagaacatattaacttaacattacttagattttttatttcatgttataaaatggcaggactcaggaaggtcatttgacttatatgcactctcctaactagaataggacatattasgattgatgtggctgaatgctagatgttgatattaccactcttaaccttttacgaagaaaacaatggcataggtttctctaatgtttggtctaacagttgaatagatagattgccaatatgatgccctctttcagtgtggtctgagaaaatgggtgttttctagatttgctcttgcctttagctgtatctgagacatttctattaaggatggtctttcactggatccacttggttgtattgtggcctgaagggttaatgataacattaaaaggaaacacataaggttatgttgaagagttc

SEQ ID NO: 157966 - DNA, 601 bp, Human
attgccaatatgatgccctctttcagtgtggtctgagaaaatgggtgttttctagatttgctcttgcctttagctgtatctgagacatttctattaaggatggtctttcactggatccacttggttgtattgtggcctgaagggttaatgataacattaaaaggaaacacataaggttatgttgaagagttcagcatatatgtttctatgttactgtaggatagtgtattagtctgttctcacgctgctataaagatactacgtgagactaatttataaagaaaggaggtttaattgactsacaattccacatggctgaggaggcctcaggaaacttacaatcatggcagaaggcaaaggagaagcaaatcatatcttacagggctgcaggagagagagcactggggaaactgccacttataagccatcagatctcatgagaactcactatctcatcttctcatgagaagagcatagggggaaccacccccatgatcaaaccaccttccaccaggtttccccctcaacacatggggattacaattcaagagagatttgggtggggacacagaatcaaaccatatcagacaggaatgtaatc

SEQ ID NO: 157967 - DNA, 601 bp, Human
atgttgaagagttcagcatatatgtttctatgttactgtaggatagtgtattagtctgttctcacgctgctataaagatactacgtgagactaatttataaagaaaggaggtttaattgactgacaattccacatggctgaggaggcctcaggaaacttacaatcatggcagaaggcaaaggagaagcaaatcatatcttacagggctgcaggagagagagcactggggaaactgccacttataagccatcagatctcatgagaactcactatctcatcttctcatgagaagagcataggrggaaccacccccatgatcaaaccaccttccaccaggtttccccctcaacacatggggattacaattcaagagagatttgggtggggacacagaatcaaaccatatcagacaggaatgtaatctagtcattaaactttaattaggtataattcactgcaaaatgcagttcatttttaggtcttccatcctggcaaactaaggaagtactggtcaaaaaatgtccatcaaaatccagagctggatgggacctcatgatgtcatagtttaaccttccagttattatttgctgtaaatgttcaa

SEQ ID NO: 157968 - DNA, 601 bp, Human
ttaaacagcaaacattcattttctcacagttctggagacgggaagtccaagatcagggtgtcaacatggtcaggggctagggagggttctcttcctggcttgcaggcggctgccttcttgctgtgtgctcacatggtcttttctcagttcatgcatgtgaagagaagaagagatctctttctcttcctcttctcatgaatcctccagtcctgttggattaggaccccatgcttaggatcttatttaaccttaattacctcctaaaagccctatctccaaatatagttacttttgaggttayagcttcaacatatgacttacggggacacaattcagtccatagcatttccggtgagggttatacatttgcacagcaacctcagtgactcttaagctcgttttacagcttattattgaaagccctacggctttcttggaacagctagaagtctgagtgtttccgaggggtattctgagcccgtaatctgacacacggaggtacgatggggtggcgcggctccgtgctcatgccagtagtgagacatatggaggaagctgttttcattgcatttacagattgcttcttttgtcaaatttctgt

SEQ ID NO: 157969 - DNA, 601 bp, Human
aatatagttacttttgaggttacagcttcaacatatgacttacggggacacaattcagtccatagcatttccggtgagggttatacatttgcacagcaacctcagtgactcttaagctcgttttacagcttattattgaaagccctacggctttcttggaacagctagaagtctgagtgtttccgaggggtattctgagcccgtaatctgacacacggaggtacgatggggtggcgcggctccgtgctcatgccagtagtgagacatatggaggaagctgttttcattgcatttacagatwgcttcttttgtcaaatttctgtaaaaataaaatcaagtaaatctagctagtgaatacaattctaaggttaacttaggcatttcctttgctgcattaactctttaaggcttaggaacctccacgctgtaaattcctgcatttctttatgctccagggagtatcctgatgtcaagatgtagctcaaggatactttggcttctgatgcaaagtatctgatgcaaagatggctggctgagtggtaccattggggaatgcttatatgttcagccattgaccaagcctgctgtcctgtggggggtg

SEQ ID NO: 157970 - DNA, 601 bp, Human
gaggtgctcttctctcagggagaaacttgcaggaggactgtgcctacctcaggaagatagtggggcacccaaggcagtgaagagggcaaactcggactccctaaggcaaatgtatgatcataaatgagaagggatttcttcatgaccgcatacagaattctgtgtacagagtttgaatcttttagtttatgagttacatgttcaataagtttatgtacttctcccaggctctttggtagtcaggttctgaaacagaaggaccaaacccacacaggttggctttgtctcataatctttccaygaacaagtagtttgagaagcctcttaaagggcttcggtgtgcattaagggcttgagaccaactaggaatttttaaatgcacatagggtgaccgtaactattgtgttatagaaccctcaagaaagaattcttcttcagtcaccaaatcgtgtgcgtcacaaatttttccacctcaagacctccctgaagctttgctccccttctctctgtcctcacacacacatcacaaaaagctcagtgtctggctaacccgtgttgccatgggaggcgagggggaaatgtaggagaggctgcaggctgc

SEQ ID NO: 157971 - DNA, 601 bp, Human
aggttggctttgtctcataatctttccatgaacaagtagtttgagaagcctcttaaagggcttcggtgtgcattaagggcttgagaccaactaggaatttttaaatgcacatagggtgaccgtaactattgtgttatagaaccctcaagaaagaattcttcttcagtcaccaaatcgtgtgcgtcacaaatttttccacctcaagacctccctgaagctttgctccccttctctctgtcctcacacacacatcacaaaaagctcagtgtctggctaacccgtgttgccatgggaggcgagrgggaaatgtaggagaggctgcaggctgcttggggacactgacctcctcatgttgaaaaggacaaaacactttcaaaggagaagtaatattataatatatattactttatgttccctcatactgtttttcataaagtactctcaattagaaaagccacttgataatatttttaaaggttgaacaagatggttctctcatttacaatcccattccaatgttacataattcaatttatattgatttactgtataatttctatgcactgtgctatttaatatgtttatatttattgtactattc

SEQ ID NO: 157972 - DNA, 601 bp, Human
tgcatctgttgagacagaacaattttcttgatgacttccagtgctagtgggctaattgttttttcattttataagggatgctacgttttatccagcattttacagtgttttatagggagagagttttcctataatttagtccttaatattatgcagaaatgaaaccttttgatgctttttagaaatttattttggatcaacttgcaagtttcttatcctttctgagctgcaagtttctataaaatagagtaatattttttactttattgcattgtttgggggaaaatgagctaatgtatamaaagtaaggaatacgaaaaaggtacactttgtgggtagtgggaatagctgagcaggatttgacgaataagtgtgagtgaattcaagatggttgaaagagtagtaccattacactgggtagataaggaaagaaaagcacattttaggtcaaaggaacaagtcatgtcctatgactgttcagcccagttttcatccataatcaactttattgcttcacaattctgttggttatgcttattttgtcttttgaggatataactgcaagaattcccagcagttcctatcaaatatgaatcttaac

SEQ ID NO: 157973 - DNA, 601 bp, Human
attgtttcccccaactccctggaaagatgtggaaatgaccagatgaggctctgtgtcgaaacccaaacccctcgtgggcaggcagaacttagttcttccataaataggatttctacactagagcttttcatcggcaacttttactctaatgaaaaaaaaaaagtaaaatcagtgaagctctggggttggcaatacctaagacaaatgaaaaggcattgaaaatcttccagatatatcataggccaaataaagtagtcattcgcaaagcttcctagacataaaaagttgttgctagctacgrttttgttcacagtgaaaaagaagcttctattttgagcttggttagataaaatgaagaaaaaacttttttttcaaggttataattagtgctctgagttttaacgctggtccactaatgttagtgtttagagacagattgttacaatgcttccctcctcttggtggtcagttctgccgtaaactcttcgctttatatttgcgcccctatcacttctggaattcgccatggatatctgcacactaagtttggctgaaacaattgtgttttttaaaaaagtaatattaacttgaggatctcata

SEQ ID NO: 157974 - DNA, 601 bp, Human
taatattaacttgaggatctcatatggccagaaaaatagttttaattgaaaagcatttttttttccagaaattaaatgattgtcattgtaaaaccacagtagtgtaatcagagaaacatgcagctgggcatgggacatagttcctaagattggcatttcctgggtagtagattatatataggtttgtaacagaaataaaaagagtcaggaaaagaagttttataactcttaggtatttgcaaactatgttaacattgttggaaagatttttgaaaagtgggtccttgctatgaaagcaaartatcatcctagagatgatgaaaccgaggctccaagggttaacttcatcagtcagctagaaagtggtggaggtgggttttgaaccatttcactagacccagagctaacatgcatgcaccaccttgttctctgtctttaggtatgtggcccattttgctgtaatacttcacagttcccttttgttgtcctttctcgggggcattcataggttgtctatgaatcctgtgaattcttagatacttatagtggatgcatgttgttgaaataacagagccagcaaggctctcaaacatctactttt

SEQ ID NO: 157975 - DNA, 601 bp, Human
tgtgaattcttagatacttatagtggatgcatgttgttgaaataacagagccagcaaggctctcaaacatctacttttttttaaagggttgctgggcattaccaattcattttttaagggagaacatatcactttaaggatttattatttgtattttactaatcactgtatgtcatgtttgttgggaaaagaagctatgatgataattgctacattctccatagctcttctcaacagctgacaggttatctatctacttatttgtttatggtctgcctctccactttagccccatcaaggyagggatttttctctcttcttttcactgtagtatctccaagcctcaaagagtacctggcacatggtagttacacaaggaatatttgttaaatgagcagaatgagacgatttctaagttgtgactgagtgcttatatttacatctgttattcattttcagcttgaatttgagcacagtttgagttcctgtgagatgggggaaaacacctactacaattccaggcacgttatttatgatatttaaaagccaattattaactgtcattttctccattttgtatgtgataagactgagtctcaat

SEQ ID NO: 157976 - DNA, 601 bp, Human
aacagctttgtccaagatcatttagctagcaaagtaatttgagtcaagatgcaaactttaatgcccatgttcttaccactgtgtaaccctgtctccttaattatgtgtatagttctatacttgattttacagaatcaaataagcagttatcatttattgaatgaactgttacttgatgtttcatgctttgcgccattttcacctttctcactttatccaattagggaaagagtacattttgtgttcctttatcttgcttttacctaaaaatataatgaaaaagaattaataataataatamcaaatataggaaggggatatcattcataattctaccatatttaagccctatgtgattaacaccaaaaattttgcctttaaaaaaataacacattgggggaagctgattcaatgcttcttacattataaaatggatgagggattttgataagtgatcagcaaggtgggggttgtataagctgctgtcagctgctcatattcacatctggcatggactggtcaaatgacattacccttggcaatacattttcctgtgcctcagttcctctggggattaaactgtgattttctaaagggcaaa

SEQ ID NO: 157977 - DNA, 601 bp, Human
catttctaaaacatcagttttctctcccttgaaaaatgcattcttgagatgattaaatgcaagaatacatgtcaagtgttcagcacggggcttaacactctgtaaatattcataaatggtatattagtagtagtagtatattattgtttataataaatgactctctataggaaattctactagtcagtgtgtcactctggacccctaaccatttcgataaaccctacaccagacatcagcatttagaacactgggcttacagcttagcctagtggttctcaaaaggttcatcccagcaccrgcagcatcagcatttcctgggaatttgttagaaatgcgaattgtcagtgatgatgagcattttttcatgtgttttttggctgcataaatgtcttcttttgagaagtgtctgttcatgtccttcgcccactttttgatggggttgtttgtttttttcttataaatttgtttgagttcattgtagattctggatattagccctttgtcagatgagtagcttgcaaaaattttctcccattttgtaggttgcctgttcactctgatggtagtttcttttgctgtgcagaagctctttagttta

SEQ ID NO: 157978 - DNA, 601 bp, Human
gtgaaagttgattaacttacagaaatagagtcccattgcaggtacacgatgaaacgggggtaaggaaggagaagaaaaacattgaaaggcatttgacagggtaaggttgtattccccagacaaccctgtcaagcagctctgttgacaacaaaaagaagaaaacaaataaattggaggttgtgtgaatgtcacaagaccagaatataaatacatatgacatggagagagtaaataccaataattctcattctcacaaaatgttttaggatgataccttccagctatgacaagaccaaaaggraaaaaaaataataagcaggtaaatctccgagacactggtccagtatctaccttttattcataatacaaaccctcaaaagacaccactgcagttataataggccaaataacaaagacaaagacaatgtgtgacaagactcaggactcgcacatccacaaaaatggatttaacattcagagaccatttcagccctgtctaactttctagctcacaagagagaatgcagacttcactctgcatggacaaaaagatatcttcaggcagaatgtggaatttaggacttcagttttctcttcacgc

SEQ ID NO: 157979 - DNA, 601 bp, Human
ttataataggccaaataacaaagacaaagacaatgtgtgacaagactcaggactcgcacatccacaaaaatggatttaacattcagagaccatttcagccctgtctaactttctagctcacaagagagaatgcagacttcactctgcatggacaaaaagatatcttcaggcagaatgtggaatttaggacttcagttttctcttcacgctaaaccaattgtagaaacacacatccaaaaataaagtgatgattaccgtctttcttttttccattaaaaatcactttaagcttttcttatcracttaattatttacatgcacattgactaaatcttaacaagctcttaaatgctagttgccctgttgcctctcagcactagccttcccagtgccacacacgtgccatttgcctttgtgctctgtgacaccaccatctgggtgtctggtccaacaagcgccttcttgaaaaccttacataactccccttttcctgtgccatgggcttcacctcaccatatctaatgggagctctggcctggactctaggaatgtcattccagataggcctgacgggtctcactgcccattaacatgagctccc

SEQ ID NO: 157980 - DNA, 601 bp, Human
tagccttcccagtgccacacacgtgccatttgcctttgtgctctgtgacaccaccatctgggtgtctggtccaacaagcgccttcttgaaaaccttacataactccccttttcctgtgccatgggcttcacctcaccatatctaatgggagctctggcctggactctaggaatgtcattccagataggcctgacgggtctcactgcccattaacatgagctcccccttccctgctgggaagccagaatgccgtgtcttcctggcacgtccacgtcctgccaactcaggagacaaaaccatyagtctaccatgagaaatctggttttctctccatggccagaaaaccttcagttttcagtaccagtaaagcctacccttctaaaacatgcttacactgaacatcaataaactctttgataaagaagtcttgttacaacatgcaaagctgtaggcaaaaaaaaaaaaaaaaaaaatgacagtcccctctcaccttagaacatatcaagccctatcagaaggccaagaaattaaaatatgttgaatacatttaagctttatagcaaataccctgtacaagaacctaaattgaagctttcaaaaa

SEQ ID NO: 157981 - DNA, 601 bp, Human
agtgccacacacgtgccatttgcctttgtgctctgtgacaccaccatctgggtgtctggtccaacaagcgccttcttgaaaaccttacataactccccttttcctgtgccatgggcttcacctcaccatatctaatgggagctctggcctggactctaggaatgtcattccagataggcctgacgggtctcactgcccattaacatgagctcccccttccctgctgggaagccagaatgccgtgtcttcctggcacgtccacgtcctgccaactcaggagacaaaaccattagtctaccaygagaaatctggttttctctccatggccagaaaaccttcagttttcagtaccagtaaagcctacccttctaaaacatgcttacactgaacatcaataaactctttgataaagaagtcttgttacaacatgcaaagctgtaggcaaaaaaaaaaaaaaaaaaaatgacagtcccctctcaccttagaacatatcaagccctatcagaaggccaagaaattaaaatatgttgaatacatttaagctttatagcaaataccctgtacaagaacctaaattgaagctttcaaaaatctaaaagga

SEQ ID NO: 157982 - DNA, 601 bp, Human
tgactaacaaatccttgtctccaacccaggcctcgttcctgagctctaagcccatatagttgtgatttgtgtccacgtgggatcatcattccccactcccattctgcccctccttttctatcttatctcattaaatgtccacaccacccacctggcagcaccttcctgatctctccctctcttcagctcttacatctttaccttaatcagtcttcaaagcctatggattcagcttttttactgtcactcaaacacacccactccctatccctacctctacctgagctcagacacttatcakttctcaggtgaagaatggcctctaggtgatcttctcttcccaagaattgctcccatccaatccattcttcatagccagaaggaccattctaaaaggcaaagtcagccatgcccttctgctgctgaaaatgtcctagttgaaatcaaagtcctttgtgatctacttcctgcctattgctgcaaacacatcttttgccttttattttttttctctgcactggacctagaggaatcctcaaatgtttactctgcctttcttcatgcctttgcacgtactattactctctctgcacagaatacc

SEQ ID NO: 157983 - DNA, 601 bp, Human
gactaacaaatccttgtctccaacccaggcctcgttcctgagctctaagcccatatagttgtgatttgtgtccacgtgggatcatcattccccactcccattctgcccctccttttctatcttatctcattaaatgtccacaccacccacctggcagcaccttcctgatctctccctctcttcagctcttacatctttaccttaatcagtcttcaaagcctatggattcagcttttttactgtcactcaaacacacccactccctatccctacctctacctgagctcagacacttatcatwtctcaggtgaagaatggcctctaggtgatcttctcttcccaagaattgctcccatccaatccattcttcatagccagaaggaccattctaaaaggcaaagtcagccatgcccttctgctgctgaaaatgtcctagttgaaatcaaagtcctttgtgatctacttcctgcctattgctgcaaacacatcttttgccttttattttttttctctgcactggacctagaggaatcctcaaatgtttactctgcctttcttcatgcctttgcacgtactattactctctctgcacagaatacct

SEQ ID NO: 157984 - DNA, 601 bp, Human
actaacaaatccttgtctccaacccaggcctcgttcctgagctctaagcccatatagttgtgatttgtgtccacgtgggatcatcattccccactcccattctgcccctccttttctatcttatctcattaaatgtccacaccacccacctggcagcaccttcctgatctctccctctcttcagctcttacatctttaccttaatcagtcttcaaagcctatggattcagcttttttactgtcactcaaacacacccactccctatccctacctctacctgagctcagacacttatcatttctcaggtgaagaatggcctctaggtgatcttctcttcccaagaattgctcccatccaatccattcttcatagccagaaggaccattctaaaaggcaaagtcagccatgcccttctgctgctgaaaatgtcctagttgaaatcaaagtcctttgtgatctacttcctgcctattgctgcaaacacatcttttgccttttattttttttctctgcactggacctagaggaatcctcaaatgtttactctgcctttcttcatgcctttgcacgtactattactctctctgcacagaatacctt

SEQ ID NO: 157985 - DNA, 601 bp, Human
aacaaatccttgtctccaacccaggcctcgttcctgagctctaagcccatatagttgtgatttgtgtccacgtgggatcatcattccccactcccattctgcccctccttttctatcttatctcattaaatgtccacaccacccacctggcagcaccttcctgatctctccctctcttcagctcttacatctttaccttaatcagtcttcaaagcctatggattcagcttttttactgtcactcaaacacacccactccctatccctacctctacctgagctcagacacttatcatttctmaggtgaagaatggcctctaggtgatcttctcttcccaagaattgctcccatccaatccattcttcatagccagaaggaccattctaaaaggcaaagtcagccatgcccttctgctgctgaaaatgtcctagttgaaatcaaagtcctttgtgatctacttcctgcctattgctgcaaacacatcttttgccttttattttttttctctgcactggacctagaggaatcctcaaatgtttactctgcctttcttcatgcctttgcacgtactattactctctctgcacagaatacctttcc

SEQ ID NO: 157986 - DNA, 601 bp, Human
acaaatccttgtctccaacccaggcctcgttcctgagctctaagcccatatagttgtgatttgtgtccacgtgggatcatcattccccactcccattctgcccctccttttctatcttatctcattaaatgtccacaccacccacctggcagcaccttcctgatctctccctctcttcagctcttacatctttaccttaatcagtcttcaaagcctatggattcagcttttttactgtcactcaaacacacccactccctatccctacctctacctgagctcagacacttatcatttctcgggtgaagaatggcctctaggtgatcttctcttcccaagaattgctcccatccaatccattcttcatagccagaaggaccattctaaaaggcaaagtcagccatgcccttctgctgctgaaaatgtcctagttgaaatcaaagtcctttgtgatctacttcctgcctattgctgcaaacacatcttttgccttttattttttttctctgcactggacctagaggaatcctcaaatgtttactctgcctttcttcatgcctttgcacgtactattactctctctgcacagaatacctttcct

SEQ ID NO: 157987 - DNA, 601 bp, Human
tctctgcactggacctagaggaatcctcaaatgtttactctgcctttcttcatgcctttgcacgtactattactctctctgcacagaatacctttcctcacactctccttttagccactttctgcatatcctcaaaactcatctttctccaggaagttttcatcagggtagtcattccttctgggtattcctatagcagatgtagtcctagtacttttacaatattccaactcattatcctctcttttcccactggactgggagatccttagatgctggatagtccttggtgtaagggccwgttttgccatctctcatttcccaggatcatacaataacacagggcctgcttattgtatgtcctccataaaattctgtgaattgaataagtcaaatgctctagaatgaggtcatgtgttcctatgcaacttctttctggaagccagggtaaatgaaggctacaaagaagtagctactgctgaaattagaaattttgttcaagtagacgcactgaatcagatttttaaggtgctagttaggccttattactggaatgtgtctcttatggagacaaagaggaaagtcttggtaattgccaact

SEQ ID NO: 157988 - DNA, 601 bp, Human
gggtagtcattccttctgggtattcctatagcagatgtagtcctagtacttttacaatattccaactcattatcctctcttttcccactggactgggagatccttagatgctggatagtccttggtgtaagggcctgttttgccatctctcatttcccaggatcatacaataacacagggcctgcttattgtatgtcctccataaaattctgtgaattgaataagtcaaatgctctagaatgaggtcatgtgttcctatgcaacttctttctggaagccagggtaaatgaaggctacaaagaagtagctactgctgaaattagaaattttgttcaagtagacgcactgaatcagatttttaaggtgctagttaggccttattactggaatgtgtctcttatggagacaaagaggaaagtcttggtaattgccaacttcagctggtagtctctagcgaagaaggcagttacgtgggagagcctgaccctgtgcacctacagacagaaactcacaggcatgtgcctagggatataagcaggattacaaacctcaatctggtgtgtcaccaataaacaaaaagtaggtctttctttgattgttt

SEQ ID NO: 157989 - DNA, 601 bp, Human
tagattcagcttttactatgcctgtcctccccatctctttctctgaatttgcatgctactatctgagctctggttcacctgatatattgatcttgctcagattagcaaaataataccctgatgttctcactgccaacccacccaacatcactgctaattttcctgaaatgtgtctctcaaatcatgtcattccctgctcagaaattttcaagggagtaccgctacttactaaatccatcccgtatccccagatattcatcctaccctttttgctctatatgttttttgtttttttgagatrgagtttcgctcttgttgcccagactggagtgcaatggcacaatctcagctcactgcaacctctgcctcccagattcaagcgattctcctgcctcagcctcccgagtacctgggattacaggtgtgcaccaccacgcctggctaatttttgtattttcagtaaagacgggtttcaccatgttggccaggctggtctcaaactcctgacctcaggtgatccacccgcctcggcctcccgaagtgttgggatgacaggcatgaggcaccgcacccgcttatatgtcattgttttaaactatgg

SEQ ID NO: 157990 - DNA, 601 bp, Human
tagggcgtttctcatcagcatagccgcattttggtgcccccatctcgggaccctggcctaagctttgttagaggatttatttcctcctgttgaatgcccagatagccaggacaagcaaacgggccatgatgacagtctcattgtagtccacacgtgcacacacacgcaccctccctttcgcttagagaaaatagccacgggctcttttttttttctcaagctgggacagccctctgggggttcggggattgggggtagggtcccttcgcaggccctcgatgccaccagcgcgttccttttycctccctgggctttgcctctctgcctctgggcttggctgggcatcggctgcaggtcgcgcttcctgcctttcctagtggcctgactttctcagggctcccctggaggttcggaaacgtgtcgggggcatgtgcctgcggaaacattccagggcacgttccctcctgcccacatccaggaggcccctgggctgcttgcggcagcctcctcccgagcagtgcgctgcagaagggcccttcccgttcaggccaccggggaaggtaattaaattggagcagaaacaccctcctcccgaggtcac

SEQ ID NO: 157991 - DNA, 601 bp, Human
atattgcccaacaaatgttacagaaaattgctatctaaggagcttggtgcggtggctcatgcctgtaatctcagcactttgggaggctgagtcaggaggatcacttgaggtcaggagttcaagaccagcctgggcaaaatggtgaaaccctgtctctatcaaaaaaaatacaaaaattagctgggtgtggtggcacacacctgtagtcccagttactcaggaggctgaggcatgagaatcgcttcaacccaggaggcagaagttgcagtgagctgagatcaagccactgcactctgtctcaaaaaaaaaaaaaaagaaattgctatttaaggatgtatgtatgttagaggtaggaaggttatcacaagacccccgcccccaacttccatccattgttggtgataaaacaggtagagaaaactccatttggggccattctactaagcagatgactaccaggtgggaaatgatcactttaacctgggccttccctggttaaaatcatagatataccattgttcccagagcaaactgttcccagttctctgctggctgtactgggaatacagctacgatgggtacacacacacacacacacaca

SEQ ID NO: 157992 - DNA, 601 bp, Human
aagccactgcactctgtctcaaaaaaaaaaaaaaagaaattgctatttaaggatgtatgtatgttagaggtaggaaggttatcacaagacccccgcccccaacttccatccattgttggtgataaaacaggtagagaaaactccatttggggccattctactaagcagatgactaccaggtgggaaatgatcactttaacctgggccttccctggttaaaatcatagatataccattgttcccagagcaaactgttcccagttctctgctggctgtactgggaatacagctacgatgggtccacacacacacacacacacagaacatggtcaagacagtttaatttggctcttggcaccaagagtttgaagtcagtaatcaagcctgaatatttcagaacaacccagaattgttcaaatattcttccccattggttctacaaaataaatccatatttttaggctaaaaactccaatttttgcataaaatgtagtcactgaaaatattgagggccagacgaagtggttcacggctctaatctcaatactttgggaggctgaggtgggaggatcacttgaggcttggagtttgagaccagcct

SEQ ID NO: 157993 - DNA, 601 bp, Human
attctacgctcttccagtgaccttagatagacagtcaagctgtatgtaatccctgatggattcccttacaggcaaaccagagataagcttagggcaccagcaaccagtatgtacacccacacccacacatacatgcacacataccactcaagaaaaagaaaaagtaaaaatgtaaatacagcattccaaatttaagacttgaaaacacttgaaatcatcactgtgtggaacacactcatttggaggacttttgtacacatattttgtagtgtcacatatatgttttaattttgaattatayataagggaaggtgggggaagggcatcatcttctcagagctactttcctctgaacctggaaatgactggaactaatattactttgtgaagtgtccatttaccagaattgttctctgtagagagcaacttttgactgtggtaatgtaattcttgcactaagaactatgtgtactagtctcaaaagctggggactctgagccttacctagagtctcagcaggtggaccattaagattaacatttctagtaggtgagttcaatcacaaaaatatttcttgttccatagattttattgtggccat

SEQ ID NO: 157994 - DNA, 601 bp, Human
agataggaaggcctcacaggacttcattctatatctttacagcatttgcaatcaaaactggccagttaaatgctttcgttcacttttgaattttaacagaatataggatatatcagtttggacttgttttttgttgttgttgttttttgttttgttttgaagttcagtgcacttttttttacagtaagattacaaaaatttaggaacatgatggattaatgagagtgggaatagatgcacttgagatgtgtatgtatagatacctatctatggataaatagaaatctgtacagatagatayctatctatatatggacttagaagaaattaagatgagtccattaattcatggtcaatttctcaataaagtgttagcaaatgtactaggaatgattctggccttctcatccatctccttccctgacttagttctgacgatggcccagctccgtgtttctttaacgagtgcaagttactaagagataccatttaaaccacttcagaataggttgcaacgtgagaaactgcatcctcacttctttgaaaaatatatgccttttagaaagctgaacattagaaaatactgaagagtaaattcaat

SEQ ID NO: 157995 - DNA, 601 bp, Human
acactctcatattaagcacccctttgtgatcatctagttatacaagacccagtgaaagaggaacacctgaccatactagagaggctatgtgatgtcacagacgaaaactgaaaaacttgtcaatcattaaaacaatagaaaattgggtctaacataaacaaaccacacaagttaattggtaggtttttcttttgcacttttcattaagatacattgggaacgagcaggtagacaaagccagagcctggaggcttgcaagagattggaaatgtgtgacatcaagccaatgacaaaaaaaagstgtaaatctgagaactgtagtgatttgtatccctatagttatagatatcttaaaactaattgagcatccattatgtcttttttaattattagacaatatcatatcgtatattaaagtttttattccttagtaagaatttttaaatcacaaaatagtgtggcaatatttaggtaatagaatttatggagtgctgaaaatactagaatataaaggtaatttctagtttatcgtcacatactaaacttttctaaaccagctggtttctcacagacagtatttatttttttaaaataatttaag

SEQ ID NO: 157996 - DNA, 601 bp, Human
attatccttgactctagtagtagtctcctaactggttcccatttgtgttcattcccaacacagcatacccagtgatcctgttaaaatgttaattagaataagacattccccttctcaaaaccctattttgtctcttcatgttactcaaagtcagaattcttagggttgtctgtagactctacatgattgaaccaccctgtttcttccctcatttttagctgctctctctctcattcacactgccttccttgagattccttgaacatgccagggacattccaggtctcagggcttctcttaactgcttctgcctgaaactctttttctagctatacacttggcttgttccttcatctccttcaggtcttgaatgccattctctcaacaaagccttccctaaccacttattcaaaattgcagtttctgtcctgccattccttatctctcttgcttgttttatttttctcaatagtacttactgccttctaatatactacatcatctgttcattattttatatagtaattgcttccttgcattttatcacccaaatgtatatccctaaatagtatagtttattcttgcctcttaaaaaaaaaaa

SEQ ID NO: 157997 - DNA, 601 bp, Human
attcttagggttgtctgtagactctacatgattgaaccaccctgtttcttccctcatttttagctgctctctctctcattcacactgccttccttgagattccttgaacatgccagggacattccaggtctcagggcttctcttaactgcttctgcctgaaactctttttctagctatacacttggcttgttccttcatctccttcaggtcttgaatgccattctctcaacaaagccttccctaaccacttattcaaaattgcagtttctgtcctgccattccttatctctcttgcttgtyttatttttctcaatagtacttactgccttctaatatactacatcatctgttcattattttatatagtaattgcttccttgcattttatcacccaaatgtatatccctaaatagtatagtttattcttgcctcttaaaaaaaaaaaagagatgtatgtgggtggattattttgttatttttactgtatttgtttgctgttgtgcctctagagcctagaactactctctggtacgtgacatatagcactcagtaaatacttgctgaatgaatgagcatccagcgcctgtttgtttgtttgtt

SEQ ID NO: 157998 - DNA, 601 bp, Human
tacgtgacatatagcactcagtaaatacttgctgaatgaatgagcatccagcgcctgtttgtttgtttgtttgtttgtttattttttgagacagagtctcgctctgttgcccaggctggagtgcaatggtgtgatctcagctcaccacaacctccgcctcccaggtacaagcgattctccctgcctcagcctcccaagtagctgggattacaggcgtgcaccaccacatccggctaatttttttgtatttttagtagagacggggtttcgccattttggccaggctggtctggaactcctgacctcaggtgatctgcccgcttcagcctcctaaagtgctgggattacaggcgtgagccaccatgtccggcccagcttttgtttattttatctggtatagtttgtatgactttctacgtaatgaaccttctaaaatgagggtaaatgacaggttgggttccttgagttgttctttttaagttttgcaagggacaatatgttgtcattgtggggggtagggagccactttcggattgttgaaactggaagtactttggagagtatcttaaccaactcttttattttacagatttggaaacta

SEQ ID NO: 157999 - DNA, 601 bp, Human
tatattgtatggcttttttttttttttttttttttttgagacagagttttgctcttgtcgctcaggctggagtgcaatggtgcgatcttggctcggcacgatctcggctcagcacgatctcggcttactgcaacctccgcctttcgggttcaagcgattctcctgcctcagcctcccaagtagctggcattacaggcatgtgccaccacgcctggctaattttgtattttttgtagagatggggtttctccttgttggtcaggctggtcttgaactcccaacatcaggtgatccgcccacytcacccacccaaagtgctgggattacaggtgtgagccaccacgcccagtggtgtatgggttcttttatatgaaatgtctagaacaggcaaagccatagagacagaaagtaaatttgtagttgggtagtgggctaagaggtagagggtttctttttggggtaatgagaatgttctggaattaaatgatgattgcacaactcaatatactaaaaaccagtggattatatactaaaaagcgtgaattttttctggcgtttgacttacattgcaataaaactgttataaaaatagtaaaattag

SEQ ID NO: 158000 - DNA, 601 bp, Human
caggtcccaggtctttgtcagggggtgtccaggtagaatacacccagcccataccctctgctgccctgtaggccctttgctagttgctcaagtgttgaaagcccctgcgttgaagtaatctgccgggacttgaaacttggctttggcactgattgtctgacgtgcctaacttggtcagtccttaggaacccagtttctccatttgcaagttggatataataacagtgtagacctcctatggttaattgaagaatcaatgagttaatacagcgatacaggtagtcttgtgcctagcacgtartgagggctcagtagatgccacttggtagcagcagcagcagcagcagcagcagcagcagcagcttcttaggttcacaatgttaagagagttttgtattaaatattgaaagaaatgtgacaatttatcccaaatgtgttgaagttttaggttcttgggcatatttgtttttcaaagacactccttagatatactagagatacaatttacacataatttttaccaacatggtggcgatttatataatgcagatctctcgacagctctttgaccgcatgatgtagggtagcaggaatcgagaac

SEQ ID NO: 158001 - DNA, 601 bp, Human
gtagggtagcaggaatcgagaactagagggagagtgtgttggatttgtacgctgctttgtctagtttctttttgaggtctctgagagcagggtctaagactttcagtcatcttttccccactaatcccgttatctagtgggtgctccatacatttttgttgtgtgaactttgggggaaatcagggagaaggcaagccagatttatttgttcctgtttcctctgcacttccccccctgtctttgaccagtgtgggtaccttgctttctgttatacaatggatgagttttggacaactgaatmaattgggacagatattgaacatgcttgtgtaactggtataagggaacatgaatgtttttgtagtaattgggagttatctttctcagatttgttttttggatttggatatgtcaggttgttttaaaggggagcacgtctatttcctcataatcctgctgccctctttattggcacaatttctattcatggtcttatcattcctcttacagactttggagctacaactggattttccagttcttactgtgttaatgagacttgtgctgtaactaccgtaactactaatcacatgtggctatt

SEQ ID NO: 158002 - DNA, 601 bp, Human
tgttatacaatggatgagttttggacaactgaatcaattgggacagatattgaacatgcttgtgtaactggtataagggaacatgaatgtttttgtagtaattgggagttatctttctcagatttgttttttggatttggatatgtcaggttgttttaaaggggagcacgtctatttcctcataatcctgctgccctctttattggcacaatttctattcatggtcttatcattcctcttacagactttggagctacaactggattttccagttcttactgtgttaatgagacttgtgctrtaactaccgtaactactaatcacatgtggctattgaagtttaacataattaaaggtaaataaaattaaagattcaatctcgtagttacactagccacatttcgagttctcagtagccacatgtggctagtggctactgtattggacattgcaagtatgtgtagaacatctttgttatggcacaaagttcttatagacagacagagcagttctagaaactgtagttctgtctttgaagtttaacaactcgataagctatcagtaattgagagtcagaaaaactccttttactctaaaatac

SEQ ID NO: 158003 - DNA, 601 bp, Human
ctttgttatggcacaaagttcttatagacagacagagcagttctagaaactgtagttctgtctttgaagtttaacaactcgataagctatcagtaattgagagtcagaaaaactccttttactctaaaataccgtgacacaagggggtttgcagtgattcaggtagcaaagatctttcacgtgtattgtttcgtatgactcttaagacaattctatgaggtagggagggtagataaatgggaataaaaatttcatattaagtagctggcaaaactaggactagaactcaagaagtttttgyggattttaaaaaaattttaaatttctatttatttttaaaatttcagtagttttgggggcacaggtggtgtttggttaatgggttagttctttagtggtgattttggaggtgttggtgtactcttcacctgagtgcagtggtgccatcatggctcactgcagcctacacctcccaggttcaagcgattctcgtgcctcagccacccgaatatctgggattacaggcgcgtgccaccacactcggctaagttttgtagttttagtagagatgagatttcactatgttgaccagcctggtctg

SEQ ID NO: 158004 - DNA, 601 bp, Human
atggcacaaagttcttatagacagacagagcagttctagaaactgtagttctgtctttgaagtttaacaactcgataagctatcagtaattgagagtcagaaaaactccttttactctaaaataccgtgacacaagggggtttgcagtgattcaggtagcaaagatctttcacgtgtattgtttcgtatgactcttaagacaattctatgaggtagggagggtagataaatgggaataaaaatttcatattaagtagctggcaaaactaggactagaactcaagaagtttttgcggatttwaaaaaaattttaaatttctatttatttttaaaatttcagtagttttgggggcacaggtggtgtttggttaatgggttagttctttagtggtgattttggaggtgttggtgtactcttcacctgagtgcagtggtgccatcatggctcactgcagcctacacctcccaggttcaagcgattctcgtgcctcagccacccgaatatctgggattacaggcgcgtgccaccacactcggctaagttttgtagttttagtagagatgagatttcactatgttgaccagcctggtctggaacccc

SEQ ID NO: 158005 - DNA, 601 bp, Human
acaggcgtgagtgaccactcccagcatagggtctacatcttctgactcttaggttccatactctttcaacttaagaattacatttttctttcgtttccgcctcctctcctcttctttggtaaacctgttaatactcttacttggcagttttttgtagggctgtttacctttaatacagaccaacaggttgggcttcttagcaaaagggcttggtctttaaataacagttattaatcagtgtgtgttgaattctactatgtgttacgtattttgcatacattgtcagaactataagattaaygttgtccaattttatagaagaggaggctgatgtaagagatttcgaattcctttgctgtaagcttagctctagagtgcttcagaagaacagcaacgctgaaacctctggctttcagtagtgtgtataaatgatggaattctttctaatgtgcttcctgtagctttagctaccaggcattcgttgatgtcaaatctctagacttctctgctgggctcagacccatacccatattgccatctggtgtttggacattctcatctggctttttcattattaaattcagcaggtctaagcttcaac

SEQ ID NO: 158006 - DNA, 601 bp, Human
atcagtgtgtgttgaattctactatgtgttacgtattttgcatacattgtcagaactataagattaatgttgtccaattttatagaagaggaggctgatgtaagagatttcgaattcctttgctgtaagcttagctctagagtgcttcagaagaacagcaacgctgaaacctctggctttcagtagtgtgtataaatgatggaattctttctaatgtgcttcctgtagctttagctaccaggcattcgttgatgtcaaatctctagacttctctgctgggctcagacccatacccatattkccatctggtgtttggacattctcatctggctttttcattattaaattcagcaggtctaagcttcaacttatttctgtcttccccaaagttcctttggttcctgtcttaaacctaggttaaatggtaccacctaattgtgtgagctggaaatcccaatgtttttctttccgcttttcagtttatcttatgtagatggtcactaaaaccttttggtctacctcctggatgtctgttaagtcactgcattctctgtccctgattagtttatgctgttttgataacctccaaagtggcctccct

SEQ ID NO: 158007 - DNA, 601 bp, Human
cttctcgaagtactggggttacaggtgcaagctactgcactggcttgtatgagagtaaaatagagttcatgagtgataataattgccaaatgttttataactgtgactattagggagacatatactgaggccaccaggtggcgttgaccaggtagtcattgccatttcctgtaaggtagtagagcttattacctggtaggtgggtagatatatatgcctttgatttccaaataagctttggaaagaaaagaaaataccttcggctaggcatggtggctcaggcctgtaatctcagagtttyaggaggccaagttgagaagatggcttgaggccaggaatttgagaccagcttgagcaacatggtggcaccccgtcactacaaaaaataaaaataaaaaaaattagccaggcgtggtgctgggcacctgtattcccatctactctggaggccttataggcttttaaaccaattattttaaattatgttttgaaattactaaaaatactaaaggactgtttttttttccagctcagaagataaaataacagtccactttataaaccgtgatggtgaaacattaacaaccaaaggaaaagttgg

SEQ ID NO: 158008 - DNA, 601 bp, Human
aaattagccaggcgtggtgctgggcacctgtattcccatctactctggaggccttataggcttttaaaccaattattttaaattatgttttgaaattactaaaaatactaaaggactgtttttttttccagctcagaagataaaataacagtccactttataaaccgtgatggtgaaacattaacaaccaaaggaaaagttggtgattctctgctagatgttgtggttgaaaataatctagatattgatggctttggtgagtatgaaacatttcttaaaatgcataagtgaaactgttagktttcaaatttttattttgtggtttttttttttgaagaagtttaacctatagcatgctatgtaaaatattaacattcaggatgtgttagtgttatattcttgtttataaagaataatagagtgacaccattgttctgttctttgtacatttaaataagtcatggccagaaatctgctgtggcctcattaccttactgtttatatgtgtgatacaaagccgacggtagggagtagagttaaaagataccaggttagagagaataaatgtcatagcacagaggggtacttaaatatcttgaat

SEQ ID NO: 158009 - DNA, 601 bp, Human
ttcccatctactctggaggccttataggcttttaaaccaattattttaaattatgttttgaaattactaaaaatactaaaggactgtttttttttccagctcagaagataaaataacagtccactttataaaccgtgatggtgaaacattaacaaccaaaggaaaagttggtgattctctgctagatgttgtggttgaaaataatctagatattgatggctttggtgagtatgaaacatttcttaaaatgcataagtgaaactgttaggtttcaaatttttattttgtggtttttttttttgaagaagtttaacctatagcatgctatgtaaaatattaacattcaggatgtgttagtgttatattcttgtttataaagaataatagagtgacaccattgttctgttctttgtacatttaaataagtcatggccagaaatctgctgtggcctcattaccttactgtttatatgtgtgatacaaagccgacggtagggagtagagttaaaagataccaggttagagagaataaatgtcatagcacagaggggtacttaaatatcttgaatgtcagctcaccttcctaggaaaggtaacttat

SEQ ID NO: 158010 - DNA, 601 bp, Human
ctgctagatgttgtggttgaaaataatctagatattgatggctttggtgagtatgaaacatttcttaaaatgcataagtgaaactgttaggtttcaaatttttattttgtggtttttttttttgaagaagtttaacctatagcatgctatgtaaaatattaacattcaggatgtgttagtgttatattcttgtttataaagaataatagagtgacaccattgttctgttctttgtacatttaaataagtcatggccagaaatctgctgtggcctcattaccttactgtttatatgtgtgayacaaagccgacggtagggagtagagttaaaagataccaggttagagagaataaatgtcatagcacagaggggtacttaaatatcttgaatgtcagctcaccttcctaggaaaggtaacttatcctagaaagtgatttatttagaaagttttcatttttagacttctgaccatatgccttaactacacgtgcaaagcctgtgttcctgcaactgcccttttacacttcctcaggcgtaccctgtatatgacctgtcagttttgttcaagcaatgcatgtttagattagcagttctcagagg

SEQ ID NO: 158011 - DNA, 601 bp, Human
cattaccttactgtttatatgtgtgatacaaagccgacggtagggagtagagttaaaagataccaggttagagagaataaatgtcatagcacagaggggtacttaaatatcttgaatgtcagctcaccttcctaggaaaggtaacttatcctagaaagtgatttatttagaaagttttcatttttagacttctgaccatatgccttaactacacgtgcaaagcctgtgttcctgcaactgcccttttacacttcctcaggcgtaccctgtatatgacctgtcagttttgttcaagcaatgyatgtttagattagcagttctcagagggtttccttgaccgttagcattagtgtcacctgggaaatgcagattctcagacactcctccccacccaccgcccccacccccgccccagacttactgagtcacaaagtctggggtaggtccagcattgcatgttgtaacagctgtctgtgtgattttgatgcatgttcaagtttgagaaccactggtctggaataaggttcaaggagcgtatctgactctgcttctttcaaggcactgttcacattatcctttaaagaaccatttctagatcaga

SEQ ID NO: 158012 - DNA, 601 bp, Human
tgagacaggatcttgctctgtcacccaggctgaagtgcggtcgtgcaatcacagttcactgcagcctcgacctcctggactcaagtgatcctcctgactccgcctcctgagtagctgggactgcaggtgcaccatcacacctggctgaattttgtattttttgtagagacagtgttttgccacattgcccagcctggtcttgaactcctgggctcaagagatcttcctgccttggcctcccaaagtgctggcattacaggcgtgagccaccatgcccagccttgaatactgaatctaagtwttttttgctagttttaaaataattataacaactagaatttgagtgtatactatattctagcatatgttaaatgaagtagattttttttttaactctccatttgatagttgaagaaacttgagtctcatggaaattaagtttccctggttatacatgcagcaagtgagagggctaagactcaaacctgtcttgaagtcaagatggtatatctcattgtggttttgatttgtatttctctggtgattagtgatgttgaacatttttccgtatgtttgttggccgcttttatgtctgtgtctt

SEQ ID NO: 158013 - DNA, 601 bp, Human
ttgagtgtatactatattctagcatatgttaaatgaagtagattttttttttaactctccatttgatagttgaagaaacttgagtctcatggaaattaagtttccctggttatacatgcagcaagtgagagggctaagactcaaacctgtcttgaagtcaagatggtatatctcattgtggttttgatttgtatttctctggtgattagtgatgttgaacatttttccgtatgtttgttggccgcttttatgtctgtgtcttcttttgagaggtgtctgttcatgtctttttattttccarcttttatttagattcagggagtacatgtgcaggtttgttaaatggatgtatcatgtgatgctgaagtctggagtatgagtgatcctgtcacctaggcagtaggcttagaaaccaataggtagttttcctccttgcccctctcccttccccctctggtagtgcccagtatctactgttcccaactttatgtccatgggacccagtatttagcttgcacttataagtgagaacactttgcttttctggttctgtgttaatttactcgggataatggccttgagctgtatccatgttgctgga

SEQ ID NO: 158014 - DNA, 601 bp, Human
ttaactctccatttgatagttgaagaaacttgagtctcatggaaattaagtttccctggttatacatgcagcaagtgagagggctaagactcaaacctgtcttgaagtcaagatggtatatctcattgtggttttgatttgtatttctctggtgattagtgatgttgaacatttttccgtatgtttgttggccgcttttatgtctgtgtcttcttttgagaggtgtctgttcatgtctttttattttccaacttttatttagattcagggagtacatgtgcaggtttgttaaatggatgtwtcatgtgatgctgaagtctggagtatgagtgatcctgtcacctaggcagtaggcttagaaaccaataggtagttttcctccttgcccctctcccttccccctctggtagtgcccagtatctactgttcccaactttatgtccatgggacccagtatttagcttgcacttataagtgagaacactttgcttttctggttctgtgttaatttactcgggataatggccttgagctgtatccatgttgctggaaaggacatagttttattctttttatggctgcatattccgtggtatatgtg

SEQ ID NO: 158015 - DNA, 601 bp, Human
atgcagcaagtgagagggctaagactcaaacctgtcttgaagtcaagatggtatatctcattgtggttttgatttgtatttctctggtgattagtgatgttgaacatttttccgtatgtttgttggccgcttttatgtctgtgtcttcttttgagaggtgtctgttcatgtctttttattttccaacttttatttagattcagggagtacatgtgcaggtttgttaaatggatgtatcatgtgatgctgaagtctggagtatgagtgatcctgtcacctaggcagtaggcttagaaaccartaggtagttttcctccttgcccctctcccttccccctctggtagtgcccagtatctactgttcccaactttatgtccatgggacccagtatttagcttgcacttataagtgagaacactttgcttttctggttctgtgttaatttactcgggataatggccttgagctgtatccatgttgctggaaaggacatagttttattctttttatggctgcatattccgtggtatatgtgtattacattttctttatccaatccaccattgacaggcacccagactgattccatatgtttgctat

SEQ ID NO: 158016 - DNA, 601 bp, Human
ctggaaaggacatagttttattctttttatggctgcatattccgtggtatatgtgtattacattttctttatccaatccaccattgacaggcacccagactgattccatatgtttgctattatgaatagtgctgaggtaaacatacgagagcatgtgtcttttggtagaattatttgttttctcttgggtatgtacccagtactgggattgcttggttgaatggtagttccatttttagttctttgagaaatctccaaactgctttccacagcagcttaactaatttacattcccaccagsactgtcttaagtgtttccttttctccgcagccttgccaacatctgtaattttttgactttttaatgatattctttatgactggtgcaagatggtatctcattgtggttttgatttgcagagtggagtattttttcatgtttcatgtttgttgaccacttgtatgtcttcttttttaaatatttatttatttatttttgacacaaagtctcactgtcacccaggctggagtgcagtggcgcagtctgggctcactgcaaccttcgcctcccaagttcaagcgattctcctgcctcagtctc

SEQ ID NO: 158017 - DNA, 601 bp, Human
ccaggactgtcttaagtgtttccttttctccgcagccttgccaacatctgtaattttttgactttttaatgatattctttatgactggtgcaagatggtatctcattgtggttttgatttgcagagtggagtattttttcatgtttcatgtttgttgaccacttgtatgtcttcttttttaaatatttatttatttatttttgacacaaagtctcactgtcacccaggctggagtgcagtggcgcagtctgggctcactgcaaccttcgcctcccaagttcaagcgattctcctgcctcaktctcctgagtagctggaattataaaggtgtgccaccacggctagcaaatttttatatttttagtagttttatatttttataattttatgattattttcaaattttatatttttagttttgccgcattgaccaggctggtcttgaattcctgacctcaagtgatctgcctacttcggcctcccaaagtgctgggattacaggcgtgagccaccatgcctgacttctgcccgctttttaatgaagttatttgttttttgcttgttgatctgtttaagttccctattgattctggatattaga

SEQ ID NO: 158018 - DNA, 601 bp, Human
gtttccttttctccgcagccttgccaacatctgtaattttttgactttttaatgatattctttatgactggtgcaagatggtatctcattgtggttttgatttgcagagtggagtattttttcatgtttcatgtttgttgaccacttgtatgtcttcttttttaaatatttatttatttatttttgacacaaagtctcactgtcacccaggctggagtgcagtggcgcagtctgggctcactgcaaccttcgcctcccaagttcaagcgattctcctgcctcagtctcctgagtagctggrattataaaggtgtgccaccacggctagcaaatttttatatttttagtagttttatatttttataattttatgattattttcaaattttatatttttagttttgccgcattgaccaggctggtcttgaattcctgacctcaagtgatctgcctacttcggcctcccaaagtgctgggattacaggcgtgagccaccatgcctgacttctgcccgctttttaatgaagttatttgttttttgcttgttgatctgtttaagttccctattgattctggatattagacctttgttggattcata

SEQ ID NO: 158019 - DNA, 601 bp, Human
tatgtcttcttttttaaatatttatttatttatttttgacacaaagtctcactgtcacccaggctggagtgcagtggcgcagtctgggctcactgcaaccttcgcctcccaagttcaagcgattctcctgcctcagtctcctgagtagctggaattataaaggtgtgccaccacggctagcaaatttttatatttttagtagttttatatttttataattttatgattattttcaaattttatatttttagttttgccgcattgaccaggctggtcttgaattcctgacctcaagtgatcygcctacttcggcctcccaaagtgctgggattacaggcgtgagccaccatgcctgacttctgcccgctttttaatgaagttatttgttttttgcttgttgatctgtttaagttccctattgattctggatattagacctttgttggattcatagtttgtgaatattttctctcattctgtagggtgtttactttgtttttttgtttgttttttgagacggagtcttgttctgtcgcccaggctagagtgcaatgatgtgatctcggcttgctgattcacctccacctcctgggttcaagtg

SEQ ID NO: 158020 - DNA, 601 bp, Human
tttgacacaaagtctcactgtcacccaggctggagtgcagtggcgcagtctgggctcactgcaaccttcgcctcccaagttcaagcgattctcctgcctcagtctcctgagtagctggaattataaaggtgtgccaccacggctagcaaatttttatatttttagtagttttatatttttataattttatgattattttcaaattttatatttttagttttgccgcattgaccaggctggtcttgaattcctgacctcaagtgatctgcctacttcggcctcccaaagtgctgggattacrggcgtgagccaccatgcctgacttctgcccgctttttaatgaagttatttgttttttgcttgttgatctgtttaagttccctattgattctggatattagacctttgttggattcatagtttgtgaatattttctctcattctgtagggtgtttactttgtttttttgtttgttttttgagacggagtcttgttctgtcgcccaggctagagtgcaatgatgtgatctcggcttgctgattcacctccacctcctgggttcaagtgattctcctgcctcagcctcttgagtagctgggat

SEQ ID NO: 158021 - DNA, 601 bp, Human
ttaaagcaattctcctacctcagcttcccgagtacctgggattacaggtgcatgctaccatgcccggctaatttttttgtatttttagtagagatggggtttcccatgttggccaggctagtctcgaactcctgacctcatgatctgcccgatttggcctcccaaagtgctgggattacaggtgtgagccaccacacccggccctctgcccactttttaatgaggttatttgttttttgcttgttgatctgtttaagttccctatagattctggatattagacctttgttggatgcatagwttgtgaatattttttctcattttctagggtgtttactttgttgatagtttctttaatgtgtcgaagctctttaatcaggtcccatttgtcaatttttgtttttgttgcaattgattttgaggacttagtcataaaaattctttgccgaggccaatttccaggagagcatttctgaggttttcttctaggacttttgtagctttagatcttacatttaagtctttaatctattttgagttaaattttgtatacagtgataggtaggggtctagtttcatttttctgcatataatagccatc

SEQ ID NO: 158022 - DNA, 601 bp, Human
gacctttgttggatgcatagattgtgaatattttttctcattttctagggtgtttactttgttgatagtttctttaatgtgtcgaagctctttaatcaggtcccatttgtcaatttttgtttttgttgcaattgattttgaggacttagtcataaaaattctttgccgaggccaatttccaggagagcatttctgaggttttcttctaggacttttgtagctttagatcttacatttaagtctttaatctattttgagttaaattttgtatacagtgataggtaggggtctagtttcattyttctgcatataatagccatcaatcccagcactgtttactgaatagggagttctttcctcattgcttatttttgttgactttgtgaaagatcagattttctagatgtatggctttatttttcgggtctctattctgttcctttggtctgtgtgtctaggttttctaggttgtgtgcataggggtgctgataatagtctctaggatctttgtatctttatgggattggttgtaatgccatctttgtcatttctaattattcttatttggatcatctctttttttttctttgttaatctagct

SEQ ID NO: 158023 - DNA, 601 bp, Human
ttaaattttgtatacagtgataggtaggggtctagtttcatttttctgcatataatagccatcaatcccagcactgtttactgaatagggagttctttcctcattgcttatttttgttgactttgtgaaagatcagattttctagatgtatggctttatttttcgggtctctattctgttcctttggtctgtgtgtctaggttttctaggttgtgtgcataggggtgctgataatagtctctaggatctttgtatctttatgggattggttgtaatgccatctttgtcatttctaattatkcttatttggatcatctctttttttttctttgttaatctagctagtggtctatccattttgtttattctttcagaaaagcaacttttggttttgttgatcctttgtatagatttttgggtctcgattttgttcagttctgctttgagtttgttatttcttctgctagctttgggttttttgtttttcaagttcttctaggttaattttagattgttaatttgagatctttctaactcctcaatataggcggtcagtgctctaaacttcatcttagcactacttttgctgcatcccagagat

SEQ ID NO: 158024 - DNA, 601 bp, Human
taggtaggggtctagtttcatttttctgcatataatagccatcaatcccagcactgtttactgaatagggagttctttcctcattgcttatttttgttgactttgtgaaagatcagattttctagatgtatggctttatttttcgggtctctattctgttcctttggtctgtgtgtctaggttttctaggttgtgtgcataggggtgctgataatagtctctaggatctttgtatctttatgggattggttgtaatgccatctttgtcatttctaattattcttatttggatcatctcttkttttttctttgttaatctagctagtggtctatccattttgtttattctttcagaaaagcaacttttggttttgttgatcctttgtatagatttttgggtctcgattttgttcagttctgctttgagtttgttatttcttctgctagctttgggttttttgtttttcaagttcttctaggttaattttagattgttaatttgagatctttctaactcctcaatataggcggtcagtgctctaaacttcatcttagcactacttttgctgcatcccagagattttggtatctgtgtctctgc

SEQ ID NO: 158025 - DNA, 601 bp, Human
atgccatctttgtcatttctaattattcttatttggatcatctctttttttttctttgttaatctagctagtggtctatccattttgtttattctttcagaaaagcaacttttggttttgttgatcctttgtatagatttttgggtctcgattttgttcagttctgctttgagtttgttatttcttctgctagctttgggttttttgtttttcaagttcttctaggttaattttagattgttaatttgagatctttctaactcctcaatataggcggtcagtgctctaaacttcatcttarcactacttttgctgcatcccagagattttggtatctgtgtctctgcttttatttatttcaaagaattttttgatttctgccatatggtggagccactttagctggtagaaatattttctgatctttgacagaatgggtaaaccatgctattgtttgtgtgcattggaagttgtggctgttgtgctgttgaaaaaatttaaatcttaatatctcataacagtgttaactaaactttcatttagtgatggtgtggtactgaaatatgtcccaaatcaataacattggaatggatgctaaaca

SEQ ID NO: 158026 - DNA, 601 bp, Human
cagtattgtgaggcttcctcagccacatggaactgtaagtccattaaacactttttcctgtataaattacccagtttcggatatgtctttgtcagcagtgtgaaaatggactaataaagcaaattggtacgaggagtagggtgctgctgaaaagataccccaaatgtggaagcaactttggaaccaggtaacaggcagacattggaacagtttggagggctcaggagaagataggaaaatatgggaaagtttggaactccctagagacttgtggaatggctttggccaaaatgctgataaygatatggacaatgaaattcaggctgaggtggtctcagatggagacgaggaacttgttgggaattggagtaaaggtgactcttgctatgttttagcaaagagactagcgcattttgcccctgccctagagatttgtggaactttgaacttaagagatgatacttagggtatctggcagaagaaatttctaagcagcaaatcattcaagaggtgacttgggtgctgttaaaggcattcagttttaaaaggaaacagcataaaaaagtttggaaaatttgcagcctgacaatgtgatagaaaa

SEQ ID NO: 158027 - DNA, 601 bp, Human
aatgctgataacgatatggacaatgaaattcaggctgaggtggtctcagatggagacgaggaacttgttgggaattggagtaaaggtgactcttgctatgttttagcaaagagactagcgcattttgcccctgccctagagatttgtggaactttgaacttaagagatgatacttagggtatctggcagaagaaatttctaagcagcaaatcattcaagaggtgacttgggtgctgttaaaggcattcagttttaaaaggaaacagcataaaaaagtttggaaaatttgcagcctgacaaygtgatagaaaagaaaaccccattttctggggaaaaattcaagctggctgcagaaatttgggtaaggaatgaggagctgaaagttaatccctgagatactggggaaaatgtctccagggcatgtcagagatcttcatggcagcccctcccatcacaggcctggaagcctaggaggaaaaagtggttttgtgggctgggcccagggcccccttgctgtgtacagcctagggacttggtgctctgtgtcccagctgtcccagctgtggctgaaaggggccaatgtagagctagggccgtggct

SEQ ID NO: 158028 - DNA, 601 bp, Human
atatggacaatgaaattcaggctgaggtggtctcagatggagacgaggaacttgttgggaattggagtaaaggtgactcttgctatgttttagcaaagagactagcgcattttgcccctgccctagagatttgtggaactttgaacttaagagatgatacttagggtatctggcagaagaaatttctaagcagcaaatcattcaagaggtgacttgggtgctgttaaaggcattcagttttaaaaggaaacagcataaaaaagtttggaaaatttgcagcctgacaatgtgatagaaaagraaaccccattttctggggaaaaattcaagctggctgcagaaatttgggtaaggaatgaggagctgaaagttaatccctgagatactggggaaaatgtctccagggcatgtcagagatcttcatggcagcccctcccatcacaggcctggaagcctaggaggaaaaagtggttttgtgggctgggcccagggcccccttgctgtgtacagcctagggacttggtgctctgtgtcccagctgtcccagctgtggctgaaaggggccaatgtagagctagggccgtggcttcagagtgtgcaa

SEQ ID NO: 158029 - DNA, 601 bp, Human
cagcaaatcattcaagaggtgacttgggtgctgttaaaggcattcagttttaaaaggaaacagcataaaaaagtttggaaaatttgcagcctgacaatgtgatagaaaagaaaaccccattttctggggaaaaattcaagctggctgcagaaatttgggtaaggaatgaggagctgaaagttaatccctgagatactggggaaaatgtctccagggcatgtcagagatcttcatggcagcccctcccatcacaggcctggaagcctaggaggaaaaagtggttttgtgggctgggcccagsgcccccttgctgtgtacagcctagggacttggtgctctgtgtcccagctgtcccagctgtggctgaaaggggccaatgtagagctagggccgtggcttcagagtgtgcaaacctcaagccttggcagcttccatgtggtattgagcctgctagtgtacagaagtcaagaactggggcttgggaacctccgcctagatttcagaggatgtatggaaatgcctagatgttccaggcagtagttttttgcagggcagggctctcatggagaacttctgctagggcagtgcagaagggaaatgt

SEQ ID NO: 158030 - DNA, 601 bp, Human
tgggtgctgttaaaggcattcagttttaaaaggaaacagcataaaaaagtttggaaaatttgcagcctgacaatgtgatagaaaagaaaaccccattttctggggaaaaattcaagctggctgcagaaatttgggtaaggaatgaggagctgaaagttaatccctgagatactggggaaaatgtctccagggcatgtcagagatcttcatggcagcccctcccatcacaggcctggaagcctaggaggaaaaagtggttttgtgggctgggcccagggcccccttgctgtgtacagcctarggacttggtgctctgtgtcccagctgtcccagctgtggctgaaaggggccaatgtagagctagggccgtggcttcagagtgtgcaaacctcaagccttggcagcttccatgtggtattgagcctgctagtgtacagaagtcaagaactggggcttgggaacctccgcctagatttcagaggatgtatggaaatgcctagatgttccaggcagtagttttttgcagggcagggctctcatggagaacttctgctagggcagtgcagaagggaaatgtggggttggagcccccacacagagt

SEQ ID NO: 158031 - DNA, 601 bp, Human
agctgaaagttaatccctgagatactggggaaaatgtctccagggcatgtcagagatcttcatggcagcccctcccatcacaggcctggaagcctaggaggaaaaagtggttttgtgggctgggcccagggcccccttgctgtgtacagcctagggacttggtgctctgtgtcccagctgtcccagctgtggctgaaaggggccaatgtagagctagggccgtggcttcagagtgtgcaaacctcaagccttggcagcttccatgtggtattgagcctgctagtgtacagaagtcaagaaytggggcttgggaacctccgcctagatttcagaggatgtatggaaatgcctagatgttccaggcagtagttttttgcagggcagggctctcatggagaacttctgctagggcagtgcagaagggaaatgtggggttggagcccccacacagagtccctattggggcaccgcctagtggagctgtgcgaagagggccactgccctccaaacctcagaatggtagatccactgacagcttgcatgatatgcctggaaaagccacagacactcaatgccagcccatgaaagcagccaggaggga

SEQ ID NO: 158032 - DNA, 601 bp, Human
tggtgctctgtgtcccagctgtcccagctgtggctgaaaggggccaatgtagagctagggccgtggcttcagagtgtgcaaacctcaagccttggcagcttccatgtggtattgagcctgctagtgtacagaagtcaagaactggggcttgggaacctccgcctagatttcagaggatgtatggaaatgcctagatgttccaggcagtagttttttgcagggcagggctctcatggagaacttctgctagggcagtgcagaagggaaatgtggggttggagcccccacacagagtccctaytggggcaccgcctagtggagctgtgcgaagagggccactgccctccaaacctcagaatggtagatccactgacagcttgcatgatatgcctggaaaagccacagacactcaatgccagcccatgaaagcagccaggagggaggctgtatcctgcaaagccacaggggtggagctgcccaagaccatgggaacccagctcttgcatcagtgtgacctggatgtgagacatgtagtcaaaggagatcattttggagctttaagatttgactgccctgctggattttggacttgcatggggtc

SEQ ID NO: 158033 - DNA, 601 bp, Human
tgcctgacgccatccatgtaagatgtgacttgttcctcgttgccttctgccaggattgtgaggcttccccagccattgtggaactgtaagttcattaaaccctttttcctgtataaattacccagtttcaggtatgtctttatcagcagcatgaaaatggactaatacaattggttacatagttgaagacacaaaactgtggcagtgtacctcagtctgcaatggctgatgtttatgggtgctgaaaattcatctttacccctgccctgccccgctaccttttttttttctgtaggaaaatgtctcaagttttaaattatgtaaagctttcagcactagcatcttttgtataaaaaaagatgattggatttagattatcttccctccccaccacatcatttaacatgccgtctgttgttttttgacttaataatatcctttttttttttttttttttgagacgtagttttgctctttttgcccaggctggaatgcaatggcacgatctcggctcattgcaacctctgcctccctggttcaagtgattctcctgccttagcctcctgagtagctgggattacaggtgtctaccaccacgccc

SEQ ID NO: 158034 - DNA, 601 bp, Human
gcctgacgccatccatgtaagatgtgacttgttcctcgttgccttctgccaggattgtgaggcttccccagccattgtggaactgtaagttcattaaaccctttttcctgtataaattacccagtttcaggtatgtctttatcagcagcatgaaaatggactaatacaattggttacatagttgaagacacaaaactgtggcagtgtacctcagtctgcaatggctgatgtttatgggtgctgaaaattcatctttacccctgccctgccccgctaccttttttttttctgtaggaaaatrtctcaagttttaaattatgtaaagctttcagcactagcatcttttgtataaaaaaagatgattggatttagattatcttccctccccaccacatcatttaacatgccgtctgttgttttttgacttaataatatcctttttttttttttttttttgagacgtagttttgctctttttgcccaggctggaatgcaatggcacgatctcggctcattgcaacctctgcctccctggttcaagtgattctcctgccttagcctcctgagtagctgggattacaggtgtctaccaccacgccca

SEQ ID NO: 158035 - DNA, 601 bp, Human
attggttacatagttgaagacacaaaactgtggcagtgtacctcagtctgcaatggctgatgtttatgggtgctgaaaattcatctttacccctgccctgccccgctaccttttttttttctgtaggaaaatgtctcaagttttaaattatgtaaagctttcagcactagcatcttttgtataaaaaaagatgattggatttagattatcttccctccccaccacatcatttaacatgccgtctgttgttttttgacttaataatatcctttttttttttttttttttgagacgtagtttygctctttttgcccaggctggaatgcaatggcacgatctcggctcattgcaacctctgcctccctggttcaagtgattctcctgccttagcctcctgagtagctgggattacaggtgtctaccaccacgcccacctaatttttaaaatatttttagcagagacggggtttcaccatgttgggcaggctggtttcgaactcctgacctcaagtgatccgcctgccttggcctcccaaagtgctagaattacaggtgtgagccactacgccttggccaacagctaatgccctttctgattggt

SEQ ID NO: 158036 - DNA, 601 bp, Human
gatctcggctcattgcaacctctgcctccctggttcaagtgattctcctgccttagcctcctgagtagctgggattacaggtgtctaccaccacgcccacctaatttttaaaatatttttagcagagacggggtttcaccatgttgggcaggctggtttcgaactcctgacctcaagtgatccgcctgccttggcctcccaaagtgctagaattacaggtgtgagccactacgccttggccaacagctaatgccctttctgattggtgtgagatggtatctcattgtggttttgatttgcrtttctctgatgattagtgatgtggagcatttttttcatgtttgttggctgcttgtatggctttttttgagaagtgtctgttcatgtcctttgcctatttttttaatgaggttgttttttgcttattgatttaagttccctatagattctggatattagacctttgttagatgcatagttggtgaatattttctcccactctgtaggttgtctgtttactttgttgatagttttttttgctgtctagaagctctttgtttaattagatcccacttaccaatttttgcttttgttgcaattg

SEQ ID NO: 158037 - DNA, 601 bp, Human
tgatttaagttccctatagattctggatattagacctttgttagatgcatagttggtgaatattttctcccactctgtaggttgtctgtttactttgttgatagttttttttgctgtctagaagctctttgtttaattagatcccacttaccaatttttgcttttgttgcaattgcttttggagacttagccaaaaatcctttgccaatccaatgtctagaagagtatttccttgattgtcttttttatagtttgaggtcttaaatttaaatctttgatccattttgggttaatttttgtrtatggtgaaaggtagggagtccaagttcagacttctgcctatggctagccaggcatcccagcaccattattgaatacggagtctcttaaaaagagtaagtgctgtccgggcgcgttggctcatgcctgtaatcctggcactttgggaggccaaggcaggcagatcacttgaggtcaggagtttgagactagcctggccaacatggtgaagccccatctctactaaaaatacaaaaattagccaggtgtggtggcatacacctgtagtcccagctacttgggaggctgaggcaccagaatc

SEQ ID NO: 158038 - DNA, 601 bp, Human
aggtattgtttatttttataggttagcaaaagctctttaaatgtcctatttgataaaaattgtgaagatgaaaattttaaacatttatttaaatggcttccaactgctattttacatgaagttacatattctcaaaatagtgtaaaatgctttttgcataaataatttgtgtggattgctttatattaatttcttctaaattaaaacataagtattatgatcttaatacttgaaagtattcttttaagtttttaaaagtatttttttcttcatcacttgtgactatatattacagtacagttttttttaaaccgcaggtgacaactattacaaggtcatgaaatcaatttagtcactcccaactagcattttaaagaaatcaaaaagaacatataaaaacatatcatcttttgcaagggtattatcttaggaaatgtttatttagctattttacaagtatatatgtactgggtcatgatgtaaaatgaaattcgtactgtgagtcacagttaaataaagttttttctgaaagtcattggttggaatggaagaatgtcctgcctgggcttctttcccagctgtatccctttttcagctttgt

SEQ ID NO: 158039 - DNA, 601 bp, Human
gaaagtattcttttaagtttttaaaagtatttttttcttcatcacttgtgactatatattacagtacagttttttttaaaccgcaggtgacaactattacaaggtcatgaaatcaatttagtcactcccaactagcattttaaagaaatcaaaaagaacatataaaaacatatcatcttttgcaagggtattatcttaggaaatgtttatttagctattttacaagtatatatgtactgggtcatgatgtaaaatgaaattcgtactgtgagtcacagttaaataaagttttttctgaaartcattggttggaatggaagaatgtcctgcctgggcttctttcccagctgtatccctttttcagctttgtgaccttgggttgggtatctaacctactcataactcatcttttcatctgtaaagcagggataatattaatatctacctcataaagttgctgtaaagatcaaatgagtaaatccaagcaagtcctaaataaatattagctaatattgttaacataggtattaatacagattcattgttcattatagcaaattttaaaaatacatttaaaaagaatttaacacttcatatcatc

SEQ ID NO: 158040 - DNA, 601 bp, Human
agtatatatgtactgggtcatgatgtaaaatgaaattcgtactgtgagtcacagttaaataaagttttttctgaaagtcattggttggaatggaagaatgtcctgcctgggcttctttcccagctgtatccctttttcagctttgtgaccttgggttgggtatctaacctactcataactcatcttttcatctgtaaagcagggataatattaatatctacctcataaagttgctgtaaagatcaaatgagtaaatccaagcaagtcctaaataaatattagctaatattgttaacatagrtattaatacagattcattgttcattatagcaaattttaaaaatacatttaaaaagaatttaacacttcatatcatcacacagagataagcactgaaataatcttttttccgaatacccaagaaatatagaaaatttaatgtaaatttaaaaattctgctggtatcatagaaattcgcgtattcagactcagaagaaaagctttaaagatcaagtatcctgacatgtccacaaatctttgtatttaaagataagcttgagataagtaagctaaactagattcaccaaagacagagttaagc

SEQ ID NO: 158041 - DNA, 601 bp, Human
cctgcactttgggaggcctaggtgggcagatcacaaggtcacgagtttgagaccagcctgggcaacatggtgaaaacccgtctctactaaaaatacaaaaattagccaggtgtggtggcgtgcacctgtaatttcagctacttggggaggccaaggcaggagaattgctttaacccaggagtcagaggttgcagtgagctgagattgcaccattgcactccagcctgggttacagactaagactccatcttggaaaaaaaaaaaaaaaaccgagatgggcggatcacgaggtcaagagatygagaccatcctggccaacataatgaaaccccgtctctactaaaaatacaaaaaaaaaaaaaaaaaaaaaaaaaaaaaacccagctgggcatggtggtgcatgcctgtaatcccagctacttgggaggctgaggcaggagaattcctcgaaccagggagtcggaggttgcagtgagccgagattgcaccactgtactccagtctggcagcaaagtgagactccttcaaacaaacaaacaaaaaaccatgagtgtcttcctttgcacataggataaaatctgtattcccagccgtaaaaggc

SEQ ID NO: 158042 - DNA, 601 bp, Human
tagccaggtgtggtggcgtgcacctgtaatttcagctacttggggaggccaaggcaggagaattgctttaacccaggagtcagaggttgcagtgagctgagattgcaccattgcactccagcctgggttacagactaagactccatcttggaaaaaaaaaaaaaaaaccgagatgggcggatcacgaggtcaagagattgagaccatcctggccaacataatgaaaccccgtctctactaaaaatacaaaaaaaaaaaaaaaaaaaaaaaaaaaaaacccagctgggcatggtggtgcatkcctgtaatcccagctacttgggaggctgaggcaggagaattcctcgaaccagggagtcggaggttgcagtgagccgagattgcaccactgtactccagtctggcagcaaagtgagactccttcaaacaaacaaacaaaaaaccatgagtgtcttcctttgcacataggataaaatctgtattcccagccgtaaaaggctctgcattatctggccccatctgccactcttcctcttttttgtttttttctcattgttctttgtctcactttggtgatactggccttttctcaagagcttga

SEQ ID NO: 158043 - DNA, 601 bp, Human
aaaaaaaaaaaaaaaaaaaacccagctgggcatggtggtgcatgcctgtaatcccagctacttgggaggctgaggcaggagaattcctcgaaccagggagtcggaggttgcagtgagccgagattgcaccactgtactccagtctggcagcaaagtgagactccttcaaacaaacaaacaaaaaaccatgagtgtcttcctttgcacataggataaaatctgtattcccagccgtaaaaggctctgcattatctggccccatctgccactcttcctcttttttgtttttttctcattgttytttgtctcactttggtgatactggccttttctcaagagcttgaactcacccaaaattcctacctttgagactttgtatatactttaccctctccctgagacacatccctctctctcccatccccaaaatttagcttttcatctatcaaatctcaatttatgtacttccttagcgaggctttgcccagccacccagtccaaagtagtggttctcctgttaccctgaacccattattctctttctcagcatcttgttcacttgttttatagtatttgtcacagtttagtaattatgtatttc

SEQ ID NO: 158044 - DNA, 601 bp, Human
aaaatctgtattcccagccgtaaaaggctctgcattatctggccccatctgccactcttcctcttttttgtttttttctcattgttctttgtctcactttggtgatactggccttttctcaagagcttgaactcacccaaaattcctacctttgagactttgtatatactttaccctctccctgagacacatccctctctctcccatccccaaaatttagcttttcatctatcaaatctcaatttatgtacttccttagcgaggctttgcccagccacccagtccaaagtagtggttctcytgttaccctgaacccattattctctttctcagcatcttgttcacttgttttatagtatttgtcacagtttagtaattatgtatttcttgtgtatctttcccaatagactgcgatgagggataaagtcattcctgtttaattcctcattgtatacgaaatgaagtaataagtgaacacatgaataaaaagggacagtcataaattttggaaacagttcaaacttataaacattctcattgccaacttttatattaatatagatcttttggatgatgcaggtacctgttttcagagtgtatc

SEQ ID NO: 158045 - DNA, 601 bp, Human
ccttttctcaagagcttgaactcacccaaaattcctacctttgagactttgtatatactttaccctctccctgagacacatccctctctctcccatccccaaaatttagcttttcatctatcaaatctcaatttatgtacttccttagcgaggctttgcccagccacccagtccaaagtagtggttctcctgttaccctgaacccattattctctttctcagcatcttgttcacttgttttatagtatttgtcacagtttagtaattatgtatttcttgtgtatctttcccaatagactgygatgagggataaagtcattcctgtttaattcctcattgtatacgaaatgaagtaataagtgaacacatgaataaaaagggacagtcataaattttggaaacagttcaaacttataaacattctcattgccaacttttatattaatatagatcttttggatgatgcaggtacctgttttcagagtgtatcataatattctgtcactagggggcagttacacacctgagattcaacttacctagtttactctcaagacatttttttcttcaatattacctgttttcttcatgtgtctgtttt

SEQ ID NO: 158046 - DNA, 601 bp, Human
catacacattttccctgttcatttacttttatatagccaaccacttataaagacactaaaagctgacagccaccaatattactctggggctgtgtatataataagttatataacttttgcacctcattccttcatatacatcatatattagtatacccatattgtgatcagctgcaagttttagccttgtagttgttgtttgttacttttatatcctttattcttttatagttttataggttatcttccactgtttattttgtagggttctctgtgtatatgaaaagccaaaaaaaaaaaagctccccattttgtgaatagcttttgtttccataatctattttcaggtcagctgcttgttatttggaatttgttttcccataaaaaataatgttggctaaatttttgagccaacacacagaacctatttcttcacaactgacttaatcaccatttatagcttgttttttgggataaaatgcattgcaccttctaactcttgtaattgtagctgctgctgcttttcttctacttttttaaagagacagggtctcatgccagtcagaatggtgattattaaaaagtcaagaaacaacagatg

SEQ ID NO: 158047 - DNA, 601 bp, Human
atgaaagggagcaaactatagatacatgcaacacattggatgaatctcaaaggcattgtgttgagtgaaagaagccagtttcagtcaaacactgtatgattctatttatatgaacattctggaaaagactaaaccacagtgatagagaacagatcagtggttaccaggggttagggatgaggtagactgtgacaacaaagcaacagcaaaagggaattaaaagttttaggctgaggaagctgctctgtaccctcagtgtggtggtggttacacaagtctatacatacattaaaactcataraactggccaggtgcggtggctcacgcctgtaacctcagcactttgggaggctgaggcaggcagatcacctgaggtcaggagtttgagaccagcctggacaacatggtgaaaccccgtctctgctaaaaatacaaaaattagccaggcatggtggctcatgcctgtaatctcagctactccaggaggctgaggcaggagaatcacttgaacccgggaggcggaggttgccgtgagccgagatcgcaccattacactccagtccaggcaacaagagtaagactgtctgaaaaaacaaacaaa

SEQ ID NO: 158048 - DNA, 601 bp, Human
attttcaggtcatttgtatttatttagagaagaagaatcattttgttccttttatagttcatttccctcttggtggatgtgagactgataaccctgggaagagaaactggtgaaatagtatctctttggacaccaaagcagagtggattgtggctactgtctgcctgtcctctcacatcttcagtgccgtgttctctatgagcacctcctttcttccccttaacacagaaactaaatccaatgactgtattagtttggttctgagaattgtgtctcttaataagagagttaaatcatagcyaactgcttgctcttttatacagttacaatttgtagatgcctgtaatagataatattctaattgaaaagaaagggaaaagggagagctacagttagatacaaaaggtctataataaatgtaagctagcaagagtattgatgataaaatttccaagttttacagctacacaatagagagcaaggaatagcttttatggtgttttatagctggtattcttaagtacacagcattttagtagaaatactttgtgggaaagagtataatgggtttcacaggtagcatttacaaaacacattgaca

SEQ ID NO: 158049 - DNA, 601 bp, Human
tagtgaacttgctctagattatacagtttgtaagtggctgaaccaggatttgaactaatacaatctgactacagaggccacactccttagcactagaaaagaatggcatgccaagggcagagttatttctaggaagatgggatataagcgtcattgtcaagttgtgcaaaggggtcaacttggttgagatctaaaaaggaacactgaattcgtcaattcagaggctcgtaggaagtaggaaatccttatcttttcgtttgaaccttgagtggaacctagatattctggattaatgtataartgaagttcatctttatatggtgacactcatactctagttgactacctaatagttcctctgccttctttcagttccgccaacatactgtgttctttaacattgtagaaccctttggctatgctagtctccttccctgaagtgttggtcctctagccctttttttgattggcaccagttagttcagatcttggctttattataaactcctctgagatatatgttccctgacagtttatctaaaatgattctctctacagttattttctattactgtgtttttgtttcctcagaggcatacat

SEQ ID NO: 158050 - DNA, 601 bp, Human
ccctcaaacagtccccagtctctgttcttcccatctttgtgtccatgttgaaatgctgttcttactacatttttttgaaggacatcaaaagagagtttgattatatcagaagcccccaaaagaagagagctactcagtggaatcaaggcatagtaaaatatagttgatccttgatatttgcaaaggataccaccatagcatagaatttgcttcatttccttttaaaacagaaatgtcattttactcctattgttatgtgttaaataagaaccttaataccagttgagatggaagtggtagrcaaagcttactagctctgataacctcctacttatcagctccaaagcatgttttaagcctttggctcagcaaaatgacatgtctctccatataagcaagagtgcttttttttttttctttgagacggagtcttgctctgtcaccaggctggagtgcagtggcgcgatctccgctcactgcaacctctgcctcctgggttcaagcgattctcctacctcagcctcctgagtagctgggactacaagagcacactaccacgcctggccaagagtgcttttaaatagttcattgtcaatgttaa

SEQ ID NO: 158051 - DNA, 601 bp, Human
tgatattacttttgtgtgtaagtcttaacatttatctttgcttcctatatatcattatgccttgcatatgaatttggcatttaatatttatccaaaacataatttttaaaggttgttcatatagaaacttaaaaattataaattatttcttcaataaaatgttttagacatatctcactcaaaattgagagagaatttctttcattttagttagttcacaagacttcagattagaggaaaaaattataataaatgttaggatattattttcacacctttaaatattactctgattataagyaaatgctgtgtgttaaattgtaataaaacaagtaaaaggaagattggaatacttgtgtatgaatttggttaaaaacaaaaaatacctcgaacaatgaaaaaacacaactgattgctggacaggagtggcaaacagggttgatgcatttttacattgagacatcattttcaaccgtgaaatccatttataactagaaacagattgtaaggattaggaaagatgaataaagtattttaaatactgagagtattaaataaactagaaataacatttgtagtcaagaggaagtgtgtatttagt

SEQ ID NO: 158052 - DNA, 601 bp, Human
ctgcagtgagctgtgatcacactgcactccggcctccatgacagagtgagaccctgtttccatttaaaaaaaaaaaaaaaagtgaaagcaagagagttgaaagttcaaaggggcgtggccaacattttaagtgttgtagaaaggataagacacaaaagtatccattggatgaggcagttagcacgctacttctaaggtaatggaaatcaaatatattagaatagaatgcattagaagacaatgtacagaacccagtgattcattagatgtgtagagtgtgtgctagggaggaatctggtgktgtttcctgtttatagctgggaggtactgagagaccacaaaggaaggaagttatggtcagagattgaaatacttcagtttgttggtttcaaagatggagcatttctgggtttgagaataagtgaaagtaggatttgacattaacaagatgattttaagtcaggtgtcaaagtcttctaatacacgaactctaaaagtttagaagcttttttttttcatggaaagtatttaagctaaattttgctagctaaattaaaagacatttgtccatattctttattgccattttattatttcaaaa

SEQ ID NO: 158053 - DNA, 601 bp, Human
attggatgaggcagttagcacgctacttctaaggtaatggaaatcaaatatattagaatagaatgcattagaagacaatgtacagaacccagtgattcattagatgtgtagagtgtgtgctagggaggaatctggtgttgtttcctgtttatagctgggaggtactgagagaccacaaaggaaggaagttatggtcagagattgaaatacttcagtttgttggtttcaaagatggagcatttctgggtttgagaataagtgaaagtaggatttgacattaacaagatgattttaagtcagrtgtcaaagtcttctaatacacgaactctaaaagtttagaagcttttttttttcatggaaagtatttaagctaaattttgctagctaaattaaaagacatttgtccatattctttattgccattttattatttcaaaatgagatacatgtgaaccacaaaactactacctaatcagtaccctcactcctgcattacactctactgttcccctgagaataaatgccttctcagctaatttcttaggagtcatttgtagcctttacgttactctgaacacaagataggctgtgtctgtaacag

SEQ ID NO: 158054 - DNA, 601 bp, Human
taatttttgtatttttagtagagacagggtttcctcatgttggccaggctggtctcgaattcctgacctcaggtgatccacctgcctcagcctcccaaagtgctgggtttatagacttgagccaccgcgtctggccacttgtcttttttgatttctttcattagtgttttataattgtcagcatatagattttttgttgtaaattgacaattttttttctttaattttatatattaaaaaaaatagagacaggatctcactgtgttgcctaggctggtctcaaactcctgggctcaagtgrtacccttcccttgacctcccaaagtgttgggattataggcatgagccaacatgcccagctgcaaattgacatttatttataattgtataaacataaagattttgtatatgttttgttagatttatactgcagtagtttgtaattgcattgtttttaacattttgattttcaaattgttcaatgcacaaaaattatacagaagtccagttaatttttgtatagtgaccttgtattttgggaccttgctaaaatcacttactaaatctagtagctttctttgaatgttcttttggattttct

SEQ ID NO: 158055 - DNA, 601 bp, Human
aatttgactagtcccataactattaggagaataaattgaatccataatttaaagcctttcataagacaaattgggaacaagataaggatgtgcactctcaccactccttttcaacattatgttggaggttctagccagggtagttagacaagaaaaataaaaggcatacagattggaaaggaagaaataacactcccctttgtagatgacatgattgtctatatataaagtcccaatatacacaagtataacattgtgaataatgttatttggggactgggcacagtggcttacacctgtsatctcagcactttcggaggctgaggcaggtggatcatctaaggtcagatgatggcttcctctaaaacaggacagatttacttgtagcctattgattataaaaagcttgaggtttctctgttataactcagtccactgttttcgcagtgtcaagtgtcccatttcaccttgcctttggtactggggaactgatgcaaaaatgaaggtagtctggctaccatcattactgggagaaataaactgtcctttttctcttatcaggaatctcaggtttcctgctagcacccaggaaactgtcatg

SEQ ID NO: 158056 - DNA, 601 bp, Human
ctggagtttcctcttgctctgtctatgattgcctttgggcttatactagcctttggaccaactcatcatggctagtatagtgactttcttaaaacagcataccacattgagtaatagcagctataatggaggaaatgtcttgtagccactttttttttttttttttttttgagacagagtctcactctgtcgcccaggctgaagtgcagtgacgcaatgttagctcactgcaacctccgcctcctgggttcaagcaattctcctgcctcagcgttctgattagctgggattacagatgccyggcaccatgcccagctaatttttgtattttaatagggatggggtctcaccatgttggccaagctggccttgagctcctgacctcaaaccatccacccgcctcagcctcccaaagtgctgagattacaggcatgagccactgtgcccggccgtgtagccactttttatcaaaagtagctgtgtatttgttttatgggctcttctaataagtatatctagataatatgtagcccatgaaactactataagtgaaagaatagtgacttttaatagtttttcatcttttactcacctcttatct

SEQ ID NO: 158057 - DNA, 601 bp, Human
tgatatgtttagggatttagttaactgcatatttagggtgaatttaaaattggcaggatgatgaggatgccagaaaagctaatgtagtttcagactactttaatagattttgtagtaccttgtttgtgagaaataatagaccttttgtttcgcatactagtcaagccacagttggattaccatgttcaccagattttgtatagtcagcattttaagttgactggaatgtgtcttgggaaagatgactgaaatggtgagaagtctgaataatatgtcatttttacactagttgaaggaactygtaatatttttctcttaggccagaaaaaggcatacggagaacttggtcctcatatgaaagagggaacatattaattgtatttgcctcaggtgggagaataaattggagaaagacagattttaggtcagaatatggaagaaatttataagaaacacagttatctaaatgtaaaatggacagttatgaaatagagtttgtcaaggatcttgtcagaagaggcattagtactgaatggaaggttggaccaggtgtcttctaacgctgatgcagcttgacagctgaataattttgtgggagcta

SEQ ID NO: 158058 - DNA, 601 bp, Human
ccaagcccagtctgtttcttttttgcaattaagctagagttcacatagcataaaattcacgattttgagttgtacatttcagtggtttttagtatttttactatgttgtacaaccatcatcactaattctggaaactttttttattttatttttatttttttgagatggagtcttgctctgtcacccaggctggagtgcagtggcacaatctccgctcactgcaacctccctttcccgggttcaagtgattctcctgcatcagcctcccgagtagctgggactacaggtgcctgccaccamgcccagctaatttttgtttttttagtagagactgggtttcaccatattggccagcctagtctcagactcctgaccttgtgatcctcctgcatcggcctcccatagtgctgggattacaggcgtgagccaccggtgcccagcccagaacttttttatcatcccaaaagaaacctcatcccttcttagcattcagtcccaattccctgcatctcctagatcctggcaaccagccactaatcaatcttggtttttgtggattttcctgtttgggacagttcgtttaaatggaatcatacaata

SEQ ID NO: 158059 - DNA, 601 bp, Human
ggacagttcgtttaaatggaatcatacaatatgtgagtcttttgtgtctggtttctttcactaagcataatgttttcaaagttcatgttttaccatgaatcagtacttcattcatttttattgctgaataatattcagttgtatggatatactccattttacttacccatccatcacctgatggcctaatgtttcttaaataaaactctgttccccagagatttggttaacatcctgagtagtaatttcactctgtcaaatattttcttaatatttcttaaaatttcttaaatttaaaaamttgaatccctttgaaagtaaaggtttttgctttacttttagatttcttagtgcttttagtaaatgttcccaggaaataaaactaatgcattacttggtaatacctgctttctaaagtgccattactgtcatgcaaaatgtttgtttcttactatgttatcagatttatatgtttctgtaatgtattactcttgctttatgagttccctgtatcttcatttcagaaagaattttttttccccctaatgaaatattagaagacaatagcaatgaaaaaagtgtatttggccaggcgtggtgg

SEQ ID NO: 158060 - DNA, 601 bp, Human
caacaatagattttagcatacgtagcaccttctaatagaattaggaagaagttaaagataatcttaagaaatcacagaataattttgaccttatgccatgataaaaagttattttctcttattttctatcttctttattctcatgtaacgttcacatatatttaagtaatcaaataaattatggatactttggaatcccaaaatattagatctggtaaggatgtttagaatttatctagttcagcctgtttgctttactgaaaagaaactgaaacccagagaggttaagcaacttctgtarggacagagatttatagattatagtcaaactcgtgatcagtgctcttttgattaccatgttgatggaatgtttaagtgtaagtgacttctggggaaaagcatattgatttagatacctattgcttaagctcatttttatatagttaagagtagctatttaagattcttaatttgtccttttagtcaagagtaatttattgaacacctgttatgggctaagcgttagatatacagagatgaataacataagactcctattcttaagtatcacacattctagagaatacacagcaaatgttta

SEQ ID NO: 158061 - DNA, 601 bp, Human
gccttggcctcccaaagtgctgggaaaccacctggcccaaatattgctaatttaatatcctttaaaatatttgtttaagggaaacttaacagcttacccagctagccaaacgttgacaattttcctgccaatttaggaagtaggacatagtaactattaacagccagtttatttttagagtactatggaaatgatggtgattctctaattaggatattgtaagagtaccatgtctatatatttccttttagtttgttaatgtgatggaatagttttcaaattatcctttttttttttttttaggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccata

SEQ ID NO: 158062 - DNA, 601 bp, Human
aaatattatgtttgtttttacagttatctgtgtctttatgcctgattgcttctgaaataaagggttgtctcactgtgagaatatgggggatgtgcatgaaaaatgcacatataattctttgagcatttatgtgttcctttctgattttttaaataagtaagtccatatatttgagtcatgtagatcctggatcctttctcataatgggagtgtcttttgggtaaaagatgttttatgaatgaggtgaggaaacgaggaagacaaaacaggatgtaagcactaggataaaggaatggagtcmctcgtccacttaacctttccacagattggtaattggaaccaaatgattggagagcagacctccgaatggatccaattaaagtacttttgctttaattttacaaccttttatttatttcagaaataatgttaaacatgctgtttctaaacagtattggaaatgataataacaatggttgtcctccttaaattgtccttttagatattaagaaatttagtatagatgaaagcaattttaatctaggatccaaattttagaagtcaagatttatagctaaacatggatgttaaagtttaaagt

SEQ ID NO: 158063 - DNA, 601 bp, Human
aaaactaatgataattgaaaacaaaaataaatctaaacctgagtttagttgattgactcaagagacttagattgtattgctgtgactgaaaatgactcactggcacaaacattccttatctccctcaagagggcaaaaggatgcgtaactgcttacctataccagatgttaaaggtttttaaacctatgctctttacttcctctgcttggtgaaaaaagggatatgtttgcagacaatgttatgcttaacatttatatctggtgtttttaaaaatactttctgaatttgcctttgagattrtaacttgtattttttctctatctattagtaaaatttgctactgaataatgacatttgatataagtaggtctcaaagtccgaagaagagaagcatttaaaagaataatctattaattatataagtagtctttgaatgatgtagatactaggttaatgttttcctttgtaatatattgctaatacatataaggcaaagcattaggtacttggtttatatattaaagatcttactttcttgaagtgaacaccaccaaaaagataaagaagaactttcattctcagaagtagaagaactatttc

SEQ ID NO: 158064 - DNA, 601 bp, Human
aggtacatggccatatagcaatattatcaacatatttcttggttttgtaatgtgtttttcctcctttttggtgtaagtggggaaggagaaaagtagaataaactctaacctataattatagctcacttatctttagggtcaatagctgttactttaatgttgttaaagcacaatgaaagatgtacagtatagttattataactctaagaaaagatgtgtttttgaagcagcatatatattggccctaatagtaaactatttatctacattccattcaagatagagaaaacactgtctgccragaataattgtttttatttctttgttgcttggttctttgtttgtcttaattgcagaagagtccaaataagattgcatctggctttttcctgcgattgttaacatcaaagctaatgaatgacattgcagatatttgtaaaagtttagtaagtatgcttcctgttttgctatcatattttgattctaataggcataatttttttgttgaaatatctttgtaaataaggatgcatctcacaacatatagctcttaacatttttacaaatgtggaaattaaggccaggtgcggtggctcatgcc

SEQ ID NO: 158065 - DNA, 601 bp, Human
atttaaaataattatttgttctttaaaagtgaccaaaaatcttgccaggcaagcaacatattcttattgtagtatttatttttcttccatacaaatgggcttatgccacatacattcttttttctggaacactgccgggcatacaaagtagttattgaaatatctattgagtgaaaacatattctgtaacttatttccattttatgacacatcttaatcattttccatgtcactgtacttattttataagctatctgctgttatactttatttatttagcagtgcatggtattctattgtrtggtgatagtgaatagtatatatgtatatgaaagcttatctgctctttttttttttttttttttttggagacaaagtcttgctctgttgcccgggctggagttcagtggcacaatctcggctcactgcagcccccacctcctaggttcaagagattctcctgcctcagcctcccaagaagctgggattacagatgtgtgccaccacaaccggctaatttttgtatttttagtagagaccaggtttcaccatgttggccaggctggtctagaattcctgacctcaaatgatctgtccacct

SEQ ID NO: 158066 - DNA, 601 bp, Human
ctaatttttgtatttttagtagagaccaggtttcaccatgttggccaggctggtctagaattcctgacctcaaatgatctgtccaccttggcctcccaaagtgcttggattacaggtgtgagccaccacactgagccaaaaagcccatctgctcttaattaacattttaagtggtttctagttttttgggttacaaagacttctgtggtacagattattgtacttttgtctatttgtatttgtgtgtatgatggatgtaggataatttctagcagtagacttgcttgttcaaaaggaatgygaattttactttttgatggatattgtcattgtcctccaaaatagtcataccaatttaggcattttcctacaccctctttgggtaacactttaggtgttacaaaacttcttaatataagaaataattttgagggaggagccaagatggccgaataggaacagctccggtctacagctcccagcgtgaacgacgcagaagacgggtgatttctgcatttccatctgaggtaccgggttcatctcactagggagtgccagacagtgggcgcaggtcagtgggtgtgcgcaccgtgcgcgagcc

SEQ ID NO: 158067 - DNA, 601 bp, Human
tatgaatttatgtttatatacttaaaaaaaatttttttttgagacggaatctcgctctgttgcccgggctggagtgcagtggcgcgatctcggctcactgcaaccttcgcctcccaggttcaagcgattctcctgcctcagcctcctgagtagctgggattataggcgcctgccaccacccctggctaatttttgtgtttttagtagagatggagtttcaccatattggccaggctgttctcaaactcctgaccttgtgatctgcctgcttcagcctcccaaagtgctgggattacaggtktgagccactgcacccggcctatgtttatatactttttaaagtaaatgatttgtggataaacctgatttttttccctcctaccatcttagtatctaatgcttttaaaggagcttcctggagaagagtaccccttgccaatggaagatgttcttgaacttctgaaaccactatcgtaagaaattaaaaccttatgttatgttcactttaaagttataaaataactgatgtgttctgttaagcttataaagttgaactttttttttttttttaccacagcaatgtgtgttctttgtatcgtcg

SEQ ID NO: 158068 - DNA, 601 bp, Human
gtgagccagtgcacccagcctgaatgtggttttgaaatcttcaatataccaaacaaagaaatcttcaatataccaaacaaagaaatttctttctaaagtaagtttactgtaatgtagtttagccattctatggtagcccccaaaaaaggacataatggtataaaacaaataatatacgctaaaatgaattcttttacactaatttcttttagcttgaatttttggcaaggtgagtatgttggcatattccacataatgacaaataagtttagcacagaaagacatattggaagtaacttayaataacctttcagtgagttttctgagtgcttttatcagaatgattatttaactttggaaaacttacttgatttcaggcatctaacaaaggagaggaaatatatattctctgtaagaatggccctagtaaattgccttaaaactttgcttgaggtgagtttttgcatttttttagtaagatctccattgaaaattttaaagcagtctttgtttgttaatgagtaatttttctctatttcatatttaaccacagttcttttcccgtaggctgatccttattcaaaatgggccattcttaatg

SEQ ID NO: 158069 - DNA, 601 bp, Human
catttcattatttacctagtagtcattcaggagcaggttgttcagtttccatgtagttgtgtggttttgagtgagtttcttaatcctcagttctaatttgattgcactgtgatctgagagactgttacgatttccattcttttgcatttgctgaggtttgttttactttcaattatgtggtcagttttagaataagtgtgatgtggtgctgagaagaatgtatattactctgttgatttggggtggagagttctgtagatgtctgttaggtctgcttggtccagagttcggttcaagtcckgaatatccttgttaattttctgtctcattgatctgtctaatattgatggtggggtgttaaagtctcccgctattattgtgtggaagtctaagtctcttcgtaggtctaagaacttgctttatgaatctgggtgctcctgtattgggtgcatatatatttaggatagttagcacttcttgttgcattgatccttataccatcatgtaatgtccttctttgtctttcttgatctttgttggatgtttgttttatcagagactaggattgcaacccttgctttttttctttctatttgcttgg

SEQ ID NO: 158070 - DNA, 601 bp, Human
gtcgacttcagactgttctgctggcagcgagaatttcaagccagtggatcttaacttgctggtctccatgggggtgggatccgctgagctagaccacttggctccctggcttcagccccctttctaggggagtgaatgggtccgtctcgctggcgttccaggtgccactggggtatgaaaaaacactcttgcagctagctcagtgtctgcccaaatggccgcccagctttgtgctttaaacccagggccctggtggtgtaggcacccaagggaatctcttggtctgcgggttgcaaagacygcgggaaaagcgtagtatctgggcaggaatccaccattcctcacagcatagcccctcacagcatagcccctcacggcttcccttggctaggggagggagttccccgaccccttgtgcttcccgggtgaggctacaccccaccctgctttgactctccctccgtgggctgcacccactgtctaaccagtcccaatgagatgagccatctacctcagttggaaatgcagaaatcaccaccttctgcgttgatctcactgggagctgcagaccagaactgttcctatgttgccatcttgctgt

SEQ ID NO: 158071 - DNA, 601 bp, Human
tagagctatcaggcttttaagttcagttatcaggggagaaggactagggtccaagccttataattactacatcagcacagtattatagaatgttggccccgtctcttttccatcacctcagcatttatggtttaggaagttccagacctttccattgcaaatttttatgtgataaatcagtggtaggtcagtggactgatattatgccagttaacattctaccagcatagtttccatggtgctttggagtaagccagcctataatcagttagccttttacctctcagtataagacttgttyggtgtttcttaaaagtatacaaatacattacctaataatcataagtgttatgtattgtttggatttttcttatttggatttaagcctaagagaaataattttactttatatttatttatttattttgaaagacagggtctcactctgtcacccaagctggagtgcggtgatgtgatcatggctcactgcagtcttgacctcctgggctcaagcgatcctcccaagcctcctgagtagctgggactacaggcatgtgccaccacacctggctaatttttttttttttttttgagacggagt

SEQ ID NO: 158072 - DNA, 601 bp, Human
ttactacatcagcacagtattatagaatgttggccccgtctcttttccatcacctcagcatttatggtttaggaagttccagacctttccattgcaaatttttatgtgataaatcagtggtaggtcagtggactgatattatgccagttaacattctaccagcatagtttccatggtgctttggagtaagccagcctataatcagttagccttttacctctcagtataagacttgttcggtgtttcttaaaagtatacaaatacattacctaataatcataagtgttatgtattgtttggrtttttcttatttggatttaagcctaagagaaataattttactttatatttatttatttattttgaaagacagggtctcactctgtcacccaagctggagtgcggtgatgtgatcatggctcactgcagtcttgacctcctgggctcaagcgatcctcccaagcctcctgagtagctgggactacaggcatgtgccaccacacctggctaatttttttttttttttttgagacggagtctcgctctgtcgcccagactggagtgcagtggcatgatctcggctcactgcaagctccgcctc

SEQ ID NO: 158073 - DNA, 601 bp, Human
tggtcctagctgtgccaacaaccagctatctgactttggtcaaaccacataaagaccctctatgccttggttttttaatatgtaaagtaagcaagttacacaaggagatctttcaggtccttttcagctttaatatttgatcatctttcctttggaaaaaattgaagataaattactagtagctggttatttctgccttgtttttcttttctgttgcttgactataggcctcttagttattacttctattagatttagaaacttaatgtaaaactttattttgctaactttaactctgtasaagaaaaatttgaaaatggagaggtttgaaacaactaaaaagtaatgtttaggtatcaggatgatgggaaggcatctcatatttgttgaacatgctctgtgttatggactttgctatgcattttacatgtagtgtatcacagatctgagtttcagacttatcctaatagagttttctaatagattatgagttgtatgtaggtagtttcctttaagaaggatattcctacaaaagtaaatttagtggtccttatagttcattcattttggcaagaacaatatagctatatctctgtatatg

SEQ ID NO: 158074 - DNA, 601 bp, Human
attttgcctatgagggtaccagagacagtgggatggcacagcaaagagagactgctaccaaggtctatgatatgcttaaaagtgaaaacttattgggaaaacaggtatggcttcaatttttatgtacttttcattccctgaatgatatgagatataacctttaagttttaaggctatttattcgatttattcgtatttatatattgaaacttagcttgtggtaatcattatctagcatagccaacccatgaatttttttggttatgtcgtgttgtctccctctgattggcttttaactaartagaaatgttttaaattagaaataatccaaaaaaccatttgaataattttcttctgccatttaaaaatttattttaactgttgtaatacacgaatgcaaactggttgttaaagtcaaggaatactaaacagtgtacagaaaaccttcactccctcttcaatctcaccaagctttccacttttcaagaaaaacaaccgtccctcattcctatagttctcataccctgctgtttgtttttttgtgacacttattaccttctaatgtatgatacaatttaccttttttttctgtctttgcttt

SEQ ID NO: 158075 - DNA, 601 bp, Human
actgaagcctctgtctcctgggttcaagcaattctcctgcctcagccacccaagtagctgggactacagctgcgcaccaccacacccagctaattttcatatttttagtagagacggggtttcaccatgttggccaggctggtctttaactcttgacctcaggtgatcttcccacctcagcctcccaaagtgctgggattacagatgtaagccaccttgccagaccataatttacttttgaattatgtttattatttaccagtcttctccagtatacatttttctctctttttttttttttggctgatgtatctctaatatattttgagtattcattaaatgtttgtcaaaagaaggagtcaagtaaggaaggatttaaaaagcttcgtttgttttataatcatttatatacatttccaaaattttttgaagcaacttatattaaaacatacatacaaattttttaagataaaaaagctgtggtcaccccacatttatgtatgtatttatttattttggatataagtaagggataagtaaccaaacttggtcaatattagataaacttcaagggaccttttttttttttagtttcctagtt

SEQ ID NO: 158076 - DNA, 601 bp, Human
gatggcactcaagtagaagtctgggaagaagttacgcagggaacaaagatgacattgttcgcagtccctgggaattcttaacagtaaagttctgtaattgagacagaattcccaaataaagtcaagagtaaaattcagatagaggagcagttatacatcagtgggaaatttggttggcagaaaaattaccaggtcatacaacttaatgatagacctgaagtcttatttaaaatgattctctaaaattgaagaattggattaagggggccttgtttggctgattttcatactttttcctctyagtctacaggttggctgcatagaagaaaaaggtagagttatttataatcttgtaaatcttggactttgagtcatctattttcttttacagtcatcgaatacttttggaaataaggtaatatatgccttttgagctgtcttgacgttcacagatataaaatattaaatatattttaattttgtgcccttgcagattgatcacttattcattagtaatttaccagagattgtggtggagttattgatgacgttacatgagccagcaaattctagtgccagtcagagcactgacctctgtgac

SEQ ID NO: 158077 - DNA, 601 bp, Human
ccaaccaaagtgctgggtctacaggcatgagccgccgtacccagcctcaccttttctttattgtgcgttattatctgtacaatttaatttggatgtgaatgtctctgagttgtatatgaacatcagagttgtttccctggcttgattgtaagctacttgaaaatatgctttacttttttttttttttttttaatgtgccctactgtgctgggcatataaaatagtaataatatctgagaaagtactttcacatatgtaatttcatgctgtctaaataagtgttgattgccatgtcttaaartactgcttttacagtactggcatagagctttgattctgatctgaagtaatactgaggctcatttattgaactgccttttaactttataagattttttaagaaaatcattataagatcatttaagattatttaagttactgagggtgaaaggtatttagataatctgatttatatatctggactgtgatatgtcatttgtgattttattgaaagtatagtttttcagtagaaaaatggtttttgaatttgggggttattaaaatctaaattttcattttggaagttcactggtctatgaac

SEQ ID NO: 158078 - DNA, 601 bp, Human
ataaataacaaaacttcctggtaaagatccaaattgtaagttttcaaggaatgtgatgtaaaatagttttgattttaacacataagatcctaaggtccactgatagctcaaaactaccaatggatcttttcaatgtcaatttaatgtttgtgttagagataacgtttaacttttgaaagcatattttaagttttaatctttataaacctcgaaattatgtttaggtatattcttccatacatatcttaattataatttttaaatgatagtctgtatttgactctatgtaaatataaaaacrtatttaagtatgttaagatgtaaagttatactactaaagagaaatttaagcatttccttccagttgagtatgctataacaatcttgaagtctgtgttaccatgagagagtctattagaatttaaaggattaggctgggtgcagtggctcacgcctgtaatcccagtgctttggaaggctaaggcgggcagatcatctgaggtcaggagttcgagaccagcctggccaacatggcaaaaccccatctctactaaaaatacaaaattagctgggcgtggtggcacattcctgtaaatgccac

SEQ ID NO: 158079 - DNA, 601 bp, Human
aaagatccaaattgtaagttttcaaggaatgtgatgtaaaatagttttgattttaacacataagatcctaaggtccactgatagctcaaaactaccaatggatcttttcaatgtcaatttaatgtttgtgttagagataacgtttaacttttgaaagcatattttaagttttaatctttataaacctcgaaattatgtttaggtatattcttccatacatatcttaattataatttttaaatgatagtctgtatttgactctatgtaaatataaaaacatatttaagtatgttaagatgtraagttatactactaaagagaaatttaagcatttccttccagttgagtatgctataacaatcttgaagtctgtgttaccatgagagagtctattagaatttaaaggattaggctgggtgcagtggctcacgcctgtaatcccagtgctttggaaggctaaggcgggcagatcatctgaggtcaggagttcgagaccagcctggccaacatggcaaaaccccatctctactaaaaatacaaaattagctgggcgtggtggcacattcctgtaaatgccaccttttcaggaggctgagacatt

SEQ ID NO: 158080 - DNA, 601 bp, Human
tgtttaagattatggaatttgtgtgatacctcaacaaaaattttaacagttttaaggttgattctctctctctttttttttttttcttttgtcacccaggctagagtgcagtggtgccatcttggctcactgcagcctccgcctcctgggttcaagtgattctcctgcctcagcctcctgagtagctgggattacgggcctgcgccaccacgcctggctaattttgtatttttagtaaagatggggctttaccatgttggccaggctggtctcgaactcctgacctcaggtgatccgcccrcctctgtctcccaaagtgctgggattacagtcgtgagccaccgcactcggccttaaggttaattcttgaagtacagaaaaacagcattatagttttgaaattagaaaatttcagttttatgtatgatctcttacctatgactctactgaaatagaatttctatatgtagaggctgttggaagctgcttgggagaagtgggtcctatagatttctctaccatagctatacaacatagtaaagatgcatcttataccaaggcccttaagttatttgaagataaagaacttcagtggaccttc

SEQ ID NO: 158081 - DNA, 601 bp, Human
tttattaaagtgagcatccgtatttagtcataactttatgcattaggtttcagcttcgggatagcaacatactagaggagttctaaggggtgccttgaataatttgttactaatgatagttaaaatactgctgattataaattatttgcattaaccaagagcctgttctaactttgtttacgtcttctgataagagcacctttattttccctgatatgctttcttgaataagaaaaaggagtggggcagcaatcagcatagcttttttatttttgaggatatagtacaatttatctcaacraagagtaaaggtacataccaaatgaaacaaagtttgtactcttccatcaaatgtgtaatctaaaacagcatactatgatgctctaagatttacagagttaatttatagcactgtcaaatgtgattcaacagaaatgtgaaaatacaacatctgatgaggtcaaacatctgctgattacagataactgatagagaagtattttcgtaatgtactcacattgaaagcaatgtaagaagcagttcttattttctacagaaaaagtagtgacagtgaataaaacatcaccttctctgcaatact

SEQ ID NO: 158082 - DNA, 601 bp, Human
cgtatttagtcataactttatgcattaggtttcagcttcgggatagcaacatactagaggagttctaaggggtgccttgaataatttgttactaatgatagttaaaatactgctgattataaattatttgcattaaccaagagcctgttctaactttgtttacgtcttctgataagagcacctttattttccctgatatgctttcttgaataagaaaaaggagtggggcagcaatcagcatagcttttttatttttgaggatatagtacaatttatctcaacgaagagtaaaggtacataycaaatgaaacaaagtttgtactcttccatcaaatgtgtaatctaaaacagcatactatgatgctctaagatttacagagttaatttatagcactgtcaaatgtgattcaacagaaatgtgaaaatacaacatctgatgaggtcaaacatctgctgattacagataactgatagagaagtattttcgtaatgtactcacattgaaagcaatgtaagaagcagttcttattttctacagaaaaagtagtgacagtgaataaaacatcaccttctctgcaatactacaccgcactcataccaa

SEQ ID NO: 158083 - DNA, 601 bp, Human
cttttagttttactgctacaaccttcatttgacatgactctaatgtcatttagacttcagtttgctatgctttatattttatgtattttattttctgttggctaacagcaattacaaatctactatttggaaaaatataaattataaacatagacatagatgcccatcctgtgatcctactagattataggctgttctctaaatgatctagaatgtgcttatatgaattttccttaggccactgaaatgaaaatcctaaaataaaaattctcatagaggctttgtaaactatctaaaatgwatctcttatctttaattgggaaaatacaggtataagtgatttaagcatttaaaactttaatatgtaatttacagtactattaaaaacaatttttattacatagtttaaggtaatcattgtttatgataatctggtaatttgttatcatgaacatggccaagacttttttcatgtttatcacttatgtatttatgtcacaaccattggaaggtaaagtaactgttttattttatctgtatacagtgccaatatttttattaccttaagtgaaaatttaaacttcacatataaaattctgtt

SEQ ID NO: 158084 - DNA, 601 bp, Human
gttatcatgaacatggccaagacttttttcatgtttatcacttatgtatttatgtcacaaccattggaaggtaaagtaactgttttattttatctgtatacagtgccaatatttttattaccttaagtgaaaatttaaacttcacatataaaattctgttattgaaaaggaaatacatatttttgtaaaatttaaatggtgtatcttttctgatggctataagcctcattgccttcactaaacgtcccatgtgcatctcaaactcagctgtccaaaagcaaacgtgtcatcttcttcatcycttcccccagcctacttttttaaatgtgtacctttttgacaaatggcactcagttgcttactctagaaacctctctcacgtatttcatctgattaccaaatcttgccaattccatattatgaataacttagtccatttgtttctctctgcccttagcatccttactgctttctagctccatgatttagcacagttgaaattctttcattaaattttccaagttatttcttgcttccagccatctcagatattattattattgcctgtagcactatcctttcctgctctgatgactattac

SEQ ID NO: 158085 - DNA, 601 bp, Human
actgtagccttgatcttccgggctcaagtgatcctcctgcctcagcctccaagtagctgggactataggcacacaccactgcatccaactcattttttttaatttttatttttaatagagacaagatcttgctatgttgctcaggctggtcccaagctcctacgttcaagcagtcctcccacctcagcctttcaaagtgctgggattacaagcatgagccgctgcacctggtcccaaattgttttttaaagcggttatacccatttgtgtacagaaatgtagttgataaggaagtggatcrgtaggaagccttatatttgaagaagggagccaaagtataactgttcctagtttagttaaaaaagtaaagaaggttgggcacagtggctcacgcatgtaatcccagcactttgggaggccaaagtgagaggattacttgtgaccaggagactgagaccagcttgggcaacatagtgagacctcagctctactaaaaataaaaataaatcagctgggcatagtggcctgcacatgtagtcccagcaactcaggaggctgagggaggaggatcgcttgagcccaggagggagaggctgcagtg

SEQ ID NO: 158086 - DNA, 601 bp, Human
gtgatttttttttttttatgtgatataagcctggtaggtcggtacttatttcttatctaattcatgaaattgtaggcaattcttctcgggtagactacagtcctcctgttgtctaggaccagtctactgtgttgctgatccaaatcattagtatatacagttgacccttgaacagtgtaagggttagaggtgctaaccccctgtgctattaaaaatcagggtaaaactaaattagtagtcaaaagttaactactaatagtctactgttgaccagaagccctaccgatgatataaacaacayaattttgtatatgtattatatactgtattcttaaataaagtagcttgagaaaagaaaatgttattgagaaaatgataaggaagagaaaatgcatttacagaactgtactgtgtttatcaataccgtaagtttatatcatctgtttacaaagaatcatctgtctgaaattgtaggcaaccactgctggttgatatgtactttaggcctcaatctacagaatgtatcaaacaattcacctttttcttgtaatggcatgacttttctctgcatcttggaagcacctccagccactgtggtgtt

SEQ ID NO: 158087 - DNA, 601 bp, Human
actgaggtagctgcaaaattattacaatagtacaatatgtacgatagttaatcttatgcaattatgatttaatactgcatctttacatttgtttatatttgtcttaaccacaaataatgctgtgtacagtgtgtgtgtgtaagttttgataaattttaactctttgtaatagatttgtgtatattttatggtagtaaatgatgaaatgtatcatatcaaatgtatacaaatgatggaatgtgtagactagttgtacatttattttatgcattcatgacataacttttaaaaaatttttcartagttctaaactgtgtggtttgtgaattttttcaaattgtggcaaacctccaaaaagttttcaatatatttattgaaaaaaaaatccacatataagttgtcctgcacagttcaaactcgtgttgtttgaactgtatttcagaactgtatttcagaatcattacattttatttctataacataacatttagagttgggagttacatattggtaatgatacaatttaaaatttgctaaatttatagaccgattttttttccttcttcaatttttgttgtttccatgttttcaggatcttctc

SEQ ID NO: 158088 - DNA, 601 bp, Human
atactcaataccaaagaattgaaaactacatgaaatcatcggaatttgaaaacaagcaagctctcctgaaaagagccaaagaggaagtaggtctccttagggaacataaaattcagacaaacaggtaactaggtttctacaagtgacaattttatgttcaccagttaactgagtgagtgtttttgcatagaaagagtgacttggtctttttatctgatatagttttgagctctaaaggtcggcttaactatatatagattatcttggtcttttgggttcttttcggtttttgttttttgtktttttttttgagacaaggtctcactctgtcacccaggctggagtacagtggcgtgatcactgtactccagctcactgcaacctcgacctcctggactcaattgattctccccctgagcccccgaaatagctggggctacaggtgcacgccatacctggctaatttttgtattttttgtagagatggggttttgccatgttgcccaggttggtctcaaactcatgggctcaaacgatctgcccaccttggccgcccaaagtgctgggattacaggtgtgaggcactgtgccctgtctgtct

SEQ ID NO: 158089 - DNA, 601 bp, Human
tgtcactaaaatctcttcatttttaaatacagaaggcataaatattccagcagaccagccaattactaaacttaagaatttagaagatgttgttgtccctactatggaaattaaggtaatttgcaattaactcttgattttttttaaactaaattttttttattagattgaaccatttgaaatagtatttttatgtaggtcaaaattggttaaatattggcaaatttcatatgtttcaacctataatttctcagtattatatttcctttgcccaagccctaaaatactcaaaagcttctcytgctttcttttccattgccttctgttctacacctcccatctttcttatgaaggtctatagactgttactttcattggccagaaggagagtttccgtgtgcttatgccaagattaatttttgacttggcaaggaaggttccaattgtcatatattgtttttaaaaattctatgtgcagtaaaatgtattggctgtgatatatcacagtattaagtaatatagtatgtattattataatattaagctgacttcatatgcatgatacacttagctctgttctaatattcttttattgcaagaa

SEQ ID NO: 158090 - DNA, 601 bp, Human
taaacttaagaatttagaagatgttgttgtccctactatggaaattaaggtaatttgcaattaactcttgattttttttaaactaaattttttttattagattgaaccatttgaaatagtatttttatgtaggtcaaaattggttaaatattggcaaatttcatatgtttcaacctataatttctcagtattatatttcctttgcccaagccctaaaatactcaaaagcttctcctgctttcttttccattgccttctgttctacacctcccatctttcttatgaaggtctatagactgttactttcattggccagaaggagagtttccgtgtgcttatgccaagattaatttttgacttggcaaggaaggttccaattgtcatatattgtttttaaaaattctatgtgcagtaaaatgtattggctgtgatatatcacagtattaagtaatatagtatgtattattataatattaagctgacttcatatgcatgatacacttagctctgttctaatattcttttattgcaagaaataatggaagtaatttcatgtgggcagggatatatgtaataagggttataagtttagaaaatgatc

SEQ ID NO: 158091 - DNA, 601 bp, Human
atatattgtttttaaaaattctatgtgcagtaaaatgtattggctgtgatatatcacagtattaagtaatatagtatgtattattataatattaagctgacttcatatgcatgatacacttagctctgttctaatattcttttattgcaagaaataatggaagtaatttcatgtgggcagggatatatgtaataagggttataagtttagaaaatgatcatcttaaatacattgtctttcttttcattttgcagtttagtgcttagtatctagttacttgatttgaaatgtagctgtatcrtgtggattaactgctgtttttctagctatatcagctaggtgatttcgctgaatgtttccttaaaatgccagatttagcagttataacccagaaaactccttctactgttttccaaaatttactttatgttttcgtgaggagttatttctcagatgactttacatatattagtgaatctttgatgaaacagtagttaaagttacgagcgtgagccaccacacccggcctaaagttgtagttcttaaccactatcacatcgtcatttgtttctctgtttaatattaaaattgccatttataa

SEQ ID NO: 158092 - DNA, 601 bp, Human
cacagtattaagtaatatagtatgtattattataatattaagctgacttcatatgcatgatacacttagctctgttctaatattcttttattgcaagaaataatggaagtaatttcatgtgggcagggatatatgtaataagggttataagtttagaaaatgatcatcttaaatacattgtctttcttttcattttgcagtttagtgcttagtatctagttacttgatttgaaatgtagctgtatcatgtggattaactgctgtttttctagctatatcagctaggtgatttcgctgaatrtttccttaaaatgccagatttagcagttataacccagaaaactccttctactgttttccaaaatttactttatgttttcgtgaggagttatttctcagatgactttacatatattagtgaatctttgatgaaacagtagttaaagttacgagcgtgagccaccacacccggcctaaagttgtagttcttaaccactatcacatcgtcatttgtttctctgtttaatattaaaattgccatttataatgtatttttctttaagtgcaaatagtgtatctgacctattatcaatcatgttta

SEQ ID NO: 158093 - DNA, 601 bp, Human
ctgtgaaggaccaaataataaagatttattttctttgtaaaaagtatttattaatgttaattatagttaggtgtttcttatagtcaactgaagtattttttccttttttttctactcaacaatatgtcacagaaatctttctcattttttaacagctgcattgtgtgtatgtatgtagttttttatacaagtccttatcgatgggcatttgtgttgttttcagtcttttgctgctacaaacaacgctgtattgtagtgaataaccttgaacatacaaatttcatacatgcgcaggcaaatytgtagcatggatttccaaaagttggattgctgggttagaggatacatgcatctgtaatctggtacatattgccaaattactctcaatgggagtgtacccacttacatttcctctagctatttgcctgagaagacaatcctcagtcacattctatgagctgatcatctttgactcttatattaattattcatttaaccagtttagaaataacaataaatccttattttgaagggcctattttccataggtttgtcttttgtgatttcattcctgtacctcatttttaaactttctccttct

SEQ ID NO: 158094 - DNA, 601 bp, Human
aaccccatctctactaaaaatacaaaaaaattagccaggcgtggtggcacatgcctctagtctcagctacttgggaggctgaggtgagagaatcacttaaacccggatggcagaggttgcagttgagccgagatcacaccactgcactccagcctgggtgacagaccgagacttcttctcaaaaaaggaaaaatgtctagaggccagatgcagtggctcatgcctgtaatctcagcactttgagaggccaaggcaggaggatcacttgaggccaggagtttgaaaccaacctgggcaacayagcaagacctcatctctacaaaaaattaaaaatttagccaggcatgatggcatgcacctatagtcccagctactcaagaagctaaagcgtgaggattgcttgaaatcaggagtttggggctgtgcatgagctgtgatcatgccactgcagtccagtctggacaacagagcaagaacttgtcttaaaaaaaaaaaagtggggttggggggtaacccagataattaattatttaatgttatacatctcaatattaaagtaaaacctgtaaacacaacagtttaggtttgactatttcttaga

SEQ ID NO: 158095 - DNA, 601 bp, Human
cagaccgagacttcttctcaaaaaaggaaaaatgtctagaggccagatgcagtggctcatgcctgtaatctcagcactttgagaggccaaggcaggaggatcacttgaggccaggagtttgaaaccaacctgggcaacacagcaagacctcatctctacaaaaaattaaaaatttagccaggcatgatggcatgcacctatagtcccagctactcaagaagctaaagcgtgaggattgcttgaaatcaggagtttggggctgtgcatgagctgtgatcatgccactgcagtccagtctggrcaacagagcaagaacttgtcttaaaaaaaaaaaagtggggttggggggtaacccagataattaattatttaatgttatacatctcaatattaaagtaaaacctgtaaacacaacagtttaggtttgactatttcttagaattacgacaataagccagtaatgttattttgagattactccaagaatgtgaaagttgtgtcatcattatgttaaactaagtgttcttgcctttagttaaggttccctagactacagcgaagtagtctacccagtccagtcatctgtagagtcattcccaat

SEQ ID NO: 158096 - DNA, 601 bp, Human
gagagaatcagatggaaatgaagacagttcttattgtgtatgttgatagctcagacatagcccttaacattaaccagaattagggtggctggccccatttttctccaccaaaactatgcattgttacaaagtatactgaacaagtctaaaatcttaggtgtcagaggatttgttttctaaaaggcaagtctctaataaacaatatttaagtgctgaaaggagctttgcacttaacctgatcatcctgccttgtgccaataaataatttttattccttgtcatgcatatttcagagcatctrtctcagtcatggttctggggagagaagccataatatcttaagacattcactgaatataatgaattaacttcatttctgtgtatctaggatgatatcagctgtgtactttcagagaactgagaaaatagtcatcagtccttttttgtggtattcacacaaaatacccagatacccagttgaaatcttccagagagtctttagtaccagagaaaacactgtcatttgctttttgaaattcaaattcagctctttctccaacaaccaacatcacagttgagactctaagctgaggtagaaaaa

SEQ ID NO: 158097 - DNA, 601 bp, Human
ttaagtgatctgcctctgctgttctccctccagccttatctaccactctcctcacactcctctcactttctgcttgtatagatgagtcatctccacctgacttacctggtcttttgcaattgcttagacacaccaatttgtttctgcctcagggcttttctgcttctgcctgcaatgcttttccctcagatcttcacaccagtcactcccttacttcattcaggcttctgctgcagtgttaccctcagaaaggcctccgaccatgttgccattacccactttctctcttttttaaacttamgttttgttctcttatacttattatctaatattatgaaatgtttattaggatatatgttcctcaccagaatgaaactttatgagggcatagtcttcatctgcctttttcccactctgttctcagtgccctagccctgtgtgtaacatgtaatacgcccccaacaaataaatgttaataaattaatcaaatgcttccttaagacacaaaacagttcaacatatgtgagaaacttaaaatttaaaaatgtatagaactaaagacaccataaggacgagtgaccagctgagaaaacgaatataa

SEQ ID NO: 158098 - DNA, 601 bp, Human
aataatgttaattagaacaaaaaggatcattttaatataaagaacaagggatttatatgaagaatacaatgatattcaacttttctagtaatctggaaaatacaaattaaaaccacagtgaaatactattaccctcagattagcaaaatataaaaagcctgacaatattaagtattgcgaaagttatggaataactctactggtgggtatataaatcggtacagtcactttgaatagttatttggcaatatctggttaaccgaggtgaagatgtatctctggctcagctgttaaattcctsggtatataccctagagcagacttgtccaacccacagcctgcaggccacatgcagcctacaggatggctttgagtgcagcccaacacaaatttgtaaactttcttaacattatgagattttttttgcagtttttttttcttttttagctcatcagcaatcattagtgttagtgtattttatgtgtggcccaaggcaattcttccagtgtggcccagggaatccaaaagattggacacccctgcctagagaaactgaaatatgttcacgagtagtttatttcattgcagcagtatttcatgg

SEQ ID NO: 158099 - DNA, 601 bp, Human
gattagcaaaatataaaaagcctgacaatattaagtattgcgaaagttatggaataactctactggtgggtatataaatcggtacagtcactttgaatagttatttggcaatatctggttaaccgaggtgaagatgtatctctggctcagctgttaaattcctgggtatataccctagagcagacttgtccaacccacagcctgcaggccacatgcagcctacaggatggctttgagtgcagcccaacacaaatttgtaaactttcttaacattatgagattttttttgcagtttttttttcttttttagctcatcagcaatcattagtgttagtgtattttatgtgtggcccaaggcaattcttccagtgtggcccagggaatccaaaagattggacacccctgcctagagaaactgaaatatgttcacgagtagtttatttcattgcagcagtatttcatggaaatgtggaaacaatgtaaatgttaatatgcagattggataactgttgtatttatgtagtatatagctgttaaaatgaatgatgtagagttaaatatgctcacatagttaggataaaatagtattgaataaaaaacc

SEQ ID NO: 158100 - DNA, 601 bp, Human
tgatagctgaatgatcatcaaatgctctttaatggccttttaaaattaaaaggtatttaatctgtaactccaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggtgagtgacacccaaaattaaaggttattgtaagattatttaatggcttattaaagctgacagctgtcagatattatrgaatacaaaaaaactttaatttcatcaggtaattgtcaaagatactaagtaaaagaaaaactcatcagaatgaaagtgtgtgagtgaaaaaggaaggattttaaactacataatatgtcaacccttgtcagataagaaatgtaaaggttattcaatgtgtgctgatttgttttcaatttgggataaactaattcttagcaaacaaaacactaaaatgccaggcacgatggcatgcacctgtaatcccagctacttgagaggctgagtctgggggatcccttgaacccaggattttgaggc

SEQ ID NO: 158101 - DNA, 601 bp, Human
tgtggttagtaaccaacccatcttcattattaaatcatatgtttcttgttcatcctgattcttagtgtctacctttttataacttatgcagaagagaattctcctacttcaataaataataaaaagacagggttttcttctttgttttatagtgaatatggcatattttctctcctctcaatatattattttctgagactttctttggaaaataatgaaacctgtgataacttatttcctttaattatttttgttcttttgcatataacctctaaatatcatcacctagtgattaatactktttaatagaattttgttttcagaatagaaaccatgagatatatttaaatattttgtgtacaatatatattttgactttttttccctaagaaattagaataggtagatagtatggttaacaaaatcctagagtatgagaactaatgtaaacattagagatcatctaatctatttgttgttttttttttttttaactaaagacaactccctccatcacttacatactataccccaggaaggcagggcatgtatgttttgaaagagttcccaggtaattgtgaaactctcttctacatagaga

SEQ ID NO: 158102 - DNA, 601 bp, Human
ggttagtaaccaacccatcttcattattaaatcatatgtttcttgttcatcctgattcttagtgtctacctttttataacttatgcagaagagaattctcctacttcaataaataataaaaagacagggttttcttctttgttttatagtgaatatggcatattttctctcctctcaatatattattttctgagactttctttggaaaataatgaaacctgtgataacttatttcctttaattatttttgttcttttgcatataacctctaaatatcatcacctagtgattaatacttttkaatagaattttgttttcagaatagaaaccatgagatatatttaaatattttgtgtacaatatatattttgactttttttccctaagaaattagaataggtagatagtatggttaacaaaatcctagagtatgagaactaatgtaaacattagagatcatctaatctatttgttgttttttttttttttaactaaagacaactccctccatcacttacatactataccccaggaaggcagggcatgtatgttttgaaagagttcccaggtaattgtgaaactctcttctacatagagaatc

SEQ ID NO: 158103 - DNA, 601 bp, Human
cttatgcagaagagaattctcctacttcaataaataataaaaagacagggttttcttctttgttttatagtgaatatggcatattttctctcctctcaatatattattttctgagactttctttggaaaataatgaaacctgtgataacttatttcctttaattatttttgttcttttgcatataacctctaaatatcatcacctagtgattaatactttttaatagaattttgttttcagaatagaaaccatgagatatatttaaatattttgtgtacaatatatattttgacttttttyccctaagaaattagaataggtagatagtatggttaacaaaatcctagagtatgagaactaatgtaaacattagagatcatctaatctatttgttgttttttttttttttaactaaagacaactccctccatcacttacatactataccccaggaaggcagggcatgtatgttttgaaagagttcccaggtaattgtgaaactctcttctacatagagaatcactaatctgatacaactagtttataaacaagaaagtaggcctagttaatgacagagcaagccagacacccagtcattct

SEQ ID NO: 158104 - DNA, 601 bp, Human
tctattaaacagtattaatcactaggtgataatttttagaggttatatgcaaaagaacaaaaataattaaaggaaataagttatcacaggtttcattattttccaaagaaattctcagaaaataatatattgagaggagagaaaatatgccatattcactataaaacaaagaagaaaaccctgtctttttattatttattgaagtaggagaattctcttctgcataagttataaaaaggtagatgctaagaatcaggatgaatatgaaacatatgatttaataatgaagctggtttggttwctaaccacatcatcactattatccccctgcaactcagaatgtagaaaaagaagtgtgaatgtaatgacggagatccagaatcttcagcaaatagatttcagttgaagtcactgggctggaggaggttctgatctcacacatcatccgtgataaagagacctaaagatgaaatcataagggaagtgagccttggaaaggctgagccagaaaaaaactgagaagtactcaaaggaagtcaggatcttggaaggcaagaggggaaaatcttttatgaaagaagtagtgctcaatagtatctga

SEQ ID NO: 158105 - DNA, 601 bp, Human
taaaatttaccatggaaatgagaccaagacctgactagaaagggataaataaataagacatgccaagcagtttaaggggcactttcaatcctaaatttgtagtggagccaatagggttgttgtatgattttccagcagtcctcaacatccttggagcttaagttgtagtttaaaatgggagatgtggtggagggacaaggggacaaggagatttgaagcactgatgagagtaatcaaacttattgtctctacccctgggctgagttagggaaagaagagggctaataaactagaaatctcmgtcaaatttgaagactgtttagtaagaataaggggtagaaggagaagaggttttgattagaatgtacaatttacaatgtctaagaagcagttttagcagactcatttctggagtacaacccatatgagtggttcattaagatagaatgaaattgaattccattagaacagagacagtcacggatattatatggttttccccagaatgaattctagagttgggacagaggggaagattgtgagctaggtccatgccaacattcagcgaatgtgagagaaaaccttacaggtttacagagta

SEQ ID NO: 158106 - DNA, 601 bp, Human
tgcttttgaacagggcaaaatccttcctactcctgagacagttccttttagactcaccagagatattgtggatggcatgggcattacgggtgttgaaggtgtcttcagaaggtaagtgatatgaagtaaaggagggaaataatttttgatgtcaaaattacatgggctgggcatggttctttgcacctgtaatcccagctactcaagaggctgaagtgggaggattgtttgagcccaggagtttgagtccagcctaggcaatacagcaagaccctgtatctaaaaaaatacacacacacaaacacacacacacacacacacacacacacacacacacgggttagagatttgtatagattatagaatttagtgctagaatcgtattccagtgccttatcaatactaaggaaaagaccctgggtaaaagcaataatagttcctcttccttccacccacctgggacctaagcccatgtaacatacatactgttattccaaacctcctctggaagcatcccacctttacttttaacacctctatcctggctgactccttcttaatgatccaaactactattgggtgctcatcactgtgcatatag

SEQ ID NO: 158107 - DNA, 601 bp, Human
cccagcataggtctgtgtactcaacttggattggggcagattgcagtcagtgtaaactaataattgccacaataatcaaagactgagagctgagcccagtggtgcatgcctgtaatcaatagtgttgtgttattcttgtaaatgccaagcttgtgaaatagtcaaatacatatttgtattcatttcaaacgtctaatgaaagcccactctgccaagtattatgctattttgagatacagatatgtagattattaagcataggctcagcatactacacatgagagtatacagataaagataygttgacaacattggtgtgtaacaaaatccgtatttataatgtgtttgactctagatgctgtgagaaaaccatggaagtgatgagaaactctcaggaaactctgttaaccattgtagaggtaaagtattttataaggaagactttattttttttcttaccaggtagactgtgtatctcatcaggaagtcactgatgtgaagagcactgcttcattttaacatagggggatgtggctgggcagcagaaaggaggagattgtgcacttagccttttcacacatccaaaaatactggtttagaa

SEQ ID NO: 158108 - DNA, 601 bp, Human
ataagggtggggctttatcccttggaagatgagtaacagtccatcagggtggtcctgtgtgcacctttatgaaccgaggcatctttatagatctcctttggactgcagatggtaatacagattttgctacaaggagtttgctgaaataggtcccaataatacgttggtaaaattaaatccaaggctgtgctattcccaaggttaaaaatacattcttttttcttttaccgatttcaaattctgttcatacatgttgtcatttgttacagtttgccattggttctgcagtaagaataaatgwtaagaaaataagcatgatgtgtaacattttaaaaaaataatacatggtaacatggatgcctcaataatgtcgaaattaaactctaaagttatattatcttgcactttttcatgtaagaaaaagagggctgggcgcggtggctcatgcctgtaatcccagcactttgagaggccgagacaggtggatcacctgaggtcaggagttcaagaccagtttggccaacatggtgaaaccccgtctctaataaaaatgcaaaaattagctgggcgtgatggcgggcacctgtaatcccagctactc

SEQ ID NO: 158109 - DNA, 601 bp, Human
ttttttcttttaccgatttcaaattctgttcatacatgttgtcatttgttacagtttgccattggttctgcagtaagaataaatgataagaaaataagcatgatgtgtaacattttaaaaaaataatacatggtaacatggatgcctcaataatgtcgaaattaaactctaaagttatattatcttgcactttttcatgtaagaaaaagagggctgggcgcggtggctcatgcctgtaatcccagcactttgagaggccgagacaggtggatcacctgaggtcaggagttcaagaccagtytggccaacatggtgaaaccccgtctctaataaaaatgcaaaaattagctgggcgtgatggcgggcacctgtaatcccagctactcaggaggctgaggcaggagaatcgcttgaacccaggaggtggaggttgtagtgagctgaaattgcaccattgccctccagcctgggcgacaagagcaagactctgtctgtcttaaaaaaaaaaaaaaaaaaaagcccaaacttttcaaattaaagagtcaaagcagcttaacatattctttagtattttactctacctagtttcagtcagaaggga

SEQ ID NO: 158110 - DNA, 601 bp, Human
ggagccaagatggccgaataggaacagctccggtatacagctcccagcgtgagcgatgcagaagacaggtgatttctgcatttccatctgaggtaccaggttcatctcactagggagcgccagacagtgggcgcaggtcagtgggtgcacgcactgtgcgcgaactgaagcagggcaaggcattgcctcacttgggaagcgcaagggtcagggagttccctttcctagtcaaagaaaggggtgacagacggcacctggaaaatcgggtcactcccacccgaatattgcgctttttggaccrgcttaaaaaacggcgcaccacgagattatatcccgcagctggcttggagggtcctacgcccacggagtctcgctgattgctagcacagcagtctgagatcaaactgcaaggtggcagcgaggctgggggaggggcgcccgccattgcccaggcttgattaggtaaacaaagcagccgggaagctcgaactgggtggaacccaccacagctcaaggagacctgcctgcctctgtaggctccacctctgggggcagggcacagacaaacaaaaagacagcagtaacctctgcagacttaaat

SEQ ID NO: 158111 - DNA, 601 bp, Human
agcgtgagcgatgcagaagacaggtgatttctgcatttccatctgaggtaccaggttcatctcactagggagcgccagacagtgggcgcaggtcagtgggtgcacgcactgtgcgcgaactgaagcagggcaaggcattgcctcacttgggaagcgcaagggtcagggagttccctttcctagtcaaagaaaggggtgacagacggcacctggaaaatcgggtcactcccacccgaatattgcgctttttggaccggcttaaaaaacggcgcaccacgagattatatcccgcagctggctyggagggtcctacgcccacggagtctcgctgattgctagcacagcagtctgagatcaaactgcaaggtggcagcgaggctgggggaggggcgcccgccattgcccaggcttgattaggtaaacaaagcagccgggaagctcgaactgggtggaacccaccacagctcaaggagacctgcctgcctctgtaggctccacctctgggggcagggcacagacaaacaaaaagacagcagtaacctctgcagacttaaatgtccctgtctgacagctttgaagagagtagtggttctcccagcac

SEQ ID NO: 158112 - DNA, 601 bp, Human
atttccatctgaggtaccaggttcatctcactagggagcgccagacagtgggcgcaggtcagtgggtgcacgcactgtgcgcgaactgaagcagggcaaggcattgcctcacttgggaagcgcaagggtcagggagttccctttcctagtcaaagaaaggggtgacagacggcacctggaaaatcgggtcactcccacccgaatattgcgctttttggaccggcttaaaaaacggcgcaccacgagattatatcccgcagctggcttggagggtcctacgcccacggagtctcgctgattrctagcacagcagtctgagatcaaactgcaaggtggcagcgaggctgggggaggggcgcccgccattgcccaggcttgattaggtaaacaaagcagccgggaagctcgaactgggtggaacccaccacagctcaaggagacctgcctgcctctgtaggctccacctctgggggcagggcacagacaaacaaaaagacagcagtaacctctgcagacttaaatgtccctgtctgacagctttgaagagagtagtggttctcccagcacgcagctggagatcggacaacaggcagactgcctc

SEQ ID NO: 158113 - DNA, 601 bp, Human
aataaaaattacttcgcaaaaaaaaaaaaccctacaacgaattagagaaaaagtagttcacaggaaaacagaaaaacgcgcattgcaggaaaaataaatcggagaaaagcacttggcagaaaaaaatgcattagattaaaaacgcactgcagaaaaaaattagacaagggagctaacggaaaaaaatggatcgggcaaaaacgctttaaagaaaaaaattagaggaaaaagcccctcgagagaaaaatagaaggggaaaaaaagcacttccaaaaaaggacaattgctttacaaaaaaaataataataataaaaaaaaataaaaaagaggcaaaagcgcttggtgtaaaaagagataaatcagaagaaagcgctttgcccataaaatcatttaccctaaaagctccctttgcaggaagaattccctgctaaaggaatcctttgccaaaggaatcgcatatttccttcaaggtgttcctggaatgctgcatttactgggtaggattcgcttttcgaaatcctccagggacacagcccattgcgagaagtgaggtatacctaagttgtgggtccaatcagcttgccgccatgcagctctcagc

SEQ ID NO: 158114 - DNA, 601 bp, Human
aaaaattacttcgcaaaaaaaaaaaaccctacaacgaattagagaaaaagtagttcacaggaaaacagaaaaacgcgcattgcaggaaaaataaatcggagaaaagcacttggcagaaaaaaatgcattagattaaaaacgcactgcagaaaaaaattagacaagggagctaacggaaaaaaatggatcgggcaaaaacgctttaaagaaaaaaattagaggaaaaagcccctcgagagaaaaatagaaggggaaaaaaagcacttccaaaaaaggacaattgctttacaaaaaaaaaaawaataataaaaaaaaataaaaaagaggcaaaagcgcttggtgtaaaaagagataaatcagaagaaagcgctttgcccataaaatcatttaccctaaaagctccctttgcaggaagaattccctgctaaaggaatcctttgccaaaggaatcgcatatttccttcaaggtgttcctggaatgctgcatttactgggtaggattcgcttttcgaaatcctccagggacacagcccattgcgagaagtgaggtatacctaagttgtgggtccaatcagcttgccgccatgcagctctcagcaca

SEQ ID NO: 158115 - DNA, 601 bp, Human
agagccaagacaggccacacagccccagtcacacccccttgcctcactccatcaggaggggacacaacaccctctggctcacttcgagccatccggctgaaccccagtgtctcaggtgctcacctgtcctccgacaggtccctggagagctccccaagccctgctccctcctggcctcaacttctccatcttctatatgggctgaagaatatggccaggggcagctcagaagaagtgggagccagggatccaggttcatgttcagattgtgtgactgtaggcaagggcctttctctctctsggccctggcggtgggtgggggccaccctgcctgccgtgtgtcttctcagggtcctggtgaagtacaaaagtggccttggattgagaagagcccagcaagctgtcaagccctgctgcaacctgcagggggtgctcctatctgggagtcaggagcctgggcctggctgtgtgaccttgagcaaagaggcctttgcttctctggcctcagtcttcccagctgtacagtgggaatgagaggggctggaccctagttcccaggtctccctgcccattgacctctcctcactccctgtggaccccg

SEQ ID NO: 158116 - DNA, 601 bp, Human
tctcacttgactttctctcagccaggaatctcttctattacaaccttacttgcccgcagagacagggggttccctccctccctcccaaggcagctctcggcatcttgagatgtcttggtacatctgaaaggaagtgaatttcttcctgtcccgggactcctcccctatggatttgagcctcagatgaccaaggccagtcctgccctggtccaagacaaagtccatctgatccagctttggcaaaaaggcgtctgcgccagggaggggaggagttccaggccagctggacctggcatgctgyggggactcacgctggccccaccacctccctgggcctccctcagccactagagccctgagcacagcacctaggaggatggtgggcaccgggcttgtggctgacggctcccttctcctttcctccctccttctgtccctgctcagagagggagactggtggctggcccactcgctcagcacaggacagacaggctacatccccagcaactacgtggcgccctccgactccatccaggctgaggagtgagtaccgtctctggctgcctctacccgtcgtccctggacactgccggtgcagagt

SEQ ID NO: 158117 - DNA, 601 bp, Human
accgggcttgtggctgacggctcccttctcctttcctccctccttctgtccctgctcagagagggagactggtggctggcccactcgctcagcacaggacagacaggctacatccccagcaactacgtggcgccctccgactccatccaggctgaggagtgagtaccgtctctggctgcctctacccgtcgtccctggacactgccggtgcagagtgcctctcctgggctggggtgggaggtctggctgtccagcgccccagccatatccagggagaagcactgtgagtgggcagaagccyggacagtcagcaccatcctccgtcctcccacccccaggtggtattttggcaagatcaccagacgggagtcagagcggttactgctcaatgcagagaacccgagagggaccttcctcgtgcgagaaagtgagaccacgaaaggtacgagcgctcttgctggccaacggatactgagtcttctgtgagtggtttgagctgggtgttgtggaatgagcaggagtttggtttgtggagtagggagggaagaaccttccgggtggaggtaatggcaggatcaaagtcagggaggtgcatttgagg

SEQ ID NO: 158118 - DNA, 601 bp, Human
cccaggcctgctggatgggaggaaacttttccggccaaaagcttttctatgctcaagggaaagaggggaggcaccagggctggccccgtttgacccaggcagccttcaggccacacccagcccgtggtctcctgcccacgacggccaaagcctctgccaaccaccccctcccgcctgagcctgggcctgtcttcagcaaggaggttggggggacatggacagtgcccccgcaagctgacccagagagggaaagcagttaggccagggccacacagccacagggagccactcacaggctccyagcagttattgagtgcccagtgtgtgccgggcccttctatatgtggttgcatggaatctccccagcagccctgggagcacccgcattgtgcagaggaggaaactgaggcccagatagggccagcaacccctccaagtctcatagctaggatgtgcacctgggatatggaggtcttgctggggccaagggtgcgtggcaggacgtactaatcaagtgtctcttgggtcccttggccctgcctctgtggctgccccggggctggctgttgagagacagggtgggcctggggccccgcctggg

SEQ ID NO: 158119 - DNA, 601 bp, Human
gggcctcagttgtcgtctctgtaaaggtcatttagtcgcttagcagacgtgttcatgcttgctgtaggcagtggtcaacaagcctttttttttttcatttaatcctcatcacgaccaggagtgacgaggattggctgttattcccattggacggatgagaaaactgaggctcagagaggggacttgggcagcaggcaggacctggcactcatctgtgtctgggtccgctggggcctctttccctggtcacctcgctttcctggctgcatcggatctcgtgcctcccctttgacctttgccytctgccctctgctctgtgccctgtgctccctactcccgcagagcactgctcctgctttcgatgccaacagcatttactgtgaactgacctcacttgcctgaagaagtgtggggagggtggggaaggggtggttggctctccagccccagagtgctctgtggccctgggagggcatgggtggcacctgagccaggctcccacggttccgcctgcagatcgcctcaggcatggcgtacgtggagcggatgaactacgtccaccgggaccttcgtgcagccaacatcctggtgggagagaacc

SEQ ID NO: 158120 - DNA, 601 bp, Human
tggctctccagccccagagtgctctgtggccctgggagggcatgggtggcacctgagccaggctcccacggttccgcctgcagatcgcctcaggcatggcgtacgtggagcggatgaactacgtccaccgggaccttcgtgcagccaacatcctggtgggagagaacctggtgtgcaaagtggccgactttgggctggctcggctcattgaagacaatgagtacacggcgcggcaaggtgggcaggggctgtgtggtatgtcgcgcttggcctgggacaggtcacgtcccgctctgagccycagttttttcctcagctgtcattcctcatggtgcttatctagcagagcggtcatgacaggaggtcagagctgccctgacctttctcgttcctgcaggtgccaaattccccatcaagtggacggctccagaagctgccctctatggccgcttcaccatcaagtcggacgtgtggtccttcgggatcctgctgactgagctcaccacaaagggacgggtgccctaccctggtaagaaggtcctcatggcctgtctgtggtccctgaatccctctgccctggtggccttgggcaagtcatgac

SEQ ID NO: 158121 - DNA, 601 bp, Human
gaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcayggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgcc

SEQ ID NO: 158122 - DNA, 601 bp, Human; identical to SEQ ID NO: 30941

SEQ ID NO: 158123 - DNA, 601 bp, Human; identical to SEQ ID NO: 30942

SEQ ID NO: 158124 - DNA, 601 bp, Human; identical to SEQ ID NO: 30943

SEQ ID NO: 158125 - DNA, 601 bp, Human; identical to SEQ ID NO: 30944

SEQ ID NO: 158126 - DNA, 601 bp, Human; identical to SEQ ID NO: 30945

SEQ ID NO: 158127 - DNA, 601 bp, Human; identical to SEQ ID NO: 30946

SEQ ID NO: 158128 - DNA, 601 bp, Human; identical to SEQ ID NO: 30947

SEQ ID NO: 158129 - DNA, 601 bp, Human; identical to SEQ ID NO: 30948

SEQ ID NO: 158130 - DNA, 601 bp, Human; identical to SEQ ID NO: 30949

SEQ ID NO: 158131 - DNA, 601 bp, Human; identical to SEQ ID NO: 30950

SEQ ID NO: 158132 - DNA, 601 bp, Human; identical to SEQ ID NO: 30951

SEQ ID NO: 158133 - DNA, 601 bp, Human; identical to SEQ ID NO: 30952

SEQ ID NO: 158134 - DNA, 601 bp, Human; identical to SEQ ID NO: 30953

SEQ ID NO: 158135 - DNA, 601 bp, Human; identical to SEQ ID NO: 30954

SEQ ID NO: 158136 - DNA, 601 bp, Human; identical to SEQ ID NO: 30955

SEQ ID NO: 158137 - DNA, 601 bp, Human; identical to SEQ ID NO: 30956

SEQ ID NO: 158138 - DNA, 601 bp, Human; identical to SEQ ID NO: 30957

SEQ ID NO: 158139 - DNA, 601 bp, Human; identical to SEQ ID NO: 30958

SEQ ID NO: 158140 - DNA, 601 bp, Human; identical to SEQ ID NO: 30959

SEQ ID NO: 158141 - DNA, 601 bp, Human; identical to SEQ ID NO: 30960

SEQ ID NO: 158142 - DNA, 601 bp, Human; identical to SEQ ID NO: 30961

SEQ ID NO: 158143 - DNA, 601 bp, Human; identical to SEQ ID NO: 30962

SEQ ID NO: 158144 - DNA, 601 bp, Human; identical to SEQ ID NO: 30963

SEQ ID NO: 158145 - DNA, 601 bp, Human; identical to SEQ ID NO: 30964

SEQ ID NO: 158146 - DNA, 601 bp, Human; identical to SEQ ID NO: 30965

SEQ ID NO: 158147 - DNA, 601 bp, Human; identical to SEQ ID NO: 30966

SEQ ID NO: 158148 - DNA, 601 bp, Human; identical to SEQ ID NO: 30967

SEQ ID NO: 158149 - DNA, 601 bp, Human; identical to SEQ ID NO: 30968

SEQ ID NO: 158150 - DNA, 601 bp, Human; identical to SEQ ID NO: 30969

SEQ ID NO: 158151 - DNA, 601 bp, Human; identical to SEQ ID NO: 30970

SEQ ID NO: 158152 - DNA, 601 bp, Human
cccagttgccccgatgtgaatgttgtccctgctttttcctgtttccatgcaaacgcactcacacaggctttcctgctggagccgtgtttcagtccgtgcgtggcaggtactgccctctcccctgaatgcgacagcgagcatttcctgaaaccagcaggtgctgggctgccgatcctcgtctgtagcaggctcagccctcatggactgtcccagtggtgtcctgtaaacagcacgccccctgctgcgtggcatttgcccccccccccccgcctttaatctagagtgttccccagtcagcttytgtgttttgtgacatctactgtcccaagagcactggcctgtcattcggcagaccgtcctcagctcaggtttgtctggtgtctccacgcggtgaccataaggctgtgcttttctcagagtggcagccgaggtgacgtgcatcccgtcagtcccattgctggccgttcggctgagacggggtctgccaggggttttcactgtgaagtgactgttttgccctttacagatgtctcttgggggaggccttccaaataccctgggactcctcaaggtctagcattttttgctaatgttgcctgtg

SEQ ID NO: 158153 - DNA, 601 bp, Human
ggctcaagcaatcctcccatctcagcctcttgagtagctgggactacaggattgcaccaccatgcctggctaattaaaaaaaaaagggctgggtgcggtggctcacgcctgtagtcccagcacattgggaggctgaggcaggtgggtcatgaggtcaggagttcaagaccagcctgccaggatggtgagaccctgtctctactaaacatacaaacattaggtgggcgtggtggcacgtgcctgtaatcccagctattcgggaggcagaggcagagaatgaattgagcccgggaagtggagrttgcagtgagccgaggttgcaccaccacactctagcctgagcaacagagtgaaactccatctcaaaaaaaatgtagaaatgaggtctttctgtgttgcccaagctgacctcaaactcctgacctcgagtgatccgccctttctcggcctcccaaagtgctgggattacaggtgtgagccaccgtgcccagccccgttactttgatgctcaaagtttcccaggtgtggccatgggaggcgtcagtggcttctctgttgcgtagggccattggtttgggttgctcctgagtttctgttgcta

SEQ ID NO: 158154 - DNA, 601 bp, Human
tatgataaaaaccgtgagtgcagccaggtgcggtggctcatgcctgtaatcccaacactttgggaggccaaggcgcgtggctcacctgaggtcaggagttggagactggcctggccaacatggtgaaaccccgtctactaaaaatacaaaaattagccaggcgtgatggtgcacacctgtaatcccagctacttgggaggctgaggcaagagaatcactggaacctgggaggtggaacttgcagtgagccaagatcatgccattgccctccagcctgggtgacagagcgagactccgtctaaaaaaaaaaaaaaaaatccatgagttaattccagtacttgcaattttaatccaatagcacagttttcttttgcattgttttcaatatactcaattgctcagccctagaatacacaaaaagtagttttaagaatgctaacctggcccactgtggagacgatgcctcctaactggagtgtaacatttgtctgtagttcttgtcatttgtagcctgaggccgtggagtccagattttgggttcagaagttactggaattcactatcccatcccattggtcagaccatgtcactcatttcaaat

SEQ ID NO: 158155 - DNA, 601 bp, Human; identical to SEQ ID NO: 30971

SEQ ID NO: 158156 - DNA, 601 bp, Human; identical to SEQ ID NO: 30972

SEQ ID NO: 158157 - DNA, 601 bp, Human; identical to SEQ ID NO: 25386

SEQ ID NO: 158158 - DNA, 601 bp, Human; identical to SEQ ID NO: 25387

SEQ ID NO: 158159 - DNA, 601 bp, Human; identical to SEQ ID NO: 25388

SEQ ID NO: 158160 - DNA, 601 bp, Human; identical to SEQ ID NO: 25389

SEQ ID NO: 158161 - DNA, 601 bp, Human; identical to SEQ ID NO: 25390

SEQ ID NO: 158162 - DNA, 601 bp, Human; identical to SEQ ID NO: 25391

SEQ ID NO: 158163 - DNA, 601 bp, Human; identical to SEQ ID NO: 25392

SEQ ID NO: 158164 - DNA, 601 bp, Human; identical to SEQ ID NO: 25393

SEQ ID NO: 158165 - DNA, 601 bp, Human; identical to SEQ ID NO: 25394

SEQ ID NO: 158166 - DNA, 601 bp, Human; identical to SEQ ID NO: 25395

SEQ ID NO: 158167 - DNA, 601 bp, Human; identical to SEQ ID NO: 25396

SEQ ID NO: 158168 - DNA, 601 bp, Human; identical to SEQ ID NO: 25397

SEQ ID NO: 158169 - DNA, 601 bp, Human; identical to SEQ ID NO: 25398

SEQ ID NO: 158170 - DNA, 601 bp, Human
ttttatgattgtcttcctgtgattcctcaataacggattaagcctgtagggattccattatggaaaactggttcatttaaatttgagcccttcatttctctagctgtctcataaaaattacaggatactttttatttaactgcatttaaattaaactcccttttatctttttttttttcaagaataaaggttctcttcagtttgaagacaaatgggattttatgcgcccgattgttttgaagcttttacgccaggaatctgttacaaaacagcagtggtttgatctgttttcgtaagtacyccactaattctgtttgctagcataaaggaaattttagtgatgtctttccatacccaaatggaatgtgtaactctaagtttatctgtttacctattaaaaagtattactagttacattgagggtctccaagacctctcccaggtatgatgatttgctagggggctcacaggactgaacatacaatcatactcacagctttgagtcattacagtgaagggatccaaagcaaaatcagcaaagggaaaaggtacatggggtgaagtgcaggaaaaaacaagcacatgcttccaagaagagtcc

SEQ ID NO: 158171 - DNA, 601 bp, Human
cctcttcatgagtccaacttctaacaccagctgtgttggcaatcccaaggtcacccctaggctcagtgattgctgggagtattcatgggacttaccatgtagttgtattcatggctatgaattattacagtgaaggaagcaaagcaaaatcaacaaagggaaaaagtgtgtgtggcaaagtccaggagaaacgaaatccaaacttccaaatgtcttctcgcagaggagtcacacattaagcttaatcctccagcaactgacagtgacaacacatataaaatattgtctaccagggaagctrattaggggctcagcacccaaactttctactgggggctcgtcatgtaagcagcttctgcctggcacataccaaaattcgagactggcagaagaaaaggaagtgttcaacgtaagtcacactgtttgtgtaaacagtttggaaatgtaaaacattctcattaaggaatgatgggaatcctcccaaaaatccaaattgccacatcctagccaaaggccagtcttgcacacgggtctgtcttaggatagcagtctcagacacactattaaaatgctgtatcaatgaattatagatgtataattg

SEQ ID NO: 158172 - DNA, 601 bp, Human
tgctgtatcaatgaattatagatgtataattgcataagctgtacacattgggctattgtaatcgttttctctctttatcacttaaaatattctaatttccgaaatgatgtaggaccttgctgcatactatcaattaacttatacttcttgcctttgggaaattaaagtttagtaagaaacagctgaggccttttaaagctttattacattcatgtatacatatattttttgtaaattattcaattaaactattttatgaatgatatgttgggtgtggtggggtgttttgttgttaatgttgtttttgccagtctgtgttgataagatttattattgagaatagtgcttgttctctgagtactcctgacttagaaaaggagcatagccctactaaaggggacttcaaagtagaaatcgtcaataaccttttacttgctacagttagtggcctcaacatgatgtttttaaagatcttttggccaggtgtggtggctcacacctgtaatcccagcactttgggaggctgaggtgggtggattacctgaggtcaggagttcgagaccagcctggccaacatgtctactaaaaatacaaaaattac

SEQ ID NO: 158173 - DNA, 601 bp, Human
ggctaattttttgtatttagtagagatggggtttcttcatgttgatcagactggtcttgaactgctgacctcaggtgatccactcaccttggcctcccaaagtgctgggattacaggcatgagccactgtgcccggcctgtccatgcttatgaactccagtcatgaacactccttctgtgtctttctcctcacccttctgtgtctttctccccaccttgcattataaaaacaaagattctcacatgtttccagatacccttctaggggaacaataccttccttagttgagaactgctgctstagatccatttacaattttacccatttttaagtgtacaattcagtggcattaattatattcacaatgttttgcaaacatcaacacagtccattccccaaacgcttcatcatcagaaacagaagctctgtacccattaaacaataattcttcattcttcctctcctcagctccattttagtttccatctatgaatttgcttatctagataactcatataaatggaatcgtatagtatttgtcgtttggaaagacatactgttttttaatgggcttggttattcagttcaggtttaatgtta

SEQ ID NO: 158174 - DNA, 601 bp, Human
tattaattttaaagtttatttccattagtggttgccttcgtgtttcttggtcttagttagaagcatgtgattgtcctactacttggaaacaaaatacatatcattttatcacaccagggtcacactatttcttgttctcttctacacaaggaaatcaaaacctctggaatagtttttacttcttgctgcttttcctgtcgcttctgtctgcctccttaagacttttgagaagcttctatttcctccctctcctatttcccaactcctagatttttctaataaagtttttaaaaagatttaycttatagcatgttcccttttaaaagcactttggggctggatgtgatggctcatgcctgtaatcccaacactttgggaggccgaggctggaggattgcttgaggccagagttcgagaccagcctgggaaacacagtgagattccatttctacaaaaaattagccaaggctgggtgtggtggctcatgccggtaatcccagcactttgggaggcgaaggcaggtggatcacctgaggtcaggagttcgataccaccctggtcaacatggtaaaaccctgtctttactaaaaatacaaaaatc

SEQ ID NO: 158175 - DNA, 601 bp, Human
caacatggtaaaaccctgtctttactaaaaatacaaaaatcggctgggtgtggtgttgtgcacctgtaatcccagctacttggccagctgaggcacgagaattgcctgaacttgggaagcagaggttgcagtgagccacgattgtgccactgcactccagcctggctgacagagtgagactccgtctcaaaaaaaaaaaaaaaaaaaaaaaattagccagtcgtggtggcacgtgcctgtagtcccaactactcaggaggctgaggcagaaagatccttgagcacaggagttttaagttaygagcttatcatgccactgcactccaggcagggtgacagggagagaccctgtctcaacaaaaaaaaaagtacattgagaacattcttccctgatacagcaaggcagagaagtaactggtgattgagaaaagagagctggagaagatgtaccaaatcccttctaaatttgactcttcttttgataagatttctagggaattatctaactccacccccttttaccacaccattccctgttatcctatgagactcaagtcctgtttgaacctttctgacatatatgcaaaagtgatttgagtac

SEQ ID NO: 158176 - DNA, 601 bp, Human
atgcctggcccagtctcttcttttagactctagattcttttagtcattagatgagactgtataggtatgcaggagtcatttaatcattttgtaatttattctaagagtattgggaaaccattagaggatttaagtatggggtaatatgatgtgacttgagttttgtaaagatcactttagcttcttgtttaatagattggagggtttcaagagtagatttggtttagtgtgagttctggagcctgatttcctggctccaccataaacttaactgtataatcttggattgtttttccttcartttccccatctgtaaaataaggataaaatagtagtactttagaattgctatgaagataaaataagttaaaagaacttagaatagtatctggctggtgcctcatgcctgtaatccagcactttgggaggccaaggcaggtggatcacctgaggtcaggagttcgagaccagcctgaccaacatggcaaaactccatttctactgaaaataaaaaaattagccagtggtgcatgcctgtaatcccagctacttgggaggctgaggcaggagaatcatttgaacccaggaggcggaggttgca

SEQ ID NO: 158177 - DNA, 601 bp, Human
aaaaattggaatataggccaaccccagtggctcatgcctatatgctggccctttgtgaggctgaggcgggtggatcacttgagttcaggggttcatgatcagtccagacaacatagggagaccgtgtctctacaaaaaataaaaaattagccagacatggtggcacatacctgtggtcccagctagtcgggaggctgaggcagggttgagcccaggaggttgaggctgcagtgagctgtgttcatgccactacacctcagactgggcaacagagtgagacagtgtctcaaaaaaaaaaaaattagaatataaaacaatttgattattgacatgttgtaattctggagttgttttatttggatttctttgactttttttaatactagaggctccattatgaattgaatgaatcactggggaacattttttgaatgaatgattcttcactatgaccctgtcctttcgttgtttctctgatttacaacttggtcatttgatttacaacttggtaatttttttacttttttttttatattttaatttattattattatttttttgagacacagtttcactctgttgcccaggctggagttcattg

SEQ ID NO: 158178 - DNA, 601 bp, Human; identical to SEQ ID NO: 27647

SEQ ID NO: 158179 - DNA, 601 bp, Human; identical to SEQ ID NO: 27648

SEQ ID NO: 158180 - DNA, 601 bp, Human; identical to SEQ ID NO: 27649

SEQ ID NO: 158181 - DNA, 601 bp, Human; identical to SEQ ID NO: 27650

SEQ ID NO: 158182 - DNA, 601 bp, Human; identical to SEQ ID NO: 27651

SEQ ID NO: 158183 - DNA, 601 bp, Human; identical to SEQ ID NO: 27652

SEQ ID NO: 158184 - DNA, 601 bp, Human; identical to SEQ ID NO: 27653

SEQ ID NO: 158185 - DNA, 601 bp, Human; identical to SEQ ID NO: 27654

SEQ ID NO: 158186 - DNA, 601 bp, Human; identical to SEQ ID NO: 27655

SEQ ID NO: 158187 - DNA, 601 bp, Human
ctaaattaaaagaagaagaaaaacgagcactacgttatttagaaacaagacgagaatgtaactccgttgaagcagtaagtaattttgtaattgtacattttatgggattatttgaaatacggaagcataggaatggcaaataaacaacataaataatattatttaacaaccaacattgttaattgattttagttctttttgcctatgagccatagcacaactttgtaggaggtatcttgtttagaacacattgtcctttggagctggtatgcaagatcaaatctatttgccatacctgttytagactttatttaatataattaatttttggtaagttttcttttattatgttttatgcatatctaaagttagccattttgtgattttcatgttgcaagtaatatatgctcccttagggatacagttgactctctttttttgtaccggttatgttctctgaagtggctgcaaacaccaaattagtgaataatgaatcatttattcctaggggatatttcttctccttctgggaagatgtttcaaacttcatttgtcatgaggtaaaaatattaattattattatttttagaaacaaagtctt

SEQ ID NO: 158188 - DNA, 601 bp, Human
atgctgggattatgggcatgagccacaatacctggcctcaaaatattaaaaaacaaaaaactagtcagtgacagtaccatggtaggtgttttcttttacgtggaggactgaccttagggtgcttcagtataaggaaagttagaatctagttgggacagtcttggaattgttgaaacacaacaatagtatttcctctggttcctttcagtctttggagccttgatttagatttgcattctcaggaataacattctagcttgcccataatcaaatatttttcaactctgaatgggatttaaawtttttttttacttttgacttttctttggctttgtccatcttaagtggtagtcgtgtttattttattctttgttcagaaatcacaccgagttggatgtcttttccctttggttcttttagtttttgttttgcttgtccttgatttgcagtatgtatcctctttggttgaaatagttttgatattggcaaaaggaaggataatttagtggttatttatagaagttctttatagtgatataaattcaggtttgggctacattcagaaggccgggaaggctgttgactttttttttaaacaggt

SEQ ID NO: 158189 - DNA, 601 bp, Human
ggtgttttcttttacgtggaggactgaccttagggtgcttcagtataaggaaagttagaatctagttgggacagtcttggaattgttgaaacacaacaatagtatttcctctggttcctttcagtctttggagccttgatttagatttgcattctcaggaataacattctagcttgcccataatcaaatatttttcaactctgaatgggatttaaaatttttttttacttttgacttttctttggctttgtccatcttaagtggtagtcgtgtttattttattctttgttcagaaatcacrccgagttggatgtcttttccctttggttcttttagtttttgttttgcttgtccttgatttgcagtatgtatcctctttggttgaaatagttttgatattggcaaaaggaaggataatttagtggttatttatagaagttctttatagtgatataaattcaggtttgggctacattcagaaggccgggaaggctgttgactttttttttaaacaggtgggccacagagttgtcccttaggaagattaatctggtgacaggaaagatggaagactggaatggggaggagctgggaataagaa

SEQ ID NO: 158190 - DNA, 601 bp, Human
tgcattagatgtctgaagccctactcttacagttttatttttacttataggagagccacttagaccctacttagatctgattttacatacaattctaataagcttgattatcactcgctgggcctatagcagatgaacagaaatgtattgaatgtatttaatgtaaaacaaggtaagaggcttccgagctgtgctgctgaacaggcatgttgacagcaaaaagtaacacaaccataagaaaagagcaagaaaaaaaattaagccaaatgccttttgtgttttaagaggcagagtctcgctrtgttgcccaggctggagtgcagtggctgttcacaggtttgatcatagtgcactgcattctcgaattcctggccttcagcagtcttcccacctcagcctcctgagttgctgggacagtaggcgcatgcaaccacacccagctttaagccaaaatgacttaaaatttgtgtttggtttttagtttttaggtgatagtcctgcataccttagtatttcctggggaaattcaattagtatttattatatacccacagtgtgtcaggcattatgctagttggggataataagatagacctagtcc

SEQ ID NO: 158191 - DNA, 601 bp, Human
aaaactattttaccatctgtgcaaaactgatttaaaaagctgaataagcaactaggtcacaagttataaattattaacattaaaataagcacttattaaccttcagtattttggtatttcaggcatggtatcctctccacagaggaggtctaaaattaaaaaaaaaaattaagcttggtgttcaaaaagacaaggtgatccagacttttgtagtgccactaatgatagtagtacagaaagaatcttagtcaaactagaaaggccaggaaattaattattgaatacattacagatatccttrtatggttaagggcctgataatgatagagtagaatcataaagtgggggaacttaagataatttttagttcaactcttacgttgtagctgaggcaaagcaaactattccttatacagagctatataactaatgaaaatcagaaatgcttttttttttaaacgaaatttgagcgaggtagaaataattatgcaaattgaataccactaaaagaagaatctggctggatgccgtggcccacgcctctaatcccagcactttaggaggccgaggcgggtggatcacctgaggtcaggagttcaag

SEQ ID NO: 158192 - DNA, 601 bp, Human
atactttccattcaagatgtattttcaaataacaagttatatatttaggatcaactatgtatatagtaatttggtaaatgggaagaaatacaaaagaggaataacatgatctctgtcctcaagaaactgactctcttaggacaagactcatttgaaataaggagagaattctatctagcaatctccctactttttgcctaggtaaaataattttctggaggattttttaatatatagaaatctataccataattgttctcttcattttttaaaaaagctttgtaatgaaagttttaaaatrtttacacaagtagagaaaatactataatgaacgctacccccatacccagtcttccagattcaacagttatcattattttgtcatgcttgttttgttgatccttctgtttgttttcctttcttttccattccttcctctctatttccctccccgttttgcctcccttccctcctgcattcctatatttaaaaataaatttatgatgttgctcatttttactccacacacattgtattagtccattttcacactgctataaagataactacctgagactgagtaatttgtaaaggaaagagg

SEQ ID NO: 158193 - DNA, 601 bp, Human
caggagaaactgccacttttaaaaccatcagattttgagaattccctgtcacaagaacagcatgggggaaaccttgctgatccaatcacctcccaccaggtccctgtctcaacacgtgggaattacaattcgagatgaaatttggctggggatacagagccaaagcatatcacaatctatattataatgtaacctatatgcactgtagtattactaaccagttctctaatgatgaccattttcattgtttatagtttatttcttataaatagtgctttctggaatatccttaaatacctctatctttttaacatccttgtgtatacatcttttctcacacttggcttcctcttggaatagaatctcctggaaattagatagctgaggtaaaagtccctgaaccttttacaaattgctacacaataaataccaaactgactttcaggaatgtagtcccatcaacagtgtgcttgtttatccatatcgttgctgatctgagttttgtcagtctattgattcctaccaatctgccagtatcatagattttaaaatattttttgtgtgcatttaaaaattaatgaatattaataattgtaaatat

SEQ ID NO: 158194 - DNA, 601 bp, Human
aatttggctggggatacagagccaaagcatatcacaatctatattataatgtaacctatatgcactgtagtattactaaccagttctctaatgatgaccattttcattgtttatagtttatttcttataaatagtgctttctggaatatccttaaatacctctatctttttaacatccttgtgtatacatcttttctcacacttggcttcctcttggaatagaatctcctggaaattagatagctgaggtaaaagtccctgaaccttttacaaattgctacacaataaataccaaactgaytttcaggaatgtagtcccatcaacagtgtgcttgtttatccatatcgttgctgatctgagttttgtcagtctattgattcctaccaatctgccagtatcatagattttaaaatattttttgtgtgcatttaaaaattaatgaatattaataattgtaaatattaaatataattataaatatataaaattataaataattaaatatttattttataaatataaaatattttgtgcatacatacatggtgtatgtagttgtatgtatttatgggttacatgagacattttgatacaggcatg

SEQ ID NO: 158195 - DNA, 601 bp, Human
ataataataaaatttaatgttaattttataataataataaaatttaaagtataatgataataaaatttaataaataataaaattaataaaattaaaaaaaataaataaataaatagtgctgcagtaaacgtggaagtgcatctatctcttcctttcttcctatgctcatttccattctttttggtatatagccagcagtgggattgctggatcataaggtagctctgtattagttttttgaggaacctccaaactgctccatagtgcttgtactaatattacattcccaccatcattatasgagggttcctttttctacacattctcaccaatatttgttattgcctgtcttatagataaaagctactttaactgggatgagatgatgtctcgttgtaggtaatatcatctgcaaacaagcgtagtttgacatcttcctttccaatttggatgctctttctttctcttgtctgattcctctaactacaacttccagtattattttgaataaaagtggtgacagtgggcatccttgtcatgtttgagatcttagaagaaagatttttagtttttctccattcagtatgatactagctacggg

SEQ ID NO: 158196 - DNA, 601 bp, Human
gattacaggcatgagccactgcacctgttgggagaaattttattatggcttctatctcattatttgttattgcttgcctagaagttacagtccttgtggcctagactgcctttcaagtttatttggagccccagagtactttagcttatagtgcgaggcttgctagaactcaagtccttaccactggaatgggcgattcccctctgtctagggctggtctaaatgctccctccatgggcatgtgtcagctgagttcatcctacttttgctttctgctgtgaaagggtggtggtgagttcartgcagtatctcacagttgctgctctctccctctcccaagcacacagattctccatgccatacagctgctgctgggggatgagggaggggtaacattggcgattcaagactatctttcctaccctcttcagtgcctcttgcagtgacatgaagttaaaaccaggtactatgagtgcccacctgatttttggttcttatgaaggtgtttttttgtgtgtagatagttgttaaatttggtgttcctgcaggaggaatgatcggtggaagcttctatttggccatcttgctccactcctctatt

SEQ ID NO: 158197 - DNA, 601 bp, Human
ttgttacaatatgtgatacactctgatattttttgttctgtcctatgtacattttttttttttttaaacctggtcacagccattaaaactgatttcacaacatacagtctgaaacacactggtctggatttttagaatctgcaaaatttcaactaccactgaacaggataatgttcaagtgaaagttttcaatgaaatagaaaacacagagcttagagtttattaggattccactttgtctttgttctctattagttatatattgttagatttacctatgctcaatctggtttcactgctkaaggtggaagtgtttagttgggcctattccagtgatgttatagaataagattactcagcagttggggcagagatttccaccttgcaaggaaagagtttcttaaccattttatatgtgtagtcttttctttatttttcttttttttttccttttttgagacggagttttgctcttgttgcccaggctggagtgcaatggcacgatctcggctcactgcaatctctgcctcccaggtttaagcaattctcctgcctcagcctcccgagtagctgggattacaggcacccaccatgcccggct

SEQ ID NO: 158198 - DNA, 601 bp, Human
cttgcaaggaaagagtttcttaaccattttatatgtgtagtcttttctttatttttcttttttttttccttttttgagacggagttttgctcttgttgcccaggctggagtgcaatggcacgatctcggctcactgcaatctctgcctcccaggtttaagcaattctcctgcctcagcctcccgagtagctgggattacaggcacccaccatgcccggctaatttttagtagagatggggtttctctgtgttggtcaggctggtcttgaactcctgacctcaggtgatccgcccgccttakcctcccaaagtgctgggattataggctatgagccaccacgcccagccatgtgtattattttcttaggacagaaatatacatggatatatgcatttaaaagtcatcagcatcattcttgtagaggagcctgaaaaaacctttttttttgttttgttttgttttgttttgtgacagtcttgctctgtcgcccagactacactgcagtgacatgatcaaggcttactgcagccttgacctcctgagcttaactgaccctcccacctcagccccccaactcgcagggaccacagaaaattcttt

SEQ ID NO: 158199 - DNA, 601 bp, Human
ctcctgacctcaggtgatccgcccgccttagcctcccaaagtgctgggattataggctatgagccaccacgcccagccatgtgtattattttcttaggacagaaatatacatggatatatgcatttaaaagtcatcagcatcattcttgtagaggagcctgaaaaaacctttttttttgttttgttttgttttgttttgtgacagtcttgctctgtcgcccagactacactgcagtgacatgatcaaggcttactgcagccttgacctcctgagcttaactgaccctcccacctcagcccmccaactcgcagggaccacagaaaattctttattcggaaaattttaagcatttttacaatgtaggaagaacagtataatgaatccccattacctaaattcagctttagtagttaccaacattatgtcaattccaaaggaatttttaataaaaaatttttaagggacacataattgcctcccttaatttacagatagatgatttgtttttcagaagaaatatatcagccttattgtacttaactttagtcctcacaacctattaatttcatctgatccccaaaagagaagtaaataattaca

SEQ ID NO: 158200 - DNA, 601 bp, Human
agccatgtgtattattttcttaggacagaaatatacatggatatatgcatttaaaagtcatcagcatcattcttgtagaggagcctgaaaaaacctttttttttgttttgttttgttttgttttgtgacagtcttgctctgtcgcccagactacactgcagtgacatgatcaaggcttactgcagccttgacctcctgagcttaactgaccctcccacctcagccccccaactcgcagggaccacagaaaattctttattcggaaaattttaagcatttttacaatgtaggaagaacagtrtaatgaatccccattacctaaattcagctttagtagttaccaacattatgtcaattccaaaggaatttttaataaaaaatttttaagggacacataattgcctcccttaatttacagatagatgatttgtttttcagaagaaatatatcagccttattgtacttaactttagtcctcacaacctattaatttcatctgatccccaaaagagaagtaaataattacatgacacgagggagcagagatgacatgatatcttctgcctcatttagattttcctgatggcctcctagagcacta

SEQ ID NO: 158201 - DNA, 601 bp, Human
ccccccaactcgcagggaccacagaaaattctttattcggaaaattttaagcatttttacaatgtaggaagaacagtataatgaatccccattacctaaattcagctttagtagttaccaacattatgtcaattccaaaggaatttttaataaaaaatttttaagggacacataattgcctcccttaatttacagatagatgatttgtttttcagaagaaatatatcagccttattgtacttaactttagtcctcacaacctattaatttcatctgatccccaaaagagaagtaaataattacatgacacgagggagcagagatgacatgatatcttctgcctcatttagattttcctgatggcctcctagagcactagacccttgctatcttacctgaaatagttcaacagcctcgttaccatatcccaaccacccactccttaccacctgccttactaccattatactgatctttaataatgacttgaggagaggagaatctcattacatttatcctctgtttaaaacttccttggggccaggcctgatggttcacacctgtaatcccacactttgggagactgacagggggatcattt

SEQ ID NO: 158202 - DNA, 601 bp, Human
aagggacacataattgcctcccttaatttacagatagatgatttgtttttcagaagaaatatatcagccttattgtacttaactttagtcctcacaacctattaatttcatctgatccccaaaagagaagtaaataattacatgacacgagggagcagagatgacatgatatcttctgcctcatttagattttcctgatggcctcctagagcactagacccttgctatcttacctgaaatagttcaacagcctcgttaccatatcccaaccacccactccttaccacctgccttactaccrttatactgatctttaataatgacttgaggagaggagaatctcattacatttatcctctgtttaaaacttccttggggccaggcctgatggttcacacctgtaatcccacactttgggagactgacagggggatcatttgagaccaggagtttgtgaccagcctggggaacatagcaagacatcatctctacagaaaagtttaaaaaattaaccagacttgatagtacatccctgtagtcctagctactcaagaggctgaggcaggaggatcacttgagcctaggagttcaaggctgtagt

SEQ ID NO: 158203 - DNA, 601 bp, Human
gggagactgacagggggatcatttgagaccaggagtttgtgaccagcctggggaacatagcaagacatcatctctacagaaaagtttaaaaaattaaccagacttgatagtacatccctgtagtcctagctactcaagaggctgaggcaggaggatcacttgagcctaggagttcaaggctgtagtgaggtatgatagtagctatgtagtaatgccactgtactccagcttgggcagcagagcaagactctgtctcttaaacaaacaaaaaaaccttcctttgttcttccttccctacctrtgaaataaaaccccaaatcatagattttcattcataatctggttgcagcctatctttctagccttctcttccactgtctgtttcttctctaccattttaagcttcctggtattcctagaatacgtaacctattttagggcttgtacttactttacaggatcccatttagataccaacttgtggatgaggccattttaactaccctagaaaaaagtagtttctaagtttttttttattttgtgtgtgtttgtgtatgtgtgtgatgccacttaactgagttatatttagttagcagtgtag

SEQ ID NO: 158204 - DNA, 601 bp, Human
aagcttcctggtattcctagaatacgtaacctattttagggcttgtacttactttacaggatcccatttagataccaacttgtggatgaggccattttaactaccctagaaaaaagtagtttctaagtttttttttattttgtgtgtgtttgtgtatgtgtgtgatgccacttaactgagttatatttagttagcagtgtaggtttactgccctcctcactctcaattagacagtgatctcttcgagagcaggaattatatcttattcttgtctcttaaatacttccttagtgcctgcacrtagtaggcatccaataatggtttgttgaatgaatgtattcacacttctagaattttataacctaattttaaaacaggttctctccagacaggaagagttaatcaaagtttggttttgtatatttttctctcccctccttgaggacttttgttaaaatttctaaagagagtctagttctatagtttttttccttaggggaaaatacactttggtaaactagtatagcatatccatcttcaataatcctatagttaaggtaagtgaaatctactttcagtataattttttttttgttgaaca

SEQ ID NO: 158205 - DNA, 601 bp, Human; identical to SEQ ID NO: 27656

SEQ ID NO: 158206 - DNA, 601 bp, Human; identical to SEQ ID NO: 27657

SEQ ID NO: 158207 - DNA, 601 bp, Human; identical to SEQ ID NO: 27658

SEQ ID NO: 158208 - DNA, 601 bp, Human; identical to SEQ ID NO: 27659

SEQ ID NO: 158209 - DNA, 601 bp, Human; identical to SEQ ID NO: 27660

SEQ ID NO: 158210 - DNA, 601 bp, Human; identical to SEQ ID NO: 27661

SEQ ID NO: 158211 - DNA, 601 bp, Human; identical to SEQ ID NO: 27662

SEQ ID NO: 158212 - DNA, 601 bp, Human; identical to SEQ ID NO: 27663

SEQ ID NO: 158213 - DNA, 601 bp, Human
ggctcagataccttttttgtagattctttcagcttttctgtatataagatcatgacatctgcaaatagaaatacttttacttcttcctttccagtttggttctattttcttttctctgactaattgctctgaccggaacgtctactacagtaacaaatggcaggggtgaattcaggcatccttgtcttattcctgattttagggtgctcactcttagtcttttgccattatattgttttatgttggttttccataacctcactatgctgaatagcagtttggcactctgtctggtagatayactatagcttatttaactggtcctttactgctgcattaagtagtttccgatgtgttgctattactgttagtgctacagaggataatattgtacattgaatatttgtgaatctttatctacaagatagagtcccagaagtgaggattgctgggtttctcttagttttctgattctaaggtgactatgtcctacttttagctccacattaaagtagaacatttctaggctgggtgccatggctcatgcctgtcatctcagcactttggtaagccaaggtgggaggattgtttaaggccacga

SEQ ID NO: 158214 - DNA, 601 bp, Human
tggcccaactgttctactctgaggtgtataccaaagagaaatgaaaacatactttcattcagaaacatgctcataaatgttcatagtagagtggcattactcttaatagtcaaaaagtgtaaacaacccaaatatccattagttgcatagataagcaaagtatgctgtatccatacagtggaatattattcagttctaagaaatgaattattattctgctatatgctacaaggtagatgaaccttgaaaacatggtgattcaaataagccagacacataaggacaaattttgcatgaatayggttgtatgaggtatcaagaacagggaaatccattgagacaaaaagtagaataaaagttaccaggggatggggaagggggggatgggaagttactgttccatgtatacaagatttctgtttgggataatgaagaagttctagaaatagatagcggtgatgtttgtacagcattgtgaatgtacttaatgccactaaattttacacttaaaaattattaaaatgataaatcttttttactcttagtaaaagatatgtgttaaaaaaggaatgaactactggtacatgctgtgacacatgga

SEQ ID NO: 158215 - DNA, 601 bp, Human
ggtagatgaaccttgaaaacatggtgattcaaataagccagacacataaggacaaattttgcatgaatatggttgtatgaggtatcaagaacagggaaatccattgagacaaaaagtagaataaaagttaccaggggatggggaagggggggatgggaagttactgttccatgtatacaagatttctgtttgggataatgaagaagttctagaaatagatagcggtgatgtttgtacagcattgtgaatgtacttaatgccactaaattttacacttaaaaattattaaaatgataaatcwtttttactcttagtaaaagatatgtgttaaaaaaggaatgaactactggtacatgctgtgacacatggatgaatcttgaaaacttgatgctaagtaaaagaagtgggtcacaaaataccacttattgtatgataacatttatctgagatacccagaatcagcacatccatagagtagactagatgttgcccaggcctgggaggtgagaggaggatagctagagaatgggatttgactgctggcaggtgtggggtttctttttggggtaatgaaagtgttctaaaattttattatggtgat

SEQ ID NO: 158216 - DNA, 601 bp, Human
tgaagactgcttgagcccaggagttcaagaccagcctgagcaatgtatctagatgtccatatcaaaacaaaaataaaaactgatagctgtcctcttgataggttgaatgaaggagggaggtagatcactttgattgttacagtagttcacacctgagccaggcattgcaaggagagatggatggattctcattaagttagtggagtatggctacctaagggaatacagaaagacttccctagagcatgccagtatggatactttcaagggaaatccatttctaaattttcaacttccacaytcactcttttctaaaattccaccctgtgatggaagtatcacagcagtttttcctttctgtttctttcacaattacccattcccagtttgcaaagaaaggcatacctctcttgattcttactgtggtgctttgcctcagaatgtagcagccttcagatggcctaagacaggaatattttgaaatactggtattgatgtacatagaattcatttttaatgagttaggtatcagatcctagtcagatagtttctacttctttgctttcagcacaattgatgttagctattatttttgtgttct

SEQ ID NO: 158217 - DNA, 601 bp, Human; identical to SEQ ID NO: 27664

SEQ ID NO: 158218 - DNA, 601 bp, Human; identical to SEQ ID NO: 27665

SEQ ID NO: 158219 - DNA, 601 bp, Human; identical to SEQ ID NO: 27666

SEQ ID NO: 158220 - DNA, 601 bp, Human; identical to SEQ ID NO: 27667

SEQ ID NO: 158221 - DNA, 601 bp, Human; identical to SEQ ID NO: 27668

SEQ ID NO: 158222 - DNA, 601 bp, Human; identical to SEQ ID NO: 27669

SEQ ID NO: 158223 - DNA, 601 bp, Human; identical to SEQ ID NO: 27670

SEQ ID NO: 158224 - DNA, 601 bp, Human; identical to SEQ ID NO: 27671

SEQ ID NO: 158225 - DNA, 601 bp, Human; identical to SEQ ID NO: 27672

SEQ ID NO: 158226 - DNA, 601 bp, Human; identical to SEQ ID NO: 27673

SEQ ID NO: 158227 - DNA, 601 bp, Human; identical to SEQ ID NO: 27674

SEQ ID NO: 158228 - DNA, 601 bp, Human; identical to SEQ ID NO: 29380

SEQ ID NO: 158229 - DNA, 601 bp, Human; identical to SEQ ID NO: 29381

SEQ ID NO: 158230 - DNA, 601 bp, Human; identical to SEQ ID NO: 29382

SEQ ID NO: 158231 - DNA, 601 bp, Human; identical to SEQ ID NO: 29383

SEQ ID NO: 158232 - DNA, 601 bp, Human; identical to SEQ ID NO: 29384

SEQ ID NO: 158233 - DNA, 601 bp, Human; identical to SEQ ID NO: 29385

SEQ ID NO: 158234 - DNA, 601 bp, Human; identical to SEQ ID NO: 29386

SEQ ID NO: 158235 - DNA, 601 bp, Human; identical to SEQ ID NO: 29387

SEQ ID NO: 158236 - DNA, 601 bp, Human; identical to SEQ ID NO: 29388

SEQ ID NO: 158237 - DNA, 601 bp, Human; identical to SEQ ID NO: 29389

SEQ ID NO: 158238 - DNA, 601 bp, Human; identical to SEQ ID NO: 29390

SEQ ID NO: 158239 - DNA, 601 bp, Human; identical to SEQ ID NO: 29391

SEQ ID NO: 158240 - DNA, 601 bp, Human; identical to SEQ ID NO: 29392

SEQ ID NO: 158241 - DNA, 601 bp, Human; identical to SEQ ID NO: 29393

SEQ ID NO: 158242 - DNA, 601 bp, Human; identical to SEQ ID NO: 29394

SEQ ID NO: 158243 - DNA, 601 bp, Human; identical to SEQ ID NO: 29395

SEQ ID NO: 158244 - DNA, 601 bp, Human; identical to SEQ ID NO: 29396

SEQ ID NO: 158245 - DNA, 601 bp, Human; identical to SEQ ID NO: 29397

SEQ ID NO: 158246 - DNA, 601 bp, Human; identical to SEQ ID NO: 29398

SEQ ID NO: 158247 - DNA, 601 bp, Human; identical to SEQ ID NO: 29399

SEQ ID NO: 158248 - DNA, 601 bp, Human; identical to SEQ ID NO: 29400

SEQ ID NO: 158249 - DNA, 601 bp, Human; identical to SEQ ID NO: 29401

SEQ ID NO: 158250 - DNA, 601 bp, Human; identical to SEQ ID NO: 29402

SEQ ID NO: 158251 - DNA, 601 bp, Human; identical to SEQ ID NO: 29403

SEQ ID NO: 158252 - DNA, 601 bp, Human; identical to SEQ ID NO: 29404

SEQ ID NO: 158253 - DNA, 601 bp, Human; identical to SEQ ID NO: 29405

SEQ ID NO: 158254 - DNA, 601 bp, Human; identical to SEQ ID NO: 29406

SEQ ID NO: 158255 - DNA, 601 bp, Human; identical to SEQ ID NO: 29407

SEQ ID NO: 158256 - DNA, 601 bp, Human; identical to SEQ ID NO: 29408

SEQ ID NO: 158257 - DNA, 601 bp, Human; identical to SEQ ID NO: 29409

SEQ ID NO: 158258 - DNA, 601 bp, Human; identical to SEQ ID NO: 29410

SEQ ID NO: 158259 - DNA, 601 bp, Human; identical to SEQ ID NO: 29411

SEQ ID NO: 158260 - DNA, 601 bp, Human; identical to SEQ ID NO: 37742

SEQ ID NO: 158261 - DNA, 601 bp, Human; identical to SEQ ID NO: 37743

SEQ ID NO: 158262 - DNA, 601 bp, Human; identical to SEQ ID NO: 37744

SEQ ID NO: 158263 - DNA, 601 bp, Human; identical to SEQ ID NO: 37745

SEQ ID NO: 158264 - DNA, 601 bp, Human; identical to SEQ ID NO: 37746

SEQ ID NO: 158265 - DNA, 601 bp, Human; identical to SEQ ID NO: 37747

SEQ ID NO: 158266 - DNA, 601 bp, Human; identical to SEQ ID NO: 37748

SEQ ID NO: 158267 - DNA, 601 bp, Human; identical to SEQ ID NO: 37749

SEQ ID NO: 158268 - DNA, 601 bp, Human; identical to SEQ ID NO: 37750

SEQ ID NO: 158269 - DNA, 601 bp, Human; identical to SEQ ID NO: 37751

SEQ ID NO: 158270 - DNA, 601 bp, Human; identical to SEQ ID NO: 37752

SEQ ID NO: 158271 - DNA, 601 bp, Human
aggtggcagcatcaattattccatggtaacctaaagaaaaagcaaaacaccaacctcctgaaaacgactgcaaggccctagcttacgtgtgttgtgacatgcctgcttaccaagccagcaagctgctggcttagagataggctggcagccattcatacctgtcaaacacatcagtacacagtggatacagcctttcacaccatcaggaaaaacaaggtatgtactaatatttctgcaattggcttacaacattcgtttgcaaattcctttagaataatgattcttgtacaatttagtaggsaacttggcatatgttttagaaattgttttaatttcccaagctgtaggttgttcaggaattctaaatgttgctctattatgtctgacaaaggacacaggtcaacaaaattctaagacaaaagcattacttcagtgctctttttggtagatcttggaggaattttagttggtaaaaatattttcaggaacgaagcacttctgggagcattacaaggctgatcctaataaaacttaagatgtgtaagcatttcaagtttttctcaaaagaatacgtttcttgcccacctacacattttagtat

SEQ ID NO: 158272 - DNA, 601 bp, Human
ctgaggagaatatgctataggaaagctgcaaattccgcaacgccacgtaattcctagtcctcacaactgcaaaagcaattgatttccttttctttttctcttagattttgaacacgttgtttcatatgctgttaatgaccgtaaatagcttccctcaaataatgtcagagtctaggtgctgagctgaaaggggccttttaaaggccccttcgaccctctcactttatagattaagaaaccaacgccctgagcgatgaagaggctactgttctacaatctataatgggcccagtctgtctaycttttagctcagtgcttatttcagaaaacaacctgaattttcacagatgtttacattttgttttctttttttaaagtcctaatttctgttggctatattatttaagcagattctattttaaggaaatttcatggaagagctcctccaggtggcagcatcaattattccatggtaacctaaagaaaaagcaaaacaccaacctcctgaaaacgactgcaaggccctagcttacgtgtgttgtgacatgcctgcttaccaagccagcaagctgctggcttagagataggctggcagccattc

SEQ ID NO: 158273 - DNA, 601 bp, Human
catggagggttctctagaagccaattaccgatcaggagatgaagtatgcagatcatcagagcagtaggtgctatctgtgaaaagtcttaggctccctggatttagctcccagatatcacttttaagtaagtctgctttagtggattaaaagttgagactcctttctgatggtgtgatattgagcctccatttttgctattgctgggtatttgaaatatttccatcggtggcatgtttcatatatttgcactcaagattatgctagaacaccatccaatatgcagagtctcttccctccaaaggctacatatgcctaggtgcaatgtttttaatctctctctcacacaaagacatccatccatcctctagaaggacaaacaaggcttctatgttatatttaagcccaacgcccatctttaggaagggagggagacttactaggtacagttttttaaagccgtgtatagtttaaagctctccgatttccagaaatgagtttcttccagctgtgctatagcaatctgctttaaagaatgattccctcttccatctgcctccttcaaggagcctcaattaaccttaattctattatcaacaaaat

SEQ ID NO: 158274 - DNA, 601 bp, Human
attttttttcccactgtcacaggcaaggcccaaacaccgggaacagcaagaggatgcgttagccaatcccgtgttgctagcaccagtctccatacctcagttttttaaagtgagaaaaaaatcaattgaatgccaaaataaatagcctgaattatttatgtgggataaattataggtgcaacatgaattttaaactattcactggtagtatggaacagataagtggggctgctaaccaccataaccaaagaccactaactctgttaacaacgtctagcagcaaccttagcacagtacgagwcaacgaatttcagcgtggctaatgatctcagctggcatttggatacagagcatttcccgtaagacatatggagccctgcaatacttctctctgtgttctgtgtcagaaacgaaggagagaaaaggcagggagcatctgtaagatccatgtcaccctgagtgtctacactcaccccagaagaacatggagggttctctagaagccaattaccgatcaggagatgaagtatgcagatcatcagagcagtaggtgctatctgtgaaaagtcttaggctccctggatttagctcccagatatca

SEQ ID NO: 158275 - DNA, 601 bp, Human
aggtactccagaatgatatacacagacttcttctagactctctagaccccgatatgtctttgaacaccctccattcttacatgaggtcccaatcttaatttcatcattgtcttcttttcttattttcttcattccctgatgacagtttaagtttatcaagtgcttgttttagggaggcagatatttttaattccaaatttgtcattggttcatctgggcttggtctttttatcgcgtctactgtcttaggggcttgaatgtgttcctgaaattttggttttaattcagatagttccttctyctcagtagtcttgacctcaggtttgactggctcaggtggcttctcactattatgtctaccttttgtacagcctacaatgcttaagaaatcagaaaaatcagttgttcttctcttacagcaagaccaaccctttaatgcatcgtgaaagactggaacgcctgggtgatatgtgcaagcatcgtcggaattggtctcaggatcgaagcgctgaccgcagctccggttgtagcacagcaaggccattttttttcccactgtcacaggcaaggcccaaacaccgggaacagcaagaggatgcgt

SEQ ID NO: 158276 - DNA, 601 bp, Human
taccactaactctgacatgtaatagtttttccacatagcttaatcttttaatttaaggttttcctaactctggtcttctttctctagggccttactctggcataccactcattgaaggggagaaaacatatacctgagaaagacatctaggaaaaagtactctatttctcaataaaggaatatcaaaaggcaaattttcccctgagaaagggaaaatcaggtttgtgaatggtctttatttgcccactctgaaaggacacatcagcttgacccatcactatccatacgtgaaagtggtctraaaagaacaatgtaaaagtcacacaaatttctaaccggaatttttatattacaaatattttacttttgggacatatttcactgcagtataaaaggtaagccaagaagaattcagcaaagcaaacaggatttagtaaaatattgaaaaagcgatcaggtaccacctgaattcacagccccaggaagacaagaggtggccttttttggtcatatcctgacaaaaatacagcccattagtctaggcccactacagtgacagaaaagatttatgctgagatccctttcagtcctaagattcctt

SEQ ID NO: 158277 - DNA, 601 bp, Human
agagaactgcttgaacccaggaggcagaggttgcagtgagcggagatcgcaccactgcactccagcctaggtgacagagagagactccatcccaaaaacaaacaaaactctgcaaagcataaagcgccatattatacaagtttaaaggcttcttatagaaaattcaatgttctaataggacagataataaatgtaaatgagaatatccacatcacttagtttgctggactaaacacagggatagaaaaccaggttcttttttaatattactcttcttcctttatatcttaacttaacatastcttatttaccactaactctgacatgtaatagtttttccacatagcttaatcttttaatttaaggttttcctaactctggtcttctttctctagggccttactctggcataccactcattgaaggggagaaaacatatacctgagaaagacatctaggaaaaagtactctatttctcaataaaggaatatcaaaaggcaaattttcccctgagaaagggaaaatcaggtttgtgaatggtctttatttgcccactctgaaaggacacatcagcttgacccatcactatccatacgtgaaa

SEQ ID NO: 158278 - DNA, 601 bp, Human
ggctaaggcagagaactgcttgaacccaggaggcagaggttgcagtgagcggagatcgcaccactgcactccagcctaggtgacagagagagactccatcccaaaaacaaacaaaactctgcaaagcataaagcgccatattatacaagtttaaaggcttcttatagaaaattcaatgttctaataggacagataataaatgtaaatgagaatatccacatcacttagtttgctggactaaacacagggatagaaaaccaggttcttttttaatattactcttcttcctttatatcttaayttaacatactcttatttaccactaactctgacatgtaatagtttttccacatagcttaatcttttaatttaaggttttcctaactctggtcttctttctctagggccttactctggcataccactcattgaaggggagaaaacatatacctgagaaagacatctaggaaaaagtactctatttctcaataaaggaatatcaaaaggcaaattttcccctgagaaagggaaaatcaggtttgtgaatggtctttatttgcccactctgaaaggacacatcagcttgacccatcactatcca

SEQ ID NO: 158279 - DNA, 601 bp, Human
gtggtggcgggcacctgtaatcccagctacttgggaggctaaggcagagaactgcttgaacccaggaggcagaggttgcagtgagcggagatcgcaccactgcactccagcctaggtgacagagagagactccatcccaaaaacaaacaaaactctgcaaagcataaagcgccatattatacaagtttaaaggcttcttatagaaaattcaatgttctaataggacagataataaatgtaaatgagaatatccacatcacttagtttgctggactaaacacagggatagaaaaccaggttmttttttaatattactcttcttcctttatatcttaacttaacatactcttatttaccactaactctgacatgtaatagtttttccacatagcttaatcttttaatttaaggttttcctaactctggtcttctttctctagggccttactctggcataccactcattgaaggggagaaaacatatacctgagaaagacatctaggaaaaagtactctatttctcaataaaggaatatcaaaaggcaaattttcccctgagaaagggaaaatcaggtttgtgaatggtctttatttgcccact

SEQ ID NO: 158280 - DNA, 601 bp, Human; identical to SEQ ID NO: 37753

SEQ ID NO: 158281 - DNA, 601 bp, Human; identical to SEQ ID NO: 37754

SEQ ID NO: 158282 - DNA, 601 bp, Human; identical to SEQ ID NO: 37755

SEQ ID NO: 158283 - DNA, 601 bp, Human; identical to SEQ ID NO: 37756

SEQ ID NO: 158284 - DNA, 601 bp, Human; identical to SEQ ID NO: 37757

SEQ ID NO: 158285 - DNA, 601 bp, Human; identical to SEQ ID NO: 37758

SEQ ID NO: 158286 - DNA, 601 bp, Human; identical to SEQ ID NO: 37759

SEQ ID NO: 158287 - DNA, 601 bp, Human; identical to SEQ ID NO: 37760

SEQ ID NO: 158288 - DNA, 601 bp, Human; identical to SEQ ID NO: 37761

SEQ ID NO: 158289 - DNA, 601 bp, Human; identical to SEQ ID NO: 37762

SEQ ID NO: 158290 - DNA, 601 bp, Human; identical to SEQ ID NO: 37763

SEQ ID NO: 158291 - DNA, 601 bp, Human; identical to SEQ ID NO: 37764

SEQ ID NO: 158292 - DNA, 601 bp, Human; identical to SEQ ID NO: 37765

SEQ ID NO: 158293 - DNA, 601 bp, Human; identical to SEQ ID NO: 37766

SEQ ID NO: 158294 - DNA, 601 bp, Human; identical to SEQ ID NO: 37767

SEQ ID NO: 158295 - DNA, 601 bp, Human; identical to SEQ ID NO: 37768

SEQ ID NO: 158296 - DNA, 601 bp, Human; identical to SEQ ID NO: 37769

SEQ ID NO: 158297 - DNA, 601 bp, Human; identical to SEQ ID NO: 37770

SEQ ID NO: 158298 - DNA, 601 bp, Human; identical to SEQ ID NO: 37771

SEQ ID NO: 158299 - DNA, 601 bp, Human; identical to SEQ ID NO: 37772

SEQ ID NO: 158300 - DNA, 601 bp, Human; identical to SEQ ID NO: 37773

SEQ ID NO: 158301 - DNA, 601 bp, Human; identical to SEQ ID NO: 37774

SEQ ID NO: 158302 - DNA, 601 bp, Human; identical to SEQ ID NO: 37775

SEQ ID NO: 158303 - DNA, 601 bp, Human; identical to SEQ ID NO: 37776

SEQ ID NO: 158304 - DNA, 601 bp, Human; identical to SEQ ID NO: 37777

SEQ ID NO: 158305 - DNA, 601 bp, Human; identical to SEQ ID NO: 37778

SEQ ID NO: 158306 - DNA, 601 bp, Human
cacgtgggaaccatatttccatgcttacaaagacagactggacttagacctggggttgggcagtgtcctcaaatacctagtgggtgtgaaaacacttcccccacagggttgctggagcattccctggggagataagacgtagttggcacatgcagcccagctccggctcccgtgaactcccagatgagtgggagcccttagactgtagcacacaccccgtgtcaggccctggagtaaataaactttccattcattctcttatgtaacaaaaagaaatgctcaccatttgtagacacacatrtacctatcaataaaaattatcttcaggacccagaaaatgtgtctgggctactatgatgcaaaggattaggaacgttgagaaaggaccgaatggttgagataaatttgatgatatatgtaatgtgcttcgctcagggccaggcacgtcaaaaatcacaccacccatttattcactcatttgttcattcaacaaatagtggttgagtgcctgtttgtgctggacactgttctaaacactggcaagggggagggcagtggtgggcacagtggaggccaggacaggcacaggcgtggaccccca

SEQ ID NO: 158307 - DNA, 601 bp, Human
ttaaatttttttttttccgtaaagacggggtctcactacattgcccaggctgattttgaactcctgggctcaagcgatccttctgcctccagctcccaaagtgttggaattataggtgtgagccaccacacctggcctgatcttatgattttttttttaaaagaagctgagattttgaatttttatatgaaaaaacttcacttttattgttggcaaccaagtcaaatttttgggaaaccttgtgtgggccaatcacatagtcctgtggggctatattaggtccccaagctgccacgtgggmaccatatttccatgcttacaaagacagactggacttagacctggggttgggcagtgtcctcaaatacctagtgggtgtgaaaacacttcccccacagggttgctggagcattccctggggagataagacgtagttggcacatgcagcccagctccggctcccgtgaactcccagatgagtgggagcccttagactgtagcacacaccccgtgtcaggccctggagtaaataaactttccattcattctcttatgtaacaaaaagaaatgctcaccatttgtagacacacatgtacctatc

SEQ ID NO: 158308 - DNA, 601 bp, Human
attaaatttttttttttccgtaaagacggggtctcactacattgcccaggctgattttgaactcctgggctcaagcgatccttctgcctccagctcccaaagtgttggaattataggtgtgagccaccacacctggcctgatcttatgattttttttttaaaagaagctgagattttgaatttttatatgaaaaaacttcacttttattgttggcaaccaagtcaaatttttgggaaaccttgtgtgggccaatcacatagtcctgtggggctatattaggtccccaagctgccacgtggraaccatatttccatgcttacaaagacagactggacttagacctggggttgggcagtgtcctcaaatacctagtgggtgtgaaaacacttcccccacagggttgctggagcattccctggggagataagacgtagttggcacatgcagcccagctccggctcccgtgaactcccagatgagtgggagcccttagactgtagcacacaccccgtgtcaggccctggagtaaataaactttccattcattctcttatgtaacaaaaagaaatgctcaccatttgtagacacacatgtacctat

SEQ ID NO: 158309 - DNA, 601 bp, Human
actgaactgggcccctgtggacttggatctccccaggaggtgccatgtaggaccacaggctggtgtatatgttggtggcggggcagggggaggggagggacccaacctcacaattttaaaaaaaattttgtgttttagagatggagtctcactctgtcgcccaggcaggagtgcagtggcgtgatcatggctcactgcagccttacctcccaggctcaagcaatcctcctgcctcagcctcccaagtagctaggactacaggtgcaagccaccacacctggctaattaaatttttttttttccgtaaagacggggtctcactacattgcccaggctgattttgaactcctgggctcaagcgatccttctgcctccagctcccaaagtgttggaattataggtgtgagccaccacacctggcctgatcttatgattttttttttaaaagaagctgagattttgaatttttatatgaaaaaacttcacttttattgttggcaaccaagtcaaatttttgggaaaccttgtgtgggccaatcacatagtcctgtggggctatattaggtccccaagctgccacgtgggaaccatatttccatgc

SEQ ID NO: 158310 - DNA, 601 bp, Human
caccgccatacctatttctccactgcctatacaatttgtacctctgaaaacttttggtctttcttgaagcttccagaatccccatatacagggaaggagtcaccaactcaaaggcccatgatctcatacacaaggagactgaactgggcccctgtggacttggatctccccaggaggtgccatgtaggaccacaggctggtgtatatgttggtggcggggcagggggaggggagggacccaacctcacaattttaaaaaaaattttgtgttttagagatggagtctcactctgtcgcccargcaggagtgcagtggcgtgatcatggctcactgcagccttacctcccaggctcaagcaatcctcctgcctcagcctcccaagtagctaggactacaggtgcaagccaccacacctggctaattaaatttttttttttccgtaaagacggggtctcactacattgcccaggctgattttgaactcctgggctcaagcgatccttctgcctccagctcccaaagtgttggaattataggtgtgagccaccacacctggcctgatcttatgattttttttttaaaagaagctgagattttgaa

SEQ ID NO: 158311 - DNA, 601 bp, Human
cagtgctcaataaatattggctggcatgatatttacgttcagttcacaccgccatacctatttctccactgcctatacaatttgtacctctgaaaacttttggtctttcttgaagcttccagaatccccatatacagggaaggagtcaccaactcaaaggcccatgatctcatacacaaggagactgaactgggcccctgtggacttggatctccccaggaggtgccatgtaggaccacaggctggtgtatatgttggtggcggggcagggggaggggagggacccaacctcacaattttwaaaaaaattttgtgttttagagatggagtctcactctgtcgcccaggcaggagtgcagtggcgtgatcatggctcactgcagccttacctcccaggctcaagcaatcctcctgcctcagcctcccaagtagctaggactacaggtgcaagccaccacacctggctaattaaatttttttttttccgtaaagacggggtctcactacattgcccaggctgattttgaactcctgggctcaagcgatccttctgcctccagctcccaaagtgttggaattataggtgtgagccaccacacct

SEQ ID NO: 158312 - DNA, 601 bp, Human
agtacttctaatgttaaattcgagagtgcacgtaaagcacttagcacatgcagggtatacagtcagtgctcaataaatattggctggcatgatatttacgttcagttcacaccgccatacctatttctccactgcctatacaatttgtacctctgaaaacttttggtctttcttgaagcttccagaatccccatatacagggaaggagtcaccaactcaaaggcccatgatctcatacacaaggagactgaactgggcccctgtggacttggatctccccaggaggtgccatgtaggaccrcaggctggtgtatatgttggtggcggggcagggggaggggagggacccaacctcacaattttaaaaaaaattttgtgttttagagatggagtctcactctgtcgcccaggcaggagtgcagtggcgtgatcatggctcactgcagccttacctcccaggctcaagcaatcctcctgcctcagcctcccaagtagctaggactacaggtgcaagccaccacacctggctaattaaatttttttttttccgtaaagacggggtctcactacattgcccaggctgattttgaactcctgggct

SEQ ID NO: 158313 - DNA, 601 bp, Human
cattaaaaggaaacataaattgtactacataaaaaaattaaaacagcaaaaaaaaaaattgcaaaattagaatacaagccctgaacgagatcggttgtatgatagttaatttctttaatttagagcttatagaaatcaaaattaaaagattaaacaggaaaaataaaaattttaaaactctgaggggcaaggcatatgaaggcagttattcaaggaaatacaatcaaaacagcaatggttttcacaaatgagtacttccaacaatgttaagtctaatgctcaggcgggctggttgataggraaacaggcactctgaagaatggagagtccaaacttgtacaaccttttttttctttagagcaatttggcagtaactgtccattttaagcacatttctgtcgacccagcaatcctacctcgaagaatttatccctagtacacaagtaaaagtatgaacgcgtctgctgccaacactgatgcaataaaggagcaccgctatgtgtcaagcacttttctaaatttagctggaaaatatggtgtgaacaaagtccttgttctcatcgacaaagcaaaagccaaaaaacagaaacaaccaaaaggc

SEQ ID NO: 158314 - DNA, 601 bp, Human
tctttctcttttcttactattggtcaatcacttagtcctcctaaatctttttgcttaatagttggagcctgacttttacttgtttagtttttccttttggctggacactttaaaagtcaaatgccaaagttctcactgtgccctacgtttctgaggtatggggttcagggagactcattagtgagcatgtcttgtctatcttgtccccttctacacttgccagtatataagcaggttgcctctgactgcaaatctctcaacaaagcattttcaattaaagcagatgattttttttttttttcactatatgcaatctgctggaggtttctatttgcatggaatgtctttttccatcccttcactttgagtctatgtgtatccttacaagtcaagtcttttgtgggaagcatatagttggctcttttttaaaaaatccattcagtcactccaggtctttggagaatttaatccctttatatccaaggtaattaccgacatgtaatgtaagaacttcctactgccattttgttaattgcttctagttgttttgtagatcttttgcttctttctctttctcctttcctttatgattatcttctgt

SEQ ID NO: 158315 - DNA, 601 bp, Human
cgacacaggctgggtgcagtggctcacgcctgcaatcctagcactttgggaggccgaggcgggtggatcacgaggccaggagttcaagaccagcctggccaagatggtggaaccccatctctactaaaaatataaaaattagcctggcgcggtggcgggtgcctgtaatcccagctactcaggaggctgaggcagagaatcacttgaacccaggaggcaggttgcagtgagctgagatcacgccactgcactctagcctgggcaacaagagtgagactccatctcaaaaaaaaaaaaaaaattagtcgggcacagtggcacatgcctttagtctcagctatttgggaggctgcaatgggaggatggcttgagccagggaggttcaggctgcagtgatctgtgattgtgccactgtactccagcctgggtgacaatggaagaccttgtctctcaaattaaaataattaattttcccaatacccttccattctgttcttgccttctttgaagcaaataatactaaaaacagcctgatgtcctgccacacttttctttgcctagagaaagataaagacaaacatacacccctaggatttttggt

SEQ ID NO: 158316 - DNA, 601 bp, Human
tccccaggataaactaagttgctctaggatgagcttgggaagctaggttaaaacaggaacgaggcatcacaggatagaaacaatcctggtgggattcacctatcaccagttgaggtcacagttagacacttaacagtgggtgaatgtgcagcctaactttagatggactgcaggccaaacaccagatttacaaagacagcggagttgggcagtccagtgggtagacccaagcactttcttcagtaactaaatagcagggagctccgtattttcagagtcacacttttttttttttttttttaaagatcagtgtctcagttcatagggaggcagcaatttctacctttttttgtggggagaggggagaaagcaagaagaggcagtttggtgtaactttgttctcttcaaagttaaggccatctggacctactgtgcctcagggtttcaccctgaatccacatttttttcccctcagacttctaaggcgaccttatcttttgactatgaagtgggtataggacagcacagcccttagaaaaacctgacagcttagtgtgtgcaatcctttatccacatagtttccttaaggattcaaaggaat

SEQ ID NO: 158317 - DNA, 601 bp, Human
gaacatgacacactatttagcatcagttgcatacctcgccaatagtataattcaactgtcttgcccgaacaatcatctccatctggaagacgtagcctttagaaacacatttttctattaatttctctagaacttcttttcggtataatctgtaagaaattaaaaatatatatcaacttctggataaatacacatgcctatgtatcctgacctttcaaagagttcactggtatgtataaagcctaaaactttcactggccattggtaaacagaaaagctcgcacacttgatgattatgatrcatttgtcctaagcaagaaaggccattaaatatttgctaaataacttagaataattgtgaaaatgaattctcagttatctttttatagaattattttcccaccatactatcagaaattagtgaaatacggtaaaatgaatcatttgatgcagaaccatccattatttaagatttccctaaaatttaaagttgaaagaaactgttccaaatattgaacaacagggtggacagatgatcatgaagcaactatatatgttagatgacaagaaagaacctcataattcacagtcattttccaat

SEQ ID NO: 158318 - DNA, 601 bp, Human
cccatcccaccacatccattaggactaagcgtagaagatcacttaatatagctcagaccaatcctcttgtgagtggtaagtgatgggttcagcagcagaacccagggaggaaatgggccggccttataataccaaaggttttaaccctctccagcatcagacagacaacctcttcctcagtttcaacacaaagtccccgtcaaccactgctcacaggaggtgatgggagctgcgtggcctcacttcagtgcctggagggaaggagcggcctcctacccttgataactgggttcagctgcamcccccttccttctttttttggcaactcctccctgctaactccattcttcgcttcctcacctcctccctccaaaggcacagaaatcatgtcccttgccctttgacagcccagtcccaggcaagaggccagcagacagcacccgccccccagccttgggacctgcctgccaccttttgttttgctgagagtgaccctcagggagcagtcatgagcaaccagaaactggtgcccctaaggggcaagagggagccgaccgccccctaagggtggcaggggccactgacgcctcccctccctggc

SEQ ID NO: 158319 - DNA, 601 bp, Human
tctttgtgggcttcctcccgaaaacctagagccctagtctaatgaagggacagtctacaatacaaccaacactcctcaaaacagtgaaggtcacataaaacattcccaatctgaataaggcataaacctcagttaataatgtgtcaatattggtttgttggttacaataaatgcaccatactaatgtaaaacattaataacacggggaaacagggtattgggtatatgggaactctctgtgctatctttgcaacttttctgtaaatctgaaactgttccaaaaactgaagttttttttttktttttttttttttgagaaaacagattccagggctttcattgtggtcatttagatacccatctggtggccaccaagcagcacttgccaagaaaaaccataaaaagtacctcccttcagatttggcttggaaactatttccccggaaatccccccaccccacccgacaaggaaaataaaagctgattaccaatctgggaggggtgtgagtattcgttccctgaaaaacatgactttaatcttaatgaacagaaagaccacggatattagtgcggatcgtttgcagattcttaattgtatctt

SEQ ID NO: 158320 - DNA, 601 bp, Human
gacagagtctcactcttgtcacccaggctggagtgcaatggtgccacctgcctcactgcaacttctgcctactgggttcaagcaattctcctgcgtcatcctcctgagtttctggaattacagtgccttccaccatgcctggctaatttgtgtatttttagtagagttggggtttcaccatgttggccaggctggtcttgacctcctgacctcaggtgatccgcccgcctcagcctcccaaagtgttgggattacaggcgtgagccaccacgcctggctggatagtacatactcttgataygatgtgatgagaagggagctttatctttgtgggcttcctcccgaaaacctagagccctagtctaatgaagggacagtctacaatacaaccaacactcctcaaaacagtgaaggtcacataaaacattcccaatctgaataaggcataaacctcagttaataatgtgtcaatattggtttgttggttacaataaatgcaccatactaatgtaaaacattaataacacggggaaacagggtattgggtatatgggaactctctgtgctatctttgcaacttttctgtaaatctgaaactgtt

SEQ ID NO: 158321 - DNA, 601 bp, Human
gagtcccaccatacagaagcaaagagaggtgactgctattaacatctgggtgacccagagccagatgcacatctggggcagttcacattagcctcttaaagcttaccatgtcccttctctttttttgtctggtttgttggtttgagacagggtttcgcactgtcccatgggctggagtgcagtggcacgatcacggctcagggcagcctcgaactcctggggttaagagattctcctacctaagcctccgagtagctgggaagctgggtctacaggcatgcgcaactaggctaggctaatwgttttatttttttatttttattagagatgaggtcttgctatgttgccccagctggtcttgaagccctggactcaagcaatcttcccacctcgacttcccaaattgttgggattgcaggcatgagccaccactcccggccacagcatcccttctctttctgggtgctaactcttctgtgctgcctacttctcagcaaagagtaagtgctttccagattctggagtattactctgtactccttaagtgtgggcttcatgtagtaatgccttccaaagagtttgaagaaactgagaaaagcta

SEQ ID NO: 158322 - DNA, 601 bp, Human
acaacagaggcacaattagaggcagtagctcagagaggacaggatctgggtctcattccccgttgtgaccctaggatctaacacagagggtgctcaatagctgaatgagtaaataaacaatggctcatattaattgaacacctccattaacaaaagcaagggtttactaaaccactagtaacagatcacatgctgtgttgatttaaatgggttaacctattcaaggcaggtaacggtcctatgaggcaagtggtattatttcagccattttacagataagcagacagatgtccagagagaygagatgacttgctcaagatcaccttgttggtaaacaaggttttcaattccagccctgccatggtcccagacaccttgctaactggtttgcatgtgtctctcaccaaatgagagaatgaggaccctaacacaatagttcagaacacatggtatggagcaacactgcccattttgggaaaattactttacctctctgtgccttagcgtcctcctccataaaacaggggtgataatagtgcctgcctcctagggttggagtggaatcacatgggctaatgaacgtctgctacatgctaaactc

SEQ ID NO: 158323 - DNA, 601 bp, Human
gccaacacattaataggtctacgaagaataagatcatatttttccatagatgctaaaaaagcctttgatataattcaactcccatttgtaataaaaactctcgggggaaaaaagaaagaactaatacttcctttacataattcatacacctcaattttaaagccaacactggagtcctcctccaaggcaaggatgcccactgtcttcactatcatgtaacactctactggaggtattagttaatgcaattagacaagagaaaacaacagaggcacaattagaggcagtagctcagagaggrcaggatctgggtctcattccccgttgtgaccctaggatctaacacagagggtgctcaatagctgaatgagtaaataaacaatggctcatattaattgaacacctccattaacaaaagcaagggtttactaaaccactagtaacagatcacatgctgtgttgatttaaatgggttaacctattcaaggcaggtaacggtcctatgaggcaagtggtattatttcagccattttacagataagcagacagatgtccagagagatgagatgacttgctcaagatcaccttgttggtaaacaag

SEQ ID NO: 158324 - DNA, 601 bp, Human
actgtgtacttggttgtctcctccactagaaagaaaattaagagtcttctttgcacatctctagtgaatacgtttgaaacctagacagataaaatggataatttcccagaaagatagagtttacaaaaattgactccagtagaagtagaaagtgtaaagagaccaattcccacagtatagagaaagccatcaagaaacaactccacaaagaagcaccaggtccaggcggcttcacagaggaattctatcacagctttagagaccagggagtcccagggagacagaaattattcctgagctkagaaaaggaaagaaacctaaacctgatagcacaaaaaataggccaatatgaatatcactcatgaatactgaaaaatgcttaaatattatctgatgccacaaccaccttaagaaaataatacaccaagtggagtccataccaaggatgtcttcatataaagaaatctaataatgtatgccaacacattaataggtctacgaagaataagatcatatttttccatagatgctaaaaaagcctttgatataattcaactcccatttgtaataaaaactctcgggggaaaaaagaaagaactaa

SEQ ID NO: 158325 - DNA, 601 bp, Human
ttttcaaatgtatttaacctgccacctgatatggctggagagccttgagaaccaacctgaataacactgctttaaagttttaggagcctctactcctgatcaaaatctatgccaccaaaagaacacaggggcttgaatttagaagccaagatgccacgtgtttcacagggaagagtgagtgaggcaacttcatttcctctgcctccctgcaaggccgatgctcagttctagccctcatttcacctttccagctgcacctggagacgttatttgtccaaagcaggcttattaaggcctgtcyttaactcaacacagaaggcaatgtctctgaatgtcacatgtgtttagtgaacctgcttgcttagtgtagaacactatttttagcaagcaccaaacacacacacacacacacacacacacacacagatactgtatcacagcacctcatttgtccctatttgtttaccagactgtgacccatattggcctgggggccaggggaggccagacaccatatctaatttgtccctatgctgctacagggcctggcacaaaaccagcattcagtgtgtttgctgaaagaatggggttttaattgtgc

SEQ ID NO: 158326 - DNA, 601 bp, Human
ccatccaccgggatggagaaagaaacagaaaaatagcagagctccctgtcatttctcatttctaccttagccaggagttttccaatgagtataatcccattaggacagtagcaagatacaatttctaattatataaatatcaactataagaggtgaacgtgcacacatcccaccgtacatgagacacatcagacaaagctagagacagcagctccatacggtgtcctgctgccctccagggccacatcctggctgtgagatatagtgctgatggcagggacctagaatgctcagtgcccargttcaaggcctgccctgccacttaccaatgcaaactctcagcaaagttaccttacccccaagaacctgatctcactggtccaggatgcagcctgagaacttctaatgcagccaggactgagagccccttgccacccattctacatttttcaaatgtatttaacctgccacctgatatggctggagagccttgagaaccaacctgaataacactgctttaaagttttaggagcctctactcctgatcaaaatctatgccaccaaaagaacacaggggcttgaatttagaagccaagatgcc

SEQ ID NO: 158327 - DNA, 601 bp, Human
tatatttcttccacagagggaaaaagcattaaagattcaagtgcagggctttagatccaaatgcccaggaggcaggcaggaccatccaccgggatggagaaagaaacagaaaaatagcagagctccctgtcatttctcatttctaccttagccaggagttttccaatgagtataatcccattaggacagtagcaagatacaatttctaattatataaatatcaactataagaggtgaacgtgcacacatcccaccgtacatgagacacatcagacaaagctagagacagcagctccatacrgtgtcctgctgccctccagggccacatcctggctgtgagatatagtgctgatggcagggacctagaatgctcagtgcccaggttcaaggcctgccctgccacttaccaatgcaaactctcagcaaagttaccttacccccaagaacctgatctcactggtccaggatgcagcctgagaacttctaatgcagccaggactgagagccccttgccacccattctacatttttcaaatgtatttaacctgccacctgatatggctggagagccttgagaaccaacctgaataacactgcttta

SEQ ID NO: 158328 - DNA, 601 bp, Human
aagagagaagcagggcctggcctgggggctggatgcccctccgatgggcagcagggccacagggctccactgatccctggccaagctgatccgacccacggcttgatgagctcaccccgatgccgaggtggcgtgagtcccagggcctgggtttgggacatgacagtctgtcgccaaggcagcacttaggatgccacagctggcaccgcagatctgtagccggaggaaaggggagcagacagagaggcaaacctcgcctcctgccactcgccccgacaactctcataacttcctgcccatyaggggccgcaaagaatcccaaaacagagcaggaaggtggacagattcttcatccggcaggtgtgcacaacctagagaaagaacccctttgaaaagcaatgggttgcctccaaataacaaatctgacactcagcaaactttctgacaagcccccagaccactgctgcccacgccccacccagtcacacacatacaccacctaacagtaagtagattctcaatcaatgaatcatgtgtattaatgaccagagtcaggttgtcacacccttcgttcggaggtgacacatacagacacaggcct

SEQ ID NO: 158329 - DNA, 601 bp, Human
ttcgaaagcattacgaaaaaaaggaagacatttttataaaaataaaatgggttggtcagcactttaggaattctctttttacctcagatcctgctgaccttcagaaaatgtgtggaggaggtaaaacgtgcttccaacaccctctccattccacactttgtacttttcctcccaggctacctggcagtggatcgactaaatcttactaaagtgttagtgggtcagtgagccgcttgtcataatcaaaatactagcacatctataccacttactttatatcgagaactgtacgcatctagtrtatgttcatatttgtctcacaagaaccctatgaagcagctgatatcgtttccccattttatatagggggaaaatgaggctcagagagggtgagtaatttgcccaaggtcacacagcttctaagtagcagagccaagattcattctcaggcaacctggctcctccacccccctaaccactactttatcctgcatctcaggaaagaggtgatttcctggatggcgacaccctgaccctgacacagggaagcaaggatcccccccggaaaagaaatcactctgggggcctcatcatttcactc

SEQ ID NO: 158330 - DNA, 601 bp, Human
tctcgactcactgcaacctccgcctcccgggttcaagcgattctcctgcctcagcctcctgagtagctgggattacaggtgaccactaccatgcccggctaatttttttgtgttatcagtagagacagggtttcaccatgttggtcaggctagtctcgaactcctgacctcaagtgatctgcccacctcggcctgccaaagtgctgggattacaggcattagccaccatgcctggcctgaaactccactccttctgactagttcaaagagaaaatagcgctgaaaaatagttcttagcacrtacaacgtcctcactggtggaccacctaaaatccatttcacctaccatgggaggtacctggcctgcatacgaagcatcagtaccaaagggaggaagaagatagaagcagggatgggggattcagaggttgctgctcaagggcctctgtacctccatgtcacgcacatgctgttccccttacccagaactcccttccatacctcccgaccttacatctcctaacaagccactatttatccatcatgacttgacctgagccaccccctcctggaggccctccctgtttccccaggctggatc

SEQ ID NO: 158331 - DNA, 601 bp, Human
aagaaaggtgtcaatggtacagcagtacctcactgaagcgctactccttttttgtttgtttgttttttgttttttgagacagagtcttgctctgttgccaggctggagtacagtggtgcgatctcgactcactgcaacctccgcctcccgggttcaagcgattctcctgcctcagcctcctgagtagctgggattacaggtgaccactaccatgcccggctaatttttttgtgttatcagtagagacagggtttcaccatgttggtcaggctagtctcgaactcctgacctcaagtgatcygcccacctcggcctgccaaagtgctgggattacaggcattagccaccatgcctggcctgaaactccactccttctgactagttcaaagagaaaatagcgctgaaaaatagttcttagcacgtacaacgtcctcactggtggaccacctaaaatccatttcacctaccatgggaggtacctggcctgcatacgaagcatcagtaccaaagggaggaagaagatagaagcagggatgggggattcagaggttgctgctcaagggcctctgtacctccatgtcacgcacatgctgttcccctt

SEQ ID NO: 158332 - DNA, 601 bp, Human
gaacatttccaagaccccagaaagtcaagacctaggaacagggaaagggaggagccagtgttagaaagaaaggtgtcaatggtacagcagtacctcactgaagcgctactccttttttgtttgtttgttttttgttttttgagacagagtcttgctctgttgccaggctggagtacagtggtgcgatctcgactcactgcaacctccgcctcccgggttcaagcgattctcctgcctcagcctcctgagtagctgggattacaggtgaccactaccatgcccggctaatttttttgtgttwtcagtagagacagggtttcaccatgttggtcaggctagtctcgaactcctgacctcaagtgatctgcccacctcggcctgccaaagtgctgggattacaggcattagccaccatgcctggcctgaaactccactccttctgactagttcaaagagaaaatagcgctgaaaaatagttcttagcacgtacaacgtcctcactggtggaccacctaaaatccatttcacctaccatgggaggtacctggcctgcatacgaagcatcagtaccaaagggaggaagaagatagaagcagggatg

SEQ ID NO: 158333 - DNA, 601 bp, Human
tcatttaattctcagtcccctgggtatttgacagtaaatttcacaaatagcacatcattaaaatatttctctaagtcagtggctgagattcgtcactatttctccttaaacaactgccacgctcacaggcggctttcttacagtcatcacgatgcccgcacggcactgggtgaagttagtttcatctcagaaccaccaaatgttctcaggaggatttccaaaaagcttgctttttttttaaccacttgcacgatctttgctctatccatgtgccaccaaaaagtatttacttaatacttcyagtatttaaattcactcacttattttttttttattttaaaaggaaactttacaccactactgcagatggaaaatcaatgtcacctccataaatagaaggtagggtaaaaatacaataaaaataaaacttactaaattcaagcaagacacagtggctgggcaaaggctctgagtctgaggctttatacagccccgcccccgccaatgcttctgcggtataactcatatacacagatgtcagtgttttgagtatagagtttgacgagttttgccaaatgtcatacattcttgctaccaccaa

SEQ ID NO: 158334 - DNA, 601 bp, Human
aattgtgtaagaaaataaatgtaactcccaaaagaaacatttttaattttatttcataggtggtaggtgacatagcatgatatacagtaatgaaaccctgttttacgaagcaggaaatgaagagtgcagtcctgctctgccactaagtagcagcgtgactttggaaaagtcccccacccactggaggcctcaacaccttctcatttataactgaacagcattaaactgaatcagtttccttggtggcttctggctctgaaatcctttgatttttctagctagcatctgtaaggcctggagktcttgtgaggctgtagtttaatgtaaatgtgtatttgaattcgcacatacacacacacacgccttcctagaaggtaacagagcacagagttttaatctaggaaaagaggaatgtcaaacccatggccgacaacattctgagaattcactgcccttcgaaccagaaaaacaaaacacaaaaagtttcttagcaaaaattccggccgtatcagaaaaactgcactgtatcttatcagaaacacacccttggggctgatgtgcacagtccacagaaacgcagtcctgaaaacacacatcactc

SEQ ID NO: 158335 - DNA, 601 bp, Human
gtacacacacatatgtacacacacagacagatgtacacgcacagctgaaggatgcacaggctttctctggaagtcacaagtaatagtgacatcctccagggaggggaactaaggaatgggaggacagtggcatggcagaaaggagacttcctttgatttgtgtaattgtgtaagaaaataaatgtaactcccaaaagaaacatttttaattttatttcataggtggtaggtgacatagcatgatatacagtaatgaaaccctgttttacgaagcaggaaatgaagagtgcagtcctgctcygccactaagtagcagcgtgactttggaaaagtcccccacccactggaggcctcaacaccttctcatttataactgaacagcattaaactgaatcagtttccttggtggcttctggctctgaaatcctttgatttttctagctagcatctgtaaggcctggagttcttgtgaggctgtagtttaatgtaaatgtgtatttgaattcgcacatacacacacacacgccttcctagaaggtaacagagcacagagttttaatctaggaaaagaggaatgtcaaacccatggccgacaacattc

SEQ ID NO: 158336 - DNA, 601 bp, Human
gcggcccatgggttgtgtttgtaaatagttttatgacaacacagccagcctatttattgacacagggtgaacaaagcaagctacagcttgctcctatactacaacagcagagttggtagtctgggaatcgaatggcccccaaagcctgaaatatttactccttggccctttagagaattttacaaccccacactcgacccagagctccgtcagtgttgggcccgtgtcactgtggcccagcattgtctgccaagcacctaccacagggcctggcacttgcaagcccccataaacatttgcygagtggctgagagaataagtaaatataagaaccatgtccggggcctgccagccagaaacaagccctcttcctgctttgggggaccccaggtggccaccccagtgagcctcagcctccttgttccctttctgggctatcctagaggaaatactgtccagtttagccaagctgatctcttagggtccatatggtacccctacttccaaaatggctccccacagctcttaggtaaaaataaatgacccccgccaggcagcctggctgggccctgcctgtgcatctaccctcgcctgcattcac

SEQ ID NO: 158337 - DNA, 601 bp, Human
acacagagggaggctgcgcagactctgcagcccacagtgccctgggcttcaatcccagatttcacaccaagtacaagaagtggcttcattcagatccagggctcctgactcatgtctcatctgtgtcattttacaaatgaggaaactgaggcccagagcggggaaaaggcccaccgaaagatacggaattagcaggcttaaaaataccacaggcaagccacttgccccccaacaggcagggtcactgctacagaggttacctgacacccaaactattagacccaatggatgcaggccgggygtggtggctcacacctggaatcccggcacttcgggaggctgaggcgggcagatcacttgcggtcaggagtttgagaccagcccggccaacatggtgaaaccccatctctactaaaaatacaaaaattagccaggcgtggtggcacaggcctgtaatcccagctactcaggaggctgaggcacaagaatcgcttaaaaccaggaggcggaggtttcaatgagccaagactgtgccactgcatgccggcctgggtgatagagtgagactctgtctcaaaaataaaataaaatacactaaaat

SEQ ID NO: 158338 - DNA, 601 bp, Human
cagaaaggcagcagcagagatgcccgtgttcactcaggtagtgagtggcggaggcaggactcaaagcgagccttaagagactccaaagcctacgtgctattctgctatctacatacatctcctcagcttcccaagactttaagctccttggctcacatatttctttttttttttttttttaggtcctccatataactgcggcacacagcagatgctaacaaacatcacttcctcttataatgagatagattttacatattaaggcttgctttgtgcctaccagaatgtcagctccatgaargcagaaatttttgcctgtttagttcaccactgtctctccattacttatgtaacagaatctgccacctagatgtttgaaaaacactttttgaataaaccaggtgccatatgagcaattacatttatcatgactgcatcctcatagccacctggtgagtcaggtacacgaattatacccattttacagatgagaaaaacctggcccgggaatttaacttccgtctcagggtctcgcaaccagcaaggggccaagccaagatttaaatccatttaaagtcagtcttaaacctgactctgaatc

SEQ ID NO: 158339 - DNA, 601 bp, Human
acagggatcgtggtaatagcatgagtcttccaattcctcatgtaggagaacagataggataatctctggccttagccctcatgtacctcctttgtcatttcatcaaaatgaagataaaaaataatacaaaccaagtttctgtgagaatcaaatgaaataacatacatagagagtgcaattcatccactgtatccatgggttctgtgtcctcagattgaaaacattcagaaaaaaaattccataaagttccaaaaagcaaaatttgaattttccatgctgcagtttctactttgagtccatrtggtgtgcaggcattgtattaggtattctaaggtatgatcatctagagatgatgtaatgtatatgggaggatgtgcataggttatatgcaaatactataccattttacataagggacctgagcatcctcagattttggtatcccaggatatcactgcacaggctctatactaagagattcacatatatcatctcatctaatccattttttaaaaaaacacaaggtaggttctattattttctcacagggagtaaaccaagaccacaaaggtgctcagtacaaaagcggggcgggggggtc
